United States Patent 9,328,346 (POLYCOMB-ASSOCIATED NON-CODING RNAS) - sequence listing, part 75

SEQ ID NO: 14004 - RNA, 235105 nt, Homo sapiens
augguugacuugaaccugccuacuuuucuugaugugucguugugaaaugcuugauguggauaacucccacuuggugaaggaaaaagucacugguuccuccagguccgcugggggagggaagaggggacgguggacagaaaccagagggagugagaggggcuaaaguugaggggacagaucacgagcugggaagcgguggaaagaggaccggggaaucgggggcgagccucgaaacgccccagcaguacccguggaagcggggcggccccgcccuggggaugggcccgcgaggacccgguagccccagcgccccccggaucccccagcuagguagacucggagccccaggcgcucacuuuuccucccuccauugucugggaggccuuugcuucccccucguccccauccaccccaagcagaaaacuggauuuggggggcgguguguguaugugggcggggggugcagaaagggugcaaggcgaaccgccuucuucaaaaucccuggaaucaaguucauucacucggagccugcacgggcgacggggugggggcggggcagcgccgcgguggggagccggcgcgggcgccgagcggcucagggcccgcagccucuggagggcugcagcggcgcgcgcgcgcccgccggcccgccccgcagccccgggcgcgccgcggccccgccccgccugcacccgggcggguagggagacgcuuuccgccggcgccccgggccccgggggguggggauugggagccagccagcggggcugcaggaggaggaggaggagagcgaagccgggcgcggggaggagguggagggagcaagaggcggcggcggcggcucggcccgguccucccgcucagagcgaggccacgugcacggggcacccccggggagggcggcaaaccgcggcgaagcgccgcgcgccgcgacugccucgggugcgggccccuggugggcagacccgggacgaacccgcacccccucccuauccgcgaacccgggcuccgggcggggccgucgggggcugggcgccgcaccccccugguccacgccggcgcgccccaacuacuugagcccaaguucgcucagguccccgccugcucggccucccccuuuucccggcagccgcaggcuccgcggacugagcccgccccgggugcgaguguccgcgccccagccccggccugggggcggccugggugugagggaauuuuccacucguuccuuucucgggcucagacgguuucggugcuucucccacucggauguucccgcggcuuaaaagaguccgcagcgagcaccgaaauaccucuuccagggcggguuuucggggguguguaugugugugcugguguggggagggcagcggaaagaagagcuauuuuggaaaaaaaaaaaaagucaugguucuguagcaccgguaggauaccuuuaacaaaugagggagagguggggggagagaaggagaaggaggaggaggaggaaggugggggggcgggggguguggagaggcuggugcaaaaggaaugcgcguuugcaggaggaggaguaaagcgaugauuguguaauuaaauaauaaaacaauccuuaagucugauuuggagagagcucgagcgggguccagaggguggaaccggugaauuuuucaacuuccaaguuuugcaacgaaagaaagcaagagagggagggaaaaaaaagagccuagagcagaaaagagaggaguuuggagccgagcgggagagcgggauuuaucguuuggaauuuuucaggagaucguuuugauaccccugggcucugggcagcggcggcaacagcagccuccacgcucggccgggucagacgcggggcgaggcgggcgggcgggcggccgggcgccgaagacccggcgcgggcggcggcggcugcugcugccggggaccacgcgccgcgagccucuuccgccccagagaucagcgcucgcgcccccucccucaccccggccucucccuucucccccaucccaccccgcccccaccccggcccucucccgcgcgcgccccgccacccgcgcgcacucgcucacgcugccccucgcgcacacacauggucggcucgcggcaaaguuucgccugcgaucaccacuccgggauccugccgcagugcuuggggcuguaaccuugaacuuucccagcgcggugacacauucuccccgcucucccucccgcccgcccgcucgcccuccugcgcccucccgcgccccccuccccgccuuuuuugaaaaagcauuuuaccaccaaccaccaccccaauccaacccacaccgaaccuucgcgcacccccuacaccccaacaacaacaacaacugcaaaauagaaaacaaauccccaaacccaggcgaaaagcagccaacaccggcggcggcggcggccucggcaagcacggccagcgcgcucggacugcaagaggguuaaaaguguagauuggauuucaccccuggaaaucuagcacgccgagugaacuugaaucuuuggcuauuuaaggaggacuggguuuguugugaaguugcggugauccagcgcagagccccguccugauugaucgcaucgcggggcucagaugacuguaaaaugaauagaugaaauucuugcuucucgaagauuuucuugggcaucucccggaaagugcguuuuaaggcgaagucaugauguauucucccaucugucucacucagguacaugucucggucgcuuucucgagcuuucucucuggcccgaaaugccuuuguuuuguuuuguugcggacaauuagcggcuugaguuaaccuccgcacauccccgucccuuggagaaguggcccggaguugcagcgggcgucgcggggcggcgugggagccgggagcggccccucgccacggccacugcgagcgcccagccccgcgcccugggcacggagcgcgggcgcugggccgggcaaggccgccggggggugggcagggccgggaccuguaagugcgaggccccgugcggccccucaagugcccguuguggugcggcauccccgcccggggugcccguagccccucucagcagcucgcgcguugagguggacucgggcuuuggaggacuuuacgggggacuaagcuuuuaaaaacagccagugaacuugggcgaggggacuguagcacgagucugugugggcgccgcuggacugcgcugcaggcggugggcgggcgacgaaucgagucggagguugugguccggggacccauuccuuugcuuuauuuggggaucugaaacccugguccauagugaccugcugcacuuugggguuucuagugaccgcaccacaaaggcaguauuuacguugacacgaguuaguuggucuuggugauuguuaaggaguuuuuagaacguguuccuuuuguggaaaccuguucauuugacgauauuugggcguagcucguaaggcauuuuaaguaaugcugguagaaguaaggucauuuuuuucgacuuugagaauuguccuaagaccuuaggaauaauguuaugaaauaaaacacugguuuuauacuuuuuagaaacacgauuuguaucacuuuaagccagacggucaaauagaaaagcggcgagacccaacagacuuaccugggggcaguuuucaucgcugcccagggaacuaacaacugacaaaguaacuaaaauaucuuagcccagaacuguuauuugaggcaguauuuuaaaccucuaaagguauggggcagcuuauuucagcuuuucggaagaugugucaccauugguaauugauaacuauuuucuuugacauugccaugaaaacuagucauauaaagaagugucagccagucuugggcguguuaaaauuuuaaaaacaucuaauaucacgaugaugcauuuuuauaauggacaaauaauuaagauuucaauuguaugacaauuagaagccauugugauucaaaaggacugaggcauucauaaauugugaaugaagaugaaaacaaugauaaggcuuauucagugauuggauacaguccuguagcuuuuuggcugacacauuuuuuauuguuuauauuuuguuuggcaucugaguaugauuaacuuagauauggcuauuuucagcaaguaaacacgcacuuuaauuuaacaaaacuggaaaaaugaguugcugagcuauuuguauuuuaaaagccaugaaugauaauagccaauaaauaugaugaaacuguuucagguauaacgaauugccuuuacuuguaaaaguuaccauuaauauuacccaucggcuggauauauuuuucucuuucugauaagcuguguuaacuugauauuauuuuuacaccgugaucaaauaaaacaaaucaaagcaagauuuucacuuacagaguauagcaucacuuauucucaccuguaaaagauugaauaauugugcauuucucuauauuucuaacaucagcuuuucagaaacauugcuagcaauuacauugcauuuuuaguauccuccaaauauguauugaaaagucacuaguuuuaucuuaauuuguguaaguuaaagauaauauugcagcauugagacagggaauguugggaucauauacagcauaaucauucagcuaucacauuaguauucagagauacacacuuaacaacaauaacuugugaugacuaauauucucuacuauuuuaauaauauaaaucuaggcuuauguauuaaaacaaggccuacaccagggaaggaauuucagcuuaagaauuuucacuucacuaagcuccaugugacuuugcagguaauauagguguuauaaaagugaggccacauuaauagugucacuuuuguaucagaucaguaguuuuguaucacaagagccuaguagcuguagaaaaacaugucucaggacauguaaauugcaaaauagaguaucauucuuaauugguuauaaacuuuuaaaaguaucucaauuguugcaauaagguaucuagguuuuagaaaaaaaaucuuaauuuaaaaggaccuaccauuaaauguuauguuuagcaaaauaguaugcuacaaaaucagcauaucaauaaccaauauuuauacaccaguauaaaucagauauaaaggaaaaauuaagaacuaucauaugauuuaauauauguuuaaaaauaauguaaaccauuaauaauauaacuuucaauuggcaugauggcauuaaauauauuuuucuuucguugcuuuuaaguucuuuagguacauuuuuugcaugauuuguuguuauauagcaaugcgccaagagcaccuaguauuuacucuucuaccucuauguuggucuaaauuauccaucccuuucauggaaacggaagaaaaauaaauaugccuaguggaauuaagacucuuuauuuuuauaucugaaauugguaacuuuguuauuuacuuugucaauuuaguucaacuaaaggaaguuuuaaaagagaauuacugaacaucaaugcauuuuacuaaaaauucugaaagagcaaaguugccuauuaccuuuguauacaguuguuugguuuuaaaucacuuauauguuuugcuuuuuuuaaagaauuuaugauugcuuaaugcuauuguaauaauccacuacuaguuaggauauuugaaaaccuuaaucaccuuuuaaaaaaauauuuuuguaucaggacaguuauuauguuccauauucaugucacucauaaucuuuaagacucuaguguuacucagcauuaggaaacagucacacuugggagaugacauuuaggcauguuaauacagaaauauaugcgacuuacagcaaaccucaauuuacagucauuuuuggaggauauguccccuugucaaauaagugcuucacuugaauucacauaauagugaaacccugaacgauaucaauaaggcaaacuggcagccugagaaaguuugcuacuuuuauuucucaaaaaaaagagcauguuuuaaaacaauauuggcagcauugacagcaaagucaaaggaacguuuaaaaacugugugcauuugcuaagaauuuucaaauucaaccuucaaauuugaauuuugguuguuuaaaauaacucauuaaaauuuugagcuuucuugugugauagauuauauuuauaaucaaauauugaaacucaaauuuaaucaaaacuguguuugaugucuuuauaagaaaaugaaaugucacugaacauaguacuuaagguguaaguacuuacguguuaccacauggcuuaauauuuauaaaauaauauugcauuuuaaaaagcauggcaaggguaaaaugagugagacagagcccacccacuccaccucaugugcucuuuacauucucaagguuuuaguuuugugagugcauauauguguguuuuuuagucauaucaauaaaucguaguaaaagauuauaggaagugaguuuccaaagcacauuuaaguccacauuuccuugagcaggcuuuccuuuugcauauauuccuaaaggggauaaacaaaguuuuuguaguuacagugaaagcuaaaagcauggcaucagaaaguguauggagauagggaggucuuaucaugggaugugguugcugugagcagggcugccuucccacacaaagaacagauugugguuuaacucuuuccauggccuaguuuaaugugcucgcauaguaacugaauuguucaaaucucugcuggaaacuacugaucgguuuaaugauuuccucuauggcauuuggguaugccucaugcugugauguaaucaucagcauucuguauuguuauaaaauuuugauucauacuuauucuggugaaggaacacuuacagcaauguuagaacacuugauaacuacauuauugauuggaugggacauguacuccuuccauaucugaagugcaaacagcuaacauguugcagucuguagcauuaaaacuucgaauuucuucuucaaaauguauucauaucuauauuggauuuuugacaccuucuuuguuaaagagucauuaguuguacuuucaucauauuuaccuaauggaauuaauuagucagucugcuguuaaauagaauuuauuccacguaguucagggugauuaacaugaguauguaaauucuaacuugggauacaaucagagaguuauuuugucguugggcugacaguauagucaauaugaucagaaaagugguggugguggaaguucucauuugcuucaaaucuuggcuuauugcguacaugcggugugcauguacaggacguuaagcucuuucucuuugaacaguaauaggccuaagcuuauaagacagguuuuaccuaaaucaggaaguaacgaaacugacugcacugggaaguaacuugaaauaucuguagguaaagauuauccaccauuccucacugauccccucccuuaaaaaaagggcuuggaugaaacaggcaggaaaaaugcaggagccuaaagguaaacuacuuaauucaaaagauugguacucuauaaucuauguaucugcaaauucacaugcacaugcauauaugcacccacaguucuaacugauaauucaucuacauggcaaaugaauuguauagauuccacaaaagcaguaacugaccagcagugucaccccaccacagcaugcagagacacaaagaauguaaaguuggugccaaguugccauuuuucauuguucaccucagauugauuuuuaagagguuuagaauaauugcuauacucaugugaucggugaacaaauuaacggacucuguggggcugcauauucuauagggaagcugauggaagaacauucauguaauuuuuguuuuccaguuugaaaacuucuauuuaaaaaugcaagagugugugugagaaagcaggagagugcaaguguguguguguguguguugggagcuggcguugguaguguggggagagaaugcacugcucaaaguauggaaaccuucuguucaggacacugauacgacgagcuguguccuuugcccacuuucccucacuguauaccgguuucucuaguuaccacuuuuggaauggugcuguuucaguguuggaauguuggacguuugauaagaaaauggaucaaguuuaauggcgcaugcucuuugugccaccagcagccucuugcugagagcaugcuccaaaagcgggaacuguguggcauuacacugagcaucuauaugcuuuguguuucugugccacagagaagagaaaugaacuguggcaucgcuccugccuucugaacagcucuacuccgauuaaaaaaaaaaaaucucacuguguucuuuguaaaaugguacugcauaguguuaguuggucaaucaaauauugaaauacuauauuaggugccaagcaccuuaguuaguugccuauauuuuaaagaauguagaaugcauggcauugggguggaaacaagggggauggggccagaguguaauacaaaauauaaaccuuauuuccuuuauaggagggagaauugaccugugaauuuugguggaaaggggacagcugggcauacuuuacuuucuucuuguccuguuauuuugauaauuuuaaauaagaaaggaauguuauuuucauguauaacuuuuuguacugaauuggaaacggguuguggucuucuuuucuuauuuuuugagcuuuuaaaauuaaacugacuaugcacaucuuuuccucaccccucugucuuccacaggaugaauuucacccauucaucgaggcacuucuuccacauguccgugcaauugccuauacuugguucaaccugcaggcucgaaaacgcaaguacuuuaaaaagcaugagaagcgaaugucaaaggaugaagaaagagcagucaaagaugagcuucucagugaaaagccugaaaucaaacagaagugggcauccaggcuccuugccaaacugcgcaaagauauucgccaggaguaucgagaggacuuugugcucaccgugacuggcaagaagcacccgugcugugucuuauccaaucccgaccagaaggguaagauuaggagaaucgacugccugcgacaggcagacaaagucuggcgucuggaucuagucauggugauccuguucaaaggcauccccuuggaaaguaccgauggagagcggcucaugaaauccccacauugcacaaacccagcacuuuguguccagccacaucauaucacaguaucaguuaaggagcuugauuuguuuuuggcauacuacgugcaggagcaagguaggagcagauuguucuuuuuucuagcacggcaaacaccgccuacaaaucuccguagacagaguaucuggcuugaguuagaugguccucaaggccccuagauauccuccacccucucuggguauaguaggguguccgcuuucacucacauguccgcugccaugugcgagccauguaaauagacacagagcuuucguaccuggauaggcuuggauauuuaagaaagaccacaaagaggugcguuuucaaguaucuuuaaaauaauacuguuuuucaaagacauaggguagucuaacaaauauaguucauuacacuauacuuucugucguaggcuacauuuuugcaucuaaucuaguaaucuuuuccugauuugaaaauauaacuuuauuuaugaauagccaaaccauccuagauaauuuuuguauuaaccuuauuaauuaaugagguagagggacuuuguuuaugaacuuagugguaucgcacugaaaauagaacuaauguuuacuauuacaaaaugcuuaagauagauaauaucaaaaguauaucuuacguagaccuagauuuacuuaauuuuaauauuucuaucaucacuuuugauugugcaauauucacugucgauuaaauggaauugaguuauuauuuaaauuauuuauaguauguucccagaguuacuugggaacacuuaauaauguuaguuuacuuguauguaaauucauaaaacuuaccgaggaggaaagucgcagcgcugcuuacagaacaaaaaacagaaaguggacugguuacacugguuuaagauaaaucuuaaaaagaauacagaaacugcauaccauaccuauuauuuaaaauaccugagaaggagaaugguauacauuuuaccuaaauaauuaaaaaagaugauguuauuacugaauauuugaguuaaugaaauguuuauuauuuuuauuuuucuuaauauauuuuccuuaaguagguaagaauuucuuuucuucaaauaaaugcaucaagauauagauguccuugcauuaccaacaauccauaguaaaacaaucauuuuacaaagccgcauaccaaaaguagacugaaguuugagcugucacagaugguaggucauuuccaaacuuggccuggugggaggaaaaauggccugcagauagccaggugacagacuguuaccugagguuuguuauauaaaugugggacuuaauaaacugcuaugagcuuuauuauucaaaaaaaucaaaauuacuuuuuugacucugaauucuaggcccucacuaugugcuuuuugucuugauuuucuuguagcuuuggagauaggcuuaagugucauuuuagaauuuuuagucugauuuuaaauaaugguguuggacauugcacuuuuagaaauauuaccuuuuccugaaaaaaugaaacauugcauuuaauauuuccaugcauuuaagaauuacaguccaaauaaugaugguuuggggaaaauaauauuuuugucccauguguccuaaaauaaaacucaguaacacaugacacuuauuugauugacagaugucuaggaggugacacuuuaaggugggcuguauauauguguuggauugacuauaaauguguuguaacuguguugugaaagucaaggauggaaguaaaguuucaaaaagugggucauguaacuuuuuagugcagggagggaagauuugcaaccacuucacuacugcucacauuuuaaguugcuugaaggcuagguuuugaggugugccugccugcaugcacauuuacuccuggggaaggcagccagcucucuuaguuuugaugaacugacaauaaagauuuguagagauagauugaaaaaagaaaaaaaacgcauaaaugccuuccauguugcaccacuggucaugauaacuauaaaguuuuaagcaacucuuaagagaccaugguuuuagauaaaacauugauuuuguuguugguucaacaaucucuauuguaagaacuuuucauuauuuuaucuuguguauauaacuuguauccucugcuaccugccagugcaucaucuucucuuaacaucuguugguucuuccuuugaaaaacucacgucaggaugcuuuuguguuuuccccuuuucaaaauuuauauauucuucuuugucaaguguagguuaauuaugucauuuuauagugcaauugauuaaagaaggcagauuuuaaaagauaauucuccggucaguuagagggcugcauaucgcgagugaugacuuuuuauuugucuucuaaguacaugauaacucaccuaagucuguuuuauaaaucaggaaaagaaguauaaaggaaaacacgaaagaaaaaucagaaaagagaaauguaauguuugcagcagaaagagcaacaaaauuacguuucccccuuuuucucucuccccacuucuaaaugacugggagaaaaacaugagaaagaacagagagaaugccaaagaugguugccacuggcaccaggauuggcaucagacccucuuuguuuagcucaggaugccugugauuuguuaguuggcauccgcauugcaguguggagugauguuacaauauauugacaauuuccagaucuagaaaugucaauaguccucuugguuauuuauacaagaucacacacugcaucucuucuggaagacgaaauaaagaccaacauguacuaaaguuucauuguugaccaacuuccuaugcuuuucuuuuuucccucuuucucuuuugguucaacccacacuuuuuuuccuucuucaugcccagcagccucaucuuucugaaaugugggaagaguuaccagagcuuugacacaagcuauagugcuacaucugcaucugauaugguuugggaaaaaauuuaugcuuuuugaaaucauuuuugauauauaguucauuagacuuuugcaucacguggccaugaggcaguauuuuauuuaaagcuaaaucucuuuguuauucggcuacuaugcauguagucugguugaccgcaauucaguccauuuugcuauuuccuuauauuagcaaaggcugauguucaauauaguuguuuauaaaauuaaaugucucccugcacuucaccuaaaauguacacaucauuugggaguaacugcguuuaaauccauaaagucauuugauguuauugauucagagggcugcgcuucggcuguuucguugcuacaagaaccgccauuuuguuugugaagugccaggcgagggggaaaaaaaaggcagacacuguguuugaugccaauaaugguugccaguggcaccgagguuggcaucagacccucuuugucuaguugcugaaugccuuugauucguugguuggcauccgcauugcagugggcacacuggaaaguuuuugacaaucccugaaugaaagcugcuugcuuguuugcugcagcaaaucuuagcuaauauaaaacucuuccuuuuuuuagguuuugucuaaaaaaacugggacagauuaaagaaaaaauagcucuaaaugguaucuauuuucccaaagauauuaaagacguccaaugauucuugggcagguguuaccuauuccccauauugccuuuguuacugcauucaugaaagcaaagcaaaaacaaaaccaaacaaaaaccaggcaagccuugcacagcacagcuuccugggauguaaguguccuauaggaugcagggugugcuaugacaaguguguggaggacaaaccuaacguaaugauaugugaugcauucauuaugacugacuguugcucucagucacaucacugcuuauuugcuaugcaauuucuaguucccucacuugccacucuugcaaauuuuauaguaacauuuugagaggacuucaguuuuccucucuaguuagaaauguguaacagaauacauguuuaaaaagagagagagaaaacuuuaaagaggagaccuaugcguuaaggucugagguaaaaucagucauucuggaauuucucgauucugcaccacacuguuacgaaauucucagugcacaauuuuguacacugggaaaaucaaccaaaagccuaaaauaauuuugguuaaaguuuccuagauaguuagcguuaauauugcuuuucaguuaaccaccguuaucucguuaauuaauaagaaggauuagcaguucuacccaaagggcugcacagaaggaagucuggccuaugggaggccuugaguugccagacuguguccugucugaaggggaaaaaaggaagggggugguggugguggugggagucggggggcgggagugggauuggccuuucucugaggcaggaaagcguuuugaagagagaggucacaacacaccaagacauuuaaagaucucaagagauagcaacuguugucguguauguaacagauuagaguuuaaaaugagucacccuaacugauuuuuggacuguacuuugcacucuuauuaaacauguuuuggaguguuaaagagagcccagaaaccucauugcuauccugaaaaaguaguuuccuuuagccuuguugaacccuuaaaauuaugaucucuuguuggguggccacuuuuguugcuuuauuguuaaauguuauaauaauugaaguacauuuugaaguugugaaaaaugugacuuauuuacaggggaagucauaaucauuauuacuguuuuugaaauagaagccuuccugguugucacauaucauuagugaggaagcaaaugcuaagaauuauuuucuuccuacaguuacugaauuucagaauccuuuuggguaacaauuauuucuuuaugaaaagcuuaaguagauaauuguuugcaaguuggcaguguauuuuaacauuuuaauagauuucacuucaucugcagguauuucccauuaugggaaaaaauaagcuuucauaauugauuaaaaugaggcugcucucuaggaugauuuggugugucugcacugugaaaugcucugggaacauaagaguuuguguguaggagaaauacuugguaugcauguuugauuuaggggagcacuguuaaguuuucccaucuagcaacuuguccuugacugaacuugugaacucuagugcacauuuguuugcauucuggcucauacacaauucacaagauaaagaagggcucuuauuggcaugucuugcuccuaggcuuaaugagaccuuugugggaacauauauugugagauaagauacuuagcaauuuucucacugauaagaaaacacagucucccaccagaaguucacccucuaugccaugaggucucugccacaagauagcuuuaacagacaauuuaagaguuaaacucugaggccccaguugccagcuggggaagcuuggcaucuguguuccgauauggcaaacuaagcucuugcauugcaguuaauaugaucucauuuuucaaagggaaggguggggggagagaaggagagagggagggagggaugggacgcuuauuuguuacaucaauuaugauuuucaaauauuuaaaaauauauagugccccacuuucuggaggcagcaaagguugguaaaauauucuacugacagcauuaggcauccuuccccccacccuguauauacagcacuacaaauuuuguaaugaaaaauaguuagauuauguauuuggauuuacagauuuagugcacaaugucucuugugugguaaaauaauuccaaauaucuccauauuuguaagaaccaaaauaauaugcauuguucgagaaucgugguaauuggagaggacugugcauugcagugacaggagugacggucaggucuccugaagaaugccuuccugauaggcacaguuauagugccugugccuggagacuuaaagcuggguaggagccauugagagaggccaucuauugcuacagcuuuaguucuuuaaaguuacuguuuucuaaggugguaccuaagaagcacuuccaaacaugaagauucguaauagauuugguaggauuuuucauuuacuuacuuguuuuucccuaaauuuggaauuuaggaagaagcugucauaaggaaguuaaaguuguaauccuccauuaacuuuuugcuuuugaauuuggcacuuaaaauuugaaacagcaauccaagauacccaauauagcaaggucuuucuccucauaagcucucacucagccagauuaaacugaaaaacuagacugguaggcuauauaaaaccguuugcuuucugacacuagcgcucuugccaucacugcuggccaguuagaauuucagcaccugaagagagagggacccaacggaagguuaugucagaauucacaggauuucuuaaaaauugagauaaguuaguuuucauuucuguuaucaugguggcuuacaugauaauggacuuauaaucaaagaaguaguuauugcuuuguuugaagcuccaaguuugcaaagagugcaaagagcacaugaaacacucauuaaaauggucaauuauuaaauaccugaaaauuaugggcaaaggcgaucccuggcucugaaacuagcuucuggguaaauguuucucuuugguuuaugaaagaauagcauuuuccaguuugaaguugaugaaaguagaacuugcggcacuuaagggguuuuccuauguaugugcuauggcggagcaaaugauuagccaacauaauguucaaagcaaauuuuccagccuuuuucccuccauccuugugaaggaggaauaauuuuagaaaucucaaggacuagugguuaugcgaucggaaacuugaguuauuacggcugcaugccccagugccaagcauagcaagaagagacgcuuccuucugaucaugcucacuuuucuguggcaacgugguauguugucucauuuuaaaguaaauucuugggaccuugaacuccaguuuugugaugcgguuaauuuaacugaauuuaguuguuagaauuuggcauagagaauaaaucaucaaacugcagagaacuugugaaaacuaagugcguuguaguaaggagugagucugugggauuagcuuguauuagauugaacguuagagugagacuaauaggacuugaaugguugggcuuuuugguuguuauauuauucagaaaauuggaagaaauggcuaacaagugagguggaaaguccuugaggcugaauugaaagccacacauuuuuaaaaaaccuucaaaauuuaauuguucuaaaaugggaaagcagaugauuacaugcauaacuauauuguuuauaguaaaacacuuagauacacauauucuguuuaugaugauagcuuaaacaggacagcacugaugaaucacugacaaauuaaagaucucugaacaaggacuauauaauuaaaaauauggggugauggaugaaguaauuuuacuaucaaaaguugccuggagguuguguauuuucagaauccuauuuuaaggcaguucagaacauguaguaaguuauugaugaagcauaaaccaguugaaaauggaauuuguuuaaacaagugcgaaauaaaauaagaauuaccuuuaagaaaagaauuauuucauguuaaauacaugcaguuuuaaaauuuuaguuagcuucaacuccauucaaaauagucuauuucucaaaauagucaacuuaauaguauucauugaauuuugaaguacacaucucucauaaaacuacauaaaagcauuuaacaagcauccauuaauauuaagcgacacauauauagucucaugcugaaugaagaugaacuguuuuuuuaaaaaccugauuuuucauacucauuuugaaaaaaauacauggauaaauguauuggugcuaacggaaugguagagcuugggacaaaaaaucuaaucaugagcacagauauuaggaaaaaguuauuugaaguaggguauauucuguaauucaugugagugguggauuacauuuaugccuaugcuaaugacacgucaauaugaagucuauaccccucuauuagugaauucugaaguguaaaaaauguuccuucguaggacaacuuguauuuuauuauucugacaucugcaguuucugguuggauuaccuuaaauuugcuaugcuauguuaaaagccuuguuuuaugaggucggucucagcuucuggccuuggugucaggaacccugcuaccugaugcaacuugccuuguuagguuuaauugaccaaagcugauguguuaaaacaauucauuugcgcuguaacuuacgcccuggcuaaguugcuaccugaaucccuugaccuugacuuguuugggucauggaauggcugcaagcuguuugaccuuucuauuguguaauaaugucacuguuuccucuuauucuuuaaugguaauagcugacaaaaaggcccaagcccgcccuuuacacaccaguggauucaaggcguccgucugcaguagcuacgucuucuguuugacauggucuggcuguagaagugacuuucuuuuguuugcugacagugauggggacaaauuugcagcccuccuugcuacaagagguggggcauaguauucuggcauuuggagggauuuagaucuuuucugcuuagauuuucaguuucucuguuuuaugaugguacauaucacaauuuccuuuuccacacucgucugagguugacuuuucagcuuuuuauauuuaugguuucuuuaauaauuacuuuucagcauuuucagcugcuacgauaaaaauauuuuauugucauaauaugagguaaaagugggaaauuuaguuaugcuguugguuaccgaugugaaaacaacugacuuuugaacuuaacacuauaaaucuuugacuaguacugaaaaaaucuguauacuaaacauguaggguaaaaccaacauuuuuuucuuuacaaaugaguuaauguuguaacuuuauauauaccaucuuauguuauaguuuuaagggaauccuaucuuuugugacuuaaauagcuaaauuucaugacauaguagagaaccauuaguaaauaugaagauuuuauuucuguggggacuuuugccagcauguaaaaauaacuauuuauuuuaaugaauauaaaaauuguuuuuuuucuacucuucaugaaaaccucaugugcaaaaauagcgaauuuuaccuccguucuucucuucugaagcagugaaauaauuuuauuuuuaaaauacuggaaaagccuucuaaaauguuaaaacacagauauuuuuauccuaccaaacucuucuuugccaaauaugacauuauaguucaugauuuuccuauauuugccagauuaaauauuuaaaauccaagcuguuacauuuuauuuuuaaauuauuagaggaaaaaaggaaguuuaaguuaaaauguacauuuccuuacuugcguguugcguacuguuuauacauguguguagauacacugacagaugagagacaaugugcuacaggcgcuagaaccugggaaaaaagcaguagauuucugcauucccaucuagaaaauaucugaaaauagcaggugagaggcuuucuuuucuuucugguuuguuuguuuguuuguuacuguuguguuuuaaacuguuuuucccccaggaauguucacaagaucaaggaauuuaaaugcuuuucagaaugaaucauguugauaauccagaaucauaggggucaaaggaggaagguugaaugaagugcucugaaucucauuuuaguccauggccucaguuuuucucucuucuccuguaaaaacuagucuagaauagaaaauaucucuuuugccuuucugccgguucauuagcauccucaggggcagcgccaauguggaguuggcuuuagaugugguuggugggcuaaggggucagaugacagugagacugugauaugagaacagcagccagcccagaggauuuaaaaaucucuuuaguuuucuccagacgucuaccucaguuccuacaucgaaagaauuuuaaggugaucucaccuguugaguuaaaguuucuaguccaacuuguguguuauccaacuugggugugugugugggcagggagcagggggugugcgcaugcacacacguguuguagggaguugaagaagugaaguuagaagaaaaagagaaaggcggggcuuagaucuugcaggaauuacuuaagaaagauggcuuauucuuagacugaagaguaaauaaugugcaaauuaaaguauucugucauccuuugaauuuugaauugcuuaagacguucagcauaucccccuucugccuuuuccauuuuuguagagcacagaaaaugucuuaguucaggcuacuauaacaaaauaacauaaacugugugacuuacagacacuaaagcuuauuucucccaguucuggaggcuggaagcccaggagcagagugccagcauagucaaguuccagcgagggcucucuuccggguggcagagugccaacuucuccuuguuuccguacaugcagcaaaagagugagagcucucugggaucucuuuuauaagggcacuaauccuguuuaugaaagcuccaaucucaugaccuaauuaucucccaaaggccccaccuccuaauaccaucagauuggggguuaggauuucaacguaggaauuuggggaagacccaaacauucauuuuguaacaaaaaucaugugcauagaauuugacauuugggguucuagucuuggcucugccauuuaucugcuuugugaccuuggucaagucacuucagcuccaugugcuuugcuuuucuguucuguaaaucgaggauuaaaaugccuacuucacuguguugcuuuaggauuaaaugaaauaauucauguaaguaaaagcaauaauguuaauaauagcaauuacuacuauauaugaaggaaaauagcauaauguagacugccagggagacuauccaguagugaaaaaaaggaaugacuggauaugaagcagagggucaucauuuaguucauauuuaucucagguaacaagacauaccaaagaggaaaucgaaguccugcucacuguagugcgcgugaauauuuguuagugaaaacucuuuguguaggcacaugaaguuagcuaguuguguguaguuuuaaaacccauuuaaauuagaaugauuguaugguuuuagaagccuuuuugucucagauuuaccagagacuaaauuuauugaucaaucuagguauauuugaagggaaggaaucaaauaauuuuauuaguggcucucugaauaaauaacucaauuuugguguggguaaaggguguccuaucaaguacucguaauucacugcacuccaauaaaaguguaaaacugucauguacaaaaaaauuaaauugccaccauuugggagaacuacacuuacguuuuagauuuguuucggcagaagugaugaugauguggcuagaugggauagugcuuuguuuguuuguuuguuuguuuguuuguuuuuugagaaggagucuggcuggguagcccaggcuggagugcaguggcgcaaucucggcucacuguaagcuccgccucccggguucacgccauucuccugccucagcuugccgaguagcugggacuacaggcgcccuuccccacgcccggcugaguuuuuuuuuuguauguuuaguagagacgggguuucacaguguuagccaggaugaucuccaucuccugaccucgugaucugcccgccuugggccucccaaagugcugggauuacaggcaugagccaccgcgcccggccaacuggauuguccuuaaaaaagcaugcugcugguuuucagacucuuuuuaaaguccgaaaguaucauauuuaaaaaugacccuuaguugagucaaaaccucaaaccguuuaaucaguugcaugaauuguuuugauuuuauugccauuuaauuuuucuccuuuaagucacucuuucccauuccuccuuuucuaucguguuaagaaaauuaaauaauuaaaugagcuccguaggaaauaaguuaacauuuauuacugaaauugacuucacuuuugcuaagaacaacuggaagccaaguggagaaugguuacaacauuuacuucuuacgaaacugugauuugggaucaccguguuugacuucaguagcucugguugguuguguccauggagguccuuggaggaacuaguuucggugcuuguuucccuacggccacugaacugcaccccucacuuugcacaggagguuuggaaaguggagagauuagcucauauccacaaucccuacuaggaaaauuuaaaucacgugucacauugacguaggguaaaaaggcaucauauucuuauauggagcacuuuauaauaaguguaucacguaccuagggguucuagccaggaguuaauaggaaaaguuauuucacuguuuguccauuaguuaaaggguaacuaggguguacggaaagcaggaucaguacauugauuagcuuguuuggauucuggcacauaauuuuuaauaaucuguggcauuccuuuucuuuuugauaacacacugguguuuaguagcaguucuguucaugggauacacaaaacucgaaaaucauauacaugaaacaaagugcagccacaguuuuuaaacauauguaaacugggauugcuguugauggcagaaagauuugauaugaugucuuucuaauguauuugaaaagcuuugcuuacacuuaugauuuaaaguugauguucacuuaaagugggagcguauacaugguuguuaaauucuaguugccuuucauagccucucagagaugcuugcauauuucuuuauuccugaugguaaagcaucaacauuuuaggauaugacuuauaguuaucauguaacaauuucuguucuauuuacagucuccaaauaagggaaaagcugcuuauaguaauaugaggaucacuggucuuacaguaauuaaauagacuuguuauacuacauuaaucccuuuuggaacauuuggaaugacuucuuaguacuaacaaacacagcauuagggccuacaauuaaucugcuuuucguguccaacauucguauaauauaaaacaugugcauggagaaacauauuuuggguuuaagaugaguucaugggaggacaagaugaaauuauuuuggacuguugagcaauaugaauauaaugccaaguacugauaaaauacggaauucauuuagaaucaacauagguagacagacuguuuuuaguaagguuuuguuuuuuggugaauaccauguuugggcugucagacuuacuuuuccccugagauccauauuuuguacaugacauaccagauauaugcaauaugaaacggaaacaguuuuucaaucuaauauccaggaguuuguguuaauaucuugugaacuuguggcucuugguaucuggcauugauaaggcugucuacuaauccuagagaaagggaaguagacuccguuuuaaagucuaguccagucuuauucuuuaguucauagaaauggucuaaguuaaugauagacuccgcacuuauguucagaaagcaucaucauuacagcuuuguugaagggacuucugaguaaggauuauguuugcgucuccuguuguggaaggcccaugaggcguaauuuccuccucaccaugggcuucuuuauuauuguugaguuuuucauacucagggaugugaauucaaccuuggguguuccaguuacagagaaaauauuucaugaaggaugaaguguugguucaauucuaggacagauugcgugcauauauacagaguacuauggaaaugcugggauuauugagugguuugcagccauuuucgaccaugugccugggacuagcuaacacauugucagggaaaaacaugauguagcaacaauauuagaucaugcaaaugagacuacugaauaguaauaguuaugggcaauauuuuggaaaacacugauuagugacaguuuuauuacagcaaauguauguaucaaguccccagauuucauuguaacgcacugaaaacagaugucaaagugucccaaacagaauuucaugguuaaucuacauauugcauggaaaguacaaacaaaccauuuagaauucuguuauuuaauccuuuuagaaggaaugaaaauauacaauuuagauuuacucuauucuuucuuuuaauuucaguuuuuguuuuguaggggaugacgauaauuuuuuuuguuuauuaagaugcauauaggagaagacauaucugcguauggacauaauuuuacuuaauguacuuugaaauguaaguuucugaacauaaggucuuuacauuaaaaaaagaaaaauuagacucuaaauuauuuagugaccugauaauggaauuaccuucuuccauuccuuuguuuacugauguagagauucacucuacgccauauagugauugaagcagcuugcugaaguggaagagaaaaacauugcugguccuacuguuugcaggugcuugggaaacuuugucccucucaguaacucaguuucuguaucugucagggaagagaauuggccuagaggacauccacuaucccuguuagcucuagcauccuaggaauuugguuucugguuaucuuggcagagagcaguccucuucauaguaagcaauacuuaauaaaguuuagcacaugcuuguuaaauuuaggguuuuaauacauuuuauuuauuaaagagaaauagaaaauguguaaccugacucuugaguaacacuuucauguugcucauuucaaaguccaauaguuaacucauuugguucaauguagauaaaagcuuacuuuuuaagaaagaggucuuuaacuuguagaauuuuagagccgggaaaaucccuacagaucuucucacuuuacaguuugggauacugagucuaagagaggcccagugcuucuuuggaugcguuacuuuuacugcuguaggaggaaaaauaaacguaaauuaucaaaaaauaaugaaagguuauuauuucgugaaaacauggcagcaauuuuuaaaggaaaauagaagaaaaauaaugauuaaacaucuuguauuaucauuuguaauuaagauaaauuaauucaagagacuagguuuuuucuuuuauacauuuucauaggaaguauucuaacgaaaucaaucugcagccauggucuuucucuuuuuuuguguguggauggaagauacacuaaauugcacucaacuaauaccaaaauuugaugcugguugaaaaacagaaaggacccauuaaaaauauauggccaauuuuccaauaacauaagaaaagaugauugagauuuguuauaagaaaacuuuuuuuuuuuuuaacugaaagucagauuuuuaaagaaaaggucagagcuaguuaugaggagcuguuagaaguucugcuuuuggguguuuguaauuuuccgauuagcuugauaauuacuacaucucccuuuuccuuuguguggcauguaucaucucaguuaaagaauuuuuuuuuaaguuuaaaacaaacauccauaucucuuuuauuuaagagauguuucugagaauuuuuuuauuaguuuaauauuuaguaaauaaaacauaugaaauuuacaaggggaauuuaauuucaaaaagcaacuuucaaugaaucuuuuuguuaagguagaaauucuuuuacagagucucugucgcccagacuggagugcaguggcgugaucuuggcucacugcaaccuccaccucccagguucaaacaauucuccugaaucagccucccaaguagcugggauuacaggugcauaccaccacaccuggcuaauuuuuguauuuuuaguagagacuggauuucaucguguuggccaggcugguugugaacaccugaccucgagugauccacccaccucagccucccaaaagugcugggauuacaggcgugagccaccuugccuggccaagaauucuuuuauaaaaugaaagaguugucuauaauuuauguuuuagaaaugcccugugugugcuuauguauaucaagagacucuggaauaaggcaaagauuaacacauugaaacagagauauuagaguauuagaaaaaguuuaauaucagcuacuucuaguagcuaauuucuaguuugacaguauauggugaaaguuugaaagcauguuuuucaggcacaauuguugauggaaaaauaggugaacaaaagauggguacaaugcaaguacaggaaaccacaaucaauagaaauguuaugagagcauacuauaaaauagauaauauguauuuguugaaugaauggaugaaugcaugcaaguuauuuauacugaauauagaacauuaggggcaaaucagauuacuguuacugagguaacacaagaaaguuccucaaacuaggaaaaucuccuuuuuacugaggcuuguuuucuuucuuuuguauaugcacuagugauuggucacuguuuuagaaauacauuuccacuuuauguguauauuuuuaauguuaagaaugaguaaaauaaaaccaugugaauuacagggucuguauuagcaauagcacguauucuggaaucuugcugugaguuuuaauguuuguuuuauacuauucacuauguaguuggguaaauuaguuuuauuuucuaagauucaguuuccugagcucuggaguaggcaugcacuuuauuuggcaauugugaggguaaacugagaaaauacuugugaagugcuuaccgccgcaccugccguauuguagacgugcaauacuuucucugagcuuuccagaagacuuggucucccuuuugugggcagagcuuuaaguuaagggcaaugcuaugccuaaagugcggagaaaaauauuaaauuuggcaaauuuuccaguuuccuagguauauggcaaaaauuuaaauacuguaauugcuauguaaugucucaaaauccacuccuaaugugaaugguauagagccacagcuaaucacaaugccuguuucaauauuugugaguuacuuaaggaaauaaccuucccuagaguacaaagacaugauagauucuuguauaaauuuccugguacaauccaguauacuuuacuacuauccauuuuucaugaggucuuucauuuggguauaagacaaucccaggcacaaacauaaugggagauaaaagugaacauacucguaacuguugccuagcggggaguguucaaggugaugguauuuauuuaugcaaggaacuaagacuuuaaaaucccaaacauuuucauggucuggaauggugauguguuuauuuuuuuccuuuauguuuccaauagcacugacuuuuagucccacaaauaagguuggaagaaauaucucaauauuaugaguaagauuauucucugaagaauaauuuugacuguuuucucuuauucauuaaaaaugacacaucauuuaaaaaaucauuucacugguaauauaauuaagucccuggauaauaauccuuaucuugucauuuuuuauuagucuuuagauuuuuucaaagugugcauauguauuuauauguguguguauguauguauguauauguaugugcauauauauguguauuuauauguguguguguguauaucuaucuaucuauaucuauaugguauaccaaauauauaggaaaauauaaccuucucaccaacuaccaaauauugguauaccaaauauauauugaaccuaguuugugaaauucuuaguucgucuauacugccccauccccucagccaaauaaaaagugaacauaaguucuuagaugacagugaucagguguuauuuucauacuucuuuuccccuuguucucuauaaggcaauauacagugggcuuguugauucuuuaguucaguguugauuauauauauuaauguauguacauguauauguguguguguguauguguaugcauauauauauguguauuugguauaccaaauuauauauuugguauauauuauauauuuugguaaauauuauauauuuggcauaccaaauauauauauauguauauauauauauauauacauauacacacacacauacacacacacacacacacacacacgcuuuggaaaaucuaaugacuaauaaaaaaggacaagauauaauauauaugugguauauuaaauccuuuuauuuugguauguguuuaauaugauuccguauguaucaucauauagucaaagaaguaggcauuuguggauuuaugaaaauauauccuucaaggaaaauauagaacauuugaacuaaaggugaaaaaaugagaaaugcauuuauggaguggaagcacuguacugagcacuguuuucaauauuuuaaggagcuaggaaaaaacggugaaauacugauggccuuguccgaguaauuuacaaguagaaaugagagggucauggucacuugcaguguuuaugaaaaacaaaaauaccaaagauagugggacaaguauacaacuaacuaacccucucaccaacuacuauauauaguuagauuugcggagcuuucugggagggaacccugugugacugcaauggaaaggucacggagaggaggugaguguuaagcagaguuuucucagggguuauguaacaaaaccaaaacaaaaugaaacagauaaccaagagucuacuuuucacauaaauuaacugcauuuggcauugauauauacuguuuugggaauguuuguuuuggugacaaauuugguguucuguuaaaaaaaaguuaauaaaagaaucuaauaggaauuuuaacacagaugccaaaauauuuaauacuaaauggcuuugauugauuaaucucuuuuuuauuauugaaucguaacauugaacucugauaucuaaauuauucuuaaauauaguuuagcucuuagauuucaguguauguccuauacacauugucuuaaaauguuucguaaaguaucuuuuaaaacuaauucugguauuucaauuguuuauguuauauaaucuugaaucaaaauugucaauauauauuugucaugugucaauaauuuguuuuaagauauuuuggaauugagaagauaauucuauaggcaauuaaaaaaucuagaaagcaaaauauucugcaaauauacuguauuuaaaaauauucuuaaguuagcugaguugaguuuugcauccaguuuacaugacuaucauuauuauuuuaaaaaucaagcguggcuguugaacucagcagaagaaaaaaugguuuuuguuugaugagguauguuuuauugucagacuaaaauaucugaccugaugcaaauuuauacuuuuuugcugcuaaaagcaaugggcugaucuagugacacacccaacaauaaaauaacacccagcuuuaaauauuuuguucucuguaaaugaugccucuuccagaauauagguguuuccucauagguaauugcagaaaaaaguguaaaaugaaaacugugggccgggcgcaguggcucaugccuguaaucccagcacugugggaggcugaggcaggcggaucacgaggucaguaguucaagaccagccuggccauggugaaaccccgucucuacuaaaaaauacaaaaaauuagccgggccugguggugcgcaccuguaaucccagcuacucgggaagcugaggcagaagaucguuugaacccgggaggcagagguugcagugagccgagaucgcgccauugcgcugcggccugagcaacgagagcagaacuccgucucaauuuuuuuuuuuugacggagucucggucugucacccaggcuggagugcaguggcgugaucucagcucacugcaagccgccucccggguucacaccauucuccugccucagccucccuaguagcugggacuacaggugcccgccaccacgcccagcuaauuuuuuguauuuuuaguagagacgggguuucaccguguuagccaggauggucucgaucuccugaccucgugauccgcccgccucggccucccagagugcugggauuacaggugugagccaccgcgcccggccuauaauagcucuuuuaaaguagcuuucaaucuuuuaagguuacaaaucauauacccaaagauagauuugaaccuaguuugugaaauucucaguuccucuguacuuccccaucuccucaggcaaauaaaaagugaaugaaaguucuuagaugacagugaucagguuuucuuauuuucauacuucucuuccccuuguucucuuauaaggugauauacaguggguuuuguugauucuuuaguucaguguugauuauguugugcacauguagggagauuaugaacacugacauuuaaaaagaaaucuuucucaguuugccccuuuaugauggcauuuaaaagccauucugucugcagugaagcggcuuauucauucaacaacuauucacugagcaccuacuauguaucaggcacucugccagguccuaaaauugcaauauagagaagacagacauuuuacagauuuuauaguagugagagacaguuuaagaagaauuacccaauuuuuguuguucuuuuuucuuaaguguucccauuaagugcuuaauaaguuauaaaaagaguaaugguagugauuauacaaacaucaucugaaagaaaugacaugaaaacuugugacaacuucugagaaaauagugagaucaugagaauggauuauugugaugaacaaguauaauuuucucuguaugacaaaaaauauuuuuguaguguguacaugguaguuauacauaacaagcauacaagcaugcuuguuaugacaucuuguagcauguagcuuuuuuugcaggagguuggaaaugugucaggauguauuucuggacucugcgcugcuccuaacuggagcaauugcauuggguucugaguggcccuagcacccucccauucaaaagugaguaagcaagaacuguaaugaaacuuggaggaauagugaguauguguuaggcuuccugaagaugauugcacuuaauggaacaaauuaaagaauaauagaauguggcauugggguacacccaauaauuucuccaauuccucagaugucagcagacuuguugcagguuuugcagugaacaugucagucugguggugucccaucaucaaggggcggugacuaggugugcauggcguuggaacuugcuagaaggagcccuggaaauagucaaaaaguuggaaaucaggaguacuaucuaaaaucuuguuuuugccauuuuuuaacuguauaacuuucagcaaguguuuugaagucccagaggcuccauuucuucuuguguaaaauggagauaauaccaaucuuacaaguuaaggcuuuacauagugaccugaugcuuaagugauacccacuuaagguggguaggauuuucuagcuguggugcuuuuccacaugugaccauugccauuuagcuaacauuuagugagcauuuacuaugcgccagguauuguuugcaaagucaccuguuugacuccuuuauucccugguaaccauaugagguagauacuuuacugcccuuucacaaaugagaacucugagggcaagcuaguuaagugacagagucagaauuuugauccaugcaguuaucgcuggacuucuuucuuaacuguaauucuagauaaugaacuuccucuggccccaguaggguaaaagagacaaaagaaaauauuauauagucugaaauaaccucuacauauuaaaaaaaacucauuucacuuauugacacacuaaaaagaauugaaauaggacugggcgcgauggcucacgccuguaaucccagcacuuugggaggccgaggugggggauuaccugaggucaggaguucgggaccagccuggccgacauggugaaacccugucucuacuaaaaauacaaaaauuagccaggugugguggugugcaccuauaaucccagcuacucaggaggcugaggcaggagaaucgcuugaaccugggagguggagguugcagugagcugagauugcacccuugugcuccagccugggugucagugcaagacucugucucaagaaaagaaaauuggaaagaaucauuuguuuuaucuuuaauuuaugaguuacugcuuucaguuuuauuaauuuugauauacaaaaucuuagugauuuccaagcaaaucuuuuaaacuaagcagucuuucucauuuuuuguuuucucuugcucuaugcugcuuauguaggagaccuugaaauuggauguguuuauugugcaguccacaaaggcuacauagggcaaauaaaauguccuuaaagagaggauuaagcaagucaagagccauacuuaggaauccaacuguucaagaauagguaucauggucuucauuguugacuuaugauaaagaucuucccuaucccacucacccuaugcuagauuaaugguuuuccuuagaagucuuagaauaaauuuuucuucuguuuuucuuauugauuugaaaaguugggauauuuuucaaauaaaauaucuauguacacuugaguaaauggacucugggcucuuucuguuaugaaaguuuucugaaggaaauagaugaacaaagaacguauauuuuaguuuccauaaguuuuuugguugcaucuuucuaaacagaguccauuuuuaauucaaaaacuuuugaauuuugagugcucacuuuguggauuauuuagauaagaguuuaugagguuuguaaaucaucauaaguuugcaggacaaaaauuccgccaccccuuauuccuauacauuacauucauuuuuuugguuucaaagauugauuuucuucuuagauaaggcuaugaaucuuagugagaaagaagauguauggaaagauccagaaaugacuucccuuucucuucugaaagacagcaauccuccuuauuauuacuguuuuauaauuauguuaguauuaauugguagcaauauuaguaauaguaaaaacaacaaaaugucccauuccccccauuaauuauuuauuauaaugauuacaguuacccagggaacuagguauucucaucaaauaauagauaaagaaauugagguuaaauaucuugaauaacucuccaauccgaaagcuaguaagaggcagagucagaauucaacccaugacugccccuucccagcucauauucccagcuucacucccacuacuucuccaguaaaacuauuuuuuaaaaaagggucuucucugcaucuccaaggguuauaagcuacauuuuauaauaauguguguaugaagcagaguuagagaacucucaugagaucucaguguaguccuaccuaccuaccuagacaaagaaauaauuguaugguuugucuuuuccugucuacuguaaauguuucuucuuucuacuugcuuagaugugcaucuguuuguccuacagacacuguuccucugucccucagugagcuacaagcaacagagcuuucuugaguguuccuggaugccaacgcacaacauuuaaacauacugacuuuauauauuugcucccuaacgugaauauggauauuuuucucuucugauuucauuuccuuuaaaaagagcagugauggcucaggccaaaucaacuugaguucaugcagcccugagcaugaucaggacugcucuugcccugaaagaggaguccauuguccucaaggacauuaugucagagcccuuaacugugaacuuucagucaagaugcuagacuugccaguuaguuacacagaaacuauuagguccaggauggaauguggcaguuaaaacagaggaacuuugauccccaagauaaaguggauacagacacuaguaugcuugcauuuuaccacaguuuugauuugcauaguuuuucucaaucuaaauuccuucaaccuguguccagugaguggugcaaugauacaaauacacaagcguuuugcuagaaaaccuuuaagaauggcugaugcgagucauuccccaagagccccuaguccggagucacagugauacccaguuaugucaguucguuuucuuuuaaaaugugugcuaaauguuaaucucuuuaaaaaugugcacuaaaauguuugcuaaauguuaaucucuggauuugauauuuaugugguuauuuauuuaauccuuuaaccuugccaaacuuagccagaguaguucuaagaugauaguaacaguaacaacagccgcaacaucuaauauuuauuaagcacuuacuaugugccugggacuguguuaagggcaucacauagcauguuuuauuuaauucucacaacuaacuuauguggaagcuauuauaaucauggaaaguaaaguucucagacaaagagagagccagucaugaccgaaguucauacaacagugguuaaaaggaggaacaaguauuugaacccagguguucaggucugaagcccugcaugaggagcucaccuggcugugcggccuaauucagaaacucauuagucugguagcuuugggaaagucgcccuccuucaggaaccuguuuccugaucuguaaaaaggacaacuacucuugccuuccugaucagauuguuaagaagaccaaauaagaaaggcacauuaaaaaaguacacuuugaagaaauacgcaaauagaugagacuguuuuaaugaccuuagcacacucuaaagacuauguuuaucaacugccauuucugugaguaaucacauuagaaagucacaucacuuguaauuuggacuuuugcaaagugguccaccauguguaauauaacauuauuuuaauuuucacaucucuacuguuacugauuguacaaauaauuuuguauauuagaagaaaagucauuaaacacaauacgauuuuuuaucugagaacaucaugcuuuaauaauauuuaugggauauuuauugcccucuugauauugcuuguuaccacuuuaguaggggaggagaagacugacuuuuacaaaaagaaaugaaugcagcauuucugucuguagcaaauaaaaugagguaaauaguugaaugguuacugaaaaaauguuaucaguguaagggaaugguuuaaauauuuaaaaauugcccuccaaauaauguaacuuaaauccaauuuauauaguagcagaaguuuuuguacugaaucaaauuucugcaauucuucuugcccccugaguagacagagcuguggaauagaauauuuuuagaaugaacacuuaccacaaaguuuuuccuuuaaaguuuacauugguuuuuugaaauauaauaagauuuuuuaaaguacagauauuugaccuaugcagcauccauuuuuuguuccucugggcauuuauaaauaugggauuuagucauucuuauguucacugaauuaauuucccuaaaaaaaacacguguggggugugcacgugugugugugugcaugugaacgugugagaacacaaccuaaggauuauaaucauuuagucaaggucauaagugaccugacaugcccuggagcaugcuguuuauaauugcugugguuaguuuuccuucucauuguuuuuaccuauaaugucaaaacacaacuauauggaguugguauguucacuaauagcaguuuaucucugcaugguuuauagacagagucaaaagccaacaacuguaauuacauccauguuucuaacuuagcagcaagcuagaaaagugugguugaaguaugcuguggauauagugcagccaguaggaauuauaggguaaagucauuucucuacauucuuuugguuuuacaauaauuguuacuuaaauuuuguuuucuggauuuuaccacugucuguuguguuuauaugaccacauaaagagugcuugaguuacgugucucuccacucuauuuuucuacuccuugccuuccuuuauaaauguacuaguucuccuuucacuuucuucagacucagcagacaguacauuacaguuaauaguuuucugaagcagccugauauucaugcucuauggaacccauaagacuucuauuauuugcauuauauguuuaauuggauaauuaugggaaccauguugaacuguuaacaacugucaagccuuugauuaaucuuuugaauguucauuggcaugguucaaguuagcaaccacaauacagauuuuagguuuuuauuuuugcugcucucacaaccauuugagaggguaaaaaugauuuuucuagaaaaauauaauaucccauuuuggcucaccguacauauuguggcacaaagagcuauguaacuuauguauugccauaauugccuuugcauaugaaguauuguaguuuaaugaaucuccagaaaauuauaagaaagucuuauuuuuuaaaugaucacaacuauauaacauauaaaagaauccuagucuuccuccaaggaaaccaguuaucaguucggucuguagucucccuggccaccuucuauaccugaggauucuuuucccuauuuuacuacucguaaaauaguaaauuucauuauuuacaaaauaggugcauccuccaaggaaccacagacaccuccuaugcacccacacugagcugucauccugaguccccccuugccuaacguugucuccuguggaaguggaauucccugggagcuacuuguuacaggagaagacuagucaaugaauugccuuauucuuuuaagguguguuauaaauugaauacugaccacaggagcacuaaucugauagaaaauacugccucuaaucuaguuuuaaaauaaguaaagugugaguguaggguuagagaagauugagguauuuaaaaaaugauuaggauagguccuccuugguaaggcaacauuuaaguaaaggcuugaaggggguggugaauguagauacucuuuuaaacacuugaaugugugugugugugcguauuuucaucuauuccuuacaucagccccaugaggcaagaucuauuaguaucuccuuuguacaugugagggaacgaaagaacagaaaaauuaugcccagggucacacaacuagcaagugguggaaucagccuuuggacacaggcauuuuguuaaacuauuauuuuagaucagccccuaagcuggcuuagugaggcugauccaggauaggacuaaccuccuuagcagacuuuguacuaaacuagauauacaggacucagauuaauuccucuuccugggaaauaaaauccuggauucuaccugucauuuccaaagugugucauuuugaaguaccaucuuggaucaaguuaauacgauuggaaugggcacuucagcugcuaucagagcaaucccgcugguuguguugucauuguguuuuggugcuuuaaucaaagcacgaaagaugugagggaaggaaaauuguuuuagaugagaaauaugcaaaaggaaucuaaacaucauucuuaccuucugaguucacaucauuauuacaggaccauuguuuacauuugggagcuuuaugguaaguguaccuucuauugaggucugagauggccucuucaaccaguucauaauaagauaaggaaccagagaugaagagugugaaaggagugugcagaaggagcaaauacagacuagcagcaguacauguuguggcccauaaauauccauccuggaaaauaucuuaggugcuuugaguuguagaugagcaacauccuucaaauuagauuuauguuuuauugucugaaguaaauuauaucgaucucuguugccuugagggucuuucuuugaagucguaccuuuugaccugccuucucuauggagcagucugaucacuguuagccuuaauuucccuuuuugaugaggauuuaauaaggucucaaucucagguggucaagucuuagguaaaauguuugugugaaaguagugggaaggggauacaacuuggagaaucuaguuaucaguguugaaaacaggauucaguuuccaggcaugauguacuuuuuucaucauagugauuaguagauguaauauccucuuauuaucguagaaaagguaggggauaugaugggaagacggggcuuccauuuuugguuccauuaccagugacugggacuugugcuucgguuuugccgucuguauaaugauggcauuguuaacaaucacuccugaggauaaauuuugauaacgugugugaaagggcuuugugaauuguaggcacacucucucuguguccgucucucucucuguguguguaugcauauauuuuucucccuaccucacuaaaaugaaaaauuccugaggauaagaaacaccuuauuuuuaacaccuguuuuauagauaguacugauaauguuuuuguauugaaccuauuguggacuuucagcuuagguguuugagugaaaguuuccuaaaguuaguuaacacauuuuuuuccccucaguaugccuguaguuuauaaguagcgugaaguucuacugcuggaaaauacaguggacaagugacaugguuagcuuugugcucugacuggaauuauuuucccccaguucguuuuucaguuugucccaagaaagucacugcuucugaaucauggugggguuaaaagucuaaauuccccacaaaacagucaauaacauuauaccuuaguaaugacccuaacaggguucugucccagcuucccgcccacauucauuguucauguuuuacucacuaaccuccaaacccaaacauucuaggcuccgcucacucaggggcucgccucuuuucuuuccucagccauugaggcagccugaggggauacauggucuuccuucuguacacuguugcuuuugauuuccacauguuucagaccauuggauggcccaguuuuggaggugcaaaauaagacugauugaacauguguaucuuguuaggaauguuaugacaaauaacagcagcuguauaaacuaaucuuucuguagcuucgcacgacucaauuaacaauggaccacugucaacauuugguccuuuuuaccucaugguuccugugaacuuuucuguuggacaucagauuacuuuuaccuaccaacagaagaaaauaucaaauacugcaagucaacugcacuucccaugguguucuccacgugaucuggggagggacugccaauuauaaugauuacugcauugauucuaauuagaaagacauacuggucaucaggaugguugugacaguuuaggauuaauuuuucugaacuuagcaccaaaacucauggucguaagaugcuggucucugaaguuuagagugacuacagcaugaggcaggguggcagggacauagcuucccccagagaucaucacaggagacagaaacaucuuugugagcgcuuugccauguagaagucuacuguugugcaugguaauuucaagucacgagaaacagaaaucucaagugaccuuuuaucucuuuagguaauuucuaucuguacuuuuugugagaaaaaaggaggguacacuggauguucaaguacaauggggaacucagaaaagcagaguuauagccuuagaguaaggaugaguaaaaguucaaguuccagcuuaaauguacuugacauuugaacccccuguuugaagcccuuacuuuaggucuaucugcagaggacaucugaaauuccuuuggcuucuaaucuauggcaagugaacaggaauggaugacaaagggauauaaagauagagcucaaacaaguuguuguuaauucuuucuuucaccuacgaggacuaaugaaaagcuuaaauuacuaaauucagacuagaccauugucgcuacuugccaaacaguacaugcuugugcgucugucuaauccauauuugaaagccacaaacagaagcacauaauuuggcaaaacaccaaaaacaugccucggcacacuucuggagauucuuccaaaugacuuaaugauucaaaaaugugugugugugugugugugugugucugugugugcgugcacgugugugcgcgggugcacaugcauauugccuggagaugcuuggaauaaauucugccagcaaaccauguguauuacacuuguuuggaggauuugaggauuucuuucaaaauucugaauuguagaaagcaaaagauaaggcuguuucuugggcaguuacuuucucuuuuauuuuaaagaugaguaaguaaaaacuuguuauuuaaaaaaaaucuccucaaaauacaacauguaaaacauucugucuuuuaagaaaguuuaagcauucuauuuguuuuugaaauguguuuugagcuuuuuuuaacagguggaucacaaauagcaguucaguacaagaaaaguucuucguagcaccaugaagaaauuuccugaauugaaaaauuauucuuuccuaagcuuuuuacagaaguauuuuuuuguggccugauuucugcuugauauagaaaagauguacuuuuuaaaaaagcacauaaucugaauucaguuuacaauacuugaagauauuuaggugacugcaugaagcuauauuaauaagacagauauggaaggcaaacagucccuaagaaaccuuucgugugaucagcuuucccucgcaugaauauuauuuuuaaagucagauacuucuauguguaguauuuuauuuaaauauugcaggaaccuucacaagauagauauuauuauuacucaucuaaagaugagaaaauuagagcucacagaauuuuacaauaaguuacccaguauuucacauguaggaaguggcaaagguaaucugaagccugaguccgcagauaaugccuuuggcguuguaccuuucagccuucucugagaaagguacauuuguauuacaauuuaucuuccuuucauuccuuaaauugcaaaccauauugcucugaaggucauucuauguagauuauguuaaugucuuccaguuagcuguuuaaguuauaccucauacuuguaaauuguaaagcaccuuuaucuuuuguuuaaaguaucuuauuuaauauuuauuucaauuggauaagauauuguuuccauuuuacaauugagaaaauaggauugggaagcaacuaccccaacagauagucuagaucuggggauuaagaacaguaucuuuuccccaacuguuuuuccacugcauuuuaaauguuuuaaguccaaagaaaauuugugcuugauucaccaccucauaccaaaaaauggaguauggcaaaccuagaccuuuuuugcuugacaagacaaaacaaaaaaccccugcaguaucuagucauguaauucuuagugaacaucuucucauauuucaguauaaauugguaauuugucaagcuauccauauaugcuugagagacucuucauuuuugguuaaggguaagaaaguuuuuuuuuuuuccuuccuaguuucagaguuuuugguauacugguagaguuuugaacaucaacaacuuuuagucuuuuggcauaauaggauuagauagauuaugguuacugaauucacacaaauguaaaagaaaaauagagauagggaagugagggaggagggacuuaguucuuacugccguauuuaucuauuuuuagugccauuugaaaauugccacaggaauguagcaucucuuuucuccugcagacuuaguuuuacaucaguuucuuaguaugccauauaggauagcauuauacucauguccuuuuagauaaguacucacaacuaggaaauuaagaugccaaggauauaagccccugggugugauaggguuuucacuuauauacacagauaucauucuucaaggauacugcuugugaaugggaugacucaggagauguuaaugagagucuuccuagccuggcaugauauccuaaccauggcgccgugcacuuuuucuucccuguuugccucaacugcacugauaucgcuuuauucuucuucuuacuaugacuuuaugauugaugguuacgaaaaucccagaacugauaugaauucaaguguguucaacgauuagaguaagagaauguuggcugauaaagaagaaguugacuuuaguugaacacaaagauauugaacucuaaguuacucauuuaaauaugugacacagaaguagaauucacagagguuaaccccuuggagcacucagagaccaugauccuggccuuguccacguaaaacaacucccuucagaaguaacaagagcaagguccagccauugccaacugaagcccguugaauacacugggacgugggcaaauuaagaacuuacugauaguucgcccacuggauuuuaucauagaucuuaucagcuucauggucuaugacuguugauuugacuuucucaugaaguaaauuaacuucaaaacaaaaccucacuaucucuuaucuguugccuaaacaauguuuccaaaaauugaccaccuuacuauacaguucacuuggauuucuuaagaaaucaguuaauuuagcuaacuggcaaacagaacuccaccaccucuucucugguucugaaacaauguuuccaaacgaugguuguccuuuagcaugcugucagagcacaguaggccccaauuuuuaaaagagauaauucuuuugucuuuaauuuugucaauuuuagcccaguucgacuuaguucuugugccucauguuggauaguugcucuagagaaaugugaucccaggaaugcuggugauuugcuguuuuaaaauggugcugugcuuuagguuucuguucaaaucuaagauuucagaagagucaguaacugcaaauaaucuaaaaggggaagagugaagaaugcuucuaacuucccuuugaaaugaauagcucugccagagcagcagcuauuagaaaaacaaaaacgacaaagaaaagcugcucagcccagcacacagagguaaauuuacuuacaucagacugaaaaaugagggcugggcuuugaaaagacaucccuucugacuagaggaaagcuuguaauuuuggcacggcugccgcccuccuaagccccugagaaauucugaaaaacauuacggaagacuguucuuaauauuaauggaugucuucguguguguguguguguguguguguguguguguguguguguagggaggaagaaugcuagagagagaaaggggguagagcaugagagagaagaaaagaucacuuaggaggaagaacuaccaguggaaaugucuacuuucugaaaaauaauuugcaucugucauuuuucacucuucaguaaaguaguggucaagaugagauauagagaagcauucaccauuuacacuucaaguuaggcuugcaguaucguggcucuuuuaacaagacuuccaaaaauacuuguagauaacauugcucacugaugugaucucaaaucuauuauaugacaucagaggugaaaaaaagacuguuucccuguggcuaauuguggugagugucacauuauguuguacuguagugaacaauuucgggggcaccaaaagccuacagcucugccucuugggaggagacuuuuccuuugcagcucagcuucaggaaacgugaacauuuguguuuucaagaccacauaccauugggaaggaaguagggguggagaugcgugcugagauuaaguggguaugagaaucucuguacuguguaugaucuggaaacugcugaauuuuauguagcccucuuucuggcaugccuuuagaauuuuaaagucacacugacaauaauacugauccuugcuaaggauauuuuucacaaaauaauuuauuuacuuuuuaggcgaggacagacggaccucuguguagcgugccugaccagcuugucucugagcugugugucaaugugucuggggaaacagagacagaaaucugccggcagguacuccacagucagauuuauuugggauguauaacuguaaccuaucaugguaaagaaauuuaauauguaauuaugggaacuaguuguuaauagacaacuugaaaguuauuuugagaagggaggcauuaacuccccacagccccgagucuuccacuccaccucagacacuggcccauguuaccuuaaaggauacaaggccuauuguaguuugacauguagaguuacacagauaauacacagagaagcugaguuucuuuuugggauugaugagggggaaagagacggaaaauguacuuauuaaaaagagugccuugauuugcuguggaguuuaaaacugggaacauguuuucccagacgagcaaaagcuuuguagcauugcuggcucguuaaugagugaucuucuuucucccuggcgugcccuggcugggcauguuuucuugacuuaggacugacacucucaauauaaucuuaauucauuuuuagucuaggcugacuaaaucuucugauuuggcaaagcagacugucgggauugccauuguuauguuuacucuggauuuauaucuuaaguugaggcuaaguaacacauuuacauaaaucaacucagcauuagacucuaacacaaaauuguuuaccgagagaaaagacuaauuguauugcuuccugagauuugcuuucauaauauauuaaaccucaaaggauuuaaaaauguagcauguucuguuuuaaaauuaacucuucuggggguuuugcuuuuauaaaaagauagaauuuuuuuuuuuuuuuuuuuuuuuuuuugcgagaauugauuauagcuguugcuacuguggaugacuuuccuggagguagaagauaaaguggagcaggccgauguuauuuagcaagagucauaugcuuucauagaaggauuuauguuuuaugaaacuggcagcacaaaugcuagaaaagaauuuaaaaaguucuuuuaauacuaaagauauugcaggaagaugaagaggcuuuaaauuuauagcugcaaacauuuucaguaggaguguuuuuaaaugauagcauuuuaugauucaugcaaauaucauguuauaauuuauuuccuuuaaaauaauggcaaggaaaaaugucauggcucuauugcaugggucaucauccuauuaagucauguucuauuuaaaauaauuuuaccuuuauuaaaauuuacuugcauuuuaaaauuacgacaaaaagccagauugaaaaauugggaguaagauauuuuaacauguaugcuauaguugcaaguuccagaaauaugugggggaaaaaagagguuaguagcuauuuuaaguuuguucaaaacguauaauggaaacuugcgccuuuuaauaguaugaaauauuagcaaaauguuacugaucacgagauauacuguuacaugucugacuauuaaauguaauuuuuuaauggccacuggauggaauuugccuuuuaaaaauacuagucuuaugcacucaugguuaggaaaugcaauaacuucaugacaaguuuuuauuuuuacuucuaagguauuucuuugcuaaaguuauuagcacccuuaaaauauucuuuuguaccuagggacaaaaauucucuacccagaguucuuaugaguguuuuuaagauggaccagaugacacagggucacguucauugugggcaguauguuuuguuuugcucugugaaauggcuuuguauagaguuuuaguuuuucuaaauaaauuauuauucaaccuuacaguguuuuccaugagguucccuaaucccugacuuuaucucauuuugcuccauguaacagcagugugguuaucuggccaaccaccucaucccucuucgucaguuucacuuggaaagauaggauccauauuuccagucucugaaagguggaagcauguguuucguccagcugagucucuuggucugauuuuuuucccgguccuaauacauguuuauuccuacaugugacaaaucugcagucguguuuucuuucugaguuauaaugacucagaugucauaauuaauuugaugagcagguggggguuauuagccuugugcuucacuugcuaauagcugcacaguuuuucuaaaguacucuuucaacuaaggaggcauuucuucacauagaauaaacaguacagcacaaaagccucaguuagauaacuauccgugggcuugaaaagcugccaagcagauguuguuauuggagcuggcccaggcgagauugggccaggcagaugcucauggggagggguguggggagggaggaggagaagggggaggagaaguaagagaguagagguuagggggagagggggagguucuaugggacgcuggugcuuucuuugcaggggguugggccagauuuuguuggggugggaggucucuucuaaugagccaccuccaugguuauggccucugguuggucucuuaaaacaugcauacgugagaauggggauggggguggaggagacccucucuaaauauccacaugggagcgaaucugaguguucauccagcagccugagacuucugguuugcauuagggcggcugugugcaauuuuugaagggccuacggagacucagcuucauaccuauccacauauguaauggacaugacugcccugacauuuaccagaacucauagguucugcuuuauugcuauaaauuagguugugcaaauuuaagacaaaaugcuguuuuguuuccugucaccucaauauguaauuuuucacugagcauucccuacuuauuaaaauguugcaaagagacaccuuacuuuuuaaaauuaaaaucagucuuggaacaugucagauuuguaggagguaaauguguggaagguuuaaucuaagcugauguuguuucuguccucugccuuuuuuuuuuuuuuuuuuuuuuuuuuuugugaucuaaggcuuuuuagaacucaucucucacuccccuucacuagauuaaauucuguaaucucauuuuucuuugagcugaucucaagccaauggucuggggauuuuauagccaagggauaauuuuugauaaugggcuauuaaaacacuugcagcuccuacccugucuuucaaauuagcaugugcacagauugccuuucuggggaaaaagucuuucccuuggcaauaagcaacugacuaugugccacaagcaguauaaaagcuuccaggaauguuuauacuaaaaacacagguaaauaagaaaugauaaauaauaauaguaacuguacagugugaacaggaacucugccuaggauuauuauuauuauuuuuuacccuuuggagacaaaguuuuguuuucccuuauucagacagauuuaguguguucugacaacagggucaucuaacaguuuccuuaaugauggaaguacaguggcuugagacagcuguguaaggucauguaacuuucauuguuguuuauagugugcuuguuaauagguuaaaaugaauaacuugcuggauggaggucagguagcaccuguauaaauaaugaauuugcccuuccaaaauauauaauguaaaauuaaucaauauauauagcuugccauuuuguuuuuauucaguucaacuuccuugccgcucuguaguuuucagaggaguaaaguaaaaauuaugaguucugagaaagcaaauuugcuugccauaacuccauuugagggugacugcgauuuuguuagcauaagauugaagcuaaucuccuaaagaguauaucugauucugugucuuaaucauuuuucacaagaaaaaaaaaucgggacauauagguauauguagaguaacauaaagccaccaauuguagaacugaugugaugugaauuguacugaggguuggcaugaaugcuuuucuuuuucacguguaacauuagguucagacauauaugugugcagugcauugcuguaaugugugcagaugguaagaacacauaugucucaauaccaugcuuuaucgcucaauagccugacagauguauaugggugaauucauucauugcccucucuguugauuaguagcacuuugaaaaugaugucguaauuuggcaaacuaaauccuggucggggagcaguacugaaaguauugaagaaaugacacgauuauaguuugauccuuguacuuagaaccuucaucaaauauaagguuuuaggucuucuguaauguuaaaaaaaggaaaggaaaaagagcuaguuuuacauaugaugcagaauuugaaaaauuugucuuuuuauuggcaaaugcugauuuaaaagucccugaaucauuucagaaucuguagagaaugagaugugguauuauaugugauaucacauuaaaaaguaaaaguucagucuguggacaaagucuauuaaaauguuuuuaauauaguagaggaccucguaacaugagccacuguuaguaaaaaaaaaaaguuuaaaauguauauuuacucauauguacuagaacauaaauaaguuuccugaaacaaggacuacaugaaacaauugcuaauaaggcacaguuagugguaaguggagauugauacuaucuguaauuuaauaaaugguuguacuguaccuaggucuucaacuguuuacaauugaaacccaaagccgucaccaucaauaucucuuuaguacuucuaauuuuggguaugucuaauucagugaacauuuguuuugugcuuacuacaugucuaggagcaugcuaaagguuagagaaauaugaagaccaaugaaguaaucccuguucucaaggaguuucuaaucuaaucuagcaguggaaacagaaacauaaaacuaagcaccuaauucauaugaaacagauaguagacaaugccacacagauacauaaaaagagcuauuggaguacagaggaggcaauucagaauucacaagaauccaaagaagguucucaugacucaagaaaugagcuugaaagaugagcaccguuuuguuagacgaggaugugaggcauggggguccuggaggcaggaaacagcacaagaaaagguaagucauuggggauggggaaagcauguugguaguugggggucaugaaccaucaggggagggugacuagacuuuagccuguguaggcgaaguggaggagaguuguaagagacuaggcugaaagaguaggguugcugagggcuucaaaugccacauuagagaguuuccagaggguagaucaucaagcuuucaagcuguuauauuuaggugguccuuuagaagacaauucugacagcaaaguggaggauggaaugaaggaagaaaauggagugaagggaggaggucguuuuaagccaggcuuuuaaauuuucauguaaaauauuaucuuugucuucuccauauuuuuuggguacaguauauaauuuuuuuuuuuuuuuugagauggaaucuugcuaugucggccaggcgugaucuuggcucacugcaaccuccaccucccagguucaagugagucucaugucucagccuccugaguaucagcugggauuacaggcacccgccaucaugccgggcacauuuuuguauuuuuguagagaugggguuucaccauguuggccaggcuggucuugaacuccugaccucaggugaucuucccaccuuggccucccaaagugcugggauuacaggcgugagccacugcgcccagcccugaauauuuagaaccuaaaacaggcuacguauuuauucauuugaaagguuguaaaguuuuaaaugagcaccugucauaccaccgauguuccuaauggcuuuggauacaguagcguacaagacagacauggucucugcccucagggggcucacugucuauucacagggaacaacaaaucaauucaacaaauuuauaagcaagucauuuccgauuguguuaaaugcuaugagaaaacuaauagggucauagauaauacauagauuaaagugaaaaugggguaugggggucuuuguuggcuaaggucuuuugggaaagucuuucugaggaaaugaaauaggaaaagaugagaauuaacccaguuuccuaguacuuucaguacucauuugugacgucaguuaugaauauagcuuugguuaaaaggcccuuugagccauuugcauuuauugagauaaccucagggacagguuaaccuuucauaauuaucagaaagcuaucuauaagaagcauuuugcuguauuccucuauagacuacuuuuguggaaucaugauuuaaccuuagguuggcuucaccgugaauuaaauauuuaaaaauauuuuauauguaaaagauccauaugcagaucuuugcuuuuguauaaaacuaccuuuuuccuauuauguguucagugucccuuauucaacuccccugcaauauauuucucugaaaaaucccuuccaggaaacaaauuuucuuuuucugauaaguuggcaugccucuuuucaucuuaugaugagaacuguguaugcaaucuaguuuucuucuuuucccuguaugcuagaaagcucacagcccaaaauuuguuuucauuugucuguuuuccccaguucugauucugugaauuuucuacugccugucugcuuucaucucuuggauuuugcauuuuguuuuauauuaguggauuauugaaacuuuugauuaauuaaaguauuaagucauuauuuguaauaauaaaucaauaaaaaucauucuucagauuuggugcuuaggaucugaccgagaacagaaacaacaggaauggauagauucuggagauauugaggaaaaagaacuuggugaugauagauguagaggguaagggagagggaggaggggaagaugacugcaucacugaaucaaugcugagaugggccacaaaaauggggcauauaagaggaagaggagauccgagggaagcaugaagacuuggguuuuacuuuauuuuauuguuuuuuuuuugagacaaggucuugcucuauugucuaggcuggaguacagagacaagaccguggcuccuugcagccuccaccucccuggcucgugaaauccuccugccucagccuccugaguagcuggaaucacaggcaugggacacaauacccugcuauuuaaaaauuuuuuuuuucuagaaaugggggucucacuauguugcacaggcuggucuugagcuccuggacucaagcgacccucuugccuuagccucugaaagugcugggauuacaggugcgagucaccacaauuggcuaagacuuggauuuuaaauaagccauagaucacaugcccugcugcaauagcuaguagucaauuaaaaagaguguuugagcauaagggaaugguuauaauuaggaaugcagauuuggguguuauugaagacuuagaagccaguggagcugucaaggaagggauugcuucuugagggaaucugagggcuacagauggacccuugagagaggucuacagugagugaguacgggagaggaacccacaucuuucagcccucaggaccuuuuuacugucaucacaccaaacauccucucccuuugccugaccaucccauccuucagcuaauuaguucugauucauucuucagggcccaucugagacauuugguauugcaguaaguugaucuccccuuguugaagcuggcuguucccccuauggacucuuguaguacuuucuacuucccuaacauaagacugauuacagaaugcuagaauugcuuauugcuaaaugaacucuuucucuccacuacacugcaaacucauugaaaaaugugucucuagcauguagcucaaugcuugaugcauaggugaugcucaauacauguuuguuaagugaauaacugaauucauccuagaagggagaggaaugcugucucagagagagggauaugguggucaacauauugguguucaugguagucaacuugggcugccauaacaaaauacuauagacuguguugcuuaaacaacagaaauuuauuuccucacuggaggcugggaaggccaagaucaaggcacuggcaagguagauuuuauucugaagcuucuucucuuggcuuauagauggcagccuucucauuguguucucacauggcagagacggagcaagcaagcucuccggugucucuucugauaaggacacuaguucugucauauuagggccccacccuuaugaugucacguaaucuuaauuaccuccguaaaggcuuuaucuccaaauaugaaggcccuguucugccuacauugggguugggcuucaacaugugaauuuuggggggacauaaacauucagucuguaacaccuccguuguagcugaauacuguucaucauuuauagagagauagauaguccuaguugcaaauaggauauaauauccaaucuauagugguagauacaaccuuuucuccaaauccugauccaaagaacauugcugagaccuagauauaccuuucccagaucaauaaauucggguccaguaggucuuuggguuuguucucaugacugaucuugcagagcgucucauguuguccccugaaucucuuucuacucacuuaacacuguugauaauaacugaaugugcuuaggcugcagcuugaaaagaaauuucaugaguagacgggugucaggcacaggaacauguuaagagggaagucacggaaccuaacuuauccuaaaguuagauuagauuauuaucugcuuggguugcuaucaguguggcuuugccuuagguugggggauagcccagauuuccuuucaaguuccuuauuggcuuuaacguucucugauuggaacuuaaaaaugauauuuuccagacuguuugaaauccuuuucuccucuacauucuagaaauagagucuguugaaaauaagaacagauccaggaaagaaguauguacuuaauauuguaggggacauauagcagaucggacccuuugaaugguuaaugcaaaguuuugucuuacuguaaucuggguaauccucagauagauaaaaauucaucauugaguguuuuuacuuuccuaaagaaaccacaguaauaugucuuuuucucaccuaaaugcucuuaaaugcacagagaguagggguuccuuugguuucuauuuuuauaauaguaucuuccuuuagucaguuucuuuauuccuagaacauuauuuauugggcacguacuuuugaauuaaaaaacaaaugaccuaaauauagaaauaaccuuccauggggaaaagaaugguuguugacugggcaggugaaguaaggccaggaguggauauugaaccaccucucuuaguaacagagaggaaggaaaaauaaaauuggacuuuugaaauacguaucuagucuuaguagggauaucuauuugcuuuuuuuuuuuggucaauuuuaaauagucguuucuauauuucuguaauauucacuaggaaauuuguuucccugaggccagaagucugggcuagaggcaaaaccuuugaaguuugucuccuuucuuccuuuguacauuaaaauaaaucaaaacaaaacucuaauccuuuuauuauauuugacaaccaugggcaauuguucugcccugucagugaaaucacucuuucucacuuaaacugggaacuuuuucaggguugcuuuuuugccuccagcaaguuuuaggagagacauggacauaacacaggagcaguaauaguuuguacgaggaggauaaguaacugccagaugcagaggacaaacccugauauuuggguuucacggauuacgccauauacuuucacuuuuauugaaugggccacuuuauuugucugcagcucaguuuucguuuugcuaucccuaaacuccaauucugaauuugauaauguaggcucauaacuguucuucgucacagaugcacacacaaauuauuugggugauuuugaguaguaaaggugaagaaucuagauggcaaaccuguguauagccacucagauccuucugaggucgcagugcagaauuccauauguauacaggguuugagccaggcuuuugggaaagcugcacuugaacucucuccacuucgcaucuuuuuaaaauaaguuuauguuuuaauauuuugaacacagucuuuuuccacagguaaauacggguauggaaacagacuuuuaaaaacaagaguacguacuugguuuuguuaaugaaggggaauguugaaaguggaacuucuggaagaguuuuucuucauagggaagaacugaaggaaacuauuucuucaugaacauccuugaguucguagcuuuuaugaaaaaaaaaaaauccccucaugcuauucaaaugccauugaaacauccaccuuuaaauaaugcaguaagggaaaaaaaaaaccuuguuuaacaguaguuuguuuuagagacuguacaaauaacaaaaucauguuauagguuaagacaaaaagccauaacaacccacccuaucagcccuuuucuuuuagggggaagugagccagauguuuaaacaauauggcaggauaugugcaugccgcaguacuuggagaccuugggaaagaaaucaugucugcaccccuaguguuucacaguuuuagacuccugaccuagaaacaguuuaaacagauguuuaguucaagggauuuaugucgacauugaauuuuuuuuuccuuuggaaauggcugccucuaaaaugggagccuuuuacuagaaaaaggaccagagaaacagcuacaucucaaaacuugccaguuucauguugaaacuggucuggugcagcaggaacaacaacaaaaaacaaacaaacaaauaaacaaaaaacaaacagcugccuuaccagugacucuugacgcguaugaacaucuuuucuuucuccgcugucgguucugucucuaguaaguuaggauugucaacaguaacagaauuuacgaaaggagaaggcaucucagaaaacccuagccguuauaagccagcauaaauuguggcuccuuuuccuugucucaauucuaacccuuuuuucuagccuucagcccaccacaaucccauugcgcuccuucuuccagaaaugauucuucucacuuuaauccugguguggggaguucauuccauaauuuggaucagucaaaaaugauacauuacaucauagcugccuuuaugaacauguuuauuucauaucugaaauguuuucguguguauucgcugugcuuugacuugcagaaggagaaagaaaguaguuuuacuggaggcaaaacagccaccugugaaaacuaauugcguagguagagguuugaugguaucucugggagggauccagcaggaagaaaguaaauguucuuaaucuacaaggaaaucaccuguaugccaaacugacccucacaaucaaagccagguuugaaauaucccaucaaauagguggccuguguuuaggagccuggagugagaagggcagcaagagggaggagucauggugagggccggugcagugcaucuuagugcccuguguagauaagugaaaagugacaugauagugucagggcucagaaaccgauacaccaaaauguggcacuuugacaugcugagcugaagaagcagccuuaggucucucugacacuguacccccuccaccuccugccuugcaauccucugucucucccaaagcaaaggaggaaauuguucccugaaguucccuuaucugccucaaguucggaugcaccaaagaauaaaacaauuaucucugguuccuuccccgaauuuccauuaacugagcucauagcauguaaagaaacacugaagccugucaacacaucuggacagacauuugucacaaaccauugucugcugugugggcccaacagacuuugucccaggccacuuuaaguucauuaaguuccccuaaaaaucauuuacuguccccuuaaaaccauccagacuuccccaucucccauuccucuaagaaggaguguauauaagcaucuguaccccauugggauauggggcagucaucccugcauucucccccuugcacacuaauaaauuuauaugccauuucuccucuuaaucugccuuuugugaguuaauuuucaacaaacuuuuagagagcaaaggggauguuuucccuuggccccuacaauggacucaacuacacugccuuauuacgggcugaaaugugauaugaaugguauauauuaucuucaaacaaaagguuugagaugugacugcuuuugaguuucuucuuucuuccuuuucaucaaguuugccuuuucagucuuuuuuuuugagacggaguccugcucuauugcccaggcuggagugcaaugguaugaucucggcucacugcacccucccucucccagauucaagugauucuccugccucagccaccugaguagcugggauuacaggugccugccaccacacccagcuaauuuuuggauuuuuaguagagacgggguuucacugugguggccaggcuggucucaaauuccugacaucaggugaucugccugccucggccucccaaagagcugggauuauaggcgugagccacugugcccggccccuuuucagucuuaaaugcuguugucuugacuuuuuucccuccuccuuuccuggauuccaccaauuuaguauaccuacagguuucuugcuauuaaaaagcuaagacauauugugauggagaggcaagaaccaaugauguggcuaccuuuugccaccaucuguguagcucccugaacugagugccuucaaauucagaaaaagcagguccuuugggccaauccaugccccauauaggccaauaagcaugcugccuugccugaacccaguauagaagacagaucugugauugguugucaagaugguaggaucugagcuauccugcaagauucuacauuuuguuugucacucuagguagacaguggccaguucagauaugcucgacuggcacaccuccauguuaccuuagcugugcauauaucugcaugcagguaacuuuccuaaauggcugucuuccaugggaaaucaaaaccguagaggagggaaaaguuccuauuauuugaagcaccaugagauuuagggaaaaguuagacaauccuuccuggaguccgacaaaaguaaaucuuuagaaagugacaaacgaguuucacauaagcuacauaaacuaaguaagaacaugaauuaaaaggauauuuacaugacugaaaagcaauuuugucuggaagacuuuggucacauuucauaguguccuuggugagucauagugagugcuuggauugggccucugcauuuauacauauucagccucugcauuacagauauugagccauccugggguggaccaggagaccagaggcugucucagaacuccagugagcuucaguuuucacugacaggaaagaaacuagauccauucucugaagucagugcgccucacuuuucucagugcacuuggacucuucucuacguguucucaccccagugucuuguagguucuuucaggacccagcaguucuacuuggcaccuguuaauaaaagugcuuccuccagacccucacagaaggcaaacuuguaccaccacgaauccaucuucagguuguauuggaggccuacuucucagcauuaagccccagucaacuaaaauaucuguuuuucaccaauaguuuuguuuuguuucguuucguuuuguuuuugaaauggagucucacucuguugcccaggcuggagugcaguggugcuaucucagcugacugcaaccucugccucccagguucaagcgauucucgugccucagccuccugaguggcugggauuacaagugcccgccaccacgcccggcuaauuuuuuuuuguauuuuuaguagagacaggauuucaccauguuucccacgcuggucuuaaacuccugaccucaagugauccgccugccuuugccucccaaaguacugggauuacaggcgugagccacugcgcccggccaccaauaccuuuuaaacagaagauccugccaacaucaauguauggcaguaccccuggagcugucuuuccagagucuaagccccaugggcccaugcuuaugugagaaacuucucccucuucauacccaagacucagccauaggaucuuuugcucaaguagaauccacagucaaguccaguuuauuucuaugaugcuuaggaacuuagaccauuuugauauguagcaggucuuugacauuuaugaaagauuuguccagagauaaugaugaguuucuaaauuuacagguagcucuuuggaguauaauuucuuuccuagacaucuguauucuuccaagaaccaucacuuccuuaggccuuuucacuuucucuucacuuucaucaccaccacaagcaauugacuucuuuuuucagugcucuuuuauuuuuaaaacaaagaaauguuaucacuucaugagcuuuguauguaacaaugaaugagaugugaauguugaauaguuggcaggguucacucaauaccaaagagauucucacgagccuuaugugcuuaugauucagauuuguccuaaggcaaaaccacaaauuugauuauaccacucccccacuccccauagaacuauuauuaauauuucauggaccuuagaacgugguuugaggagcacugguaugggauaugagccuccaaaugaagccagauccuagaaagaaggcauaguaaccagagcccuggacuguguguuuguuaguccuggggcucaguuucaaguugagcaaguguguugugugcacguauacauguguguuuauguauuuuguuuuuauaauguuucuaugcaacaugcuuuaaaaaggaaugacauccuuacuaacuugauuuaugaagagaggauguaaaacuuuuaaaagcacguauuuuggaaaugggguauaauggaaaaguaaacaguugaaauaaugggauuauuucucagaguaguugcauaguucaugcugaaccuucagcaaaaucuuauuuggaauggcuucuacuguaaaacaccuaggagcaaacuuaaaaauacuauaaguuggcagcagcagaaagaauucacagggaauguaguagugcaacaucaucugucuuuguucaaaaaaguuuauaagauaguucuauuccacugucuugccccauggcagaagaaguucuggcugggagagcaggccuggaaaggcagcacagggccacauacuccagauguguagaaauguucucagauacuuagacaacaugcuguucucacccaccagcaaaaguucuuugacuggaagggcugaauuauucagcauaauccugaaagcauuguucccuuacuaauaaguauccaagguuaaacagccuauugguuaaauugcauguuggaauaaauugcucuguuagaucagagcaguuauaaaacugugguagaucugaaugaauguucucagugaugauaagcaguaccuuugcuucuauuaaauucauguucuaauacgagucaucaaaagguucuuuuaugcuaacuauguucauaaaagaacacucaauguuugaccaccacaacagcuacagccacuaaaaacauaaauaugggggaaguccacacugcucagacaguuuaguaaauuguauuauuuaaacaaaaucuauuuauaggagauacugagauacugauaugaugcuuuaagaaaaccuuguccguuaaaaaaaaaucucauuuuuucuuuagcaugauaacaaauaauucugccuacuuauauuaauaaauucaaugacaaggaaaccauagcuggcacauuauuggucuuagucuuagaauuauguuucuuucuuucguuuuuuuucuuuuuugagauggagucucgcucugucgcucaggcuaaagugcugugaagcgaucuuggcacaccacaaccucugucccccggguucaagcgauucuccugccucagccucccaaguagcugggauuacaggugcccgcaaccaugcccggcuaauuuuuuguauuuuuagaagagacaggguuucgccacguuggccaggcuggucucaaacucccgacucaggugauccacccaccuuggccucccaaagugcuggcauuacaggugugagccacugcaccuguccagaauuaucuuucuauuacugaaagauuuuugagguuuucucucuuguucauucagcacugagcuaggcauugggaaugcuggguuuugcugguccuggggaauucacagucuaauauccagcuuguagaagagugacuuucaguguuucacaguuuuuuucagcugugcaguagcuguaauaaggcacagcugucaccuugugugcaccauguucuaggacuauacucaguuuuauauauguguaucucauuuaauauucagaguaaccucguacuuccccucauuuuauaggugaggaaccugagccucuguguuaaccaacuuaaccaagguuaaacaguuaguaggugucaaagucagauuuagaaccaggacagucuggcuuuaaagccuugggugcuaaaccuuuaggcaauacugccuaauccauaaaagugacaguguuuuuguuacuaugugggcccuucuugugcucuaggccauagaaaggcaucuuggcucucaccucugcuuaguucuaggguagcagaucauaaucucaucagaacugggguagugacaaagccaggucaaacuaggccauggaagcucaguuccugguucuauuucaaaggcaggagucaggaaguuaacggccucaggaugcugugcugucucuucaaguucugcagaggaccucuggaacuggugcauuguuggagcagaucacccugcucagcucccucucacccuucucacccaauggucuugucacuuuggguccaguuuuaugagcucacagugauuaaguaacugugauucucaugguucugagacucugacugccaaacaagcuaguguugcugaaauauuuuaauggucuggcauauucacuuuccuuuuuggaaguuaguggauuggcagcuagaauaugaauauuauauuucacuccucuuccuuuuuuucucuaucuucuaauuagucuuucucugcuuucugauuuuucuucuaucucauccuacuuauauguuuucuucuuuaugguuagcagugaaauuggucuaaagagaaaacuucuguuuguaaggagggguucuugucuagguaaaaguuuuuggaaaauuauuuauuucuaaaugugcagaauggguauauaauuaauaauuuuuuuucuuagaacauaguuucccuguaaccauguuuugguauggaaugaaagaugaaacugagauuauuaaggcaaaaaugcaguaagaccucccucacccugaaauucaaucucucuggaauuugauuaguguuuuuguugguuuuacauaugaauauuguuagagggagaggcuucuagaaaaagugggucaaaaugaauauuuuugguaaaacagaagcugcauaaaaugucucauuuuuauacucauaauagcccuguggggcaggcaccauugguagcuucccuuugcacaugagggagaauuaagggacuucucaagaucacacagcuaauaggugguggauuuaaacuaggugccuugaguacaguguuuuguauuucacuaauacuaugcuagcaugguguuuugcgcuucaguaauacuaugcuagcauaguguguggauucuggagcaggacagaguugaauucaauguuuuccaaaggcauucaggcuauuugaucauuucucuuauaugugauucucacagucaguugagugcuucacaaaacacaccaagacucaucagugagcuggauuguuaaaagguuauuuauagugaccuugugagagucuaaacacuccaaguauuucaucaauaaaagugaauaauaacuuuuauuaucuuuuuuuaaggauguuaggaggguuaaucugucacuaccuauagagcaauuuauauaaacugaagcauguccauguccauguuauauuagaacuaauucuuaccagcccauaucuggucaucaguaugcccuggauuuuuauaucauguuugguuaauauaaaguuuaucauccccucagucauugaccauacauccauuucaugagaauuguaaaacaagguaaagucagaugcucacagucauugauaugugcuacaguugagauuuaauccccaggugaucuuacauuaaggaaaugucaguaaucuguuagagacacaaguucaacaaauucagcaagauucuuuuacaguugcagaaucaaaaaauguccaaguguuaacuccucaugguucagccaaguuucuuuuuucuuucuuucuuucuuuuuuugagucaggguuucacuuugucauccuuguuggaguucaguggugugaucauagcucacugcagccucgaacuccugggcucaagugauucuccaacuuuagccucccaagaaacugggacuacagguaugcgccaccacaccuggcuauuuuuauuuuuauuuugaagagauggggucuugcuauguugcccaggcugguggugaauucccauccucaagugaucuuccugacuuagcgaagguuauuuuguuuugaaauuuggaagcaugguuggcgcuuucauaagcuaauacuuuaaagcuuguagcuuuaagguacuugucugaaguucacugaagaggagcaaaagaucauuauuauuauuuaggccucuagaccuugcuuguaaaugcacauauaugcacaugcauagauucacacacacacagaaucccaacuacaaagcauuuuucagaagucuuauucaaauaaagagguaaauggcucugcucuuggugagacccuaauaagcaugugauaauuaaauuauuuaucucaggaaccuauguaucauuauuaacacuaauauuauagcagaugggcuuuuggaucaguggagggccuuugagcagcuauuagagaaccagugcacgggaguacuguaaaauaaauuagccucaucauuucacuucaaaucagcaaacgauuauugagugcacaucccugaagaugcgugucuccaugcuuaugugcuuaugucugguggagggauaagaucaguaaguaacgcaagcccauaucaagucaguguuuaagagaaguacuguauaaaugugaagcuacugagaugcaguggaggagcucauaucugguucuagggguggagggagcaucuuauggagaaaugcuguuuuguuuuguuuuguuuuguuuuguuuuuuuugagacagugucacucuguugcccaggcuggagugcaguggugugaucauggcucgcugcaaccucuaccucccagguucaagcgauucuuaugccucagccacuugaguagcugggacuacaggugugugccaucaugccuggcuaauuuuuguacuuuuacuagaaugggguuuugcuauguuggccaggcuagucucaaacuacuggccucaaguuaucugcuugccucagccucccaaagugcugggauuacgggcaugagcuaccaugacuggccugagaaauuauguuuuuaacugacuuuaaaagacggguuuugucaagugcuggggaggcauuuagaccaggggaacagcaugagcaaaagucaaagggcaggaaaauguacaagaaguuauccaguguagcuggaauacaagacccaugaugugcuggaggccacgugaaaaaaauaaauagagauuacuucauggagagccaugaauguuggcuugagagaguuuuacuuacuguaacaauuccgcaaagauaccuagaggcagcacccagguuauuacguagucucaaaagaguauuucugacaacuucauuuuaaacauuuuuuucuuuuuuuuauuaaaaaauuauuuuuggaaauggggucucacuguauugcccagaguggucccuaacuccugagcuuaagcaauccucccgccucagccacccaaguaguugggacuaacaggugugagccccugugcuaggcuaaaacauuuuauuugugcauuauuucuucauugccaaaggaucgaaaucucacuugcuuuuuuccuucugggaguuuugugggcuguuuuggucugcuuagagaaaaccacacacuuccaggcuauucugccucuguacauuuccagccuuccuugaaacaaucaucucgagaacugugaaauuaucccgcuauaaucuaauugguggugaccacucagucccuuugcaccagagaacuuguaucuagcaagucucuuucuuucaaacauuuguuaguucguuaaagauguuauguuagcaguaggauaugaugcaucugagaaggaaauaaaagaccaggacaaaagacauguugaauagucaaagaugagcuguaaccaucagggaacacuaacuguagcaccugauuuugauugaaaaacaugauaacauuggcuuugaaguuguugcagaucugcuuaaacuuucuucauggauggaaugaaugaaaauuaugaagcauugauguaaaaauaauuguuuuuggucuuuuuuuucuuuguagaaaccaaccugccuucccucccucccucccucccuuccuuccuuccucccuccuuuccuuccuuccaugcauccaucaccagucuuuucuuacuguacaauuuccuugacagauggacuucuuguagaaguuuaccugaguuuaauacgggugaccgucaugggugcaauauuuugcugcaggagauggaaagacauuauuuuuuuuuccuccacaaaguuguauggcaggaacauguaaagcugcaucaguagaucuuaagacgccuguucucgugaucuuguucucacuuugcuuagagguuuccccaagguaauauuaauaaggauguauccaguaguaacagauaguucauugacucuauuauuucugaaacauguauugucuuuuacguaauaguaguuacugcagucauuacaguucuuuuucuuuuacauauuauaacugaagcaguuucuguuuuuuuuaacaaauacaaauguuuaaaaaucaugacacuucuuuaccuugcugcccauuauuucucagcaguuaaaacuuuauuacuuuacugacagaaaaaagaaaggaugaaaaacuauaaauauaaugauauagaaaaucuacaguauuuuuaaaugucauauuuuaaagauuuagucucuuuaaagugaguuuuuaaaaugaauucauauaaauaaaugcaaagugccauagaaguaaugaggaauauuaaaaauauuucaagguuuuuaaggcauugggaaauauguucaagacuuugaaaacagaguccaccagccauaucagcccguuugcuauuccugauguuuguauuuucuucuggaggaagaaagauuaaaaaguggaucuuguuuuuuaauucucugcauuagggagugaaauacuuucucucaccgaaagauaaggguaaucacaguuuuaaaaacuggcuacuccuuacaugcauguacccuugcaaauccuguagcaacugaaaaaucuccugauagauguaaaaauuaauuaaugucuuacuaccaugcaaagaaugugggcauagguggauaacggugacuaaaucccacagaauuuguguggcuugccuacuaaaccucgaguaauauaauauaagugaaagccaaaaccaguuuucuguuguuuuccucuccagcuuguucuuuauaaaaguuggaccuguuuguuuuguucucuaagugugccaugugcagcacgccuguguaauuccugguccuuggagcagacugcggugugcaggaugcccgugcaggauuuggguggcuggaacugacaaacugggauuagcugaccuccugcaggaggcuccaguggccccucggccguggugagaaggagcagagccuugguguguaugugaccucuaacagugaagugaugccuaguucaccgauaccacuugcaguaaccugaaugacugguuauucuggucaggagaaaauagcacugacaucaugugauucuggcaaaguaaaccacauuggaacuuggccuuugaauacccaaggggcuggcagcaaucucagggguuggcugggagccccauugaguucacuaguaaucaguugacugcugagcuggacaagcugcccuaguuuuucugacaagcucugucuaaaagaaugaugggcagucugccauuaggauuuuuaagcagaguugcuaaagauuaacucuuuagcuacuguaaauauaucauguccuucguuauguguugguaugcaaucagaugaaagcuuggagggagguucuaauuccucauucagugauugcaccuggaguuccucucuuguaaaacaaacacccaaaggcaaggaaaaacaccguaaaguucuuuguauguauguuucaaaggaaugccaguggauagguuuuucuugagguuucuaguuugcuuuuuaaaacaaaauacuauaaucuuuaauuauguaaaauguuagauguugcauucugaucauacuucaggaauagacaucaccuaagaaaagucucugaaaaacuacaagcauuuaguauuuacuuauuaugacacauacccauggauuucauuuucaaaaaaacuuuuauuaacucagaguauucuagaagaaaggagguacuauacucaaaugucauaaguccagagaaaccaauucuuuugaauaaacgugacuucucaauggauuuauuugguuaucuuuuacuagaaaaggugauaccuuaguaacuuuuauuccuucucucacauaguuaaaauaaaauauaauugacagagauauacagguugacuuaaaauauucuauauacuguaaucccggugaugaauuugguauguuuaauguugcuuuaaacuggaauauuuccuaaggcauacucucuuuucucuagguaacuaugacauaagcaagggaacaccaaaguucuuugauagugcuucagcacuccuucacaaaaucaaauugagguaguagugaggccacuguggggauguaguagccaaugauguaucauuuaucuugggacacaccugaaaguuuuaauggcaaaagcugaaguuuuggaaaucugucuuccuuuugagcuaaggcuuuaauucugccuccucuuugaucuucccuuccaaaaagcugccuuugagaaaugguacaauuucucucucauguuuaagagguuugugacauuagcuaccuggggacauuauuguccaucagagaacuuacauaaagaaaacaaaaaaagauauuauaugcacagacacugucuaauggauucuuccuguuucccacuccucuuaucuuccuugacucagcacaaaagugcucaacaggccauaaacucaaaagacccuccucccuguuagagcuaaaaauccugcgugauaaccuuucagaugcucaguuaagggcaaauuuguaacugaguuuuaaaacuugguguguuacccuaagacuuaucaagaaaagaagaaagagacucgagggguuuugaacaaggaguuaggaauaggugaaacuuuuuaucauguuuguuccuacugugugggguuuugggggagucagaaaugguauccacaagacuuuggcauuuaugaugauauuccugccuuguuccggaauuccucuauuuaucccuuugcaugaggacagugucaccacugucuauugcuaggcccuaaauuaucucaagaaagggcuuaaggguggugaagggguuguggaauuaccuuccccucucacuuuuccauucucucuucugcccucucccuccuuccucauuucuuuucccuuuacucuccuuccuuccucucuucuucuccccucccucccucucucucuuccuuccuuucuauuuuuuuacaguacuugcuaaguaucuacuauugucagugaaugcacaaugauaugcaauaaucaugauagacguaaacugaggaaguuuauaagauaaugggagaaaacaauuucccaaaucaaaggaucacaaaaaugcacuuuagccuaggcaacagugagacgcaaucuuaaaaaaaaguagaaugaacaauuguggugaaucauuuggugaaaaggcacaugaugcuauaagagcauaaaacaaagggaucuuauaaauaugugagauuuccgaguaauacuauuucuugguaauacuuaagaaaagaaaaaagcuaaaucuuagguaguaucucaucuccaccacuuacuauuuaaacuugggcaauuuguuuaagcucuuugacucauaauuugcuuaucaguaaagcagagauaauaauaucuacccccauccucaguuuauguaauuggaaauacuaaauuugaaauauuuaguugacguacagugagaauuuaaugaaagguauuucuuaucacuaaguucuuauuucagugguccuuuuggucacugaaaggugucaaauucuugcugcuauuugguuuguauauuaauugcaaguguaagaaacugaaguuauacagacugaagugagaaagggagauuauucucugauguaauuuaaaaguccaguuuaucugcagguacaguuugauucagguguucaaaugauguaacugggaauguuucucugauucucuuccuaugccauucucuuuguucccuuacuucucgggcaaagagggucucuuuccacagugaaggcuuauauucuauuagccaagcaaacccaguggggaggaaaauguucccuuccucacuagucccugcagacguuccugggcuggaucuccuuggacuaccccugaaccuguugcugaacuggugcuuucuucucuuuggcuaugcuuaagucuccugccuguucuuggagaggagcuagaggaggaucacgagacacccaaacuacaugaucucagaaaguggggaagaguggcuucccagaggaaaauuauuguuauuacuaacaaaaaguaauagaggccgggcgugguggcucaugccuguaaucccaggauuuggggaggcuaaggcaggaggacugcuugaguucaagaguuugagaccagccuggacaacauagugagaucccauccccacaaaaaaauaaaagauuaguccgacauggugguguaugccuguaaucccagcuacucuggaggcugaggugggaggaucacuugagccugggagaccaaggcuacaggaaggaaggaaggaagaaaggaaggaagggaggggaggggaguggaggagaggggagggcagggcaguuuaggugggaaggaaggaagggcaguuuaggugggaggauugcuaggauggaaggaagggaggaaagaaggaaagaaagaaagaaguagagcugaggugggaggauugcugaggccaggaguucaagaccagccugggcaacauagggagaccccaucucuacaaaaaaauucaaaaguuagcugggcaugguggugcaugccuuuagucccagcuacucaggagacugaggcaggaggauugcuugaguccaggaguucagaguuacagugagcuuugauuaugccguuguacuccagccugggugacagggagagacccugucucaaaaaaaaaaaaaaagaaaaaaagaaaaaauuaguagauacuguguagacaacaccuaaacaaacagggcagauaucuacuguagauuuuaaaaaauaauaagaacacccuguuccugcuuuuaguuuagguagaagugaaacuguuaaugaggugacaucaaagcaugcagaguacccacuaauuacugagucuugacuguaugccaagcagugggccauguacuucuguauuuuauuucugaucuucacagugacccuacaagguaaguauuaaaaucuugcuuuaauuuuauauccagugaaauuauauaacuuuuucaugguuuuucagcuagucagugguggcgguggccuuuggaugcuugaucauccuuuugcccugcaguggugccugugcagugucagauggcccuccugaccuggagcagugcagagacgugccauguaggccuccaugacuggcacauuuuccugugagaaauggaguaguccuuuuuucuaggucagggauuugaaaggcaggacuuuagaauccuguucugggcauggucacugccucucccugcauuauuggauggcgcauggaaggccuccaaccauuagcuggaucugucuguaaaauggugacaguguuaagcuuuugagagauuaaugagucuguuuguaaaguuaaauacauugugcaucauaccagagacagucucaccacuuaauuguggacuguucaaguucucuugacuaugguauaaguccuagucagcuuggguugucauaacaaaauaccauagacuggguggcuuaaaugguagaaauuucuuuucucacaguccuggaggcugggagucugagaucagggaauuagcaucauuggauucuggugagggcucucuucgugguuugcagacagccaccugcuuauugugucucagaaagcagagagagagagagauauagugaaagaaagcaagagagagagagagagaucaggcacauuggcaucucuucuuuguagggauacuaaacccguuuuaacaggccuucaacuuuaugaccucauuuaaccuuaauuacuuccauaaagacccugucuccaaaugcaguuacacuggggauugggucuucagcauaugcauuuucagggacacaguucagucaauagcagggugauauuagugguuuucugugaaccacacauauaccuugauauuucacucuagccuguuagcacugucaguggcaccaaauaagaggguuuggcauaggauguuuccuaauauuugccuguuaauuugggggaaaguaauuggaaauuacucacugaaguucucauuuacagcaaaagcucuucaaaaaugauauggcaaacauaugggcauucacucuacaaauccauguaugagauguguggaaauagagcuaucaacaaagggacugaaggcucagaggaggacacaaugcaggguugauuaggaaggacuucagcagagugaaauuaaacuugauaucccaggguaaaugggauuuugcagggugaagggcagagaggcauuuugguggcuggcuggagcacaguccuguaugaagguguagugacuuccuguaccuaagacaaagggauguggagagcagugggagcuuccucccaucuaaugggucggaguuuagaauaccagugccuugccaaugcaagguauuggauuuuauccuagaggcaguggaaagcccuugaaggucuuauggaaaagggaaaguguuaaaauuaggucuggguuuuagacuggcgaguuuuaaguguaaacauguugauuagagagcuuagagucuaacccacgcugucccugauaucuagaaugccuuuuccucucuaauucucaggaauuagagaggaaaaccacacauuccuguucauugcacacauuugugcaaccacacauuccuguucauucuucaaaacacuccucuagagugauggauauuuacaguaaacucauuucugaccugucuagauggaauaaucacucccuccucugucccacuuuuauaauuuauguguacuuauuauuauuaucauuuuucgagacagagucucgcucugucacccaggcuggggugcaguggugcgaucucggcucacugcaaugucugccucccggguucaagcgauucucgugccucagccucccaaguagcugggauuacagaugugcauuacaacgcccugcugauuuuucuauuuuugguagaaaugggguuuugccauguuggccagguuggucuugaacuccugaucucaaguaauccaccugccuuugccucccaaagugcugggauuacagucgugagccacugagcccggccauguguacuuauuauugcuuguaugacauuauaguauaaucauguguuuacguaucucucccacuacuugaagaaccuugagagcaaaaggguugcauuuuuuuuguugccguugguuuuuuuuuucuguuuuguuuuguucuguccugguuugcauucagaguauauggugcuuggcauaucuuagguguucuuguuuguugaacauaaccaagcuaagacuucugugaaagucaggagagcagcaagaaggacauaggaaagcuuguacugguaggaauagaaagaaggaggcauauuauuauggauguagggagaaggaguugggugugacugugauguuucuaauuucgucaccuggguaaauguuaguuuccuuaacagaggcaguggaagaaccacugaguuuggaggugaguuguucaguuuuuuucuucuagguuggguaggcaugacccaaguguugaugucugacaggcaaaugaaaauacaggucugaauuuagcuguuguuaucccaaaccuuugaagccaaaguuugauugagguugcagagggugauaaagagaaccaggggaaugcugacuuuuagaagaauuggaguuaauacaggagaaugauagugagaagucagauaaguaggaggagaauccggacaccccaaugucauggaaucagagaugagaaauuaggcacaugcugcacuaaucuaggcugauguauggccagagacuuuuaucaugaaaguacuguguaauaauaauaacaguagcaagaacaacaauaauaguauuuacuauuuuuuuaguacuuauuguguuccaggcauuuugcucaauguuuuuucuacauaucccauuuguuucaaacuuugagccuauuaucuuuguuuaaauagauauacaaauucaaauucagagaggucaguaauuugucuaaggccaacggcuaauaaguauuggaacugggcaugguuugugaacuuugauaugcugcaaaguuacuaagcaguuauuuuauuuuuugguggggaucugucuauggagauuguggagauuaaaguuaucgguaaagcuuacuauacucauucccauuagcucagaagaaauguaauucuuuccugcuuacauggaugagaaaguauguggguaaguuucauucauuuugaaugucucucauuuaaucagcagauucagaauguauuagugacuccaauauaucugacugcacugguauaugguauauauuuuaacuuuguuuucuacuauaaggucauuuaaaaaccauucugaccuaucauuuccucuacaaauuucuuaugcuuauguuguacaaacugaauuuuuauauaauagagaggauuauuuaaauaggaaagagaauccugaauaucuuuaagcacuuacuuuguuuagugcuucuauguggaguugcaugcuuaaaagagacauacacaauagccauucuugaaaauauuugcucauaauugcuacacccuuauggauguguuuucauauauaauucaggaaagaaaaauuauugcguaugauagauuaguauuaccacauaauaguacugauuuguguguccuauuuuagugcauugcuaauucucacgugauaacuacaguauacgguaauuuccaugaaaccagacaguuuaauucugcuaccaaugucauuuuaaugcaguugcagccauaucuguggcuucagcuagcccuugugcaggaaacccuccagcagcaaggauccuggcuugagcucacucagucauuuuacucccacaugaugucaugcagcuuaggguuuccuggucuuugaguggaugaacauuucugccuuuuaggcuaucugagacgagguugggauuucuuaggacgaacuuuuacgaagaaaaaugcugagaaaaaaaugaaauacaauaagauaccauaaaaaaauggaugagcacagguuuuuguuuuuguacuuuuuuuuuaaaaaauacccaauuagguaaaucuaaccauagguugacuuucuggcuggacuugaaaacucauuuauuuccaguuugucuucccucaugaaacacaauaaaacaaaacaauuccacccccaaaccugcuccucuucuagauucucaagggacuuaggaaucgggguagaagaaaauggucaagacagcccaccugauuuauuucucuuacuuauccagauuuguuuuggaaucacaugccagcuucuccaccuucaaaugccuuaugaugcagaauauuauauauuuuuugagaagguaauauaaguugcuuuuucuucucuuucaaauaauuaguuaucuuuuuuccacuucauaugcuagaaguaaaacaauaaagaaaccucugggaauuuucauuaagugauugguuuucauauauucugucuuucuaaggagggagggaaggaaugucauuuaaauuuuuaaacucuagucuugaugacuaaaauguucucaaacuugguuaaaucagcuaucucuuuacauaacuauuggauuucuuucagggggcuguuuccuuaccgacauacuguacaaauaaaugcaguuuaauauagauauaucuugauguguuuagauuugguaaacccucuuaucuuucaaacaugcaucauuuauuuaaaaugcauaggcauauguucagaacaaaguuauuuucaguacauauauauucauuagccugugugugaaaguacauuucaaaucacaaccauuucaauauuuguuuuucuuuccaaacuuucuuuucucuccaucuugguuuaauugaacccuagaccugaacucuuuaaagcauuccuauggagccaggguacauuugaaugucuuugacugauauaaaauaauugcuuuguugaucauauacccaugcaugauaagauaugcauaagaagaaaucugguacagaaguauaaauaauacuuaucuuuaagccagcaucugucaucugcuucagcagacagugcuugcuuucuuccuagcacaaaaaggccugaaagauuuauggagcagcuuuguuugugcucugugaugcuuaaucaauuuuuauuaaauucuaaaguaaaacuuggcuuucacuucagugacaucucugauguauagaacaaggggagagaucaugaugcccugaaaaaguuaggcaugggugaucuaaauccccaaucuguuucuuccugcaggacuucuugcaauaacuuuuguaagucugaaggaauccuuguagguuugcaauggaaaaagcaaauacagcccaaacuuuagacuuuucaaacuucuagagaguggauauuuguaauuuguuuuuuaauacucaugcauauuuccauaugugggaaaaaacacauaaauucuuucaaugugcagauaaugugcucauuuugcauucagaaucaucugaaaaauaaagacucacuaguuauguuuacagagaaucuuaaaacuuuugguaauugagguuuaacauauuaaauaucugauagacauguggacucugucgccuuuugcuggcugguuugccuuauaggcuuaacuucuggaauuuuuuuugccuuuucaaacaaauucuucugguugaauaucagcauaugguaggaggcucacucugagacaggauaauuuauaaaugaccauuucuugucuugugaucuuauguauauaaagaaucuagagucaugagucaaauugggauuuuuguucaggaaaaagguuaaaaaauuagacauacaauuggcuuucuuugauucugugucuauaaggagaggaagaaugggauuuaauuuaaaauauauuucugcauugaauacugauauuucuguuuuugaauuugcuuuuuuuuaacaucugguacacaccagacuaaccuguacauauuauuccuuuggaagcauaugguugugggcccugauccaaaaguagcuuauguaucuacauuucagaguguaaaguuucuugaagaaagguggggagggaacaacuaugagauauguuguuaauuauuguuuauuuucuaggaaauauggcaagcuguaaacuuaagaugacaauaucuguuuuuuuuugaauuauguaauaugcuacuuuggagaaagucgauuaaagaaaaauuuggaagccaauucuuacgugcccuaggaaaauuaauaauucaugcagcuacuucuguccuaucagucaucuuuucacugccacauuuauacuuauguauuaugaacugcuguuuuuuuaguuauaaaugccacagguagauauggauguugauacugauauagucuauuuaucuacuuauuaccuaaaccuugaugcauauucuuguauuuacuuagccuugguaauggccugguccguuaugcauacauaacuauugaggcaguuuuugagguucuggaauuauucaaaagaccuggccagaaaugguuaaauggcagguaauugccgaauacauuugccccucauuugccuaaaagguauucggugccugaguguauucuugccaugugcuuucuuucucagcugcggcugauucagaaagacccauuggaauuacugugagaguagagaagaaacccugaauuaccaaaaugaagacagcccugcucaacuugauaugcaaauaagcuuugaggauacaguuuaguugguccuggcuuucuaaccucagagcuccaucuuacgcugucacuugccaaugcuacuucauugugauacuugcagccuacaaagcuagagaguuugucugcuuucuguggaguaauuuugaguagaugaacugaggcuugggagaguuugccaaaugagguggugaugauggcuaaagagacuuggacuuagggagugcuuucuggcagaaguacaacgcagacgguaucauguuuuugaccaugguacuuuagacaugcugccaaguguuuguaacgagauagggcuguuacuauacuuugcuuuuaacuuuacuuuugcauacaguacaucguucuuguuuuauaaacugugucgcauacuuuuuguaccucuauaaacaagugaagcuguugaguuuuuggauaaaguuugaagcagucuuguguugcuucuucuuugcuuuaugcuccaaguugagagcugaauaguaagaucuuuuuucacaccauuuauaaugcgaugcacauuuugaaggcaauuuaaauucuuuuggcuccccagccauaugcuucaaaauggaagcauuaugcaugucugaauaggggacuagguaggaaauuggaguauaaagauauauggcaggauauauaguaggguaauauuaucuauugagagagagggagagaaagagagagggagagagggagagauggggacagagagauuaauuucacucucuaggaauuuuuccaaacuuuaggcccaauuuugcugaagaaaauuuaaaauguuuccauaggcuacacaggaacuuuuauguaugcaauuuauauauuuaaugaaauuuuggaacuugaccaguguauuauuugagaaauuggcaauauagucaagaguaauggacuuuaagguauaauuuuuaauggaaggacaaaacuaauauaaguggaaaccauauuccucuucuuuuauuacauuuuuuacucauuccuuuuuaugauuuuauuucucuucauccucaccauccccucuaaauuuucuucaguuuguuucuacauuggaaaagugaaauguaauguucucuuuaacauauaaacucuugcacucucucccucuggaggguaucuuucacuguuuucauaauuuauucugcuggguagaaaaccccagauuccuccaauauucugaaaauaauuuguacuuuuuguagauagaaauuuccuguuucgaagcuucucucauuauaaucguguaagguucuugugguuaugccucauugaucacauggauaucauuauaaaauaauuuggcucauauuuggauuuauauguuuauguaucuuuaaguuagaacagagauuccuuucucauucuuauuuaaauguuguuuucuuaucuuuucucuuucuguuuuccuucauagauaauaagugacuuguaguauuagaucauacacaacugguaguuucuucuguaacuuucaucagaaaugaguauugugucuauccaggaguuccugcacuuuuuccugaaggaaacaguuuguauguuaaguauaccucuaaaccuuauucauuugaaguaauagucuuagaacauauacacaugccauuuuccucuuuuccucucuacaccguggauuuggaaauuauggaagcuuuuuacaaaaagaccuaaugggauuuauguguuauuuucuuugugaccauugugugaaaacaguuuucaaaguuaaguuacuguucuccuguguaacauugugaauacaaaauacuacaaaccuuuuugguuaaaugauggaggagaaucaauuuguucuuuaggacaaauuucuuaauuuuaguuucuuagaaucccuauguaaugggcauauuaccgacugcucuugcagaaucaaauguaacuccuuuuccuauuauaaacuauauuguauaacauaacagcuuuugaauaauuaucaugugauguacuuucaccaucaguugaccuuaugcuguuuaggagacaccagggaguccugggaauuaggaaacaaaacagagaagggaagaaaaaaaagcaggaacugaauuuccuucauucauucauuuauuuuugagaaggguggagaagcccacagauuuauaucucgguugggugaaauuguguuacuguuuaucuguaccuuuuucccccuguggcaagagacguggagaauagacacucacucccaaagauaccaaguuccaaagcacugagucaugaguccacaaugaaauacuaggaugcagccauuuccuaccuuuguuuggaaaugaacugauuggaccaggcggauguaagcccucagcugcagggcuuuacagaaggaaaugcuuuuggucucucuuagguacucgaugcuguucuguaacuucuuuguauuugacugaaacaaccaaugugaaaauguuuccuagacuauauaaaauucagcgcaugcacccuucugucuguuugugcacauauacuuuuuaugugaugguagggaaagcaucaacugcuuuuaaugcagugaauuuuuaauguaaccuuacguauuaaacucuucacaagacugucucucuugaguagucucauuuauauuuguagccccuacuuuuaguggugacuuccaggugcugugugaucugacccuugccucccucuccccagugagucacucugccugcccuuucaguagcagcaauacuaccaucccuccaguacagcugagccucaggcacuuugcucugucuguccuuucugcugggaaccguuuuuuucucagaugaucguagguagggcuugcucccuuaccucauucagaggaagacuuaaauuacaugugcccccaaaaucuccuaccacuccagcuaccacucucuucuucccaggucuuuuucuccuuacccugcuguacucuuugccccauagcuaccucacauauuucauauucauuuguuucuugguuuacuguuucuuaccccuccuagaccguaagccucauguggguuaggacuuugauaaucugcuguuuugcccagaacccagaauaugguagaauacacacacacacacacacacacacacacacacacacacacacacacacuguuauaccuagcagggugaggagcuuacacacacacacacacacacacacacacacacacacacacacacacacacacuguuauaccuagcagggugaggagcuugguagaucaauaauaaauguuuauugaauaagaaacaauguagaucggcaagagauguugcugaccucuuauauugggcuauuugggaguuauuuaacuuuuggaugccucagcuuucccaucugguauguggggacgagauuuugcauaccuuggaagcauguugggaagucugauuaauaaugaguaguaaucaugagcagugaaaagaucagacaccagcucuguuuaaugagaagguacauagacauaaugaagagcuuuugugcucagugggcaaugguauaucuuagguggccaagcuuuucccugugugugcuggccuucggcacuuuuuggguguuagggauuuugaugaucuucugaagauggaugagaagagggcuaagaauggcuaaagcuuggagaauaauuuggggagucacaguaaaucaauaggaugagauagaugaaagaaauuggcucuaaagagagcauuggaaguuuuagauugucauauuuaccaccuucaguucucagaccugauaguuuucagugacguagccuuuuaggaauuucagaagugugauuuuaccuugaauuuauuagggcuaaauucaauuguuuauguuuaugcaguucauaauuuugcaguuuaguuuguguggguuaguggcccuacuguucaacuggauggcaaaucugugcuaggaggauaccauaugcacaaguauuuucuuaaauaauguuggcguuugccacugguguuaggggaagaagaaaaaaaaaugagagcaauucuggaagcccuccaguaagggguuaggaaagaacuuagggacaaaugcuccuacuuggaacacaacaccaaauaguggcuuuuuuguguuuuuauuuuuuuuuuuuuaaagagaagccaaaauuaaacacaguagaguuuacuguuugcuaaucagcauguguuuacuuucucuuccaaaacugaaguugccaaccaauacauuuccuacccagugcuaugaaucuguccaaauaaacaugggaaguagugaaacaaugacaccacaugaaaaauauauccuuauucauuaaauagaauccaaaaaauucucuggaauuuaauuguagcaaugacgugaggacugucuggucuauuaagagaggauagugacuucccucuucaguuaguccagcacggaugagugugaucuuaaguggcucuacaauuccacaugcaucguccuaaaucuagauacaugaaaauggaucauuuccuaucaaccccucacucacacccguggacucuagggcauuugugguagaguuuuaugguaauuacaaacauaagcagcuugucagaauucaaauaaucaauuuuaauuucugucucaaucacuaaagauuacugaccacuaugaugaaauuaaggagugcuuucucuggagauugcaaacacaagggcagagagaaguuagaagcuucuauuuuguggucaguuuugaaaaauacagucaaaagcaguagccauaaucaacauuauagagaaccuuaaauucauaaagaugccaauuuagcuauuagugggcaguuccauauaaaacugguagcuauaaugcguacacaugucuuuguuaaggggcuuuguuguaggaauggaagaugaggguauagugauuauuguguuaugaucaaugcuauuauuuaaauaugucuuuaaaaaauauccuguacacucuugauacuggagcccagccucuugucuuccaucaaaaucugcuuuuaggaaauaaugcaauaucaggcauugauucuuuauugugaguuuaaauacauaauggugagcuugcaguaguaauuguguuaaaaacccaguggguaaaguuucauaguuaaaguucaagccuuggggauaagugguguuucugauaaggacaagcauuccuucugacaaaacucuuacugcccagguuacuauuuuuuucuuucuuguacauaucagguccuagugaugcuucuggacgagccucaaaacaaaagguuguucauucuuugaaggugauuuagcaccuaauuguaauucagcaguacgugaagauuagaguuguucuaucuacagcaguacaacagugcuuuuuuuaaaaauaagaaauaaauuaacugaacaacugugcuucguaauucuuggacuuagguaagugacauauaaccaaauaagaguuguguauaaaaccaagaugauagcccaugaaaacccaaagggaucuuuuagggugagauaguauaugucaaaguugucaggcaaacuguauaaacuugguuguugccuuuauuaucuauucuaaucauuuacagauaaggaagcugaggccuucagcacuaaggucucacacaggcuuuuacagcuggugaggaacaaggucggggcuggcaauacugggaguuccuaaacacaaaaggcauucuccucuaucaguuugccucccaaguuuuaaaugauguccuuugaacaucagaucgccuuuaucaaaaaauuuuuaagccugaauuuuaaaggaaugagauggagugaauuagugugaagucuuuuuuucugagcuugguguuuauucuuuauuuuguuuucaaucguauaacauuuucuguaaugucccauuugaguaaaguuaucauuauccucuauaggcauauacuuauuaaguaccuaccaguugugaaacccuaaauaguuaagauugccacauuugaacugcaagaauaaugaaugauuuaaaagucuaaaagauuugguuauucaacauuuguucaaaaagaccaaaugagcauaugugaagcuauuuuuuuuuguccccugguugauccagugauuucaccucacuauuguuauucugauccucuuggaucugguuuuuaaaaacguauguugaaauaguuaaaacauacccaaaaaaaaaaccaaaaaaaaaauuucaacgaacaaaugccagcaccaccaaguuuaagaauguuuaauaaaauuuuaguuaaauugauguaaauuaaauuaaaaauaugcuaguuuuacaaagcauaacuaacaaaauguuaaaaaaaagaguagaccaagugcaguggcucacaccuguaaucacagcacuuugggaggccgaggugggcagaggucaagaguuugagaccagccuggucaauauggugaaacccugucucuacuaaaaauacaaaaauuagcugggcgugguggugcgugccuguaaucccagcuacucaggaggcuaaggaaggagaguugcuugaacgcggaagguggagguugcagugagccgagaucccgccacugcacucaagccugggcaacagagcaagacuccauuaagaaaaaaaaaaaaagaguaaugauaauauaccuacaugccuccucuuaucaaucucauuccuucuuauccuacuacaccaugagguagcuucucucuuaaauguggugauuuuuguucuaguacuuuuauugcauguacuucuguugcagauggguuugugaucugguuuuugaugcugagaaugcuaaucucucucugccauccaaucuagagaguaauccucugacauuuuaccuuaggauaauuucuccuagguuugacuguucaauaagucacaggacugcaggcuucaauccuggauuuuccaagagucacagaaguuagcucuaagucuccuuuccuugacauguaacacaauaaaacaaugcccuugacuccuguuuugcuaauuauaauugauaggugcuuucuauaaguaaagcaucuauaaguaagauguuauauaaauuaaacaaaaauuuuccuuuugaauauuggaaugagugcugauggugacaaaacugcccucagaguuauuauuucagaucaaaauugauagacuagaauuaagcuacaauauuucagcucagacuacuaguuaauuuugucuuuguacauaugcucaccuuucaauauuuguaguuugcaaacaguuauuaaagaauaauagcaaaacaagucugggcccagugguucacgccuguaaucccagcacuuugggaggcugaggcgaguggaucaccugaggucaggaguuugagaccagccuggccaacauggcaaaacccggucucuacuacaaaauacaaaaauuagcugggcgugguggccugggccuguaaucccagcuacuugagaggcugaggcaagagaauuugcuugaaccugggagguggagguugcagugagccgagaucgcaccacuauacuccagccugggcgacagagugagacuccaucuuaaaaaaaaaaaaaaaaaaaaaaaagaauaauagcaaaagagcuaaauacugggugucagacuucaccaaagcucuuuaugguuaaauuguuagauguuuuuccugaaaauuuuuaggaucacuuucugagaaauuccuucacaucugaaaauuucagcuuccaguuucucaugaagggauauaaauaguuuaacuauuacuuacauuuggaaauaaaauauuuaaggcaauauuugugugauuuugcauuuucaacacaacguacuaucuuuauggcuaaacuacaugucuguaagagaucuuuugaagagcaguaaugacaucaauuguuuaggagguaccacgaguuaaacuuucuguucuuugccuugguuuucuuaaaaaguggugacuuuuugcucuauccuaucaagagcaagugcagcauguguuagaagaaggaggaagccagaggcagacccgcccucuugaccugucccacugagcaugccaguuugcuagaugggcccuggccacuguggacucugcuuuagagaccucugcaaauagguggugggcacuccugauuucuuugauuauagacuaggauaguuacagacuauaguacauaggcaaaacaauugaaauaaacauuuaaauaaaauaaguuaaauaguucaacucauuauaagaacuugcuacacuuuaggauucuguaaaucacuuaagagucauagaaaaauauaaggauucugcuccuuaaauuucucauuugaaaguuuccaaggugaaaagaauucuuagaaaagaauuuaacacugacgcugauccuuagcccucuaauacuuuaaaauggacuuccagacuucguuucucacaccuggcaaccuuuagucuuccugucucccuugucuuaacaaguuccaugaugugaaguaaaucugauggcuuuuguuuauuuaauuuuugcuuuccuugagcagguagguggugugucaguagcugaguaucuucuuuccugguggcaaaugauuuagaagaauccaggaccacugugcauuuggugcguuuugcagcaggaagacaggcacacacggaguuaagcccauggcugcucuguguuaacugaacauucccagugugacggggucguaaucccuaagcagaugcuuuacggggucucauuauuguccagaaguggcucuuguaugagaaaaagcagccaugcagaaaaggcacaaacacuauugacuugcccaccauggcauacguuuuuuucuuccuaacauccaugaacccauuucauucuuaccuagccauggugucgcuccuucccucgcuacaccuuuaacucauuaaaaaucaaaaacagaacaacaacaaaaaacuagaguaaaaucauacuguuccauacugauaagagacugcgauuuaccuuaggaucuuuugagugugguguuguuggcgaagaccuuguuucuuucccaagucuuucagccacacuguggccuuucaaaaccuuuaaguccuguaauaguauauuuugugaagaaggggaaaaaugagauuuuuuuccuccuugcuuuuguuaacccauucuuguuuuagacuccaacaaaaaggguuuuuguuaacuggagcuuaaaaucggccagcuugcaaaguauucucucuuuuuaugcaaggaggauuagcuugacauguuaugcaguucucuuguaggagccauucacguguccugucauaagguguauaauuacugcacuucaccaucagcaaucauucuuaaguuaaaaccuguuuuaaaccucucauuaauauaaaucauaccagcaagguagaaaauauaccuucaaaaagaacgaacuguuagggaguuaaucuguucuuuucauaauagaccuggaguaaauaauuuuuacuuagcacuuuucuuucuaugcaaucaaaauaguuugugauaaaagaucugguacccgggauugcauaaaugugcaguguuuuauucaggcaggauugggcuuccugcuuggugccagccucguuuucccucugucacccuugaacagugaaguguguaauccuccauucuuuuacagucagcccucugacaggacugccucucucucccucucucugccuuuccuugucucucucccucucucugucucucucacacauacuugcucauacagauaaauucaggagcaaauaguuuuucuuuucagggcuuucucccagugaauucucccagcaugcuuagauagcaaucugaacuuacaaacaaaugucucaacgaauauauauauauauauauauauauauauauauuuuuuuuuuuuuuuuccccauggaaaaacuguaggccaaggacucagauaucccuguuguauuuauuucuuagugguuuguucuagugacagaguggcagcucugccacuacagcuugggauccucaguuacucaucuugcgaacuccauuucuccgcucccccuuugccuuucgccaccagaauccacaugccacugccucagaacuguucugagggaugauuguggaaaguucaauccaagcugggcuuuccagggcaguaggcuagucagucucaggaaaaaugucuccaauucuuugcacauugugaaaggcccaguuugaucuggauuuuacccaccuuuccaaacuuguuucucacuuuucucucuggaacuucugccucaucgucuguacaaccugcuuccucuuuaaauuugucaaaaagugcuacuuuuuucuaccuaaaugccuucacuucuauuaaucccauuuccuccagcuaauuuuuauucacccuuuaagucuaagcuuaagcuaaucuuccuuuucucuuucauguauuuuuaguuaagugcguacuaugugccugaaauuauucuggguucuugaaauucaggguucauuuggauauagacuauaucucugcucucaugggacuuacauucuaggagaagccuucaacaaagaagucuuccuugacauuccauucuguuagcgcccuuuauuuugcauuucuguugcucucuaaguuucuucauagcauuuuauucacucuguuaaacaaauauuuguuaauacccauuggaaauagucauauagcuuggacaaguucugccuucccugaugaacucaaagcucuaugaggacaugaucucugacauaugucuauccaggaagauagaaggcaauucauagaaccugaaugaauuaauaaaugaauggcuuucucccuguccccaaauauuauaauuguacucugccugaauuauuuuauaccauucuuuuauacugucuuaaaaauaccacuaauuagaaauucaucaggucaggccaggcacaguggcucacgccuguaaucucagcacauugggaggcuaaggcgggcugaucaccugaggucgggaguucaaaaccagccaugaacgacauuggagaaacccugucucuacuaaaaauacaaaauaauuagccggacaugguggcauaugccuguaauuccacuacucgggaggcugaggcaggagaagcgcuugaacccgggaggcggagguuguggugagccgagaucgcgccauugcaucugcuuuucuuuaucaccuagcagauguuaguggcugcaggaugggaauaaaagucagguugggaggggauauuuuuagagccuggaacagagagaggucuaagaugguuggcucagugagggucuugcacugggcccugaagcccggaagggaagguggagaggagugcaaaugaugaggaaauuaagccuggcuuccuucaagaauuuauguaaagcugagaacucuguuucuuucuucuucuuccucagcagaaaggaagagaguuaaaauuaguaaagauuuuuuuaugugccacaaacuuuacauacauuauuuuauuuaaggcauuauuuuaucuccaguuuauauuuaggagccaggccuuuuuaauuccagaauuaguacauguaaagcugacacucugcagccuuuuggugcucaauuaaugucuacugaaugaaugaauuuauuguagaaguacuugaucucccauuuggcauaauucuucauaaggccaucgucuuuagacucagaauuccuguugguacuauugguaugaugguugaguugcauucaggauugaauugggcuuugcgugcugguguaacaaccugaucaccuaauauguuauugguucaauagaauucauugaguuccgaccauuaacuuaccgaugagcuuuuagagcacgaaucaauaguaaguuggagauuaccuguacgugaauguagaaauauuauaaaaugaaaucguauguaguugauuuuccugugauauuuagggcacuucuuuucucauacuuaguuuaagugaauuucucuacuacuguuuuuuuuuuuuucccuguaaaccugcccaaagcguuuuuacaaguaggugguacauauaauaaugauuauaauaaaaacaacuaccugaaaauuuaaaaagaaguaaaagagauaaaggaauuucuaagauuccaaaaagauaagaucuuuuuauguguccccauuucauauugagucaccuggaacauggcauuaaauuaguuuugguuuggguucaugugaaagagaaaccacaugaguaacacacucuaauaaaauuaaaauacaguuacaaagagacaucucagauggacugaaaaagccaaacagucagauccuuucuuacguagugguaaagccuggcuagaaaggaagcuuuuucauuagaauauuuucaaaaucaagcauaccucaauuugcaagcaauuugaauuuauguggaauuaauauagcccaaauaaauuaaaugaacaauuaaauguuuacuguuuugaccacuaaaauggaguguggcuuuuguaaauggguucgaguggaacauuguauaguuuagaugugggaauuacuauuaagaaucguggccggaugcgguucugggaggcuuugggaggcugaggcggguagaugaccugaggucaggaguucgagaccagccuggccaacguggugaaaccuuaucucuacuaaacaugcaaaaaauuagccaggcgugguggugugcuccuguaaucccagcuacucgagaggcugaggugggaaaauugcuuaaaccugggaggcggaggcugcagugagccgagauugcgccacugcacuccugccuggaugacagugagacccugucucaaaaaaaaaaaaaaaaagaaucauaaaguuuauuauuucaauaaucuaauaucuuugaugcauaugauucuguuccuauauaauuauuuuuaaagucaguaguuuaacacaauagcuuuagauuccuucuacugguuacuauaugucuucaaaagauagaaaaugcaaaguuguaugagucaucugauuaaaggaagaguaaaugaauuauuaaugaguuaaaaauaaaaacuuggauacuugaaaaugauguugaaguauauaaaaauaaauuauguaaaauugauuuaaauuaacaccauaauaagacaugaauuacuucaaaauacugagagguugaguggcuggagcuuagacuccagagguucagaagguuccucucugcagcuaaacagcaauauuaacuugggcacguuauuaaacccauugaggccucccuuucuucauuuguaagauggaguugaugauaguauccaccuugaugauuuguauugagaauuagagugaaacauugugaaucuuguuacaaaaagcuugcuuacaauugacauauguaaggggugguuauuaucaucaacaacauuggagaaaauaaauuuuuuuuaaaaaaaccaugauuacaguaccguuguaaauuuucaugccaguauucauauuacuuagguucagggaaaauaacuaauucaugaaaauccaaaguaggugugccuuucuccauaguaugauauauuucaagucuauggagagauauucaagaacaauguuuuccaauucauugguuuuuaaaaaauucauccaugcuuuguuuauucaacagauaguuuugaguacuuccuaauauuucaugcccuauacugaccuagaaaugaaaagcacaggcucuauccucaaggauaucacagucuaaaaauaagaucucaccagcaaacugggaauccauuuagacaaugauagguggcagaaaucuuucaacugauaaauuagcuuuuaaaauugguaguaguuuucugcacauguuuagaauauauuucuuuucuuuuacuuuacuuuucuuucuuuuuuuuuuuuuuuuugacacggaguuuugcucucguugcccaggcuggagugcaauggcgugaucucggcucacugcaaacuuugccuccuggguacaagcaauucuccuguuucagccuaccaaguagcucggauuacagacaugcaccaccacggccggcuaauuuuuuuuguauuuauuagagacggaguuucaccaucuuagucaggcuggucacgaacuccugaccucaggugauccacccaccuuggugucccaaagugccgggauuacaggugugcaccaccgugccuggccaagauuucuuacucucuuccacaacuuccccacccaugugaguuuaugauaaauugggaaaccauuuggaauccaaacaaaaaaggugauuuuaauuauuaguccaucgaaaagacagaauuaccagaauaacuacaguucuuuauuucuaagguuucuuuggcuguauuagucuaauauuuauuuuuaaaaugugauuagcaauuaucuggacuaauuuuuaaauauaugcuuauauuaauaaagcucauaagaaguauuuuuuaagacuaauaugcuuauauauucauugcuuuuuuuuuuuuuuucugagauagggucuugcucuguugcccagguuggaguacaguggcaugaucauggcacacugcaggcaccaccgcaugcguucaagagauccugucaucugagccuccugaguaacugggacuacaggugcaugccacccugcccggccaauuuuuuaguuuuuguagagauggggaucucacuauguuuuccaggcuggucucaaaguccuggacucaagugauacuccugcuucagccucccaaagugcugagauuauaggggucagccacugugccuagccucauuguuuuuguugauggucguuuuaccuaauagacuuuagccaaaaaaaaguuauccaaauauuguuuauuagcuuguuaaaagggagaugauccguaucucaaugaauaaauauuuucagccuguguuacaaagccaaauugucaucauuuagauuuuagaaaaaaaaaaaugcucuuuaaaauguauaguacauaccuucccaauuaauuauucuguuagugcuguauuuaacaaugacagggaauuaaagacuauaauaauuaaaucugaauuaguguuaaaaauuuuaccugaucacuguucuaaaucauauuucaaugaauuuuucugaaaugugauucauucagauuucaaaaggaaauaacauguauuucaucagaaugacaaaauguuauauauacagucagcauaaaagaaaaaaaucauuaaaaaacauuuggcuuggaucuuuaaauauuuuguucuguauuucuggauuuuuuuucuuuuggcucuucuggagaauuacaguaaaguugagagugaauccugauacucugauagagucaaaucucccuuuaagccccaugccuaugcuggaaaacuuacuauuacuuucuauaucagacuuuaauauuauaagcaaugaugauuuuuucauguuguuucuauaaaaugaaauuuuauccuaaaucuaaagucauuaaaccaaaaaauuccaggcacaauccaucacuucauuucagcacaagcucaaucauugcuuucaaaucuaucauauuaccuauuuucuucuucuucuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcaccuauuuucuucuugaggaggaauguaguguaaggaugaaccuaguaccaaacaauaacuggcuucuuaagaaugggauuuauauauuuuuuuauagcauucuugagauaagaagauucuuggauauccaaagcaaauguauuuaaaaaacgagguuacaguuuuuguucuaaauaauaccuucuguucucacuuauaucuggaauuuuaaaauguuggauacuuagaagcagaguagaauggugcugagguggggagguggggaaaugcagagaucuuggucagaggguacagaguugcaguuuuguaggaugaauaagccuugagauuuaaugcaaaaguugaggacuauaguuaacaauauuguaauguauacuggaaauucgcuaagaaaguaaaugucaugugcucuccuauaagaaaagguaaaaaagccaacagguucuuucaaagaaaaauuuauaaaauugagaaaccacuuauccucucagggaagauacuguauuccuauuuuaaagguaaagaaaauacgacaauggaaaauacagucguuccaugguauuuugggggaauugguucuaggaccgccccaaccccaggccccacuggggauaccaaacaccauaaugcucaaguuccuuguauaaaauggcauaguauuuguauguaaccugugcacauccucccauauacuuuaauucaucucuacuuacaauaccuaauacagugccuacauaucacuucauuugaguggauucagcauaguacucagugugcagcaaauuggaguuuuacuuuuuguaaguuuguggaauuuuuguuuucugaauauuuuuguuccaugguugguugaauucauguaugcggagcccauguguauguacaucauucuggaagagacuaagauagggcagaacauccaacugugauccucuacaccuugauuuuucucaggacacuuucaaucuaaauauucucuuuaguucuuagcuguuauguuuuagugauaagaucaucauggucuuccaauauuagggauauaugguuucuacacagaacaucauguggaaacugaaaaauagcugugaucuuagugaacagaagccucagcaaaugauggcacaauuuucuguguagccuaucacuuguuuuccaccuuuuuguguauugaauauggccuucugggucagccagaaauaucuuaaaagcuguuaauuguucaggcaaacauaauaaguguggggacuggaaggcguaauuggacgagggacauuuuacuguuuguuuuauuuugaugugaccuuauuucuuuuaauauuguuuuagauuauuuuggaaggcagggggaauccuguuugcucaagggacaaaauuugagaagauacacaggacagcccucagugacuucuuggccaacuagaguguagugggcgguuaggguggcugauaggauauaguguggcugagaaggaaacaaaccguugcccuugaggagaccagguggauuccuaguauuguacuucucuaucaaucacagguauuuccauuuccuucuuagauuuugauuuaguauauuuagaggaauugagcuagagcugauaagauuuuucugcguuugcauuuccuugaaauuagauuggccucuaaccagucauguaacacaucuuccccucuucuucuuccucuuuuacacauugagggaaaacaugauuucucaaaaaauuuaacuuuugauugaucuccuauugaauugcacaagaggagaacuugagguauaaaaagagucaguguaauuauuaaauaauuagugguuucuacauuuuuauagacaaaugcccuaaaaaaaauuggaaugcuaauuuuuaagcuuuguucuauuuaaauuuguuucuaaugggugagaauuggacuugcuaaaauuauuacaaauagauugcaauucagaaaagcaaugcaguggagaaguuauuaguaucaugagucugaacuggaguauuacguaguagucacuuaucaguaaggcgaggacaaggucagaguagaucagcucagugaccugcgggaaucauaagugugccccugcuauagauuucugucaggaagucccugcucuaucaucuaagcauagcaacuacccucccugagcuuuuauuuagcucaagcuuguucaacccauggccugcaggcugcaugugacccaggaucgcuuugaaugcagcucaacagaaauucauaaacucucuuaaaacguuaugagauuuuucuuucugcuuuucuuuaaguucaucagcuauuguuaguguuaguguauguguggcucaagacaauucuucuucuaguguggcccagggaagccaaaagauuggacaccccugauuuagcugcauaagccacuagauagaauuccagguaaugucuugagggagcaguggaaagaagaaauggauuaauguugaguccaaagaguaggaaagaagggguguuugagcuggucugcaaggaauacggauuucuuuuucuuuucuuucuuucuuuuuuuuuuuuuugagacaggaucuuacucuguugcccaggcuggagugcaguggugugaucauggcucacuguagccuugaguucccagggcuuaagccauccucccagcucagccucccaaguggcugggaccauaggugugugccaccaugccuggcuaauuuuuuguagcaauggggucucacuuuguugcccaggcuggucucgaacuccuaggcucaacugagccucccauuuuggccucccaaagugcugggauuauaggugugaaccacugugccugguccuggaaugcagauuucuaaacuuaaugaauaaagggacagauuuaccuggaaauuagcuugggcaaaggcucagauuaccaguuuaccuggagcuugaggugcaugaauuagugucagguaaccugagccuggaauccaggaaaugacccuuaaggacccugaaugccaucugaugcaauggauuuccucaguaggugcagggcuuguagaugagggugcaggaagucuuaggggccaucuuagaauucugccuuccaugguagauaauggggaguuucugccaguguuugaaaaaggaaguuacauguuccaagcuguguucuugaaaguuaguauuagugggauguagaaaguguuuuggaaagaugaacuggaaacaguugacaagggaggaagucuuugcaauaucaaaagaucugagagcaccagugcauuggaaauggggauccaaggaucaaaaagaggacaacuugcuaccuucuaauuuaagccaagauuugcuuccuuugugcuuugcggagggaaagguaaugaaggguagugcuaagcagacaggcucuucaugcuuucucuuaaacagggcagccuuuuucuaacacccucauuuaauaauugagauauggugguucagaaagggaaaaugacauaguuaccagaguuucuaagcuuugccaacuaugcaguuuaguuugagaagagaugacucacugguaaagaaugauuagcuggcauacagggcauaagaagggcagcuugcucaauuauacuauggauuccaagggaggcuggggccagcuuggcuuggaauuugucaggacagcuucaugggagaaugugggucuuacccuggcuguuaaaauaaguuauggagaggacaugagcauuacuuaaguaaaggucagaagacaggaccagcucugugcaaaauuggggagucagauaagcuugaggggcagugugguauguggcugugagccuuggggucuuauauacuugagcugugugacuucgggaaacauacuuugucucaugagccucaguuuuucuaacuguaaaauggagcuaauaauaaugcacauauaaauacaaaauaauuauuucauggcuuaaaucuagcugcguauuacaaauauugugugauucaaccaaaucuauuuauaccuuauagaguucuuaugauuucugugucagauaaugcaugucuagcauaguuccugccacuuaaucaguauggcaucuuaguaacuauuugcaauauuauucaaggaauaggaaacuuuggaaucuggaauuuagguagagcgguuaacuuuuaaagcuggagaaggcuuuuacuuugcgauauggggaaguagccagguuguaagggagaggauguugaauuucaagugaaaugugggaauaucaacuagaagcuggggucggaggggcagagacuccugguaugucaacauuuggcuuggcuugaccucaggaugcagaguuuaguaucuugcugcugauggaggccuuagaggaguucagacuuuucgggugagggaguagaugggcuaguagguaggauauaacguaguucagagcagaaaacucuccuugggagggggugagaggaauaggaagaagaugggaugugguguguguguguguguguguguguguguguguguguguguguguagggagauugauuucacuggauauagagcagaaacuucgggugguggaaccucaucugcacugggcugauucuuugcaguucuuccugaggaaguuacaccuugaugaaggggguuuucugaaugggaaauaagggagagggcaggaggaagaggagaaagugaaggggaggugaaguuuacgagguugagagugugggauugguggguauaaaaagaugugagagcuaugggcugugauccacuguugaggagacugcaaguccagcauccagagagauagcagagaagaaacuggggcucccaggcggggcuccugguuucuuggugcucuagguauggucgaaagggagccccaugcccagaacuauccugccuugugguaaagaugccucucaauaauauuuggagaaugccaugucuuuccccuaguacaauacauggaagcagaauucaaagcaucucucucuaagccuaugaaccacaacaagggcuuuaaaauagcuucagauaggcaccuuugccuuguuuaugaagcguguacuaauuagaguuguguuuucuuugugguauaagccuuugcaauggaucuacauuguccuuguuaucaauaauaacuaaugagauuaaaauuuaaaacaggugucugauaauccuugaugaagagaauucaggggauauuguuccugauuuugcuuucucuccacuuggaaaggagguggacgagcccaucagaccacagccuguugcuaggaggaaauuccuuggcucaacaugcagaaaguguaguacgccuagauuacaguuuaccagggacgagggccuguugcuuugaugcgcucccaagacuggaguuggaaaaguuuuuuugguguaguuccauccucucauagugaaguucuucauuuucccagggauggaagcuuuguuauaagagucccaguguagauucugauguaaugauucaagauauuggcuuuccagaggauucuuaauauauugcuuuauucaccauagcuuuaauuccauuguguuaaaaagaauaugccacuuucuugucaucugaagaacucuuaauuucuuauaucccaucaaauguaguauuauuugcucaagcuuucuuuccaaauuuugcucuggaguguuuguagacaguuacauuuaucucuaacauugcucaccauuuaguaaaagaaacaaaacaaaacaaaaugccagcaaaaguaacuccuccauaaaauacguguaaagcaggaauaacaugugaaugaacaaaauccuggcuugaaucuguucuuuugcaacaaauguaaugcgguuguaauuuugagaaaagaagccugcaaacaaaaauaguuaguaguuuaauuuuagguuuacaguuuugacauuguaacccuaaauuacaucguauuuggaaaaaucucuucaacuuagacuuuuuuuuuuuuuuuuuuuuuuuacccuagugcuacaagaugacucuauauuaaaguuucucuggagauaaaauagcaauauuugucaaucuauauaauaguuaauauucaaaguaacguaauuuaucugcaucuuagauuugcucuucuuguugaaaauacugguaguuuuaaauacguagaaucaaaaacaaacaaaugcaaaacuccuuuaaacauggcagauagggaguugugagaggcugugccaaacuucauaaggugcagcauuuaggagagaugaagggcuaaagccaucagaguuucuaccaaauugggugaucuacaugagcuucauuagccaccccuuaaugaagagccagcacugaagaaauguuuuugcagcaggagaaugaggcaacuauuuaaugguaucuaguuaaagccagaaggagaccaugagaggaaugauuuuaaguucccuagagggcaagaaguguuucuccaugugguacuucgaagaguaagguaaacaaauagguacuuaauaaaugucuuuugaugauggagaaguuaaaaggaggguacaucaauaacugaaauuaccuggacuuaacaaggcuaaaaguuaauagaaaucuaggcauccacugugaucaaggccaaugcauuuaaauaaguccacuuccaauuucagcuccuggggaaaagaguacauuucagaugccaaacccccaaccaaaucugguugguagcaauaggcucuuuuggcccuugguaaaauucccaguaauccagauaccaaaauacacuauuaaauacugaagaaaauucauuuguucauugauugggugacaucuauagucaucagucucucaggagguuagaagcccaacuuggaguucuacagcagugcauugcuguuugccaugcaccuucagcgucucacauuacuguaugcaaagucuuuuucaagcaccugauaaaagcuguguuggcuuagacagaaugccaguggguggaaucuggguuuuauuggugcuacuugagggaaaacacuuaguucaggaaggcacugaaaacagaaacaagguuuugagguuguuauuuggagucagacucuugaguauaucauggaaacaaaagaauuuuaaacuuaaaaaaaaucauuuuauuuucuauuuggcuucaauauggugauaaugucugucccuauuuccuguacaacuggccuuuuucuucaguauuuuuccucugggaaaaaguaugccuuccaaauaccaccuuggagcucucagcucauuauucuuauucccuugcuaggcaaagcaaccacugccuucuuaaaaguucgaugaaaucuacagaguaauacaggaacucccagcaaacacggaagaaacugagccugggauggaaaguacagcuuuacuggcaaaggaucagggaccuaaaagcuuacauuuuugugcucuaccacugcccauauauauuuacuuucuuaccuucauucugacuuaacccagauuuacuuaccuaucuauuuuaucucaguggcaggaguauuuuuuguaaguguucucaugucuuuugggggaaagaaacaaaguauaaaauaauaaaucaauauugacauggugaaguaauaucuugaaugagauaauuagcaauaugaguguuuggagcaggauuuuugaugagucuuccaaaauaauauaaauuuagaguuugcuuaguuugugucuuuuuuuuuuuuuuuuuuuuugagauggaguuucacucuuguugcccaggcuggcaugcaauguugcaaucucggcucaccgcaaccuccacuuccuggguucaagugauucuccugccucagccucccaaguagcugggauuacaggcaugcgccaccacgcccagccaauuuuguauuuuuaguagacacaagguuucuccauguuggucaggcuggucuugaacucuugaccucaggugauccacccaccuuggccucccaaaaugcugggauuacagacgugagccaccgcgcccagccuaguuuguauauuuuaaaagaauuuccuagcauuauugaauaauuagauaauguauaucuuaucuuuugguugcucuugcccauucuggaaauaauuuauaagaagaucuaauuuagauucuaucugcuguuaagugugaauuagugugaguugcauauaacauauauaaaagcuguaaccugggaaaaaguuauuaucuggaagcuuuagaaauuaauguuauucuuucuuaaguaucaucaggaaauuaaucaaaauggccaccuugauaccaaaaauaagguuuuggggcauaacauccuuaugaauucaaauguuagucauuucacauaucuuccacuuuauuucauuaaguccuuccuaguagacacuguucaaacauuauucaccauuuacuaaugcuguuacaacauuauuuuagaagauggauauggauagcuguucuagcuuuuaaaguuuucaguguaaagcaccaugugcuaaacauuggccaggauauucuguaugaaauggcuuuaguuacaggccugucugacaacaguuuucaucagaaaaguaugcuuauuuuccuuucuuuuagaaaauuuggcugaaagcaauuuuggcaaagucagcauagccuuaagugucacaugagaaagauggaauugaaguggcuguuagguagaccugaccuggguauggugacuguggugacaugaguccuuuggaggacacagcgucucuccagcaucucucuucugagguucacucucuuuuguaggggcuuacccccuugucaaugcuacacacacacacacacacacacacacacacacacacacacacacagagggagagagagagagagagagagagagagagagagagagagagagagagagaaagaauggagaaccuuccuucuuaccuguggauacagaugcaccuuggcagagcccacuugccuccugcuuccggccuuucucaaaccagaccuuuuuuaguuucuacuucauccacacagagacuuaauaguggccaguaaagugacuugaaaaacgaauacaugccaccauguuaaugcacaccuuuccagugggauaagcucagccugagugccaaauuguauuucuuugcacaugauuaucaguuaaaauuauuuauauaguuuguuauucauuaaauuuauuuuaggaaaguacacaaagaaaaaauugugaccaggcaauuagguagcuucuaagguagccauugccaaccuaucuuuuguuaugaagaugaagucuguuauuucuuaauauugaacauuauuuuugacuaaauuuaaauucuacuguaugcaauagaauugaaaauauaccagcuuuaucgucauuaccaagagugaugaugaugauaccuccuauuuauugcccaccccccaugaacaagguaucgugcugagaauuuacauaaagcaauucaguuaauucucaguacagugcugcuugggagagauugcuauuugccuuuuacaagaugaugaaagaagcuuggagauguugagucauuuaucugaauuacaaagcaagugagugggcaagauaguugaaaauucuuuauuaaauuugcuuugauaacaaaaguaauguuugcuuuugguaauacaauuggaguauuacagaggaaguuaugcauaccauaggaagcuagacugguuuucaguacauuauccagaagaacaaaaaguacuguuaacaaauggggcaucuuuaucuuuaucugacuucuugagaauaaucuuuguaaauuaucugaucacuuuuuaaguaguaguuuuuuuaaaugacuuuuugaugacauacuuucaacuuucuuugcaauagaaucaaggugcauuuuaaauuuagaauaagcgaggauuuucaggaccauauaucuuuuuacacauuugcuuucugacaauuuuucacccccaaauacucaaacuuuuacuuauuuauuaguuaacuuuuaauaaucguuucuucuuaacauagucuuaguauaugcagauguuuaagguuuucauuuucacugcuuuucauuuaauaccauuaaauguauaccagagguuacauuuuucaaguuuauuguucugaguauuuaugccugcucuuuuucuucgguuccaauaugcuggacagucuaugagaaacugaugugaaaguugaugucuuuggagauuacguaaaagcugcuuuagccauuauuuuuccauuucuugcucugcuaagcacccaauuguugagcuugacagaagaucauuuuacugagcuauuuacuuugaaaaauuauaaguaauauacuuacagaaaauaauuaaauacuauauacagguaaaagugaaaaguaaaucucuuccuucuccuuguuucuccuuuggccguugcucccaagccuaaauuucuuguuuccacauuuucuuaaugggcauggaagcauagguaugcauguguauacacguacuuuaugaagucagaucucuuuaaauuccaauuguauaggauggcucucugcacugugugugccuccuuccuguguguacuggacugugggauaaacagcucucagcaggauauucauauucaguaaaauaaaugaugaauuuccaauggaaaagagagucaggaccaagaaaauagaaacagagacugaaaauaugggaaacaguacaaauuuauagaccaugaaguucaaaaauguuggcugcuaaauuagcaucauguguuuaaaaaguuuccugguaguuauguaaaaagcaugauacaauccauaauaugauuuuguuuuacucugaaggaaggaaguauggcaguuucuuagaggaaagcgugacuuuucuguuaggcugcugggagcugugcugcugagauagugugggugaaaaugggaugugguaaugugugcuugcugaggagcugagauguauccaguuccauaauuugccuucaggaccagcucccuaaugugugggccucuuguucaaaaauuaagaguuucaagauggugacagaagagcaugaagccaagcauggggaccacguaaguggggcucuaugugacugcauggguccaugcuccugacacuggcccugugugcuuugagauccuugagcaugcucaggaccugugaggagaagagcaggcugguggggaaggggaaguuggugccucauucagggaugugcucagagaagugcagguucucucuuugggcuuuccuuaucucugucgcuucuucaggaaggggaauuaauggggggcuaggauguggccuauuuggggagcagaguggggaguaauaaagaaggguugaggagggcucugcuagaaauauuggaaacgagaccugaugcauagcccgaagguggcaucgauucuuaaguaaaaugaugugaggugaaaugaggggacucuuccccccuuaaauuuggagcagugggaguuggggguauguuuacaaaccacuucuggaauguugagaacagaggcaaggaagcaugugauaacaguuccuuacaguuuuaggacacagggaacacauuuuccuaagagcacagaugagggacauaaaacucagcccagcagcuugggguaucaggaaaggcccagaaagagauccugagcaaugcaucuggguggagaccuggguguccacauacuguuauucauuuagcacuuuggacuuuaugcuaagggcuauggggaaaccacugaaggcuucuggagagaagcuacaucagacuuucauuuucugaaguauuucgguuucccauguuacuguguagcagugguucccaaaguuuggucccacgaccagcagcacuggucugaccugugagcuucugggaaaugcagauucaugggcccuaucuggaccuauuaaaucagaucucugaggaugggccagaaacucuguuaggacaagcucucugggugauucuugugcauguuaaagcuuaagaaccacugcuguggagaauggaugguggaccugacuuaggaaguguuuauuacagaucccuuaugugacuaacaaggaaccugggggcccgcguuaacuuuccaaagaucaaccugcugguggauagguaacuuuccaaagauaaguaacuuuccaaagaucaaccuacugguggaugguaaucaagaaauaccaguuaccugacugugcccagucuuucugccauggaaacuucccaggcagugagaagauuaucauagcauuuuaaaaagaaagguguaauuauaugcuauauuaccuuucagaaacagcgcuuacaaaaauacgaauggaaauaggcaaauaauguagugcauaaacaugauugauguauaauuuuugauuuuaucacauuuuauaugugaugcauauuguguuugugugucucugagacuggaauggggaagcaggaaguagcuguuaucuuaacuuaagcuaauuauucucuaagcagugaauuuacuagggcuaugaccuuggguaaaacauuuaaucucugugagccucaauuuccuuaucuaugaaauggggauaguaauaucuaccuaacacaguuguuagcguaagguggcuuaugugaaaguguuuuguaaguuguaaagcauuuaaagcauuauaagugugagcaguauuuuuuuaucauauaacuuaaauccaaucaucuagcaaacauuuauuaauuauauuaugugaaauauuguaaguguagaguuuuaaacauguuuuuuuuuuuucccagaggaauuauaaccuuuugagaugauuaccuaaauuauucacacuauuacucaguggugaacccauucaaacaauauggacaauuuuauuagaaauucccaaaucuauauuuuggauugaauuuaaccuaguuguuaguuguuuucuaaccuuguuuuaauuuuuauuuuuaguagggauacuuaagcacauugugacaugguguacuguacuuuaguauguuuaauguugcccuuaaggagaucauucaguuuaauaauuaaaugaguauauaaucauuuguauaaccuuccaggaaagcaacaaaagugcaugagcaauuucuaaguaaaauuaagucagugagugguuuaugugacucaucaaccuuaaugugaauuggaguaguuuugcuuucaucaauuggaaauaaguauucuaauuauuuguaugagucuuuugguugcccaguuaagcaguuagauguuccuuacagccguaggcuaggcuuucucagggauuuauuaauuuaugccucuuucauguuagaaugguucauuuuuaaggaaaguccaguuaccuuuagagaugacacuuauuuuaugauaaauggcaacguauuugcauuaacacuaaggccauauuccauuucauaugggcuaaauugcagcuaccaauaaaacccagugguacauuauuuugauguggguauucuggucaguggagagaucauucuuuaaacgcuuuaaucuuuuaaaugucuauucuuucuagaggcugaagagcuuucuaaaguguauaccuccuuuauugaaaguacaauauucaugucacaacucaaaucacuuuuaauaacaauaugcuauacuguucaacucugauuuccuuuuggagucuacgagagggcugacguggaggggcccaccagcuggggaagcacagcucagacggccccgcaggguggauggcacagaaucugauauaaacggguaaacuucuggccauugcccuggucaccaacuccuuugacuuguuuugucccuggcucuggauucugucuucuggauucaaauugcaguuuguccaguuccgugccuugaguaacuauacuaguauuuuuuuaagguagacaaugggaguggucaaagcuuuuaucuauucucauuauuuuucagcacagugucauuuuaaagugaguagaauuauuuuuuuaacuuuguuucuuaaccaguguagacccaauuuauguauucccuauauccuguuucugugcauuuccuugcuguuucuuacuaucgaucuaggauaaaauguauuucuuuuaagaaacuucccagguccauucauaucugaauccaggauguuuuuugagugcaguuuuuaaaauugaauucuaauuccagauuuuaaaaauagcccagguaauauuacuguuaaucacacagaaaaacuauuuuugaauacaauauuguagaggauuaagcuaagagcacuguuguuuugaaaugaaaaauuuuaauuuuaccgcaaguuuuuccagguugcagugauacuuaacauuguacaaauacauguauguaauuaauacuuuaaauuuuuagggaaugauuguugaguaucuggcuuucaguccaaacagagacaaaaaugaucauguauacagagaagcagaaauucaguacgguuucaaccuauuaauuagacuuuccuuuacuuuccuauaaucaaaggugaguaacuucccagaaaauccacaguguacaagagaugcggcuauuuugauacauauuagcacugacacaaaugaaauuugaaaugggaaguuuuuuuaggacucagugaugaauguuuacauuugaaaguuaaaaauuuucuuucuguuuuuuuccaguaaaaauucaaaacaaauuaaaacagugaaugauguuuucuauuguacuuauaguaaucaucucuucugcuugaaguuuuauuauuuggccauauaaagugacagaucauuguaaccaauuugugguuuuaaccaucagaaguaauugacuaacgaugcuauuuauauuugguuagggauuaauggagggguguggguguguguuugugugagugugcacauguguguauguauacuuacauuuuagcguauuuucuucguaagugaagugccaaaaacaauuuguaaagcaauucuguuuuuuuugguguucucaaacucaaggguuuuaaucacuuuuuaaguucauuuuucguuauuuuuaaaguuuugaauuauuuuuugcaaaaaucuuaaaguaaaaaagaacuuuuaucucuagaguggaacagaugaaaaggguagagaucuuaaccacaaaaaauguuuuaaauacccucuacauuuacuacuuuacacguacaacuuggaugccucucuauauauuuaguuucauucaaguuuuccaguuuucauucuaaaaaggaagcaaaauacagaauccuuuuuccaaaggaaaauguuuguagugucaugaaaaaugagaacagauggcauuguaaagcuuuggggagauguguagcgcuucaauucaaauuguuaggcaaagucggagacaaauacauagcuaccaauuguuguaguuauuuauaugacuuaauucaaguauguaaaacaaaaacguagaaaggauagaauuuugcuucuuguauuaaauaaaaagcauuuuuguaauuuaugauccagcccucaccaagugaaugccuaagcaaccagguuuuuuuuaggaaaaaaaaaaauaaucaggaaaagcaguucuagucauuuaaaauguauccuguacuuuuggguuucacagugggcaaguuuacccagaggcagugugacagccuauuagcaaaauaaauagaucuuccaaacuuguaguccucugcucuuuucccuccacuuuuaaguaaauuagcuuuucagugcgucugggcuuggguugugguaggaugcauuaacuucuccccacacuguucugauugcgcagcaaagcguccauuaccaauaccauauccaaagugacguuuccauacaggcugccugcuguuucauucauaaccacaaaacaaacugaaaugacuuuacuucuuuuuacaacuugcaaagaguuaauggacugugcuggcccccugccaaaaccuuuaagaaacuuuauuaauguguuaugaggcugggacaccauagugugggauuuuauugguuauucaucuuaaugaauaaaaauauguaugcacaauuaaagccacauucucuagcaauugccuucuaauaaauguugagucuuugucagugcccgucauugcauuugcuuaucgauugugauccuuuuccuuccaaauccuaaaguuaccaguagugcaauuacgugaacuuuaaagaaauaccagcuuaguauuggaaacgagcaauuauucagugaugaaaagaacauaagcaugucauaaaaaugaauuaaaaauaucuccaugucagaaacaguaguuauaaucugcagcauuuuucccacuauauaugaaaaaggcugggcugugauguauugaugauucauaagacagaggcaacauaauuuugcuguagaucauguaagaaagugauaguggaaaaaaauaacuuguuuacucugacaugcuacuuaucagaaaacauuucauuuuuguguacauuuuuguuguucuuucaucucugacuguuucuucuuuucccuuaugggugggguguugcaaggaagagaugagggcagaaauaauaucauauuggaaacuaaacuuaaaaaaaagacugagugaaucagugggucuagaugaauuuaauacuggaguuguuugagaaaagaugaauauuuuugcauuuuuuugaauauaugcuuuguccucugaauagaauacuguauaucuucaaaacauuguugaaugguccucaguuuaugagaauaaucccaaguaccuaaaaugagggaaacuuccaggauguuuuuuggcaaaaugauuuucauauuauggucauuggaauaggauaauuuuauaccacucuaucaaaaguacuugugaagaguccuuaaggaaaaaaaaaaaaaagcucuuuuaaguaaaaauaccaggaaaaugaacacauuacaacuucaaaguaguaaaauaaaaacuuaagucacgucuguuuuuaugaauuuagucguaauucauacucacauuugagacauaaaguaauuucuuguuuugccacaaguagacgugagaauaauucaguucuucuugaauuagcaaauuuggaaugagguguaauuuuuuucuuuuuuaguacaauuuaaccuugaugucggaaggauugccaauugaaagaaaaaaaaucuaaacugccacuacacugaacacguaucgauuuacucucuuagucuuuuuuuuaacaccacguauugcuuuguuguauagaugaauuagaaccugucuggaguuuaaaaaaauggccuacccugaggucauuaaaaucagauuacaaauauggaauaaaaguggaaagaugauucuaaaaugacuuuugggguauaaaacuauuuagggagugggaagugaccuuugaauuuagauuuugaacauugugugcagcuugucaucuuuucaagucaucaugcugaggcauuuggccuugugaaucugauggugcugugcucuguaugggaacccaccaccuaaauucaaccaaggaaauguuugaccuugggcucuuuccuugagucucauuuagcccugugugagaaaguggugaacauuguguugguggaucugucuuucagguggcaauggaaacgggcucuucucuguggucauguugucucuguagauaaaccaucagaccuugaacucugguuaaguacagccaagaccguaguaacauucaugugaaaaaugacacgugggagaaauuagacucucauuuacgagauguggcuuagagggggauuacuugauccuguggugaagcuucaggacuuuggugggagaugaagagguuuguggggaaggaggaagguaguggcuuugaaaauggugucuggugucacaugcagucccugcacggagcugcucaugccgagcuggcccuuugccugucagcagcaugcacugacuuaguccucaauuuguggcaugcuaugggcaaaagggguuuucuggucucauccuccucccaguuuguacacauuaccaaaccacaacauaaacuccccacagucaguggccuccacucaagggaggcuuuugccaggaaaauugggaagguaugugucaaaaauuagaaaaaauugacuaaggagcccuguaauugcagaggugcaaccucuaccuggacuguaucucuuuuucuguccaguggugacaccucuaauuugggaagacaguaauuuaguuuggauucuggggucaguuuggcuuggguuuaauuccuggcuuuuucaguuauuaguuggauagccuuaggcaaguuuucucaucugaaaaugggaauaauaauagcaucccuuaguguuaucgcaaggacgaaaucuauggauaccguaauauugagaacaguauuggacauguaaacaaauacucaaugacuguuagccuuacuauuauuuuauuacuguucaccuagaagauauuugcugcuaagaggaggauaagcuaacauuguaagcacauacaauguauggaauagugggguuuuacacagcuaaucaccauuuagccucacuggaauccuuucauuuguaggugacaauuuuauaugcguugcacugucuugugcagucaguaagacauagagcaugaucuccaaaaacuuguauucuaguuggggauauaaaauauagcuacuuggcaauauauaccaaacaugacugaaacuaagacacaggcaaaaucugaaaccaucccuuagguuuuuuuuuuuuuuuuuuuuuuuuuuguaaagcauguugucugaaucucauaacucuguauaugauagcauagggucucuuugcagguacuagauggucaaucaacauuuaucgaauucuucuguuuguugagcagauuguuguuuuaguauuuggaaacucucaaggaagaaaagguaauaagucagcagugucagaccauaaaaucucaugaaaggaaagaaauuagcucaaguuuuaagaguguuaguaagggccaggugcuuggcucacaccuguaaucccagcaguuugcgaggccgaggcaggaagauugcuugagcucaggaguuugagaccagccugggcagcauggugaaacccugucucuaccaaaaauacaaaaaaauuagccaggugcaucugugguccuagauacucaagaggccgaggugggaggauuguuugaaccuugggaggcggagguugcgagugagccgagaucauaccacugcaccugaguggcagagugagauuccaucucaaagaagaaaaaaaaaaaaaagagagagagaguuaguaaguuacuagugaacuagaaauauuuuuugaacacaaccacucuguuucaccugucuguuaagaguggcccauuauuaaauagcugugugacugauuauuuugauaacuaauuaaacaaaggauaaaagucccuaaaugucuuuuacgcagaaacauaauuaauaaugcugagaaauuauucugcuguaaaaagguccaggaaaaguguguguguguguguguguguguguuuuucaggugacuacuggagaauagacauuauucaaaauauacgauuaaagagacauuagauuuucuucuccuaaaauggagacuuaaaaaaauuaaguaaacaauauugguguggcucugcugaguguguggacauauaauucaagcuagaaugggcauucagugaauaagcacuaugaugaauaccaccaguuugugucagcauuauggaauucaucuuucaccucugaauuaucuuucagcagaggcaagaauguuggauucaguugaagcuuagauuaccaaacaguaaucacugccaaugaugauuacaggaguacaccaggccuaaugugucucucaaccugagcuuaaacuugcggaacagucucaaagaaaaauccacugaccucauuaugcaguauuuggcugcugugaacauagccuguuagcugggauuuaaguuuaacagagaaaaaaaggacagagacaauauauaccuuguguauauaucguacuuaugaagguguacuuaugaaguauuuuuaauucuucaaguguuuuuuauauuccuacuaugaacaaaucaguauguauuuuuaguuccaugcagugucuccaucauuuccucccucccacguuuucauuccccuuccuuucuucuuucccucccucccacccugcuuucccucccccuuccuuccucccuucuuuuuucccccuccccuccccucccuuccuuccaauuuuuguuccuuuggucagcccuuggaacucacucacagagacuauguaucugaucucgguuuuuuucaguuuuaugccacagacauaguuaauuccucagauguuuuuugaagggaaauuuguauuauuuuuauguacagaaaacucaacaguguacauuuaacccaguuugguggcaaguucuuuagcuuuugccuuuugagcuuggcaauguaagccacaggcuugggacccaggacauugccuccccagugaugacggaucucauuggcucugucguuguaauugguucugauagcuaccaccagcuuaaccaaagccccuuugucuucugaguuaaccuguaugaaggcagcaguggugcaggucuuccuguggauuagaugucccagucuugucuuccccuugauauugcaguaagggacccccauuuuacgacacagggcaggcaggaacacaaccagcucgaugggauccauguuguaugcaaucaccaccaacugagcuuucuuauucuacaccaagguggugaugguguuaacuccugcuugaaggacagguguucuuaguggggagguccccuuugccggcgcuuucuucuccgcccgggccaacagccucugcuucuucucuugcuuugucucuggucuguacuuguggggcagcuuaagcagcugaguagcuguuuggugguccagguccugggugaacugguuaaucgcaggaggcauuuucagucgcuuauagaggaugacucucugccgcugcaaccugcuauagcggggccauuucacaaagcgggcgaggucucuuuugggcuggauguccugucuaaugccaaaauucuuaggccuuuucucaaacaggggguugaccacuuucuuggccuccugcuucuucaagacagcaggggccggagccaccuucuuccccuuggccuucuuuccuuuccacaucuugggcaguggacggcgggaaaagagagaucauuccucaaauuuugaggccugugccauagaaagguaugaaaagguuuucuuuuguuaauguuauuuuaauguuguaagacaaacauagccuguuaaaggaugagaagaaaacaaauuaauuuuuugguuuucauuuuucauacacguaugcuuugauagagauuauaaguuuaugucaaaaucaugccauugcaaaugggaaaguguuggcuuugcuuaugcuucucuguaguauguuuuaauauggucagaauuuguugagguuuuuuuuaacauuuuuuuuuccccacaaauuaaaugaguuucuuuaaucagcagaaaauauugcgggcauuaugugugauugaaauguugaggucagcagaauuucguaaaagaccccuugucaccauuuucuaucugguaguauuccaauauuccuuuguaguuaguuuuucaagcagcuuuaacuacugcaacacaaaaguugugguaccaagucuuauuuaugagggaaauacacauuuugacuuccugugagacagacuuuagacccugccuugguagcaggguuggccuuugcccuuggugaggcgggcccaggccggcgacauuucaggaggccgcuuggcagccauuuuagauccugcccgcgcggagagcuccuggcugccaaaaacugcagucgcuccgugccaagacacucuuggcaguggagauaaacuuuguagagauacacaguccagaaauaucuuauaauuacaaagcacagggggcagaauguuuuuacaauacagcugugcuaauguaaacauuuaauuuggcagccuucuccacccacuuuucaauuaaccggguuuaugcagauacuuuaggucuguaauaaacuuuauugcuaagaguacaguuuaugaaacacagauuugaggggcuuuuuugagggguuuuccauccauuuaggaaagcacauugugaauguuauguugccgugaauggaaaggguagcuuucugucucaaaagaugccaugggccuggcuuaacugaaacaauugcuuuaggaaaaaaaaaaugugggggcugucuccuuuggcuucuaaagcaugcaagaggauauuaauagaaggagguaaaaaucacuuauauagcuacaaaaagacacucguguugaugaucauucaaaaagauaaauguccccugcaaggcaugagacuguuucagagauaaauucccaguaacaguucuuacagauguaauuguaauaauugugugaucgccaugauaauuauucuuauggagugaaagaaauaauuuucuauguaaguagcauucaacuguucagcucacaaagcuagucaauagaucguuuucagcuaaccuaaaaaaugguagaguucauggaguuguaaagcuaaauuugguauuaauugacauugugaaggugauuuuuuucauaagaaauaugacaucacaauccaugauaucucuuugcauagauuugcuuacccauuucucagauacguuagagaaaaccauauaaaauacuacacauaugggucguuuuucuaaaagacaagaaacguagaaccgauauuuuuaugucauuccauuuagaaacuuugcuuuggugaugauuuuuuuaaauuagcuuuuguuuuuucuugaggauggguuugaguagcagaaaaccaauucuuaacgauguuuucucucaguacuccuuuugagacuuucauguaguguggcuccaucaauauucuauaaugggaugugaccacaaaguaauuuucauccuaaaauaguauuugacucuucagcucccgaacuagucaguagaccccuuucaucuauucugaaagauaauggaagucggagaauuuuaaaacuguggucucauuauuuuauagucucauuauuucaugcugcaauagcuguugugccaucauaccaccuuuacacauucugcuuaucacagcuaaacaaugcuuuugcagucuguggcuuuuagucucucauguuuuaguugcuauaaacaaaaauuaaaugaaaaaguuugucccacugcuaaaucuuugugugugugugugugugugugugugugugugugugaaaaguaucaauuuuaucuucaaaauauaaugauuacagauucugcuuauuuguaaauuguauagagagcacauuuuaccugcuagcaagugaaugaaagucaacauugugcaaaugaaaccauaagcuccaugaagacaagaacaaaucaucuuuuauugacuguuguagacugaguuccaaggaugauacauggaccacuguagguguucaguccuuuucaaaaaaauaaacgaauggauaaauaucaucuguauaugucacaaucagaauauugaauguuaauuaccuguauaaauugauagcucauuaugacuuuuuuuuuuuaagguuacuuugucuuucuuuugggaauuaaugcucuuugucucaguuucuucauggauaguacauccaagauaaauuuguaugccauuuaaauagauucccaaaauuauucaggguaaguugggauacaggaggucacaaucuuggagagaaguaauguauaaacaaccaacuauaaugcacuggucgggcccugcacuaaagugugagcaagaccaugugggccccagaggguggucucauuagauggggcaauaagguucaggaagguuguaacagacgaaauucaagagcuuuuaaagaugaauuaggcguuugucuugcaucaaauaagggauauuccaggcauagaaaccuuaugagcaagggcacagaccugcaguugcacggcauauucuaggacuguuaagaagaauauuaggaaguugggugugggugugagggggaggguaaagggugaugguuucugugagagugaggcuaggcuggggccagguuauggagcaccuugaaugcuguacuaaggagguuguagauuauccuagcuagcaauuggaagccaccaagguguuuuaaggagugaaguguugugauuccugguggcuaugcagaggauggagucugguuauagugugaagagugaaucauaauggccugaggaggcugaggcuauugugagguaaaaaugugaagcucaauaagggacuuagcaccaguugggauggagauggggaaauaggcuugaaaggaagauagagucugggcugacaacugaaugugaagcuuuggggaguugggguuucuggaaugagcauuuucagcuugggaaacugaauggcugugaaugccauuaauugagauauggauugguugcggggaggcaagaguguacaaagguugugcacuagcaacaucaggaggaguuuugcaguuaaagaagagguuagggcuagauauggagauacagaguucucaaaaaacggguaguauuuguaaacauggaccuagcugaguuugcugagggggaauguacaaagacaagaagauggccaaguuggauggaucgucuuugggaucaccaacauauaagggaccaacagaagagaaggagauagccaucaagacaggaaagcagcccucagaaauagaggauuggaccuaagaaaggaguggugcccuaaaggaaaagggaaggagaauuuccaaaagcuagggauacuuagugugaaaagucaacuaaguagagucugggaaagucaagucguguuuuaaaaaaaauaguaauuuuggagcugaaacacauacuuagacuuaccgauccugagagcuaguguugggcaugaggauuauuauuuucuuaucucacaucgugaucagagaguaugugaguuuugguauuguguuuuauuccuuggucuaacuucacugaaacagauucugggguccuggguugcuuaaaggaugaauauucuguagacuuuaagaaacuucugaugaaaacaguggauuauguuuauuguaaucuuucucuucuaccaguucugagaggaaauuugcauuuucuucaucaaauuucaccauugacuacuauauuuuaaggaggagaagcuaauuugaaauuuugcuuugaguuuugaagaaggcaugaacaguuucacagaaaauagaaggaaauaugcccaacuacugagcacaccccuuuaaauugcucuuaccaggccuucagaccuaggggcaaaauuaugcuccaggcuccaggucccuggauucacucuguuagcagcagcaguaaggaacaguuuauuuggacaaucccuucugcuccuguucucccugcgugauucccuauuuuagcuguaaaagacucagaaaguggugauuuuaugcuaguacauacagaaauaccuuagcaaauaugauugagccaacuaauguguaaguaaaaacaauagcugaguggaaacugggugcaacucugcagucuccuuggauaucuucaggaguuuugugaaauuaaaaaaaaaauggauccuggauccuccaaugaacugaagucauaaucagucugcaauguugacuugagaauuucuuuuaaauaaaaauaaaugaccaaguggaagucuuauuagcuaaaaccaaaagcacaaacauacauggcccuuucacaaaguaaaacggcuauaagcauaaugagacuccaacacaucuuuacuuuuuuugcuguuuuguuuuuaauuuuuccagcucuuaacauucuaagaugcugccuuaccacuuccuuaaggaaacacaaaugggugaguuaaguuuuugaaaguaaaggaggauccuguuuaaguagauuagggucuggcaggccauuuaacuuuaucaggcaucuaaagccgaggauguacacuguagccggcugugaguugccaauuagcugggcuuuccccacuguuucugguuuggcagggaugaggugguucacccugccgcacuacugccugccaaggacacauggccagcucccggcuuccugucuuccucuuuguguccuggccuugccuuccagggagcugccagaacacaauugccaaaaaaucuuccuucagaaaggucaaguaaccucaagucaccuaugccaauauuuguguuuucuuuuuaauccuucuguguucgacuuggaaaaagcuguagaagcgaacuugcagaauggaaccugggucacuuuggaucacuuggauaaagcaacagaacccaaagaaucccuuggccagucagggugugauguuuugaguagaauucuauuuaaagcucugugaagugugauagaguucagaaugguucaguguggauuuggauuuaguugcuuuuuaggauucacuguacacaugugauuuuuggccaaagcuggugcaucacauggcagggagagggagaaaaguggagauugguuuuggcuuaaggacugcauuuuuguuuguuuguguuuucaggacucuauagucacauacugccuuuugcuuuccaguuuggugucugugagcaagcaucagcagccaagucccuuguacacuggcugagaacaaugugcgggaguuaccuggggugcuuguugagagcgcuuucuuggccccagcauugcuguacgagucccagucauugcgggugaggucgaggaaucugaauuucuaacaagcaucucaggugaaucugaugcucacuagaauuuguggacugaaugucacugauugugaaaugacaauaaggcaaguagcauuuauugucaugauacggcaagcuguucuacuucuccuuuaauuggucuuuuuggagcucuguguuuaauuggaaucuagauuauaugcagaucuccacugacaacaaacacuuuucugaaaauugaacuuuuaaaaaccuguuaacauaagaaacuuuauccaaguaauuguuccagguuuaaacucuaaauuuuaggaugauuuauaaggcuuuuuuaaugacacguagaaugccauagugaacauccgaaacgacuuuagaaggcucccuccccguagcccacacugugaaucaugcuccuuggagacgugcagugugaugggccuagugauuucuguuauggaagggaaaccccauuucucuaauacuucauaaagcaaagcuuuuauuauuuacuuugaaaaaauuccauuugaggaauauggaauucuuaaagugccuaaaccugagccaccuacuaauucuuauggcuguugguaaugaauauagggggcaacguguauucugucuguagacuccaggaaaguucaacguagccccaacauucccuuuuggcuuuucauguaaaauuguccauagcacuuucuuccuaagcucaguuuaauuuucuuuugugccuuuuguaccucgagauaugcugucuuucuuggugagaauggucuagccgugaaccuuuucgucauuguuuuguagcauucguagagugaggaccagauuaacuguguaauuuaccuuuuuuuuccccaaguuauuuccaaaauuugcuaaagcgcugcagccucagggacaccucugacuuucugacacagcuaagaaacaccacacuaauuuggaacacauguucugucaaaguuuaccuauagccuugaguuccaaauuugcaacuucagcaucuucuguugaaaauaaacagcauauuuuuucuuaagcucccuuuuugccuccccuugaacuccacagucuuuuauaaauaguaauaaggaaaugugguuauggguauaauugccacaaggcaauuguacccuagaggacugauagaauuuucuuuucuauaucggagggcugggcuccaucaagaagauccauuugcaaauaacucaauuggaagaauaacaacagugucuuuauuuuuauagcaacuuucccuauagagaucacaguacaguguguuagggacauccuaucagauucauuguucuaauaccccaguggacuggaauaaaguuuuauuauagcuuguuugagacaggagagugagacugagaaagguuaagggucgucccucagauccuaagaaagucagaaggggaaaugcaaugaaaaaucaagguuuuucuauuacucugcaaguugucaagcucugcauuccuuucugguaauuguaaagggucagaauaaagcacaaccuauuucgggauugcaaaguaauguagaugaaaaugccucgaaaauagcuaagguauucuugcuaucuuuaucauauuuaguacaaauggaagguaagaaagagccuuauugucaguaucuaauuguaccaauguauaugaaauggauuuugcacauucuugauugauuggauucaaacugccaaguugucuuaaucauuaauaaaagacaaauggaaaauaacauuuauaauucuggauuuaaaggaauuccauacgauuugacaacaaauuuugaacagauuaagaagccaaagaucaaaguuacucugauuacauaaacggccuaagaaaacacuuaauuaaguagucugauuuuucuuuuuaagguuuuacuuguagacuccauaguucugaggguaggagugaugaacuuaggcucuguuuuuuuuuuuuuuuuuaaguuagaauaagagaauugggaguaaaauuacuacuaaucuuucaaccugauuucaaggagccuuggaggacacauucuguggggaguagacacaauuaacuugaugcuccuaauuacuguuguuugauuugugauuaaaggugguauauuuugguguagcgcuuuuggcuucucagguguccagugugcugcugcuggggagaguaggggguggcagcauucccucccuuaaacaggaacccccuuccgcaaacuagaagcugagauaucagaaauaacccacauuuagucagaccuugccuucuaaugagaaaaagugaaaaauuaggcaaaacauaaacacacggcuuuuuaaagcucucuuugauuuucaaaguucuagaguggguucauauuuuuucacuuuaacccaagcgagugaagcuaucuuucacuuauagauccucccugagugccucaugggaggaguaauggccuugagacuuuuaucucaucaucacugcaccucuuguuaugucuugaugcuuaaugaauguuaagcugaaaacuaauccagguaaacaggugaacggaaaauuaaguucaaccagcgugaacauagaaaaaaaaaauccuucauuuaggagcaccauuagcacugccaauggacuaaggagacacaugcuguucccuaccaggugauuggaucauaucagcuaauuuauucuauuuuuaauaauugcuggaugauauuaauagggaacuuucaguuauuauuuuauuauuaugcauuuucuuuugcaaaaaaaaaaguuuaaaaaacauuuucuuaaauaccccacccccuuuuuccucccaaugcccuuacuagauuccuuugucuauguuugcaaugucauuguguuuuucauggugugacauacauacccuuaaugccauaaaagauuccugcucugugaaaagaaaguugaacaguguugucacuuugaaaacacagugauagcuuugaaugggagucuaaugugaggaggaagcuuuggcuuugggauccagauugcuguagccaaacuuccaaauucagauuuggucugcaauccuggcuucacugcagucauuuauaucgacagugaauaaagaaaccuaaauaaacaagaaugaaguggcaacacaauaaaagucgucucauaugugcuuuauacuuucaaauaaaaauuagaauuuaucauuuucuuugagauuauuucucuguuucgugugcucacaaaauuagcuugauguuuuaacccaucuuuauuucauuaaaguauuccuuagauauggaguuuucuaaaaaauacaauauuuugucaauaagauggaaaaugacaagcauuauuuccuaaaagcaccacaggagagagaagcauugugcauuuauuagguagugacagagcuuugcagauggaugaaggaagcuguaacaucaaaccuugccaucucuggcgguuuaaauucucuguaggucaguucuaccaaaaguuuuuuguuuuuuguuuuuuuuuaacuucuuuugccaguugauugguccuaugaaguaaauuaaugguuucaguucaauucuugggcacauaaccaccccaguuagcauucucuggggaccuuauuggcuuaagcaagccuagaagaauaggauuuccuuccagggucagguauagaacauuguggagaagcuuacgggaucucuuucucuuuugugaaagagagagagagagagaaugugugcuggauugaggugguagagugcaccuccaauauuaaaaaauaauuuccuaauacguuaucucaguguuauuuuguucuaucuucugugaaauugguaaguggauauuuuguguaaauuggcuccaaacagaccuucaaauacauugaagguggagcuuaguucuuugcugucaucccauuucuaagauagugccuguuucaaccuauuucucagccaaauuauaucauaauuugcuaucugcuuaguauaauguaucucauuuguuuuaucuuggcuuuaauugaauuaucuauuccuauggcauaauucuuaaaucauagcauauacauauacaguacauuggaagaacugggauaauuuuuauuucuucuuauugucuuuuuucuuuuuugacuguaacuuagaaugaaaguuuaaguuucaaauaguauguguguaauaaaaaauuugguuaaaaguuggauucguuuuccuaucuggcuuuaggcucccugucccacccauucuaccugccauuacgagaaaaagucaagggcuauuucugucuuguggucucagcauuauuccuaugguuuuuagugucugugcaauaugucugcugucauauuuauggagauugucucuuagcuuaccugucacacuauaaguuucucauuggggaaaguaaaggguggugggaaaacauaaaaagugaaaguuauugcuagacuuacuucauggccacuuuaugucuauuuagacuccaacccauuuucuuuuuucaguaaauauuuauugaauuaaauucauaaaugugcauuagaaguuugccuuauguggcauagauugacuaaaauacauuucaggcacaggcuuaaaaaauaauaaacauguauuuucaguugaaaugaucucuguaugauguuugguggugacugucaccaacuaggaaaauaauguuuuaaaaagagacauaaaauaaaucuuggggguggggguucaaaaugauugagagagaggauguagagggacauugcauagggugcaaugcuggcagcuaagugugcacauccaucaccagugucauccuguuaguucuauccaaaaaaaguuggcaacaugugaauugaugcuguauguuuuuccguuaugucacuugccucuagccgggcuguuaucuagcacaguuuaaaacauuaaguauauugguacuguuugcauaugugauucuaaaguuuugguacugugaguucauauauaucccugugcguaugaacauaaauauuuuuguuuucuccuguucguagaguguuuuagcaaaacacuauagaguguuacuauucugaugggaaaaauacuuuugucuuauuuuguaauuuuucuuauguaaaaugccucauguccaguggggacuuaugaaccauuuccuaaaggaaacagaguaauguugaagucauuucucuuuccuguuagggauuauucuuacguugauguauaguggugcauauuuaagaaaaccuuuugauuauccccaugagacuguuaguuauuccgacaauugauaagcauuucgaaguuguuuguggcaugaaauauaaguaaauguaucauauuuuacaaaaauaaucaaacuuauaauuguuccagucaaggagcauacagucaugugugaaggaaaaacacaugcacaagaaaaaacuuguuaaaaauugguuagagagacuaggagaugauaaaaagaagaaguaaacuuggauggauggguaggauuaucagaagaccuccuggaagagauauauuuagaacauggcauugagcaucuaguugccuuuuuuaaaaacuugauuauuuuuauguaucaguaugcauuacaaaaaacuuugggauacagaauuuuguacuuaguacugaaugguggcagugcuuucucaucuuuuuuuuaaaagaugagaaucauaacaaacacgugaaaucuauugguuuuuaaaaaaguuauuauauuugucuaauacugcuuaauucuauuaccugacacguauuuuagagugacagauaugccaaauucaaaaaaacaaauguaucugucagauuugaguaaaauaaacuaccagauaguccaauaggaggaauuucaugggcaaggccaguuacaguaauguuagaauagaugaaaagcugaaugggcagugaggucacccagucauuagcaucaguaggaaucuacuacacaaauugagcuggagcugccugaagggagggcaucacagagggaggaacuuguucaguggaagcaagaaucacaagaggaaaacucaccacuguuuggagacaaaugucaaagcagaggagggaaggaauaccucuccuucuccuuucuucccacccuccaaauucccaaacuccuaccauugccuccuguugguuggaccuagccugaagucaauaguuaauggagcugggaaaggugguuugcagaaacagaguucaggauggaucugaggacaaguuaccguuacagggcaauucuaauuuuggggguggguggagggaugagauuuagguaagauucaaagcaauuguuuggggcaggggaauuaaguuugcauaauaucauccaaagcuuuaucacaccaguuuuucuuacugguguugaguuacuaauuuuuuaaauccuaucugaaaauuuaguuuauacauuucugucauggccuugcuguuagaugguuuugcaaaauauccaugaacaaucuuguuaguuaauuuuagaauuuuaacaugcuuuaaaugucaagaagaauuugaucuugucugauuagaagcaaucuuuaagaccaaaaacaacaggugacaggcucaaauuauuccuauggcaauuaacucugacaaagaauuggaugaucccuccuuccccuuuuccaucuuuuggagguaccaagaguggacaaggaaaaguucaacuggucuuguaaccaagcacuaucuagaacuuggaaauaaugaugugauuucuuguuuuuguguauguguuuguuggagguugaguaugcagcauaguuuguuuuuugauuggauuggaaggcaaugucaguuuugaaauggcagcauaauaaucaauuuggaaaauuaaacauuagccauauguaaugguacgugcaaugaaaauaaucuuuaugagcaugggagaugagucugcaguaaaaagcuugaaguuggucuguguuaaaauuuugucacaucuggaaggcauugaugucuaagauuacauagguuugauaucauucaggguuaaggcauauggaugggacauuaugcagaaccuugauuuuuucauacucuuuggauuuggcuuaggcauuuuugaaucauaaggaauugauuugaaucucuauuaaagauaaaaugaguaacaagacaaaaugggaggaauuuugagcaccugguacauagcucugcaccaguauacucucaguucccuuuuuuaaaauggauauagcaagugaacaugcccgucaucauuuauuuucccauuucccaaauaaccauagugaugaguaguagauuucauggugggcuucuguuauucuuuauuauucuugguuagaauuaucuguauuuuuuuuauuuuuguuuauuuuuuucaagauaggggcucacucugucaccgaggcuggagugcagugauguaaucucagcucacugcagccucaaccuccagggcucagaugauccucccaccuuagccucucgaguaguugggacuauaggcacccaccgcuaugcccagcuaauuauuguauuuuuaguagagguggaguuucaccauguuggccaggcuggucucgaacuccugaccucaggugauccucccacuucagccucccaaguagcugggacuacaggcacccaccacuacgcccagcuaauuauuguauuuuuaguagagauggaauuucauuauguuggccaggcuggucuugaacuccugaccucagguuauccacccaccucagccucccauaguguugggauuaaaggcauaugccaccgugccuggccaggauuaucuguauuuuaaacuguucucuuuaagugacuguuugaaagaauauugccccauaaaaugccccaucuucaugucucugugagcuuguaaacuuuucaaaguucuuucaaacccauuauuucacuuauuagaauauucuugaccuucucuuuuuacaaaaaggaaaaucaugucagcuauuuuuuuguuuuuauuuuaucaguauaauugaguuccuuucuuugccugcacaguuuuaauuugcaagaggaaauuacugucuccucauuuguuuccucauuuuaucccuuuucaaaaauguugguucaaugaugcauuauucaaguaguuuuauuccugguauauuaacuuuugccuugaaaacauggggacagaaguucuuugaaccacuuaucaaggaacuguuaggacauuuaauacuauuaucugccacaucagcaagcuuccuguucaucagaugacuuaucugauuuuuuuccucuaauauuuugauaaaguuauuuuaugaacagaagcaguaaugaauaccccacguacaaaucuacuuuaccuuuguagaaaguaggcuaugcaucaucuuacucuguuauccaguuaauugcuaugcaucuugaguuuaaauguauacauuuauuuuuauaugaauauaguaucacagacuuaagagccauaauuuaauaauaaaacaaggacugguuauuaaucacauguaaguaacauaagauauaaaaaacccauccaguuucuucucucuaagcucacauaaggauauaaacauaaacauuuuaaugauuuggcaaaguaucuuuuuagcuaacaugauagagaaaucuguauccaauuuaaaaaauuuuuuaggaacauaugccuaugaaaaaaugagcaaugaaaaaauaagaauaugacuuuuuggucauugagucaaucacuacauuuguauuuguagagagguuguagaaacuuaaaaauuagaauauguguagauaauaaucaaaaacugaaaguuaugauugguauuacuggcaguuuguuuguaauuuaaggaagaugaacuguuuuaacugcuaccagucaucaucuuguucucuguaaaacagugguuagucauucaacacauacugauugagcaucuaguaugugccaggaauaugcuagggcagugaauaagacuaacauguuucuugaccccauggguuuuaaaauguagcagaagaguugcacucuaacccagcccuucaauuaccuguguugucagcguuugcaaggggcagugcaaccaaguagguggggauuuuuuuuuuuuuaggagggggaggaggaguacuaauuaaaccuuaaagaacauuaaauauauauaucucauagccuuuuuccacaaaaauacuugugcauauuucacuguugugugaaauuauuuuuuuccuaguauuucuaauuccuuugaaaacaacuaagacuaaacucuuaccuuucauuaacuaguugccacugggcaagaugaaaacugauucgugcgugaaaugguuugcuuagagucagcgugcuagugcuuggcaguugccggauagagcccagaguccugacucuccaggcaguuuggagagaacauguccugcucccugagaagaaagauugccaaugaaauauuagaaagucuuaugucugauuuuaaccuagauauauuaaguguugggaaaauacaugaagugacauagcacagaggggccauguguacacaggaguguuguaugugugggauuuagaauaaugcgugaagacuccaggauaaaccagauauguaagucauggugcuagguaguaacauaaaugcuguucaggacuuuggagguaaaacagcacuuauuuuucuaugcuuuccuuuuaagagaaaaauuuaagacuaauaggaucauaaacauugcauuuguuuuauguugaaauucugcauugauuuuucgauuugccuucaugauuauguucuugagucugaugacauucugguuuucauuuucagauucuuauuucaccagcauuuucuuugcacuacauaccuuguuguaaaaugcagguuucuugguuuccaaggggaaaaaauguauauuacauaguauagcugaaauccaaaaugucucccagauggaaaagaaagaacauucaucucaucuuuuccuacuggaucuggcuggguuuuggaaaggacuuuauuauuuucauguggcaaacugcguuggcaaauuguuccucaaaguacgcaguggcguguucaucuaauauuauaagauaugggcagcauuuaugaaagauuauaaaucuuacaacccucuucagaaacuuaaaauacagcuggaaauguuuugcuuccaacaaauaugcaaucuucauaaaauucgaaaagaaauguuuugaauaaauaauguuuuaguuuauuucucucuagugcgagagcuauuucuuuuagucaaaaucgugccauaaaacucuucccuccucuacauuagcacccuugccucuguauuuauauuaugcuggugcauuuaauguauauuuuuaaguaugccagauugcuuugccuuguuuuuaaagauagaaaacuggauuugcucccagggacucuuucccuaacucgaccaguuuaaaaacuaagcaaggauugagucaguuaauuaauuuaaauaagauuacaaaucaaaaacauauuaugcaaucuugauuuaauuaccacauuuuauuuacuuaauugaaaacacacuguagaaagucagcaaucuugacaaugaccaguacgguguuuuugcauucuguagguuaaagccuucaaaagcaagaacuguaggugauccugauuaugaccuuugguucacucaaucccuagaucaguaggaagucauugaacuuaaucuuagguuagggcagaaaggucagauaugauuauccuagcuucccauuguugugggggguggguugguacuacuuaaugaaguaccacagcccucuggucagagauguuggcagguuuaacacuuuuugugcaggguuucauauuugcaggggauucauuaguaguccccugugguagaaugauuugcuuugauuuuuuuugauauaugauuuuugauaauaugauuuuuuuuccaccuuaaauuucaguggccuauuuuuucaguuaauucccuguggacaaauuucagucuugagcgcuaacaaauccuuauuuuaauccuugggauaugacucuuuguaccuaaucuccuuguuaagcaaaaaaguggcucuuuaaaagaaagcuuaaugauaaaacaacugggauguucaggaaugaaacaggauauaucguauaucuacucucuuguucuguaguuuucuuugguuaaugaaauuacuuuaucaugaagaucuuaaguguagcaacaucuuuuuaaacuaugcguuuugcuaaaucaaacguauauuuuaaaaucaauguuaaacaacagaaagagggaucugaagauauaggucuucauacuugaaauaguaaauaguuuaaaauaugcaggaaacugcaucucccaaauauuauauugguucugccaaaauauucagagaggucuaauuucucuuauugcucagaacuggguuuaggaggaguacggauucacuaaaaaaacaaacaaacaaacaacaaacaagaucagggauuccauuaacaaagugauaaaguuaaaacuuuucaugaacagcuuguuaaguuaaguuuugcagugaaguggacuccaaauaauuuaaugcccuauugaaaagagacagagagacagaagcagagagagacaggagauaaagggagacacaggcacacacacacacacacacacacacacacacacacacacacacacauacacacacacacacacacacaggagcgaagaaugaaggagggagagagagagagaaaccauuucccaaacauuuacaugcuuaugagaggcaaggaaaacacucaguuuucccauguucuuucguugucuuauuuuaauacacaucuaauagagagaaaauaaaauaauguagaacuauaauuuugugucacccaaagcaaugaagcaaccuuccauuaaaacugaagcugccugguguuuuaacugugcuggaaaaaaaaaagccaaauuauguaauaggaaacuugauuauggaaagcuaguguucuguaaaucccaaggaaucagucaugggagacaguaaacugcaaagagugagguagaaaacuuugggcagagagaggggaagagagaagaagguuuggcccaaggagaauaguuugcucuccauuacccuuaauaauauagauguuuuuguuuuaccuuuuuauuucccuacuauaaaauacaugcauuuguauuccuuccgucaagcuuuuguuucuuaccuguuacgucuuguuucuggcaugcuauauauuuaauuguaaaaauauacuguuuuauuauauuaucaauuaauaauguuuuagagagaaagaaagagacuguucugagccuuaaaaaaaaucucaugguauucuuucauugacaaugggcuauuucuucaccugcuuaaggcaaagaacuaugacaaaagggcccuuuaucacaggaugacuaaguuuaguucuagcaagaggcuaucuguagguuaacagguuacauuguggguuucauuuacuccucugauaucccuugauauaaaagcuauauuguuauggaaucauagaauuuuagagccacaggggaccugaaaacucaccuuguacagcuccuucuuugcaccaaacucauuauaaauuaaaauuaugcuuuuccaguugucuuuuucuguugauccucaagccauggugucagagaauaaaaagaguuccuaaaagaaguuucaucuaggaguagaaaguuuaucuauaaaggucauuaaaacuuucuugccucagugcuugcaaaguagggacauggaccuucaacaaacauuucuucucuuuauaggagauggacaaaaaauaauuucuaacucaaaauaguaugucuuauccacccuaucuuguuuccaaauauuucuucaggaaguugggaaguaggauugagccuuacauuagacugagagacuuagcccugggaauugugugucuguuucccuggcuugccacaagaaauuuaucuguuugacuucuacuguaugauuuuacacagagcgguaugcuuugucuuucuuucuugugcacuuuuauaguuuauagacugaugguuuucuguucauuugacuuaaccaaaugugccaggcccuaucccaaagauuagggcuauaaggcuaaauagggcaauaauagacuucgugucauauuguugaggauguaaaggggaugaccucacccugggggacuucagggagaaaaaagggggaacauuaugcacagacuuggagacaucaaaugcaggagacacacaaggaguccaaaggcuaaaguaugacccaggugcugauggggaccagaucaaggugccaugaauggcauacuauuuucagaauauauguaaagguuuuagcagauguuuagcuuaaucaguuuugggucuuauaaagaucuucuugguaaaagagugaaauaugucuuagaaaggugggaaaucaggucguuuuuucacggcauuguuccuaaggucaccuucuuuugauaucuuuuaugauaugcccuugcccaccuuuccuaggaagaaucaucuguccccucuugauuuauguauuuuuuuauuuguauauuucugucucuucaggcagccucugagcuucuacauggcauagaguauacuuuuuuuaaaacaauauuuaaaggucauuauuguaaauuaaauauaaauuuaauaagcauuacagagcaccuacuguguuccaaacauuaccagguguuuggaauacaugagccgaucuuggcucacugcaaccuccaccucccagguccaagugauucucaugucucagccucucaaguagcugggauuacaggugugugccaccgcaccuggcuacuuuuuuguauuuuuugguagagacgggguuucaccacguuggccaggcuggucucaaacuccuggccucaaguaaucugccugccucagccuccaaaagugcugggauuuacaggcgugagcauaaaucuuaauugauuuacauuuaaaugauguuuacauuaaugaccuacaaaaaaaauuugacaguuuugaugauuuaucuaccucagauaguugcaguguaucuacuccagaaaguuagugcucaguaagaaauacuuuacaggcuauuacuuauuuauugucauauauauuuaacacacaucuuacagagcuuccaccagauuguccauaaaacauuagaauuuccuuugcuuaauggagacaaauuugauuuauagaauuggccucucuuuaaaacgucaauuaguauauagaguucagugauacuaauaauugcuuccaacuuagauauagaaaauagcuaaagguuuaaaaaaagauucugaaaaagauuuugaauguauuggugaauggugggaagggugagggagguuaggggaagguaaguuucccagaaacauuuaaacuacugaaaaaucauuuagcuucgcauuauuuuaggauugcaucauaacgauucaagaaguauugugucugaauaggcuguccauauagagaacauaaguuuuaauaguugcuaugcaacuuuggacaagccguuugaucacuuauguguccuaggaucuuccauaaaauugggucauaggaaaaacugcucacuccuuagguaagcuuagauauuagaagagccacgagagauugaccgcuuuuaaaaaaggaguggacgaaaggauugaaaaguugguaagggucgugcaugaaugugaaccuuuucuuguuccuggagaaucuuuaaccuggagaagaaggaacugauugaguuuaaaauauaguaauuuagaaauaacuucauuacuuuuuuuuuagaagaauaaacauauguuuaacccacacuuaaagaauggggaacaugaaacccacacuuaaagaauggggaaaauagagauugagaucgaggaagauaaaaugagagguggaagagaaugagggaggacugguuuugguuggcugccuccaaaaacuccucucuuuuucucuacugcaucaaaaucuuuccagacacuaaacugggugugguggcucacaccuguaaucccagcacuuugggaggccgagguaggcggaucgcuucaggccaggaguucaagaccagccugaccaacauggugaaaccccgucucuaccaaaaaauacaaaaacuagcugggugugguggugugcgccuguaguccuagcuacucgggaggcugaagcacaagaauggcuugaacccaggagguggaggcuucagugagcugugauagugcuacugcacucuagccugggugacagagcaagacucugucucaaaaaaaaaaaaaaaauuuuuuuucccagacaccagacccaguaugcugggcagcucacaacucuuagcagccuuguuccucaaagacuucagccuucuggaagguaauuuucaucaacuggcugguaucuacugccuuuugagcaugacagcugcuaagagccuugaagagcaguggacuccucccuuuuggggaaugaggggugaaagcauuuacacaggauuucucagguaggcacacacuucuccaugcuuagucaucccaccagucauuuucagaugcguguguugggauggacagaacuuaguuaugucccuuuucucccuuucuuccuaaaaguuaguuguuauuaagcauagagccacauuaaaaaugauuaauuuuuucauuuuaauauguuuaaaccauuaaauauauuaaucauuuuaaauguggcucuaugcuuaauauuaauaucuuuuauuuacugauaauguagacugugucugacccaaugcuuuuggugcuuaaugugauagaaucuugcaaugauuuuacaagguagauaauauuauugcaguuuucaagauccagacaccaagacucuuaagaguaaguaauuuuguacaagaucaugucacuagugagggacagagccaggcuucacuguaacauauuaaauacacacacacacacacacacacacacacacacacacacacacacacacacagagagagagagagagagagagagaggugggggguguugagcaaagugauggaagugguuaaauaaaaccuuuggguauagaguaauuugaccuagguggugaauuggaagggguuuagauguggucugaauaauuccuucucugaagucaaccacaauaacaguucauuuuugguuucucugccaaccacgacucccugguuacuuccuuuuccagcaguuggaauuaagugaccgauauaaggugacauaagaguuaagaguagauuauaguguuagaauuuacagucugaaaaguaaaugcucuaucauuugcucacugagagggcccucuccuauguuucugagacacaguauacacugcuuuauuucaugagaagguaugggcuuuggcauaugaaggagucugucauugugugccaguaaacaccagaucauuuuagaaaguggaauuguuacaaaaagccaaugugugccucaaauuuagggucuacuucagcuuucccucaaaugcuugugguuuuuuuaguaaguauauuuuuucaaucgaagaaguuggucugcaguuguuggaaaugagaagaaaaaguaauuuauagcagaaaagaauagaguuucccaagugggauguugugguaacaggggaugccauuguucuagcuggauaguuucuuacgaauggaagagacuuuucauucuuuucucugcuggacccaaauuuuagcaacagaugauggaaaagaguuuugcggcaccauuuugaaguugcuguaacuaaacaugcuaaggcucaugcagagucuacaacuccugaaauaaggcgacugcugcaacaauugacaacuuuaacuaucucaggugucaucacaagcuuggcauuagccaccuugaggggugcaugucuagaccuucauaagagugagauagcuuuggagggaaaguaaaacauagggaggcucuggucaguggguguauuauacauaaguaggaauuccuaaaaaauguuagaaucgcuugagaaauuaaacuggaauguaauaucaaugcugagagacauuugucagaggaacucaagguaaaaauagcugaugcuauagcaaaaaguuaugauuuaucauuuuuauguagcuaucauacuccaggccuggaaaguggcccauauuguaccaguuuuuuaaaggaauguagaacgaagaagauugaucuccuaauuuauaagucacugaaucuugccuugauuucagaaaaaguaauaagaggacuucaugggagaugagagagauuuucagagaguucucagcucucugacugucuucaggagacucgagccagaugaagaauggucauuucuaguuucuuuacuuucauuuugaaaaaucaggaaacaauuggaggaaaaugugggaaucacuaaauaugccugccaagaucucaugaaaucuguucuagaauaaaaccaaaaagacaauuaaggaaaugggaugaagggguaaaauucugauuucagcauuaaaucuaagcuaacaggcaugaggcaaagggcagaaauaaauaaccagguuuuauaugagaagaaacuaacaggauguucuugcauuuaauaguagaagcagcaauuucaguauguuaaucacuuaccuggaaggacagaauaaccccgaugaaaaaaaccagcauaugauuuuccugcuuaaccaaaucacuuucuuggcucaaguauaauggcaagguuugggggaagagacuugucaguauauggcaguacaugacagagccgucauuugugccccaccuaucaaauuuuguugaaauucauuaucaaguucaaaauugccuuuucuaggcaagcaaagaggcugcuggagcugagccauccauuccuccggcguuuacugcaagccuagugcauucacagccaugaacagcacacugaggaggacacaaaagaaguagacagaaucucugccucugcuuaggaguaugcaauuuaguuggggcgacaaaacuuaaaugcuagaaccaauaaaagaagauuacaaagcaacucgcaaguaaguguauaauaauauggggcaaaugacacagauaaauggagaggguacaaggagggaagaggagugagcaaaacacaacagugucagaucaguccgaaagggcauguugccuaacaguuguaugucuuccacguuucuuucuguagcaucaaugaggaauaguaugggguaggaaauucagauauacgacauugaucucuuccuccuuaccugcaaagucuguccaucugucauggauggaaauuaaauugauucaaccauuugcucuccacaaagccauguugguuucuaccuaguaauuuaugcuuuccuugcuguuugcaaaucgauugcuauuaugggauguagauaaaucugggccuggauccaguagguugggagauuauuggaguggguauguguacuugugugugaaaucauggaaaagcggacucucauuucuguguauuuuacucauugaauaaaaacauacuuucaggcuuuuaaaugcacguuuaauuacacuuagauugcauuuuuaagagaauauaucugcuuuauuucauauugcuacugacaggccucaauauuugccuaaccuucaaaccaucuucaauggcuuuguagccagaucuuuuguuucaaaaaaaccuugcucuagcccaagaaaauuauagaucaauacuuguguuuuucuuuugacauagaaauauguauaugcauucauguaguuugaugaguaaaauguuucuaucaaaagucuugggaaaguguauuuuauuuaagcacucaacuucauuuuuauaccuucaaauuuuuuuuucgaguccuuugaggauugugaaauucuuucaaaacaaauuaaaaagaaaacauuuucugugauuucuuuacagauucuggacaaucaggaaguccaagccacaaugauccugccaagaauccuccagguaaauauguguuccaggacauuugcaaucugacauuguuggagaacaaagguaccacuguauagauaaacaccccauaauuggucagcugccuauuuuguucuggcaggcagguaugaucgggacaagaugugauugugcuuaggcccuuugcaguggcaaauacuuuuauauuggcgucaucaguauuuaccuaaucaccaauguuuuaauuuuuguugguguuucuuugaaaauaaauacgcauauauuuuaguuguguaucuuuuaggugcuaaaauaauugcuguuugaaaagccaaugaaccuuuuaaucuuucuuuuaaaacucauaagaaaauguaaaaauuuccauacugcaauuauaguuuaucaacucucauuacuuuagaaggggguugggggugggagugguugguuguguuuucacugaaggauuuuugcaagacuuuuuauuccauaaaguuuuuauuggaucuccagaaucaggaaauaaugaaagcaggauuuuuuuuuucuuuagcauaagguaucccaaauacccucuuuguuuucagaaguuguuccagaucugaaaaugggcuuuuauaacuuggcugucuucauauagcucugaacauacaacauuuugcuuuugauuuaggaacaguguuuuuucucaugagauaaaacuagcacaagcaguuuuucauuauuaaaagaaugugaauuauauuggugacuuuaguaaaagagugcucuaagaauaaacuaacaaaaacaaaaccaaacacaaaaaccccgaaccagcuacacaugccccccaccuccccaaacaaucucaucuguccuuucguugaaaauaaaccagaaaguuuauaugaaguaauaggaaaaguuuccucagguagacuuaguuuuuagguccuccaucguuugaucuuccuugaagucgugcuuagcuaauaugaggcugaaauaccagaagaacaccaaaauugcaagaaaguuuaucagaccaauuuugucuuaaaaugauuuuagaaagauacagcaaguagauauacaaguaaaaaugcaaaaucaaaacagacuauauuuuucugaguccuauguuuuuuuauuucagaaaaauuaucuuuuuccaaauauuuauuaauucuguauuguacaaaaucauauuguugacaaaaguaguauacacuucaaagauaaaaaguucuaauuaaacacagguuuaaaaauguaugcuaaguugauuuuucauuuucuucauaaaucauuuaaauauuacuguacauugagagcaaaacauuaaaaacagaauaauuuaaaauguaauucccaguuaaauuuauuuuauuuuguugugugugaauggaggauugauauuauuuuaguuaucuuuccaaaaaggcuacuuagaauauaauaaauuuugucaaaaauuuucagaaguucagaauauuucauuaacuuauagggucuuuuaacuuuacaaagauuuuuuucuuuuuaauuaacugauauuuucccuguguugcaugauagacaaaaugaauuuuauccaaacauuuuuuaaaagucuccuuacucaucuuacaaagaaugaggugggagaagaggggaaccuuugguagaaaaagaguugauagcuauuauaagucggacuaaacaacggauauguuuucugcauuugaaugaaagcuugauuugaaacuaauaaagcaguuauuguuugaaguucauuucugaacauguacagaaggaauuauacucaccuaaaacuguucucuacuugagcugaauaaauaauccuugaauaguuauguaacaucauucaauuuuucaauauuugucaagaagcuugguuaaaauuucauuuuugcugcauucgauguagcaucucuuuauuucucuguuugcauauaacauggcaaacaaaaacaaccaagguagaacaccucuaauuuuuuucccuuuuaaauuuuccuuggaacucaaaccuuuuugagacuguguccugaaacugggaugcuacagauaaauacauuuuaugauuaguugaaaauuguauauauguaaaucguacguugauucuauuuuuuuagagccagaauguaauauaaaauacacauuauacccaacuuaaauggaauauaauuagaauuuuauuuaauuauccagaauguaaaauauugacuuuaauaugccuuguguauuauaauacuaugaacucaaccauaaggcuuauuaaggaauucuauuuuggacuuaaugauagagauuauuaaagaauuuuuuaugagcuuaagaguuuguuuuguaauacuucgaaauaaauuaaaccuagaauauaaaauguuuucuaauuuuaaaugugaacaacuagaacuuauuaagguuuuuguuuuguagucaacuggaguaaauuauacuuucuauuaaaagcuucuuuuuuaaguauaagcauauuugguauuuuaggacauaauuuaucuuuaggaagcucuuuuuaucucuguauucuugccuuggccaaaauaugaaaucuccaaaauugagauuuugugucuugagaaggcacgauccauguaugagaaaauucagucuaccaccacaagcaaugaaacaaucaaaucacuuugcugcuugaauuguuauaccaaauacaagcuaagcuuuugaaaaagaucaccuugaauaccaacacuuucuuaucacugguaguuuuccacugggagaugugcaacccauggaaauugcuaccgucuauuccuguguuuauuccccaacagcuugggaagagauggcaaaaauucaagcccuuuuggagauauaggcucuuugaaaucuguuccccacuguugacuugaagguggaaucccauccgaucauccuauaagugcagaugcauaugccuacccacaaacuuaacaccuccucuggcuuggcuuuucuccagcaucaggcuugaaugucugacuuugagacuacuuucuuacugacuuagaacuucugaagggugacccuaaagcucuucaaacuauaguauggacaucuacagauaggccuuuaguucuuacuuugaguuucuguguuggaauuaguauuuaagcacaagcagcaaaggcaacgcauuuuuggaaaggaauauuugauauuauuuuauaaaauauuuaaguaauuuuuugucauuuguuauuuuauagagcuuuuaaguagccuuuaugguauuucuuuaaacgauuugugacuuaaauguuuuguuugcauucuuuguuacguggcaggggugggcaccguaaucuuuuuggagugaaggugcucuacaacucagauagcacccaaggacauggcauugcaauuuuggcugagaagcgcuaagcacuucauuuuucuagggauacacauuugccuuguuuaugauagagucagaaguuauauauuuauauucacuucuucuucuuuguuuuuuuuuuuuuuuuuuuaacaaguuaaucccuccuaagcaauagaacuaaaaauguccucucuugguuauagcaaacaacucuuguggaccaaaugaggguaaaccauuaauuuugggacuuagacaugaaucucuuuuuaccuuuaauaauuaaaaacuccacugcuacuuuuaggaaaugugugauugauuggaugguaaucuuuggaaauuagcuuugacuugcuuuauuauuuugugugucuacauucuuuggacuaugaucuuuaagauuucccaaucucaaucccuugacuaauccuagaauggguaaaauccaaggaaaacauagcaaucuagaauucagauuuuugcuucuaagucaguuccaaacuaaugucuuauuuuggaguucaggaaggcugguaguuuuguggggaauucucugcugguaauaugacgaagacauguuaaaugcuagggcaguuuuugcaaauuuuaugauauaaacuuuuggggccuuucuaguaucauuaagcagaacuuucuuaccgggaauaacauggacuuaacaugcuacuuuccuuuuuguagguuuuauaggugcuugugcuauuuuguguguugacuuaugcauguaguguggcaacaccucugggaaccaguaggauuauauauuggguguaccucaaguaagccaccuuauauccucucuggagcaaggaugacacuaaauaaauaacugaguaaaucaaagaaggauuaucuauuaaugauagcuaugugcuuaucuugcacuuaagaaauucuuuaagucgcuggcugggcguggugucuuacgccuguaauccuagcacuuugggaggccgaggcgaguggaucacgaggucaggagaucgagaccauucuggcuaacauggugaaaccccgucucuacuaaaaauacaaaaaaauuagccgggcaugguggcgggcgccuguagucucagcugcuggggaggcugaggcaggagaguggcgugaaccugggaggcggagcuugcaguuagccgagaucgcaccacugcacuccagccauccuggacaacagagcgagacuccaucucaaaaaaaaaaaaaaaaaaaagaaauucuuuaagucauaaaaauuuugagauagcucucucuccaauguuauuuuauagauacugaaaucaaagccaacagaagguugucauaaaacuaauagaaacaaaccaaauaauuauuaggaaaacuaguucaaaaucuucaguauucauugucauuuguucaucuguugagaucacuagagccgauauuugcuugauuuuucagaucuuagaauuuaggacaaacuuaguacuuuuuaaucuguacauaaaggcagauaaauucgcauagguccuugaggaccucauaccacguuuuaucuuggaauaugguguucaaagucaaagucaaagaaaagagaaauuuacucuggcuuuuucaaaucauauuucauucacuuuuuuuuuuuuuuuuuuugagauggagucucacucugucgcccaggauggagugcaguggcgugaucucggcucacugcaaccucugccucccggguucaagcaauucuccugccucagccuccugaguagcugggauuacaggcgccugcuaccgugccuggcuaauuuuuucuauuuuuaguagagaugggguuucaccauguuggccaggcuggucuugaacuccuaaccucgugauccacccgccucagccucccaaagugcugggauuacaggcaugagccaccgcacccggccucauucacuucuuaauaaauucaugucuauuccuucucauguccucauuuauuguguccauuaggaucaagauguuuuuaaugaggaaaaaugcacuauuucaugauacuuaaaaggugauuuuaaacuuuggcacuagacaaugugcauucgacuauaaauaggcucucuauucauaaaaauauuuggagaaagaugcugaaaggacugguuaauggcagguaagaccugacaucguagguaaaaccuuuaaguaauuugagaaugaggucuguaugggucagugcuaaaaucaaaggacuuuuuuuuuaauguauuuuguuuuaaaacauuuuucuucuuuauccucuaacuuguuuggagacgucacauucaauaaaguucuuaaauguucaaauuuagaauaggauucagaguaaaggaagagaggaugagggaaguguuucuuucacaaauuacucuuaaaaagccagaagaacgcauagcccucagcuacauaauuuuacaggguacauuaugggaacuuguauacagcccacucaugaaagguugaucuacauagcaguuggcaccaugcccagccuccacagugcuucuagccugauuauuuguaauacuuaaugugaaagagucaaaaaaaggggacaauuuaggaaugucuuguaagguccugagagaaggagauuuuuccaugucuccccagucaccuacucuaucagauaacaaauuauauuaauugccuaacgauugcugaguuaacaauuaaauacuacauuugagucagcucaacauuagaagcagagacagccauuugcccuuguguaaaauacacaccauuuuauaccaagaaccauaaacaauucagaaagagcugucuauagguagauuuuucagccagcagauauuuauugagcaucuauuguaugcaucacacucggcuagauacuggagaagauaaaaaugugaguuacacaugaaccuugcuuuucccaaauguuuuuguucauaaaaucuacaaaauaauauauacauaauuauaauauaugaaauguauauuacauauguauuuauauuuaagauaaagacuaaauauuaguguuacgaugcaggucuuguaggaguucaaaguugugaaauacuguuucccaccauuguagguggcaugguggagugaaaagagcaugaacuuuggaauuaaaauuuucccuugaaugauuauaagggucaucaggagaaugagcaagucagccaaccgcuuugugcagucaauuauguucaugccaguugugaggaucacauaggggagcacaccugacagauagcaggugcuugauaaaagugagggguuuuuucauucuacuuucucuucagcuaguuugaucaagaaggcuuccugcagaaaguaucauuugauguggaaucaaauagaaauguguugaauuguaaucccagcacuuugauaggcugaggcgggcagaucacaaggucaggaguuugagaccagccuggccaacauagugaaaccccgucucuacuaaaaauacaaaaauuagccgggugugguggcacuugccuguagucccagcuacuugggaggcugaggcaggagaaucgcuugaaccugggaggcagagguugcagugggccgagaccaugucauugcacagcagccuggguggcagagugagacuccgucucaaaaaaaaaaaaaguguugaauuuuuauacugcucuucucuaaaggcuuaagaugacauaccgaaguuacagaagaugcauaagaauagaauguuagagauuuuauaaaggaggcaaaagaaacagaugcuuucaagucucaugaugaaauagaauuguaauuuuuagaaagcaaauguuguuauaagccuauuggcauaaaaggaaagguggagugacuuuuguuacauaaaucucaguauugacaugagaaaagguacaaauguaucuuuagagauuacuuuuuuccuaccaagaauuuaucuuguagaagcuuguauuaacauuguauaauuuuuuuccccuccuuuccuuuccaugguguuucuacuuuaugaagccaucaacuuucugugucuauugaaacuucugucuguccuuuacuuuuccuagcccucuuacucugccucuuauuucacugauuccuaccuaccaacuuauuucuuauuuuaaaacauacaucuuuuguuccucauuuggacaaaccccuuuaaccaagugucucaucucucucucuucuucuucguaacauggcaugaaggaugucaaagucucaucuugauuuccccugaaauuccaucuugauuucuucucagcuucuguccccacugaaaugauucucauuaaauccaugaccagugguuucuuucuguccuguucuugcuuccauauuccugaauauuuauuugauuuaguuggccaugcucuguuuaaaacuuugcccgugccucugaaaacaggaccucuccugguaauccaggaaccuuccuauguuuaaaaauugcauauggugauuucuucugucuucuuaaucagauuuuugucuuuaauucucuguguuuucaguaccuugcgauuuuuaaaguauauuaaccuuuucuccuagauguuuaccuuugaaauaccucucucuccuaaugauuuagaccuauguguccaacuacuuuucggacauguuucccuagaugucucaugguuaacuccaauuuaacauuuccaaaguuaaauuuauuuuauuuuaccagacuuggguuuuuuguuuucuuuguuuuugcuuuuucccuuuuuaagauauccuggagucaccagaauccuaucuagauacccuugguuagaguugcucaugauuucuuucccaggaacccuuuuucuuccuuauccuccacauauucauucauauucuacuuugaaaggucucuugaauuuacuuuuaccucucaguuaccauuacccuuauuugaccucugaacacuguuucuugccugaaauugaggaaaaaccuuuaaaaaaugugacugccuacugggcaagagaugugugcacacaaguuuauauuuaaaggagcagucauaguggagucagagaugucuaccccuucccagggaauauaagaugcauggaacaguuuggauaaaaggaugaacaagagguuguaggguggauauaguccuagccgaggaaagagcauuucacauggaagaaggggaaaggaagggaacuuggugucugagcaaggcuugagcagcauuuaaagccgugacauagaauauagguucauaaguagugagucaucagggguuuuucagcaagucagauuuguguuucaugacuuguguuaauauacaggucagagaaagaaagaauggggagaagaguuaauuucaacacaguacucuccuuucacaaugcugucagagaaaggacucguucaugggcuacaguuaguucaaacuuuccuuaacuuuacaacgguauuuuaaggucucguguuaucugaaauggugucauaagguaacauagaauccaaguaaaauuuuaauauauugauguaggcacuuaauuaauacuguaccuaguuccagaaaacuuccaagagggcuugcacagaaauagcuuguaauuugcuaaauuuuaaaggcuauugcuauaaccuauauuuuucuuaguugaaugucuagguuccccuuaagggagggucagaauccucaugugaaaagacgucugagucauaaauuccucuaggugagguugugaugguaccugcuguucugggcaguguuguagugauggcuuuuacccaaguaucucauguaacucccccucuccccgagauggggucuugccuuguugcccaggcuggagugcaguggcauagucauggcucacugcagccugccuccuggguucaaacaaucuucccaccucaagccucucaaguagcugggacaacaggcaugugccaccaugcccagcuaauuuuuaauuuuuuuguagagacagagccuugcuauguugccuaggcugguccccagcuccugggcugaagugauccucccaccucagccucccaaaguguugggauuauaagcaugagccaccaugccuggccucagguuccuucuacgguggccuccugcauccaaaguuuccucucaguuuaaauucuuucccucuccauauuuacaagaucugcuuuugccacauacagcuacaauuuaauaaugcaaagcauuuucugccucacagacggaaagcugggauuguuuuguaucacaaauauaguggacuugcucuaggcuuguuaaaaucacugaacuuugcagaaguuaagcucgcuggacuaaacuguccaggcacuaaggcaacucucacuuguauauuuaagcauaauguuuaaaaagagaguacaauucuauaguaauauauugcaaacagaauaaaauauuaaguagauaugugucuaauuacccgaggaguuuuaaucuuuuucuaccuuauaggauuaaaggaugugauuuaaagaucuuggacaaaucuccuacuaaagucucaguuuuucuuuccuucuccgugacuaugaaagcguaucuagguaaugaauaauuuaagcaaggacuuuuguguguuaauuugacuguuguuuguuuguuugagaaggagucuugcucuguugcccaggcuggagugcagugacaugaucucagcucacugcaacuuuugccucccagguucaagcaauucuccugccucagccuccugaguagcugggacuacaggcaugggccguguccggcuaauuuuuguauuuuuaggagaagugggguuucgccauguuggccaggcuggucuugaacuccugaccucaugugauccgcccacccuggccuccucaagugcugggauuacaggcgugaaccaccacacccagcugacucuuauuagcuuuugcuugauaaugucauugaucauagaagaauuuaagaaacaauggucagguuuugguuuucaaaguuguuacaaaucuuuuuggggucuuuugacuuacauucugcucuuuagggaccuuggcaucuuucauaccaaacuccuguuuuugcugagauauuuuaauuccugauuccacuagacauaucuuccccuugcgcagugcucuauaccuugcauguauguguguuccugcaguauucagcaggaagaagacaggaaaaccacuugacuuucagauuugaucuuauuaaaaucaucacuuccacuuguuaaugucaugaaacaaacagugacaugaugaaugguaagaugcuggcuccauuguguauuuugcaguaauguuuucaaugcaauggauuuuucauuuuaaaauuugguauuuuggacugcugucauuuucugaauugaaguacuuucuaagcagagcaguauuuucuaaauaaguaagauagaacuagaagaugaucaugucuguugggacaugauaaaguauucugcuauuuuaugcuuaccauguccaaauugauauccaaaaauagcccacaugaauaauguuaccuuauauaauguugaugggugaagaagggaguacuugugagcuuuugggagaaagaauguagaaagaacagaggaaugaauacaaaggcucaggcugcugaugagaggggcaaaauguuuuaaaaagaagguaauugaugcugaaucuuaauaacucuuuaaaaaccuuuacacuuugccucuuuaacuagcucaccuagaucauuuuaaucauuuccuaaucucuguagcgauauuuugccucaugucuuaaucccucugauauauccauuacaggucuguggugaugugcaaaucugauuauuucauucaccuccuuguaugguuccaaggucuccacucuagccuaagccuagcucguuagcaugacauacaauaugacccuucaugauuuguccguugcacacauggacuaugccuuuagcguuagccgugugcugcuucuuuguaucuuugcucauguuguuucucugccuagaaugcuuguacucccuugucaccuccucagugagacuucuucagagccucucugcagugcuguuuuacaguacuagcauuuagugcacuauuuuaucucuauuuucgcaucuacuccccuuaaugaauucugagccccuuugggugaguauugcauucuucuuuuuuguauaccuaucauccaaggcaaugccuaccuacagacaauguccaagauuuaugaagcagaggcuuagaccaauaauagacuaaauaaauaaccuguucuugcagugugugggaucauucccuuacucagaaccugaccuaggccuagaaaaagcggguacuucugcggagauacuuacagugauccucuuaugcccuguagguauaccacauccuagacaugauuauuuggaauauuuuucugaacuccucaucuuauguagcauacugaugaugaauuuuguagagagguaucugacugagaauuguagcacuccaauauaauugcugauucagaauacuaaucucagguggauagaguuucucuucucccaguuugacaaauuauagagaaguccuguuugcugcuuuugugcuuuuguuuacuagggaguauacuacaguguucuuagaguucacuugaccaugaaugaggaaccugguaagauaacauucuagaagcugcaaaaaaauaccugacuguuguaauucauaccuucaaaaauauuccugauuacacugaauguuucugauucacuugugauucuuuuugugcuguggaaauagcacuuuuugaaaauuuggaaaccacucuuuauaggucacuugcuaacuuuauugagguauaauagcauacaauaaguugcauauauauaguguacaguuagaugaguuuugacauauguguuuguuuguuuuguuuuguugagacagcaucucacucuguugcccggucuggagugcaguggugugaucuuggcucauugcaaccccugccucccagguucaagcaauucucaugccucagccuccugagcagcuggcacuagaggcgcguaccaccaugcuauguauuuuuaguagauguaggguuucgcuauguuguccaggcuggucuuaagcuccuggacucaagugauccaccugccucggccuccuagagugcugggauuacaggcaugagccaccacacccagccaguucugacguaugcauauacucaugaaaucaguaccacacucaaggaugaugacguuuccucuaaucccaaagguuucgucuacccucaucuucagaugacuuauugaucuguuuucugucucuuccaauuaguuuacauuacugaauauguuaaaaaggggaaccccccccccccgacacacacacacaacaauaugcccuuggugagaaaauauggaggaacaagggaaaugggauaugaucaagaaccacgaggacauaucuuugaaaauaaagaacuagaaaaaaauuccagagaaaauguuuacccagaagacuuauacgaaaagugaaccuacaaaagaauagcuucaauaaaugcgguauucugugagaugaggaagaauaucaagaaaaacuaaauugcuuucauagcguuaaaauugcaucggaggaguaagaaacagcacugauacuguggaaaaaagcauugauauagaggacaaccccaagauacuuauuccagaagcagaggaaacacagagguuaagaugaugagaaaaggguugaugaugagagaauagaaaauucaagguuuauuuagguguucauuguggagaaauuggaggauguaggaucaaagacaaauggagaaaaauuugaugagcuaaaaauuaucuauguggauuaaaaggacuaaugcuauuccagccacauaaugagaggcuuguaucuaaauauauccuguugaaauuuuuacauuucguggaugaagaaaauuuugaaauguccuggaugaaaaacaaguuacuucuagauuuccuuuuaucgacauuaaauaacaggagacagugggagaauacuugaaauugugauggaaaaaacauuguuuuucacucaaggaguuucaccuacagucaaaggcaauggaaauauauucuuuauuacucaugguaucaaaaaauagaguuccucauuuuauuugcaaaaauguuacuugaauaccuauucugacuggcaaugugaugacucaauaaaaaaauuaagaacaggaaaguauaaccauaaauauaugaauaaaaauauagauagagacuaaucaugagaauaguaacaauuaaggugagaauuaugaccaaguaauuguuauaaauaagaugacagacauaaaugucaauguaaaagauuguucuugaauauauguaaacaagaaugugguuaacaaucuggguccaaaauuuuagacugcauuuuuaaauuuuagugaaauacgcguaacauuaaauuugucaucuuaaccauuuuuaaguguacaauacaguagugugaaauguauucacgucauugugcaaccaaccuccagaaacuuuucaucuugcaaaacugaaacucaauaccuguuaaauaacagcucuccauucccuacucuccccagccccuggcaaccaccaugugacuuuguuucuaugaguuugacuacccuagauaguucauguaaguggaauuauacaguauuugucuuuuugugacuggcuuuuuuccagauuacauuuuuaagggcugcaaagaggaggaggcuggggagguugggaaaauaggaaugacagacuaguguuccccuuuuagaauaauuuauuguugaauuuugcugaagagucuguauuauuugcuuugucucuauuugugcuuagauuuauuauuagguaagccugccucuuggugucaaguacauuuucagcaucuugauauggucauaugacuuuuuccucuaucguaaugauagcuuuucucauagugagcugcacucauucauggaauaaacccugauuauaauaguguauuguucuuuugauaauauugcuguauucaauuucauauuuuauuuaggcaucuugaagucacauuuacuugugugcuugaucuuucauugguugguucauuguuuuguuucgaugagagaggcuacaaauuuagguauucaaguuuugcuggccucauagaggcuuauaagaaaguguucuucaugaggaagcuugucuuauuuccuaaggccugggagaguguaaauaacauuggaaccuaaagacuagauaaaggauacauaaaauccagcugugcacucgccuggaccuggugcuguuuucaaaggugguucuuacucacauuucuaguauguucuaggauugucaaauuuuuaaguacacuuaugaaucaccugcagaucucauuaagcuguggauucugauucugagggucugggguagagccuauucuucuucacuucuaauaagcuccccaguuaugccagugcuaguggcucuggaaccacauucugaauguggugucauagugauucccaaacuuugcuguacauuugaaucacuugggggaacuuuuaaaagaguucucauguccaggucucaccccauaucaauuaaaucagaauagcugggguuggaagccaaacauaaacugcuuucaagaaucccagaugguuccaguguucagcaaauuuggcaaccacuacacuaggauaaucgguccacucagguuuuacacuucucugcucaauuuugguuacuuuuaguuuacuaauacuugcccauuuaaguuuucaaaguuguagucaauaaguuguauguauuauucucucauaauuguuuuaauguauuugauuucuaugguuaugucuucuuuuuauauuuguaugucauguaccacaucaugauaggucagucgaagacagauuacauauggcaguggucccauaagauuauaauauuuuuaugguaccuuugcuauguucagauauguuuagauacacacauaccauugucuuaaaauccccuacgguaucaguacaguaguaugcuauacagguuuguagccuaggagcuauaugcaauuucaugcauauagccuagguguguaguagguuauaccaucuagguuuguguaaguacacucugugauguucauacaaccaugaaauugccuauuaacacauuucucagaaugugucccugccauuaagccauucaugacuauacuuguauauuuuuacuuucucuuuuucccuuaaucaggcauggaagugguuuuucugucuuguuggucuuuuuagagagucauuuguuuuauuuauuuuuuuaaauauuucuuuuuuucuauucuguuaauuucagcuuuuauguuuaauuucaucuuuuuaauuuuuggggugguugugaugcuguucuuucuuuuaugguaaguaauggguuucuuucuuucuucuuuuucuuuucauugcuuuuuagauaguuuauaauuucccuuuugauuuuucucuuugguucaugguuuauuuucuuaauuucuagguaguugagauaauucagucauuuuuuuauuauuuacuuuuauuugccaaagaugagacaguauggccuuaaaagucuguacuuuuagggauuuguuaaaguugccucuuuggucaaaaacaugaucgauguuuuuagaaguuccaugaacauaucaguaaaauauaauuuguauuugaaugauaugaaguuagucuuugucuaacagucauguucaauucuuaaaaagauacauuaauaguaaaaauucucacugugacuuuauuuuuuauaaaguuucuuguauuuuaauagauuguauucauaauauuuuuuggugcaugugggguuuaugauuuaucuucuuuauuaauugugccuuuuauccauuuauaauuaucuuuguuguaauucagcuuaaguuuucucuuaaccguugcugauacugcuuccuuuuuguuugaauuugccugauuucucuuugccuacccauuuauuuacaacuuuuuguucucuuuauuaucauuuuguguuagguguguuucuugaaaacaguuggauuuuguauuuuucaguugaccuaaacucccuuuaugggaaaauucaguccauauacauuuauuguagugauuuauguauuuuauuuuaucccuuauauuuuacuucauauuauuauauauuuuuacauccuauuuucuuauuuuugcugccuugauugcauucuuauuuauuguguuuucuuuucucuuugcuaauuuggaaauucuacuuuuucuuuuccugcucuugagaugucugcuuuacuauuacuugaaaagauuaugcaauuuuugcaucuacucauagguaguaugauuauuaccuauauuuuagggaagagaaaugugagguguagaagaguuagacagcuugccuuagguuuacauaguaaauggugauagucuugccccagggcugccuuuuuagcuaguaugcuuuaacaccguuggagagaggcauaccuuccacauccauuaaaaagauaagagggcauacauuuaauuuuauuaugccauaaaaauaaacauagcccacuuaguaaacuguaaaauaacggugcuaauaaauuuauaaaucugaaaaauugaauuuuuuuggaaaauauauaauaaaauuuaucucaacauuagaaagcaaaaguagaauaguauucacgauucagaguuaucuaagagucuucucugcaacagauucaaggaagaugauauuacuaguaaaguuuuccaaacauucaauaacuuuuuaugaaauaauauuuuguuuuguuccagagcauaaaacauauugggacaaugaucaaaaccauuuuaugaagcauguguauacuccugguauaaaaacuugacaaauaaaauacaaaaauuuccauaaaagcuuuccagcuaccuguagaaauauuagaagaaacugagccaaccaguucaacaguaaauuuaagaacugucuuccauggaugagcaaagauaauuaaaucuacgaauucaguaauauauaacaccaauaaaugcuguuagaaaaaaaccggagaaucucuacuaaugccaaaaaagaauuugauaauauucaauagccauucucgucagaaaacuuuuuaaaaaucugagaaaacuaggaauaagugaguacuuuuucagauaaugagaaaaaaaaaucagugauaaauucauagccaacauuuucauugugaaacuguagaugcaaucucauugauauuaggaaaaaaauuuccugcuagcacaauuucuauuuuauauauuuuuaauguuuguguauuuaugaauguucugauuuuuaaaauguuuuguuucuuaauguucuggugaaagaaauaugcucauauaucugaaaugaguccauuuuauuaaaaugaaauaaaugaaaguuguaacauuaauguaaugaccuuuuuucucuaucaacuugccacaauuaaaaacaaaucccuacuaauauguaagucuggcagcaggauugugagauggacaugcucacagcuugcccuaaggaguguaaguuggcaaaacaacuuuguggaaagcugcuugacaguuuuuaccaagaguuuuaaaagaguuuauguccuuugacccuguaauucuaauucugggaacuccagccuaaggaaaucaugagaauggcugacaaagauuuguguaugaggauguuaauuacagugcuauuuguuuauuauauuuuaaaaauugggaaauaaccuaaaaugccaaacaauggaaugguuaauauaaaguaugauacagccaugcaauauauagucauaaagaucaugcuuuugaaaaacuuuaucuaaaaggacagauacaauguuaauaggaaaaaagcuggauacaacuauauuuaaauuugauauugauuuuauaaauaaauauauauauauaugcggaaaaaguuuaaaggacuggaaggaaauauugaaaaaaauauaaugcuaucagggcguguuaaaguugggaaauuucugacucccuccaagaucaccuaaaucauccucguggguuuacguuucauauugagagauacacuuaauucuaaauuaauauuugaauguuaaccugggcuauaggcugagauuuaaucucugugaagaaaaucaccgucuuugcaaugauuaauauuucuauuuuauaaucacaguuucagcuuuaacuucaacacaaguuuagcuuuaaccauggauaguucaagucaguugagaaacugaagauagaacuauguccuguaacaucacuaccagaaaauuaccaauggguuaguugugguaucugaaguuauaugaagauuggcaaagagcuaguauaaaguaaucucuucuugucccuuuacaaaaagaauuaagccuucuuuuaaacucuguugaagaaagugaacaauugcaaucauagggcuggaaaaugccuauagaugucuuauguccaccuguuuguucuccaaaugaacaaugccagaaaacuaacauaggaaaacaucuguguaagaagggagaaucuguggguugcaguggcuuuugagaugcuuucuucuuuuuuucuguuuuuuuuuuuuuuuuuuuugagauuuccuucacaaagcaagaauuuuuauauccagugggagucuuuauagccacugagaaacuaucucuguaagaugaaaguuuccucaucuguaaaauggcaacaccaauaauaugacauauuuuauaagauaauggugaacgugaaguuaaugccugcuugugaaggucaucacaguuguugggaauauauugguuaugcuaccuuugcaaaauuucacaugccuuuuuaggccuguucccauuggaugacaaaucuguuuauugagccaaaaaacagcuccuggaacuaugcagaauaagucaaauccaccaucuacauuaauaguccuucgaauacuugaagacggcuuucaugaauuuaauaacugcuuucuguggcuucuuuuuuuuuaauuucaagaauagaacacaguagacuguaaaaaugagcauuaucagucuuccuuuggauuuucuauguaaauguuguuuaacauucaaaugguacugauuauaauuugagauauuaacaguuagauaugccauugugucccucuguuauuguuuguaaaggagguuaaacaguauauuaacuucugaguagugauuuacuguugcuuuugucagagaaaaauaaaaaagaaguaaaauaauauaauuugauauugccuuugagacuuuucaguuuguagaagucuuuauuuccuacucaauuuuauuuuuuuuaaaaagcacacauguaguguaaauacagcaucacacaaaugcagaguuguucuuuucuuccuggauuaagcuguuguguaauauugcucuguaaccauuaagcagcugcucugccucagagaugcucauauuuccuuugguagacgaagggaauuuacuauaugaaugucuccaaauugcuuuaagaucuuuagcuguuguauuagcuauuuagauuuacaguggucuaugaaaugugaaaaacauguuccugaaaggcccaaggaccuuggagguuacagaugggguuauguuagcagcagauaaccugacauuuugcugaguuucacccccuauccuacugcaggaccccugcccauuucaaaauccucucaguuauuuugcuacagcccucaaguauugucuucuguaugcuaaugaguaagcacuaguagguauccaaguacuauuuuaaguaucugaguacuauuucauccaugauuucuuuuucacucugccacgucuugguuaaugccuguccguuacaaaggcuaugcugccugcagagaugcaugaagguggcagccaucugcuuccggugcuucucccaggcuaccccacuuggcugauucucaccugucccuguucccauagguacaugguuaauaggcaucaucacucauccucaggaaaccuuccuccacuaaagucucacugggcuccaugcaggaguagagcccagugggaccucugugguuuuuugcauuuuauccaguagguuccaaagaaguucugauauauuuccaaugcuuuucaugguuucgguaaacuaccucuuuccauuguuuccguagauuccaauuucuuagaaccugggaaguuggggguggggaguggagaaacacccugcuacauucugaauugucuucuuuuuuucugugaauagcugcaauagucauuguauugucuguguuugacugccugacugucuucccacugguagaauuggccuugagcugacucaucccuucuucaugauuuggcuuccaacaggcucacaccccacuccaucuuaauggucaugacuuaggagcagauggaucucugacuucucauuggaguaauaaggaaaugaacuucagauuacacauagauauuguaauguuauuuuguauuaccucugauauaguuuauguaaauacauugaaauguucaucacuuauucaucgauguguuucacaaauauuuuugggcucuuacuauuuaaacacuuccaguucuuugguuguuacuuuguauuaaaugcuugacauuacacauuaguacacaacaaaguaagagauacaauccgacccuaaucauuacucuuucucaugugacccaaaagccuaaauacacucuucagcaaacaaguucuagggaauaacagagguuaguauaauuauccauaaaucuuaaaccaucuguaucuacauuguaauaaaaugacuaagauguuaaugugugacccuguuuguaaaguugaauuuuaaaauuuuguucuguguuuauuuaguacuuacucuauauauaggcaacgaguuagucauuaaggaagauauagagaugaacaaaacccagucacuucuguaaauaaaggaucugauaauccagcaaugacugcaagacuugaaaacagaucucucagaaaaucugaaaguacaaaguauaaaauuaguacaaacuaggugcuauacaaguacagaggaaggagauuucuggcugggccagugggugguagaaggaguuggaggagcaguuuacagaguggguggugguugggcuggauuuugaaggaugagacuagaguguguagaaagagggccaucucaucucagggagcugcaggaggaagauaugaaggguaggcauuuacaaaguacaauugggugaugaaaaauaaucuugugugacugguuaaguauaugagcuguagucaugauaaaggagguuguuuuguuuuuuuguuuuguuuuguuuuuuuuuuuuuuuugagauggagucuuguucugucgcccagacuggaaugcaauggcuccaucucggcucacuacaaccucugccuuccggguucaagugauucuccugccucggccucccgaguagcugagacuacaggugcccgccaccaugcccggcuaauuuuuguauuuuuaguggagaugggguuucaccauauuggccaggcuggucucaaacuccugaucuugugauccacccaccucggccucccaagauaaagaagguuuuguacuuaauauauuuacuuuauuaaguuuacccuauauaaaauaaaguauaaugaacuauaaacaauaacaaaagcaacaaaaaucuuucuauaugauaguaaguuacagugguccagaagagucaaaacaucucuuuccccgaccaggcaagacagucaguguccuuuuuuguauucaugacuuuuagcaccuuguacagugauuguuacuuagaaguuucucaauaauuacugaaaugaauuuaaccugguaaaaauuaauugcucaagaaauaagaguuucuuaaaauagaagugcauuaaauugggacauuuuguuauaauacucuuaaaaauguauauauauuuuucagaauaaugacuuaauguggcaccuguuuuauucccuacugagaucuuacaacuuccucucacuccuucuuucauucuguuucuaaagaagguggguggguggaugucaaacaucaguggcuccucaguucacagcagugaaacacauaugcuaauugaaugauuuucugucuuuucaugcuauguaugguugaaaagcaguguggugccuuuuguucugguaaauuuucugaauaaagauuugcggaucauuuuggacugucuggaggccagugugcguaauucgguauauagcugaucgcagguuccacuggcccuaagaucuuaauuuguugguaacaugcuuaucaugggguuuauauuuuuaucuccaguaguaacaacucuauaagauaggugauuuuuauugucuccaauuuguuaagugaggaaucugaggcaaaaagaggacuaauaaccuagccaagauuucauaacuggucaucuguggcuaggauucaaaucccagcucuuugauuucagugcuccauguugcugcacuacccaugcuucacaucucugaacugcaucuaauuccuuggucagcccugaagcuuuauguaaaauccagucaaauugccaguucuuagaaucuaguuuuguuuguuuguuucucagauguauuucaauucugaggauuuucaaacuuauucucacccuaggacagaagcaaguaggccauaaccuccccugcuaagguauuccucacacucauuacacccccuuaacauagaugagaauggggugggcugggugcaggguuacuguuguuugugggaguucucaucucuaguuuuggacauagaccagcuagcaagcaggcuccauggccacuguggacccugccccggugugacuuaagggucauguggcauucccagaggccuggauucaccaccauuugccagaaaaguugucuaauucuugaaauaaaaggaguccaguggaauaguagcaagggugaggaaagcagugaaaucgugcaacguauauuaaagaugcccagaaauaggucaacgcaaaguucuguauuugcuguauauacaaguucugcuuuuuauguuauuagugacccuggaacaagggucggggugcugguaacagcaguucacuuuucuuucaucagagaaggguuuacaaaagaacgguggcuuuaagagaucuuugacauuauuccagcaaggugcuaauugugguugugguuuccuuuuucuuucuuucauuuuucgcuuuagucuaccaggugcuaccgagucaaaagcauucacugagagcccacagaccauucuguaugcaugggccauggcaaaucaaaccgcaucaauaaaccuguacuuuuagaaagggaagaaaaaauuuuccuaagagauuauuugguaucuaaacuuuuuauuuuuguuuaaacaaaccuaauuugcauuccuaagagucauuuuuuaaaguccuuauuguaagcauauuugguuuuuguucaaaccauuggcuuuaaaacacuuaaauucuaguguauaaucauuuauuuuacuuucugcuuauauugaucauuuuuccuuuaauauuuauuuucagguuaccuugaggauaguuuuguaaaaucuggagucuucaauguaucagaacuuguaagaguauccagaaguaaguaaauuguuuuguuacuacuuaagcaugcaguaugauuuaaaauacuuuauauuuugaaccuuaaauguaguauaaagagugaccacauauuaggaaaauuugaauuaaaaucuuaaaaccuuugaugaaauaacaauauauuuugcuugauuuucuaaaauguuugcauucaaaucaucaaaacuuuuuguuguacaaaaauaauuuugggguuuuucugauugccauguuauugguauucauuuaauucacuguucucugcaugaccauagauggccauuuauaucaaaggaagugugauuaauuaaauguacucuauguuguuaugauaacccacauaaguuuccuguagauaagugcuuuuucauuuuacuaacauuuugguggggguuggagaugcacaggauauacacacuaacgugcagaguguagagggaugcagaaauuaacuuugcagauuguaguuggauauagauagaaagcauuguuauccaaaacaauguccaauuguuuuaacuggccacuucaccugagacaccauucuuagcaggcuggaucagauuuuucuaggcuaagcucaccuggcaggcuaccuaagcaaaggggacguuaccuugauuaacucuuuuacuuauuacuagcauguacaaacauauccaagaugcagaucuauauguacuaauuauguuaaagaaggugacuccuuucuucauacucccuucacugauuuagcuuauuuauguaacuuugaaggguauauuuucaccugacauuuugauagaaugcaucacacuucggagugauguuauucagaugauguagucacacucugauaccugccuaaguuguguuucucauuugggucauauuuagaggucaugaauaagaauuaugaugauccagaaagaacaaagaguaaucgaguuacugaggauaagaauaagcaguguuuuagagucuuguuguucaguaaaggaaucuucacgcuaucacugacugucuuuugaaccguaguuccucaaauagcucacauuucuaaagugaacagugcaaauagcauguauagcagggagugauacauaugaacguuuaagaucuuaaguaguuuauccuuucugguauaauucuagaguggauaaauguaugcccaaaagacuucucucaugggucuuuuuacaugguggcaguguaggagaagaaacacaaauauccuguauucugguagccccaggguguguauucgaugggcaaggagauuguccaaggcaguguaccuuaauguguuuuuccagaucaauaugugauauccaaagguauccaacauuugaaaguuuucacuuuuaauuugggaagaaauaugccugacuuaccaguagcacuuuguagcaucagguaagacagggguuaucugaaggggugugugugucuuccccauacucuucuuuagcggaaaggcuuauggugcuccaguuaggaggcuuauuaaauuauuugcuuaaauuuguacuucucugaguucaaguucaaugguauauuuucauccuucuuaggaguagggcaguagagucagcugucagaaaauauuuauuuaguaccucaugauagguaauauuaugcuaagggcugucaaaggagaaccacauuagaaccuucaaaagcccagauagauauuuugaaaaaucugaauuucaaacauuaaaacaaagaugaaaauuaucuuucuagaacaguucaaaaccaagguaaauuuaauauacuucauucauucauucuuaacuuauaaugucauauccuagaaacuuuuagguuauuuguuauaacaaacauuacugauuuguaauuagcacauuaauuaucuauauucauuacguaauuuauucagcaaacauuuauuuucuccuccauauguaaauaggugucucugaaaggccugauaaguucuccuccuaaguguuuuaauauauccgcaucauaaucuuuguuuacacaauuaaacuucauuauuuaugaaauagggguuugcuaaguaaacauaaacuucagcacaacacuauguguguaucacaaauucugacuucuugaggguuuacaguaugcuagugcuuucaguccucuaggguuuuacaaucauaagacccacugauguguauguugacuuuagcuaaugaagccauucagcauuaggauagugaucucucuuuugaaugauauuaucuccaucuuaaaaguugauuuaggaucagcuuuuggagugaggagaacaauaagggagauuaaagguuggccucuaacccuuagaaucugagguucuuuggugcuucauuucuaagaggauaucggcauccucuuaaacaugauuugcagcuuucagccuucuuguagcucccugggagaggcgcuaacacugaucuuugcgucugauguaaguucuuccagaggcucuuaagcaggaauaucugacugagacuugcuguucccacacacucugucauuaaauaauuuccauguguguuguuuuaguacuuuggccguguuuguuaaucuacuuuccuuucuguaucucccauuuagugucagaaugcauacuaaauuuuuacagugcucaugcauaaauccguagacaaauuauuuuauugcuaucuuuacaaaauuaaaacauaauauguguacauauuuauggaauccaugugaucucuggauccaugcauacaguguauaaugauuaaaucaggcuauuuaggauaucugucaucucaaacauuuaucauuucuucauguugggaauguuucaaaucuucuuuuuuugcuauuuuaaaauauguaauauauuguuguuaacuguagccacccugcugugcuaucaaauacuggaaauuauucuuucugucuauuauaacuguauguuuuuacccauuaaccaaucucucuucaucuccucaccuccccacccucccccaccucugacaaccccuucgaugagaucaacuuuuuaagcucccauguaugagugagaacaugcuauauuugucguuuuuauugcugucuugacacugcggaauaaucuuucuggaacaaaauuuagaaaaaaacaauuucugaagauuuuaaaauuaucauuuacuacaaauuacaucuaguuuauuuauggguaagcaaauuauguuaacuauggagccauauguauucaauagaaacuauaaaucuuugccuaaauauugcaugagcuuaauaaauugaaaauaguuuauguaagguggaaccucuaaguuuccuguuaauaacucaggucuaugaauuguauccauuacugugauaggaagccagacagauuguuuacuucacuugagccccugaaauacuccuucuagcauguaccccacuuccagugucauauagaacaugguucuaauaauaaauuauaaaacaugcgguuacugugggauuucuuaccucacauuuuuuuaaccuuuggugugccucaagccacaacagacauagcuacauuuuagcuguccaaauaauucaagccaucaggcacuuaguuacucauuggauacaaguauuuucuguguaaaggauguuacaguguauuauauaacaugaacaaucuaucagaaggcugauagauaauccagaaguuuggagcuguuacuagucauguauauacugauguauuuaauuuuuaguccagaaagggagauguucauuguguauuccgugguuacuucucugugauaaagcuuguaccuccuaaucauacuuucuuaaaaauauuuuaaguuaaucuuagccugccuaauauuaaaauacaauucaaaggguagugaacacauuuagaauauucauuaaaaaugagggguaagaaaacuuccauaaaaaucugcaaucccuuuggaauuuuauacucaacuugaggcagaugggagagaggaggaguuuaaguagaccacguaugcuuagagugcaucucaggggcucuagaauuuuguugcaaagccccagaguacaauuucgugugagcuuuugaagggcugauuaagacagguaaagaaauggaaacuauucuuaaggaguucuuugacaccaaccugccuggucuccacuuugcacauuaucucuaccuaugauuuugcuucugcagcagucccuguuuagaaugaccucccucuaaucucuuacucauucuccagaguccagugccagcuauggcuuuucgcagacuucuuggacaauucaagcugguauuggauucuuuuucccuugaaauucuacagcaguuuuggaucaugucauuaauuuggacaguuucauuuucaucuauuuugguauuuauguguuucgcaugaauguuuuacuuacccagcuuguugcccaauauuuuuauuaagggcaauauaugagacuauuuuguacacauugcagccaacaccugccagcaguggacacagucaguaauuuguugaaugaacaaauuuucagcgaacagguucauuuauaccucuuccucugcuuuuaacacguuuuugaacuguucaucuuugcuaaccauuccagucuaccagggaagaaguuuggaggagaaagcaaagaaggaagggaacucacaaugguugagcacguguuauacacuaggcaugauucuaggcucuuaucacuaccuauuucauuucauccucaaaauaauccuauguguccgguuauuauuacucccauuuuacaguuaggaaacuagggcacauaacuuauaauacagagggaguuuaaacuaaaaggcuauuuaucucucaagacucugcugauucuaacacaauaugcugccucacagcuuuguucaugauaucuaaaauuaaauuuaaaaaaugugaacagauguaauuauacaaaauaucaugagauauuuugauaaagacauacaaugcauaauaaucacaucaggguaaaugggguauccaucaccugaagcauuuauccuuuguguuacaaaccaaaaauuauuauucuauauuaucaacauuaauaucaacauuaauauuugaguggauuagaagucaugauauuaauaauuauuaucauauccuaacugggaggcugugaauaaugauuuuugcuuuuuuuugugaaacgguucucuguuuauuuauuuaacaaugauuugguuuucgagagccuagguagugcaaagcagcuuguuugguguugcugagugauaggacucguauauucuguuuccuccaaggcauuuuuaacuagcagagugacagauguaaugucaacuaauauaaaggagugaguaaagaagguugaggaauaggauucgggaaauugguaaccagugauuauaaucugauugccucaaauuuccaagcuugaacguugcuaaggugagcaaguuuucagguccuacccagguuguaugguggguauuagaggcuuaaggugaagaaaguucucucuaucuuugaccagaggcaugaaagauucucgauuauuacauuugaauagaggucagaaauacgaaugucauucccagugcuucuuugucuuauuccucagcgcccauaacccagggaacuggagucaacuucccaauuggagaaaucccaagccaaccauacuaucaugacaugaacucgggggucaaucuucagaggucucugucuucuccaccaagcagguacugaaagaagggcugcucauauucucaagugauacacacauagguucguagguggaugauaggcagauagauagguagguagguaaagagagaugggaaauaauuuuugcugguaguacacagauuuuuaaucuuuccugguuaaauuuauuuggcuguuacaaauuaaauguaauuguuguacacagcaguuuuaaaaaucuuuuucagggggacagguaacuaggaaaauauauuaauaugacuuuuguccuguuguaggaaauauuaaaaugcuacaaguuaacaaaaucuuuugauggcuuuaaaaaugauguugcuguggcaaugaucucugguuuauaacugauuccugguaacuuuuacccaaauauuacaucuaagcuuaggauaaugaaacauaaaaaauaaaaugugucauuuaccuagccuuaaaauuaaagaccacaguuugccaaguucuucaauuaguugauguuuuuugacuaauuuaauuaacgcucuguuaccaaugaaaauacuaccuucccugagauuugguuuaaccauucuauguugggggucagcuagagagaguucucuuugcuuuuuacuucucuguuaacauucucauuuuuuuuuuccugaucuucucauuguaauugccagucagggugaauaaagauuacagauguguuaauuuuuuuuuauuugagcuagaucuucaagacccaucucauuccuagagcauuaaauauauguguaaucaaauauaagagcauacaugaauucuagagcaaaacacucauuuuacaaugucaacuuuuuaaaaauaaaaggauaccuguauauuuauuuuucuaaaguauucucaguagugaaaguucguugaauuugaauuaauuauggacugggcauguguauguuuauaaacuaagaucaauuuuauaucaguuccgguuaaaccauuuucauauaguuaaauuguguagcaagauaauuugguuuauuauuaaaauagucucugacauaucaaagucuuagaaaugcuuugauuuuucuaaauuuaaaaugugagcaguaauuuuuaaauucugucugcuaaaucacuguugucaacacagaucuuucuuccugacuacuuuauauaagauacugucuuucagaguaagcaagguuuaaaaaacauuucucuaguacuuccuuaugcauguaauuuguccccaauuuuaaguuuuucaggcagauuuucugcugacucauagaugagagaauauguuuaaaagagaguuaaaauguaaggucuaacuuuggauucuuugggaagaaacuaagcuuagcauggauagaaauugccaucuucuacaucguuaauacucugagaauugugagucaaauauuaaucaugaguaucuacaaauguacucaggcauauacaugauucaagggcuuggaaacacagugcaguggaaagagcacacuugcggaagucagacguccuuaccuuaugucugacugcuuccauuaacuugcccuggacaguccacugaaucucuccaaaugugucuccccauuuguaaaaacaaggggauugguuuauguauaugauuuuugaggucaauuucaaugcugaaauccuauaacauuaugguuauuauugcugcgaaaagugaauuuugaagauuuuuaaaaagguuuuaccagcauaggugugaauaagauuuuuuuuuuaauuaaagaaaaaauauucacugggcacagugacucacagcuggauucccaguacuuugggaggcccaggcaggaggaucacuugaaccuaggaguucaagaccagccuggacaacucccucucuacaaaaaauuuuuuuaauuagcaaggcuugguggcaugugugugugauccuaacuauuugggcggcugugguaggaggaucacuugagcccaggagcuugaggcugcagugagcuguggucaugcaacugcacuccagccuggacaacagagugagacccugucucaaaaacaaacaaacaaaaaaagaaaagaauucacuuuuauagucauaauuucauaauugucugcuuuauuggugggggcauaugaaagaaguauaucaaccacuauggguauaaaauagcuucuuaaucuuuguucuggauagucaccuuucuuauucauugagaugagucauauuuccauauuaaaauguaucauuuuggcugagcacaguggcuccugccuguaaucccagcacuuugggaggcugaagugggaggaucgcuugaguccaggaauucaacaccagccagggcaaaauagcaaaaccccaucucuacaaaaaauacuaaaaucagcuggguguggugacaggcaccuauaguucaagcuacuugggaggcugaggugggaggauuguuugagccugggagguggaguuugcugugagccaagauugagccacaguguacuacaucguaggugaaagagugagacccagucucaaaaaaaaaaaaaaaaaaaaaguaucauuuuaaaaguuugaauuuggcaguggccuucuuuuuuucacagucgauuuuaagaauaaagaaucaauaaucuaaguuuuaagaaaaaguaaagaauaauauaugaaauaguuuauaaucaguaaaauacuauaauuuuuuauuauuaaugauaggguuauuacuaagaauuacuauuugauaaguaucuucuaaaugccagccacuuaacuaaaagcuuuacauuuaacaacucauuuuacucuuccaaccgucugccuuugaacuagguuuuauuguuuccaauuuacagaugauuaaacugaguuuagauaaguuaaggagcuuacuauuagcaauucauaaguggccuacucaagauuuuauacuaggacugucuugaccccaaagcucuuguuuuacuuuauuaccuuaucuuuggauugcauugucaaugacaagugcuauuaaaaggaacauuguuaguauugauaauaauaaugagucagguacacaauaacacaauuuuaauguuagaaggcaaacaacauuaagaguucacuuuuuauuaguggaauuuuuuuuggaaauacauuugaaagauaaauauaaugaacaccauauuuguuagacagguuagguauaagauggucuaauaaaugguauaugcaacuagaaauauuugcuauuacuauugauaucuucaauacucaccauuauacucaccauuauuacuugugcuuaugaaaauuuucacaguaaggaucuucucagaucauuuacuuuaaaauguacacaucuucccagaaaucccauuaauauaacuauugccauauuuuaacagcaaaagacccaaaacuauauccauagaugaaaauauggaaccaaguccuacaggagacuuuuaccccucuccaaguucaccagcugcuggaagucgaacauggcacgaaagagaucaaggugaguaauaaggagaugccucuagagaccaugaguaaaauguuggcucguuucuuaaguuucguugagucaaaauuucauaauuaaaccaauauggauuguauauuuuuuucauaaaaugauuccuguagaauuauuuuugagauaauguuagucaaaugucgucaaaguuaauuuauccaaaaucuuauuuuuacauguuucguuggaguuuuuuuuagacaaaaugauauuuuagaacccacaauuauguaugugacugauuauggucugucuacauuuguugguuggaguacagcagaaccacaaacugugauucaauuagauccgccugcuccucucuauggagcguugcagggagccaaacuuuaagcaguuugcaagugccaggaacugaaaguugucauuuaaaggaaccugcaauuccuuuuggaaguagguagaccauauacaauaaagaaaaguguaauguaagauacuuuguguuggagucaaucuagcuaugcuuucuagauaaaacugugacccaguucuagggcagcuuugaggagaaauauaacuuuaagaaauggguauugagacccggaaggauugagacuuagcucuucuuaaagucuguuggauuuacuauauuucauuagauauauccaugcuuucccccacaaucagagggagauuauuaagcauggaaauagaaaaauuagcuaacugaaguuuuuguugguauguaagcaugucugcaaauaagaucuuaaugucagcagcauaaacauguauuuuuaaauugucuuuuaaauagaauucugcauuaaaaaaaaucuagccugggcaauguggcaagaccccaucucuacaaaaaaaaaauaaaacguaagccaagcauaguggugugcgccuguagucucagcuacucaggaggcugaggugggaggaucaguugagccugggaagcagaggauggaguaagcugugaucacaccacuguacucuagccuggguaacagagugagacccugucucaaaaaaaaaaaaaaaaaagucuaaaagaaaggaauaaugguuuucagcccaggacuuggguguguauuggugaggguugggguacucuauguugaguacucuuaggagacacauaacucugggccuuaacaguuaaggccaaagucaguucuuuauucagugcuccuucuuugcugcucaaauuuuuuauaccgagugccauggaguuuaaagaauagugaaaaaucuucauggagacauuggccuuugagucaaguguaccuccuuuagcacaacugacucaaagcucgauuccuaaaucucaucuaaaucuccuugagauuuuaacuaguaaagaagugaggggcugaagagggugguggugggaacugagacaaaagcauaacccuguguuagguggggaggcaaauuugagaauggcugugugugccauguggcuggacacagugcacauggagggaaauaauagagauggcaagggucauuuuaugcaaggauaugaaacucaacuggagaguuuugacugugagaccccccccucagacggaauuuugucucugagacuccccucaugagagaccccaccaaaucuauuuuucaggcaguagguaaaaaucaucuuuauaaaauguaaauaacagcauuuuauuccccuacuucagauccuuuagucaauucccacugcucucaggaaaaaaugggaaucuuuucauaucaccaacaggccauagccuuggcaggugacauucugcuuccucuugcuugcacuugagcccacugcuuuacuugaaguugcgaauucaacaaccgggaccuuccuauaaguuaugaccucuggaaugcucugcuaacucuucaucuggcaaacucuuugccauccuucagagcccagcuuaaacugagaaauuucagucuaaauucugucuuccuaguuuucucugucaacacccaguacuguucuuucauuguacucauaauauguaaucauauagcuauuuaugggauuaguugucuaaaucugucuacacugugagagaagggaccuugucuauuuugacuauuacuguaaccagcacuuaacacacacuuggugcguaguaggaguacaauaaguaguuguauaaaugaaccauugauaggcagaacaccagucucauuagugaaggcaagauauaauagagacuuuuaccagaguugcagaagugaaacgaaaaacaaaacccucaacccuuuauauuuuauugcuuguuuuacugacauugucagcuuauucuaaacaaagccauacuuuccuugucagaaaauucuucuggagaagauuuuaaugguaauaaccuugugaaugugugggaauggaugcguuauucagaaguguagguguucuuuauuauagagagugucacuuuguaagaauugauuccucuuuaagccuacugaauaaagccaaucucaaaucauauuaugaaacauuuuugaaaaguagaagggaaacugucauucuuuuucuuugugaaaacauuguauugucuuggugauuuucuuuugucaagaugacuagacuuauuggaggagucuguaaaggcauauuauguuuagaggaaggaagaauauuccauucucaaaugugcauuuuaaacacacacacacacacacacacacacacacacacacacacacucugucacuuuaauucugaagacccugaagacuucguaaugugcacaauaagccauugugggaagaagacucaacuacaaugaagaaaugcgggcaguacaguacuaucuuuauaaauuugcuaagcccaaugcaguccuuuuguucuuagaaaauugcuuuuuaaaaauuugcaaaauaaaaugcccaaugguuguucuuguccaucuucuaauguucuuuagacacacuucccugugauggagggaguugucuaaagcacauauugagugccacuccagucauugaaauagcuuugacaugucuuguauuuauaauauuuucuccuacaaagcccugcacuaauugauacucaauaacuauuuauugguuaauuaaaauaugcuuguguuuaaaaugggcagaaauccuuaaaauuuacuauuaauuauuuccuggguaugccuuauucuguuaguguuaaauuugcauuaaaaucuguucuugacauagcccuuagcaaaauugauuuauuaaauaugagaaucaaagauaacaaaauuauggacaauauguggcauucugcuuucccuuucaaucugaaauaccaaccuaaaccauugagauuuauucugaguaggcaaaaauaaaggauauaauaugaccaaauuauuauauguauucuguucuuaaaauaaaucaggcaaaauauuaacacaaaaucuagguuuauguaauaauauguucaugcaauuuuaguaacuuaaugaaaaaguauuuuuagcauauuacaauaauaaauuaauuauguccuuauguaauuucuuuucaaaacaaaaaguuacaacuuccugauuauaagagaauuguaauuuauacuucugcaaauauagacaugaauauuuuaaaacuaaccauaauuuaauaguguuaagcauuugguagggggcuauauaauuugcuucuucugaugaauagugaugaaaauuaaauuugucagcaucuauauuauguaguauuuauauuuuuacuuuguauuauuuuauauauacagaacaaaaugaaaaggaaaauaauacugagucacuagcaaagggguauccaacaacuguuauauuucuuuccuauguuucagaauauuucuccuugcuuagucucuucuguaaauccuggucuuaaacuccugacugcuucucucucuauuaaaaacuuucuuuuuuggauauugcuuuucuucauuuaagauuuuaaugauuaaugaauagaaccagauuagacugucaacaggcaaguugaacauuucuuuuauuccaauacuuccuccauaaaaaauuccauuaagaucuugucuuucuuauuuuuuuuuccaucugagucaauucagagacucaauuucuaguugauguacuuuuuuugaaauuuuucuuuagagcaaucuuuuguaacuuuugauauaagaggaaaaauaagaggucauaguuuuucgucuaauucaaguuacucucaugagacuaaauccaguuguauuccguugcucaguguguuaguccauuuucaugcugcugauaaagaccuacuugagacugggcaauuuacaaaaggaagagguuuauuggcuggguaggcuucacagucaugguggaaggaggagcaagucacgucuuauauggaugguggcaggcaaagagagagcuugugcagggaacuccuguuuuuaaaacccucagaucuugugagacucauucacuaucacgagaacaacacaggaaagaucugcccccauaacucagucuccucccaccagguuccucccaugucacgugggaauugugggaguuacaauucaagaugagauuuggguggggacacagcuaaaccauaucacucaguaauuuaacagacaaauaaauaguaugcuugaacauugaaaacaauucuuuauaaggucacuuugccacugccauucuaauagucacuaauuuaucuaagucugaauguaaaauuucuaaaacauuuaauagacauuuaaugagaaaaaauaugauauguuaaauauauuugcaguaugcagcuggggauuucguuguuuuuuuuuuuuuuuuuuuuuuuugugagcagcagcaagauuuauugcaaagagugaaagaacaaagcuuccacaguguggaagggggaccccagcggguugcccucagcuggggauuucuaaauggaaauuugaacagcuuuucagccagaugaguauuuaaacaaccuguaaucuuagauaaaauauaaauucaaaaagacuuuaugcaguaaaauguuauuaauuucuacauguaugggauuugagauaauuugguucaaugaacaauuugucaaaugucuauauuauauuggaggaauuuuuauaggcauuggguacacaaauaugaauaaauuaaguuuccagcccuugaccuccugaauggaaaaguaacuuuuacuauuuagaaaaaucggggacuaaaauaaauaagauuaugagagaaccgacuccaugcuuuagagcuagcuuaguuuuaaggacgaugagccguaaaucuuuacauaaaaucaauaaauuggcauguuagcaaaaacuagcacuacuugguauauuggcauguuauuacaauuuggagaguaguuugaaaaauuaaacuggacucucaagcuauauuuaggcauuguguucuggugucuuagguacuaaaaaauaaaacuacuaauuuuuauacaagucuccaguucuguuauauaaaugucuucucaguuaagucuuucugaaauuuuaauuuguuuccaaguccuagagauuuauuuuugauaauuuugaaaauauucucauuaguaagguagucuuaacuguugugcuaaauuucaguuugcacuuucuagaguucuauaaggauauaguauuaaaugucaaacgcauuaagccagagggcccaagggaacacugggggcuagagaguaaaaaugccaguuuaguauuaugugcucaaucaggaaauaaguaacaguaaauaagagugugauagcaugcugacagaaccagaaucagaggccagcauuucuguuuuuucucugucuguugcccaggauggagugcagcggcacgaucauggcucacuguagcccugacccccccagguucaagugauccucccaccucagcuucacagguagcugggacuacaggcacuugccaccaugcccagcuaauuuuuaaauuuuguguagagcuggggucucacuauguuacccaugcuguucuggaacuccugggcucaacugauccuccuaccugggccucccaaagugaugggauugcaggugugaggcaccacaccaggcuccccagcauuuccuaaugugaguuuaggaaugugaaaagauaugcuacauacaaaagaguggucagcuaaauuugcaaaguuuuuuuguaacaaaaauuucaacuauuuucauucauaaaugaauaugcagaauauuuaauaugcuacugugugcugugaauauccaggaguggcucuugacugaacauguuuauuaaguuugugacuucagaaccuuuuauuucuaucaaagaauccauagggagcauuaauccuaggcccaaacuuuggaacacagugcucuaguccaaaccacagucugacaaaugauauaaucucaagauuucucuagagcugugggagcugagugaauaagcagcugucauagaugguugaauaacugcuaucugggagucauuaacauuaaaugaaguccuagaaaauggcagugcagacagcuuaguaaccauacuggaagaaguuuuaaaguucucuuuggggaccaaauagaacaccaacaauuccuuauauuccugcaguuaguaucacagggaugaaauggcaaauauucaaauaccaaaguuuugaaccagaaaaaaagagagcuacaaaugcuuuugguggaugaaugugaagaagagaugguuugaauuugauguucaagcccaauuuuuaaguuucuuuguuuagcuucuuauuauggaaaauaucaaaaguaaagaacucuaagugaauuucuagguacuacccuggcauuggaaagcaaacuucaaggaugcuuccacccugaagaggaaugccucuucaacuacacugcuacacugcuguaauugaaaaaucacaacacgaucuucuucaaaauggaaaggaaaacaauaaauuguuggugaaggcuuucaucagaauuccccacauugccuccuaauuagugaauguuuguucccccuucauguguucuaaucaagaauagcauuuuggaugggguaaacuuguauacauguuagaagggcugguacugauuaauauggaaaagucgugcucauauuucugugcucuggaggcuuaaagauuugaaaauacagcauuuugcagaaaaaccacaauagauaauuaguuugaaaaaauaacaacuuucuauuuaauacuggguuucuagcuugauggaacacagcuuaaaauagggaagugggaaacccaugggagauaaugucauagugugccauacaaaguuucucugcauaagaaaagguuuuauuucaaaucuuuuuacauauugaguucauguuuaagcuuauugugaaguaguuuggaaagccagugucauuugaguuauuagacucccaauaucauauacaauaagaaauugauuuuucagguacagaucacaaauuauuagaacccuuaguaagacauaauucaagcuccuguuucacagcuaaguaguccaaggaucagagaggcuguccugucccaacuaaugaauggcagagccuagaucuuuguucaagggauuuuuuucauuuucuguuauccugcagccugccuagggaaucaguauguaaacuuacaaauggccuaggagauuuaaacacugcuucgcaagucuucccagagggacacuuuucuuggaaagcuuaaggaagacucuguuagaccuaacagaacuagaaugagaaaauagagguguauuugugaguuuucaggguucugaaagaauucucaaaacaaaauuuugagaugguaaaauuuuacauauacauacacacacacacacacacauaaaucaacuauuauuauuagugccaggauuaaaauuuuuucaacuaaaauaaacugaagauaugaaugcuuuugaagaauaaauguggggaagaguuuguuugaaaugaauguuuaagcacaauuuuaagaagucuuuuggccuggagaauauugaaaguagaauuguaaagugaaccucacuguacugucacacagcuucaacuguuauuaacacuuugccagucuuauugcauuuacuaucucccaguuuuuaaaaguauuuuaaagcaaaucccagauaucugucauuuugcauguaaauagaucugaauauuucgaacaaugaacuuuuuuuuuuuacauaaucacaguacuauuaucaauuuaacaaauauaacauuaauuucuuaauauaaucuaacauauaauccauguucaaauucccuagaauaucucaaagguugucuuguuugaaucaggacucaaauuuaguccauagauuauauuuguauuuucaccuucuuuuuagccuacacugauuauucgccuccuuuuucuguguuauuuauuuauugaagaaagcauguaaauuuaaaaauugucuucaacaagcacauguaaaugaaacauggaaaacaagauucuauugccauuugugguugucauuuauuuauugagcccuuccuuucugucaggugcuuggcuaaguuuauaucuauuuuucuuuuaaaccugacagaaaccccauuuuacagcuuacuaaacugaucaugcuuaagaaacucaucauagaucaugcagaucauaaguagcagagguagaaugggaaccccuggcucucuugcugaagaaacccaugcucguuauugcuauauaauacuguaucccaaauaagucauugagauauuauguuuaugauuuugcaaacuaauuauaaaaccucuguuacaauuuuuuuuaaugcaugaaacuucaauacagaugaaugcacauaacuucacagggguucguagacuccuuagagauucaugcauguaguccuugcucugaaaucagguuaaaaucacuuuuccauuuaauaagauaguaauaaauaauccuaaguucuagaaugucuuuaguagaagugugugauauauggccaguuuaaaaugagcuauauuugucaaaauauaaaaauaaaguauauauuuauuaucauacauauguuuucuuuuaguucuguucuagucuuuuugccuuaagccuagugcacuguaauugugauuaggaaacucuaaauacugguguggucuuagacaaaucacuuaacuucaguaacucuugaguuuucccaucuguaaaauaacaaaguuguauacuaagauuuguguucuaauauuuuagauuuugaaucuauuggaguccaagaauuugaagaucuucaguacuugagucuuuccaaagccgucauuaacauggaucuuuuggaaaauucagaaaguuuucuguuucuuaaauuauuuuuugaauguucauuuuaaacacucucauugaauaacaauaauugggcugcuuaugugcuuggaggccccguauauuuugcuuuauaccugaggaaugcgcaguucucacaaaugcauguccuguccugcaccauucuggugcaacaaaugauugauagagauugaguuauuauaacagaaccuuguuauggaaucagugucuccuacuuugaaaacaaaugacucagccagacagcaacauuuauuuucucuaaaugacuagggauguagcaaugggagaccauuauccugugacaauauucgguuucauugacauuaucucacaaauguaauugguccauuacuaaauagagguuuuguuacugaugaauuucacaugauuucuaaaaccauuaggauaauaaauaugccaucauaguaauuucauugacagaauguucuuuuuuucuucauuuacauuuguuggagaaaaaaaauauagauuuagguugaacuuaaacacuacaauuuauaccaauuuugacuacuuuuccauuaagagcaacagaauauugugcagaguaaucauauuugcauugagcugcugaacugaugaccuuaaaauuuuuguaauucuuuuucuaccacacuaaaucacaucaaaucauaauuguucucaagcaauuaguuuacuaccucaguguaaugauuuuauuugaaguaaguuccagaucauuuauaggacuuuccuguaaauccacuaaaguaacacaucaguuaaaucaacucuaaccauuaccagcguggauaauaacagcauuaguaacaacaaaaaccuugagaugucuuguagcauaaauguuuuuaaauguauggcuuuuccccaaauguucuccucugaaaacucaucuguaaucuuguuaaauuagagcccuuccaguaucuuucugacuuuuacaguuaagguuaugguauugauuuuauuuuauagcccauggcucucagaugcuuaacauuaauaagacuccauagccaagagguuuucccgagaggcauggugaauagcagcuauuuaccuaugccaguguuuaauaagugacgaaaauaugcuccaaguccugcauaauuguuugauguuuuuucucucuuucaaauuagguuuacacacauuacucaagacccuuuaucauugucugucuguuaaaaugaaauugcuuaguggacaaaagcauuuugaaguguuuuuaaaaaguaguuuucauuuauuccauauucacuguuuuagcacuguucuucauuauucaaaggauuuuuuuaagugucucuggaagacauuugugagcuucaaagagguuugcuuuaacuugguauuggguguagguguagccucgagaccuuuuuuauagcgaagugauaaaauugagacuuguaggaacaugcuacuuaaccgugcuugggcuaaaauauauggcaagagagacuuaaacuauuagaaaagauuuuacuuuacugaggaauacaauaauaugcucaaguguaauuaagauuaaauaacucaguaauuaaaguaagaauuucauuuauuuaacacaaagaccaccauacuuucucauuugaaaaggaacugauuucauaaauuuaaaaaaaaugguugagaaaucuaauugaagaugacaucuuaucuccucuuaacguagcuugccauuuuuuccaguguuauuuuagagugugauaaauguaaauauauauauauaaggagauacuuucuuaacauggcagcuaauuauuuuuugaaucaucuggcaucaucaucaaacuacuguagugggauuacauccauaugucuugucauaacauucagagcuuuuuguuaacuuggagugugugggaaggacuuguucacauuugccacacaaucauaaaauuuuacaucuagaggaguccuuagacacagauauuuagauauucuuuuuucuucacuguauuuucaaaagacauuguuuugccuguagccaacuaaauugcaaauguuacauugaagcauuucauuuuacaguuuugcaauauccaguaccuaaacuaauaugaagcuuuccuucuugcaguguaaugugggacaccuaacaggauucaauauugucagcccagcuuugggaauuauuuauaguauucuguggagcuacaggcaacaauuuucccaaaaauaucuauuuuacaguuuuuacaguaaaaguaauaguuauuuguggggaauuugaaaaaacaaacuuucaaauaugaagaagaaaauaaaaaucaccuguaaucucaucacauaaagauaacuucuguuaguauuucauuguauauaugcuagccuguuuuucuauguauuuuucugcauuucggugcguucuauuucuaugaauguauuuuugcaguaaauugagcuuauaugauauaugcuauuuuguaaguuuuuuugucuuuauaaucuaauggcauuuuaccauauccuucaauuuccuuuuuuuuuuuuuuuuuuuuuuugagacagagucucgcccugucacccaggcuggagagcaguggcgugaucuuggcucacugccaccuccaccucccugguucaagcaacucuuccugcccuaaccuccccaguagcugguauuacagaugcacgccaccauggccagcuaauuuuuguaguuuuaguagagauggggauucgccauguuggccaggcuggucucgaacuccugaccucaggugacuugauccacccgccucggccucccaaagugcugggauuacaggcaugagccaccccauccagccuuccacuuuguaaugaguacauaauaugccacacuuuggcuacaccauagaauuuuaaauaucuacuuugcugaugaauauuuagauaguuuuggaguuuuuguauuauaaagagagauacagugaacaucacugcauguaacucugugccuaaucugauugggugauucuugucuaguucuuuucacugucccaagucccuagcauacugccuggcaugaagucaccaaguagaaguucagugaaauuuugcuacgggaauaaauacauuccuacuguagaauuacuaaguuaaaucuuauguccauuucuaaggcuuuugguaaauauuggcauagaucuuaucaauuuacauucccuagagcagugccugaguggcuuaacuccauuguuauaagccguaauaauuucaauguagcacauggcucuauaagcaauuucaaagcauguccucugacagaaauuuauagaacauucuuuauggcccugugacuuuacccaugcaccucuuuuuuaucauuugaauuuuauuuaaaccaucaaggaacacaccaugugucuucuccccaugagccaggauagcuccauuugugaagaaaauggagaaauugagaggguauuguacaaaggauuguacaaagcuuucaaguaaaggcagagccugcuuggucucucucuccuuucuuccuccuucaggacacacacccucacccaucaucaguccuuuauuuauuagguaaaaccuguuaaaguaaggauugcugucauucucuacauggagauccuuagaaauaaauaccucaaagcuuuggacugggaucuuaaguaucuggcaggcuagaugcugccccaaucuggccuuaauaguugucuuauucuacauaacacucauacacuuauaaauaaccuggacacuuuccucucuucaacacuguuuaucccagggcaaaaacagaggcagagaaauuguggucuuuuuagcuuucaguuggcagucaucuucucugccuucuccuuguccucugggaacagagcccaaacuguuuccuugucucaggacugacucuggauuuguggccugaaguaaaaaugucagauuucagcuacaaaacucaucccacacacuugauuugguagccugucauuuacuaccuuauuuauuuuaaauaacauuauuaucuuauacagaugguucuuuucuuuuuccuguugucuuccagcuuccacccaacauuuuaauggaaagcagaaauaucccaguuaagcuaaagcucauuuuucucuuucagugcuguguugcuugacagaguuucaauggagugauggauguguugaccaccuuugccuucacccagcaaugaauuuggucucugaagagguuuucaauauucagaguuuuuguuuaucuagaaaacucuuuuaaaaaaaaucuaugaaagucuaauacuuucaaaaguccaaaaaaugaagaacuuugaaaauuaugaggguguaucaacuugauaaaacuugucaauauaauauaaucuugucaaaucccagccauuggacugucucuaagcuaagugugcuuauguauguucuuuccuucucuggucuguaucaaacuccucuggucaguaucauaccagagggucaaaguuaacagaaguuuugcaacuguuuucauuacacuuugaguuuucuucugccaaaaaauaacaaaaaaagaagaugaagaaaaaaaggaagaaaggaaaaaagaagaccguaugcaaugaaucaagccuauaaucucaacacuuucaaaggccaaggcaggagaucucgugagacuaggaguuccagaccagccugggcaauauagccagacuuugucccuacuaaaaauuuacaaauuagcugggugugaucgugugcccauaguccuagcuacuugggaggcugagaugggaggaucgcuugaacccaggaguuugaggcugcagugagccaugauugugccacugcagccugggcaacagagugagaccuugucucuaaaauaauuaaauaaauuuaaauaaauaaaugaaauuuacacaauaauaaaagauagaaaggaaaaagaggaauccuguaaauuguuuagcagcuugauaaugugaaaaauaaagaaaauauguagauauuuuaacaaugauuauagcuuuauaagcacuuagcaauaaaacaaaccuuaacguuaaauacuggagaauaaaaguagccagcaaauggugacuugucucuauaggguucauuuagacuuguuuacaaguuacaaguauggcauguaaauaaggaagacaauuuaggaauauguaaaauaauuacacuuuuaaaacauuuugaaggaauuuacuucuuuguuaaccagauagaaauaggacuauucuauccuagaaaaaggacuaaaucauaggacuggcaugguuaauacauuuuaauuuagugauaugguuugcugaaaauaauagcuuccagaaauucaagaauucuugcguguucuuacauaauuaauuugaaauuguuaaaaauuguguuacuauagggaagaaaaggaauuuuucaaaaaagaaaauuguauguuuucuauguaggcuuuaguagucugauuuguaaccuuaaucuacucgagcauauuggaaaagcuaacauauugcucuacuauaugugaaaaaggagcaggugucccagacaggcagguguuaaggugcuguuugagcuugcccuagaucacuaguugacuucaaugaaguucuacuaacagguggcuaacugauuggagugccaugugacauuuaucccgggagcgacuuggaugacaggcugcuacagacugaggaaggggucuuugcuuugaugaagaaauugccaaaacucaugucucauuaguguuuccuaagguucuuuggaagugaacaacaguuuaauuaagggcugacguaaacacguuucugcacacuuucccugcagcauuuuaucacauuagaauugaucaaaauuguugccuugggcugacuugaacagauauacaucuggagcgcaauuugugcaagcugccgaugagucgaguacauacgcuguguuucacagcgacucucuuccuuuguagaugaaauuaccuuguugggagaugaguugaucuaacucuuuauuugcuuaaguccuuaucucuuugaagugaugacgugaaauaaauaacacaucaaggccuaggauguauauauguuacagugccaaaaauauauauaguauggucaggaaaaaucgugugauaauuugauuuugcaaaauacuuauuuaaagggaugcuuaagaauaaaugaaccaacuuuaucaguagccuacuugaacuuuuuucuuacauggugaucuuuuauuccauauucaacuacacgaugaguuucuaaagucauagcuaauuuuccaguuauaaauguaaacauggguguacacauugaagaauaacaccaucaaugugaaucuuuuuaaaaaaauuauucucucuaaucugucauuaagaagaauucuuucugcaauccaguauuauuaugauugcaacuauuuaaugcauuucugucuuuaauuucugcccucucuacuaaaccaugagcaucaccaagacagggaccacgugguuuuguuuggcaucuugaugcauagccauaguuccucacacuuacuagaaucucagugauugauuuucuuuucucuuugcuuuacagucagcuacuucucaucuggugauauuuauucauggaacaugaauuuuaagauauacuggcuaugguuauuuuucucauccugcacuacuagucaucacuucauaauacaguuucuuucacaugccagagauucuaaaauaagcugccuagacacggugccugcuuuaccucuucuuucuuucauuucuacuuuuuuuuuucauucucuucccaaguagcauauucuuccagccucuacaucuuuuuguguuuuugguaaaagcauguuccuuaggagguaagccauuagucaccuuuuuaaaaaaagcauacgcaguggauacaaguaaauaacaaugaaaaauucaucaagcaauauaagauacaaacaaaagaucauuaaugaaaucuagaucucagggauuuccaagagagauuacuuaaggagaaaacaaguuuguucaguggauaaaacauuguucuaugcguggaauaaggagaguggaaaugccucauuuucuaguucaagggaaugucauagaucagggauggcacagaguuaaaaacauauuucuccugcuccuaauggaagccauaagaaaauuagcuucacugaaguuuaaacaaaauggaauaacaaagaaaaagagcuauuuaaaaaugugauacugugguagaucuugcaaugagaaagauacuguuugaaggauacgaugccagcugcugguuuuuauaaagugccauggagaggaaggccuggaggagacuaggaagaaaauuuuugguucagccagguacaagugaaaagggcggugagaacagaaaaaaaaagucaaauuuuuggaaaguuuuuucuucuaaaaucaauucauuuauaaauuauuacuuucuaaaucaaauuuaaauuguucugucugauuuuaagccaucacuggccucuacuuguuucucuucaacuaccagcaacuccugccucccucccaccaguagaaacaucagcuaauccuuugccuaucauuuugcaucucuuuucagcugcuuuauuuuauguauuauucaacuuaugcauuauuauguaugcauuauucaaguuauuauauauuuaugcauuauucaacuuuauuauuauucaacuuauuuucaacuuaaucuuuuuauguaguauucuuccugcuugagggacaguagauuguguaaagcgugguauuuguuuuucuucacagaaaggucacuuuaaaguaucuuuucuauauauucauucuucaaacuuuuuuuuguagcauaugagcacauuacacauagaaacaauaucauuuuucaccuuggcaugaagccuuuuagacuguagacauucaaaauaaauuaaaauuaaaauaacacuaguuugguucaugauuaaaauguaauagcuagaaacucuaucuuuacuuuuuccccagauaauugaucuuuuauuuccccuucuagucuagagaggguguuuuuuuuuuguuuuuuugucuuuuuuuuuuuuuugagcggggauucacuuuuguaucuuccuaaguucuuagcauagugccuucugcaugcuguguagcaguguauuuuuauuaaugggccaagaauuaauuucauuuaaugagaaaacaaaggcaauuaaaccuauauucugauacuaccguucuucaccugucucuaaagcaaauccuuucaguuuggucagugaaccuucccauucuuauguuuacuauuauaaguuacuuuuguuguuuaaggaaagaguuugugguuccuuuugcaacuugaacagcaaauuguauucuguuucuucuguguuggucuguauaauccucuaugaacguaccguuauuauuaggugcaugcccaaaaaagaauugaaaaaauaaauggacccauaauaauuacucaguaaaagcaagugugucauuuuggcuaagaaaauacaaaugcuuugcuucuuaaaauuuauauaauuuacauuaaaaauuacauaaucaucuucaacuucuauauaaacacccuugauuuaugugcccuuuacaaaaggagacccaugaauuugccugaguuuaaugaaaagucugauauaguuacaguaguugcaguugccuuaauugauccucuucuccagaaaugacauacccagaacgacacuguucuguuucucaagcuguggucacauuaauuuuuuuuuuuuuuuuuuugagacagaguuuuguucuugucgcggcuggagugcaaugacacuaucuuggcucacuacaaccccugccuccaagguucaagcgauucuccugccucagccucccaaguagcuaggauuauaggugcccaccaccacgcccagcuaauuuuuguauuuuuaguacagacgggguuucaccauguuggccaggcuggucucgaacuccucaccucaggcgauccacccgccuuagccucccaaaguguugggauuacaggcgugagccacugcacccggccuaaauuauuuuaaaaugagguauaauuaugcuuuauuauuuauucuauggaauuuuuagaaacugauuuacccaguuacauuuuacuugaaauuuauauuuaaacauagguaaagcagaagaguaucaauaaaaaguucccaguuucuuuuucaaacaguuaauuuuaaauuaaaaauuuggaauggcaagugauugcaucaucuauaacaagaaagacagaauagagguucuuuccaccucuuaauaaucuguaugucuaugauuuuacauccauuaguuagaggccuauauuuguaguauuaccuuuugaaaucacauagcucuuaugcgacauuaaguauuauuuuuggcaucuugaagauagcaaaaugagcuuugucuauuuuuuaaaccaugguuuaaauuuuuuuucuuuuuuuauaguggcauuaauugcugugguuuuaugaacaauuuauuucugguuuuuuuuuuuuuuuuugaaaaagauauacagaaaugguucucugacucaucaaaguucugauagauucacaacagccaguuagucacaaauuguagcuuacagcuacaaauccgccuggcauuuuuuguagacugugaugucuacugccuuuacaguagcauauucauccuuuaaaugccaccaugcugaaaaugcauauuuaauuuuaugaaugccuuuaccagagcuuagguaauuuuucaaaugguaaaauguaaugauaauuaguuucucauauuaauagcaccauaaggucuuuuucuaauuucaagaaaacucaaaaaugcaaauuguguacauuuuguaugugugauaaaguuuugguguuuuuuucuuuuaauaaagauuuauuuucuuuuagagauacaugcugaacuacuuagaagcaaaguuauaugauaucugggauuugcuucaaaguaccacagggagagaaaguguagauggggauaaagaugaaauaagauuuguuaugaguugaucauugccgaaguuggguuaucgguacgugaggauucauuacaauucugucuacuugugaauacaguuaacauuuuucauaauaaaauacaaauuuuauagcucaucauuuuuauaacauuuuacuaugaguugauaaacuuccauuaaagucaacagcacucaagauguuaaaaccaaggcauaucucucaacucccugcuuauuccaacaaacugcaugguauagucucuuagucaacuaagaugaugacagucuacauugcuuaauaauuuaauugggugaacccuguuaaaauauuuauugcauuaguucuaucaugauucuuauuucaagcucucaugaucuaucuuuuggcaguauuaaauauuuaugaaaugaaugagugaaugaagcccgaaaucucugaauucuuuuccuaucacagcaccuuugcaauuccuucuuacuuguccacaucgccucacuagauuuuaagcuuuaaaggagccgaaagugaguccaguucaccagugugucccaggcuagugcagcauguggcauacauucggucuugaacaaguauuuauggaaugaauguauugaugaaucugucuucugaaguggucuucaugauuucugucucuguuuuggccaguccgcccuccauuuaguuucugggggaauuguuuuaaacugucauugugaucauguuuugcccaucuauggcguuucuccuaugaggguaagcauucagacguuuguacaggaagcuggagacccgucauccugugggaccugcaagaggcuugcuccucuucuucaucuuucaccacuccacacacuguuuacuuguguauucugugccaucuuuuuuucugaguauuuccucucugagaaugucauccucauucacauuuugaaaauggcaccaaugagaaaugccuuccucauccuggggagacugagacgauaucuguccuguacaucgcagcuggcgauguagcagcaaaugccaaaacuucccugcucucaacacacauuguaccucucaaccauucacaaccauuuucuucuaaucauuuuccuccucaccaacagugagcaucccuagagcaggaauuacuuuuaauuucuuugacaucuucauuuuaccuggccaguacagaaacccaguaaacguuugcagaaggaguaaauuaaggaauguacuuuuugcuaaucaagugaaugaguuuuccauaaaagcugugaaaucagugauaucgugaccaacauaccugaagguuguuuuucccauuugcagcaguuauccucugucgaaagacaaucuucugaaucauauaaaucucagaaugaaauacugagguaaagaaggccuuugugugaaccaaggggcuaaaggaaacaagacuuuggguuuuuagaaguuuaagauuuauuuaguaaugggaauaauucugaugauaauuuuaaugaaggcuucugcuagcuuccauggagauugaacaaauauuucagagcuccaagacagcuggaucguugacacucagaauauauuuuguaaaagagccaaaguauaagaauacuaaaauguugcaagaugagaucugucauuuguugacaugaaccuuagagcuuaagaaagucauggagcuuuggguuuuucucuguuucucgcagauaugucuucuccgacuacuaugaagaagccugaaaagccauuguucagcucugcaucuccacaggauucuuccccaagacugagcacuuucccccagcaccaccaucccggaauaccuggaguugcacacaguggugaggaguuucaagcauagaggagaagccuccuucuugucuguagggccuaacccccuuagggacggagcaaaaguuuauaaauagagcuauggcaaccauauuuucucaacccauauggugaggggcacaauccgaucaaguauuuuuucuucucaauuuaugagaaaagauuucucugggugcaggggcucacgccuguaaucccagcacuuugggaggcugaggcggguggaucacgaggucagguguucaagacuagccugaccaacaugguggaaccccgucucuacuaaaaauacaaaaauuagccuggcaugguggcaugagccuguaaucccagcuacucaggaggcugaggcaggagaaucgcuugagccugggaggcaaagguugcaguaagccgagaucgugccacugcacuccagccuaggcgacagagugagacuccaucucaaaaagaaaaaagaaagauuuucaaagucauacaaguaaauaauauuuauaauauguguuuuaaaauuaccuuaaucaaaaagauuguuaucagaagaauguggaaaauauggguacauagcuaucuucauuauagcuucaggauuaguccugauauuuuacuaagggaaagauggaauuucaguuauguugcugaguuuagaguguuucuaaaggcauuaagacguaaggcacuauuucuguagauguuauuuucuacauauaaaucaauauuuaucuauaugagaguaaucagagaauaaaagguacuuuuuuugacacuuguuuuauaugcccaaauccuuugggcuaguacacuugauauugugucugaugucuuaauuuaaguaggaaaaugaauccaauauuugacauuuguacuuuaaccaacagcuaauaccaaaucuuucaaaaauuaaaaaugagauacagcuaauaauuaacacuguguacuuuuuaccuagagaggaguagacugcauuuuagguggaaaaaguuuuauauauaaauauguuaauagugaaacuguuauugguuuaaauuuauaguuaggcacuuccucauccuucugacuaaucgaaucugguuuuuaaaucuuuaugcaaacaauguaacaucuuuuaaaauaaaguccuuauuagcuuugguuuguaaguauauguugauauuuguuggugcuauacuuaaaaaaaugcauggccuuuauugcuaucauuaaaaaauuacgaaauugagagaggacuauacaacuuaaaugugguauaagaacuuuugcauuuauuaccuauaccauugagauaggugaaaaaaucaguaacuguuucauagguuuguaauguugaauauuuggacagaauuaacugagaagucaaaucacccauuuguuacgacaccugaugaaaauauucuuauuucuaacgugaaaaaaaguagacaguauauuuuuauauaacgaaacaggagagaccuagaugagcccuccaccuugguccuucacccgauauuuguucuguaucuguauauuagggucuguguuaggcaucuuguucagaaagaucguuucuguccuuaaagaguucaggauauaguggggagagaguggggccacgucauuggcugggcaucuaaucugaacaugacuagauaaccugaagaagguuuagauaccuggaagauauguguucugagcuaaagugugauggcaaaguucaccacaagaaggaacaacaaacuaggaagaagaggggcaaccugggaggcagagggacauacuaggaggaagaggggcaaugugggaggcagaggggcaaacuaggaggaagaggggcaacauggaaggcagaggggcaaacugggaggcagaggggcaaacuaagaggaagaggggcaaacugggaggcagagaggcaaacuaggaagaaaaggggcaaacuggcaggcaaaggaggcagaggcaacagcauguaucagugcauuagaggccauugcagcaggcaacugccauauagccaaggauccacaaauaucuucgucuggccagagaugaagccaaagaagugauccaggacucggucucagaguaccugagguuguguguacugaaaaaccuguugggauuuuauucuggaagcaguaggaagccacugaaauaauuuuagcggagaaguuacaugauuauaaugguguuuuuaaaaaguaauucacauagcacuauaaaggauguuuuggaaggagcaagacugaaggaaagaagacaauaaggcuuugcaauaauguaugcaagaaauacacauacauguguauguauucuuucauaauaaaggaaaacuuuuugucuuguauuuuacuuuucuuauuuuuuuuucuuuuucuuuucuuuuuuuuuuugagacagggucuuacuccaggcuggaguguaguggcgugaucuuggcucgcugcaaccucugccucccagguucaagcaauucuccugccucagccucccgaguaacugggauuacaggcacucaccaccccgcucagcuaauuuuuguauuuuuuuuaguagagaugggguuucaccauguuggccaggcugaucucgaacaucugaccucaagugauccacuccacccacccugaccucccacagugcugggauuacagccgugagccaccaugccuggccugcuuuucuuauuuuuaaaggacuagaauggcuuuuauggaaaagguagucauuuuuacucucaguuugaaauacgacauuuuacccagugguaucaggccaccuacagcucaugcaagcacagugccagguugcccauagaugugaguucggguuugauuucugcaauuucacuugaaaauagaucuccuccagaacuauuaaggccaaauuaaucucaaaagcuaaaggacccaagauggaacuauguauauaucuuuccaggguuuguguacagaugugagcaaaaaucaugguuaaaaugagcugagauuaagagcauuuagacacuaaguaaaagaugcccaguuuuucuuagauguuuguauuuccuuaaaugauacuuucaaauggguauacuucuuaaauaaaguaauacuucaguaaagaguuuuguuuuaagaaauacgcauuuguucucugaaaugcauacauuugauggaggaugcucaaacuucaguauguaggaagauuacauggacacuuauuuaaaauauacauuuuggugccuuaccccuagagguccugauccccuaggucuguguguagaccaagggaucugcauuguaagaacaauacagagaauuucagaaacagugcucuggacguucagagaacaaagucgugacuauaaaauugaauuuauguuuuuucuauucuauacauucuuaauuucuuauaucuucugaaaaaguuuuuuuugggagagguaagcaauacaucccauaaauaggucccacccccccacccacauaguuucaaaguuggaaauaaaucauucuaggugauuucccuuuguagguuauggcuaaaauuuauuuuuuuucauauucuuuaaguugucucauaaaacauuagacauuuaucguuuauaauuuccuauuauuugaauugggaaauauuaaaauagaaagacauuuacuuuucacuucuacauauauuuguugguaguuuuaauuuguauuucuaugauuauuucucucaacauuuuagagauaaugaucauacgauuacacucuuucuccaucuuucaaacuuaagauuuauauuucaaaaacugaacaauaaauuauaagaauacuaauguugagaaguuauaguaaaauugaacauuguccacauugcauguguuuuauauaguauuucccuuuauaaaauuauuauaaaauaugugauauauggguaaaguaauauacuuaccuauaugaaagcuuaaauuuucauugcuguguguuuuauucuugguuuuauauuaacaauaucuuuuaaacuacauauaguaaaaguuaaaguagaaagaaaaauaguugcagaauagagcucuuuugguuuugaaagaaacauuuucauuaggagaguuucuagcucuauguuccaauguucauaagcauuuauaccaugaccagacaauuauaaaugacaugagaugauguuguauuaguuauugucuuuccuucuaaacaauugccagguaggauguacagggaaacguuuuauuugaaauugaauuucacuuuuguuuuuaauuuugguagaaaauuuuuggcucuuuugcccucuacuuaaugcugugacuugcucuggacuuaugagacaaaguguuuuuuguuuguuuguuuguuugagauggggcuuaugagacaaaauguuuuuuguuuguuuguuuguuugagaugggguucugucaccagguuggagcgcaauggcgccaucucggcucacugcaaccuccgucuacuggauucaagugauucuccugccuuaagcucccaaguagcugggauuacaggugcccaucaccaugcucagcuaauuuuuuguauuuucaguagcgaugggguuucaccauguuagccaggcuggucucgaacuccugaccucaggugauccaccugccccagccgcccaaagugcugggauuacaggugugagcuacugcacccggccuaaagauuuuauaaucaaagaauauguuuucaacgggauauaucuuugcucaaagaaguguuuuaucaaguauugacauaaccuauaaaagagaaacugauuuuguaaccacucacagagccaggaagcaagauuguuaauuuucuagagugauguuuuaucucuguguaguuagccguacugguguugagaauaaaaaugaaaaaguaacuguugauuuaggagagcuugguuaaaucauggggacaaaaaugaaugguuaccaguuuuguaguuucacagcauucuucaggaucagaauggagcaauaagguaaccagcugaugagucaaucuuuccuuuucugucuucugcagucaucucaacucgaacuccaccuccaccuucaccguugccauuuccaacacaagcuauccuuccuccagccccaucgagcuacuuuucucauccaacaaucagauauccuccccaccugaauccucaggauacucugaagaacuauguaccuucuuaugacccauccaguccacaaaccagccagguaaaaauaagagagaaaauaagauuagcaccuaagggagaugggacagaucuaauucugagacacaaagguuagucagacagugugucuggcagaacgucaagccuugaaauccaucuucaggaaguugcuuggugacucaauaaguuuuuauuuaaagguggcugaaugacagguaggaaguguguugccccaaaggguacauuugugaagaugguuuaauguuuuuggauuuucacugacugaagggaaaguuuaugcagaaaguacauugacaggaaagcucugggcuggaguucacaccucuuaaauaccugguuugacacagagacaaugugcuuauuucaggcaggaguaagguaugugcuaaaauaaacacacacaaaagaacuuacaguuguauuuauagaccaacuauuagguauuaaaauaagcuuugguaauguaaacauucucaguguuugaugacuacuugaauauucuuugcagagacaugacuuacauuuaauaaugagugacauuacuagaagcgucuuucuuuuuuuuggaaacauugugcagugguuuuggggauucauuuuguaaguguagugacucaugagcauuucucacuccccuagacauaugguuucuucuaccaagagguuacuucauaggaauuugguauaugagcauuuuccacaaucaaguagacagucuuugugccagaccuggggcuaucaauaauuguaauaucuaaaacauguaauguaauuuugauauuaggaucugauauuuagcuuugcugcuuuaccucuaagacuccuguccacuuauuauaccuuuuaauauuuuggagaauuuucacaaacauuccgucauuacuacgguggaacauuccugaaaugcuaguaaauagugugugucuaucaauuuaaauuagcaaagaaaggugagaaaaaaaucccuuuggucuuaauuuguuaaaaugaaacaaaaugguccuuucugaacuuuuaauuuagaauaacaacgcauccaggacccuuuggguuacuuaaaaaguuaucauuacuuuuaguuugacugacugagauauuaaacucaauauugaauuuugaauuugaaguuaaaauuauuauuuguauuuuagaagaaaauguuaaaauguuguagcacuuuucaugacugaaguacuaaagacagcuaagugagagugggaucuuaguauaucguuuagaaauaaaauuuguugucagcucauggauucagaagucucaguuccauagagcauuuugcuagacucagcugggaacagugcacacaaggucugauuuuaauuuguguagaauuuccaugaauaacaaagucuaauuaagacauccauuaaaaguccuuaacguuaauucaguguggaaaaucuuagaguuccauuggauuuuuuuuuuaacugaugucuuaauuaggcacuguuaggggaaaaauuaugcaaauuaaaaucaggcccuuaguguuacacauuucuuuaauuauucagugcuuguuuuacguauauuucaauuucuuuauaaguuaagagggcauauuaggugauaaucugccuauauuguucucaguuuuucuucacuuuuucaagauacauaucaccuucuaaggaagcauauuacucucaucucaaaaaaaaaaaaaaaagaaaaagaaaaacuagcaacaaaaaaacucucaggauuuuguauaauaggaaccguguauaaaguagaauaauccuuuccuaaugcuguuagcuucaccuucagacaagacaucucucuuuucuaucuacaguaugaaaguucaucuauuaacagccuuaaaagauagaaauuuuuaguguagcuucaucuguuugaaccaguagaaaacugaggagaaaauagcccucaauucuucucacccugaguuuuaggaaaguugucugcauugacuugggaauucuuucuuugucaccuuuauucuuuucaaaugagagaagugucuacuaguucauguuguucaauuccaguaggugaaguuuguagaauggucaggguaggauaauauauuugguggcagcauuuccuugaaauuauugucauucugcuccagacauuuuguuccagguagguacuuucagacuguuuuggugaacacuguauguagaaacauuuuuaccauugaauguaccaccaaugauaaaaugagaccugucuucuuucuuaagauauuuaaagcacuuauuuccaguguucagauaaccagaaauggauggccugcuguagaaacaaacuacuuuuucccuuugaaaggaaaaaugggucuuuauaguuaacugcagauuuuuuuuuuaaggaacaguguaucugcuuugauuuuuaacuccaacucaaaaccaauuaauuugcauuucaaauuagaauucuugguauuuaccauuuuagcuuuagaaauggaaaaacaucaguauuccuucaccauucacuucuagucagcuguugcuucccaauauucuccagcacugcacugauuuugauuuuuaagauaagcaacugagaugccuuuuccuccccacagcaauuuugagauuaauugcauuacugcugcaccaauuauagugagacagucaugcuauucaauggaauauuuugaauaaaauuaguuuaaagauguaacucucccauagguuuccauauuggaaaacucuggucaauuuuccugacaucaaguuaaauacuuaaaauuacccaugaugaauaaucaggauauucaggaaguccauuuucuuuauagaauaaauaauguggccucugaggagccuaaccgaagacuuaguucaugucucuaagucacaauauuuaaguguuauuagcuguucaucuuuuucucuaaauaaaugucuacuuguaauuuaugugcagauauuuagaaaaauauucugcuucauuuuuuuuuugccuuuaacaguucagauuauaaagacuauauacuugccgagaauagccucccagcaaauugcgaugaacaccgugcaguggagaauuccaacauggguauaaucaaaaauaacauucucagucuagaaaaauauauuccacuauuucuucaaagaguguauccuuaggauuuuguuuccuaccacggaaacuauuuuuguacccaggagcuaaaacucagauaguaacaucuuuucuaucauugcccaggggauuuucucaguuaauucucacaaaugucaacaagaaauguuuuguguaacucuccaugcaccaccauggauguaagaguaacucaaauaacaaugcucauuugcuuguccucugcuuccccucaguacaguuuaauuuacuuuggaaaucuuuuauuuguagguguaaggacaaacguagcucagcauuuuauaucauuguaugaccucugaaauuuuagaugcuuuacaucuuauucuaucuucuuguauuaguaaaucaucaaaaguugaccauagaucucggaaucuaaauugccuaaugugugcaucucagcacaccuguguguaagagagcuagaguuuuguaugcaggagaaugguucuugacuguaaaugaugaaaauuccagaauucguuguauuugaucuccuagauauuuuuguguccuuuguuucagugauaucaucauguaggugaaaauuguguucuaaaagccaaaacugacucauuauagaaaaugaagagcagagaauaaggaagcauuggguuccaacuguagcuaguucaguaaggaauuccauuuuagccuuugggcuaagcauuuaagucugcacuugaguuucuuggccuacuacaugaaaggaucaagucuaccuggcucucaggggugcuguaaagaggaauucaccuauaccaugacgugcuuugaagaugaaaaccuucuuugaaaugcugcugcuccuuauuacuaccaaccauugacuggccucuccgacuccgacucgagagggccuguguggcgccuaugcgcagugugcuggauccacacagucgugugugcugaguggacuuguugaacaagaugacugccuuuuggauugcuucacccggcauucuguuuuuguuuuguagccuaacggcaguggucaaguaguagggaaagugccuggccauuucacuccugucuuggcacccucuccccaucccagugcagugcgaccugugacccugagcaugacagauacuaaacccaucacuacauccacugaaggugaggcagcuucaccuacagcaaccaguaaguauuuccauaggaaaugagaaauguccaucagaggcaccauuggauaucugauccaagguggaaaacacggcaauuuuuccagcuaccugaccagauggagauuucucauuuaaguggagcuagcaggcauggauguggcccugcuaucacaggcucucucuucucaaauuccagucagugaaucauauuugaaaagggagaagcucacuuguuuaaguuaacagcuauaacaaaaauaauaagucaugccugcuuguucaagguauacauugaaauugcacugaguaacauaacgcagaauacaaaguuuucguaucacccaaagagagauuagguaauugguacuuauuggagcauuccuauagaaaucaagccccuucacaaagcagauggaaucagugccucuguaagguaauugcauguuuacaucauuguagguuaugucauuguuaaaaacagucgcauaagguugggaacagaugaggacauuucaaaacuuaguauuaggcacauguaagcuaccuguacuuucacuaucugcaagcuuuuuuuuuaaaaccuuuugauuauuuugcuuaucauugguacaucaaauacugugcuuuuuaguguggccauaacauuuaaaugucagagauuuagccagugaaccuuccuaacacguaccaauaagccgcaucauuccuuuguuuuuucauguaaaauacuuagaaguauagaagaaauuaauuuugaggugguuucacccaacugucagcuucuuaguacuggagcuggaauguacaaauuggugaaguagaauggauaaagcuaucgaauugguggaauuagcaugcaccucaccaauuauacagauaucuucaauucaaaccuuuuuuuuuucuuucuuagagcaagaaaauccccaugaucuugaaauuuccaugugaaucagagacaaucagaggcaugcaccacucauucuuucucagccauuggaaagaugcucuuuuuuuuuuaugguuucugaaagacuaggaaggaacccuauaagaaaaauggacaauacuuuguacagugaauucagcauuucuuucucaaaauucaugagccccgucaauuaauaaguuccuauaggcuuguaauacccaucaguaauucuuaaugcuuagaauacuucccugaaugcacagauggaugcgaccuacucaggaaaaacuaaaaauuauuuuguucuagagguuugcuaugugcauuacagucaccaaaacacuaaguacucauuuuaaaaguggaugucuucacaucuuugagcaaacaaugucagcaauuuaaauaaaagcacacagaaaacaaagauuuuuuuuuaaguaguugaaagauuaucacaggauaaauggucaaaaccaaguucuagaaacucugaugccuacucuugugguguuauuaauagaagagauucaggagaggaucagacccaaaugaucacaguucacuuauaggaguacccucagccuguuuguuaaugaauuguuuuuauacuuacauacagguuguucaaaaagggaucugauuugacuaguaaaauuacaaaauauucaaaaggaguaucuugguuguauaaagauggcugcaucaguccauuuuccacuccuacauaaaagaaacauagugaguaguuuuucuuuccuauaaacaagcuuguagcuccagcuucuuaggcaccaccaguaauaaaaaacuggucauugaauugauauaguacuauggucaaagaaaacacagaagccaaggaaggcucuuucucauaguugaaaagaaaaagcagcauagauuuggugcucuucuguaagggugaggcucaucuccggcugucugugagguguggugaauuccagaggcuuggagauugaguaggggucacugguugcugauggcugccuugcauguccccuuauucaggagcaauuaaaauaugaauugugagcaucuucacuguuuuuaaaaaguugaccuaaaaaagcuuccauggaucaaauucugcaguccuuuaagugaacaaggcagaauuaauauauugguuuuagaaagccaguucauuuaaaaugaagccuggauuccucauuaaucuggugguuuuaaaccaaacaguguagcuuucuucagaacaauaaagguaauauaugguaauauggagcagugggauugccuaguucugggaagauaccucaguccuuuccuugugaaaaguaacaaaagucuuuaggaguagcucccuauucauuuuuuuuuugugugugugaaaaauuuacucuauaccaaaaagcaaaaagcaguuguacaaaaaguacuugcaaaugagacuauaacaauguaaggaauagucaccauauauacuuacuaccuaguggccaacuauuuaaaggugcaucagcuuucuuccuggaucaguuacaaguaauugauuuuuguaugugugcuuaugggaaguacuuuuuuucaaaaacauuccuaucagacuugaggccauuuucacagguaaaauaccgagcugauucauucuacaugauacaggcuucuccuucaugauaguaagauuugauuuccuuuuuagcaaaacuuuuaagaaagacauuuuccaucccauaucauuaagaacaucugcuuaaauuccaucauuaaaagcugucacuuuuuccuggcggacuuucagucugcuuuacauuuagaaucauauaccaucauugauuauuuuauauuagacaacuacuaucuggugaaaaaguacgucuaggaacagggcccuucuauuuauccaauccuuaguaccuccacaggacaguuacuagagcauguaagugugagacacccacacugaaguaugagaucugcuuuacuggauagauuuuuuagggggaauaaacuaguugauuugaagucaauuauuauuucuuuucuaucacuugguguucacucagacaaaagagaagagaaaugaagacacuuuuuuuuuuugguugcaaaucccacuucucuggguuucuuauacauggacaggguguucguucugauaguucacaauuuuuaucuuuguuuuuguucuuccuuaaucagccuacacagccucaggcacaucucaagccaaucgauaugugggacuaagcccaagagacccauccuuccuacaucagcaacaggugggcaaguuucacccaggugugacgguguagccacgcuuucgcuuccgugcuucuccauguugccucucagauccggacucagaagggggcucccggggcuucugagaccaaaacugaucauuucauuucccagaauuuuuucucauugauccuuuguuucucaccucuuugaguagaguuucucaaauuggcucaugaccuuuuccaucucuguagcauauauugauaacauccaugaguaauaguguuucagccaaaguguauuuuucucagucucauuggcuauugagaacuuacagacuauagcuuucaaagacaaaaacugcaaacuguuuuaaagccaacuagaauagaagcaguauauaauucgaguuuuugagugauuucuuauuuuccagauguuuugcuccucacauuuguauuuuaguccaagacgaugaguuacgaaguuaaaaucucaggcgacacuucauuccuauuauuuuaauagcuuuaaauugguuuacugauuucagaugugauaaaacacuuuuuuuugguucugcuuucuuacaucauuuauguuucuaguagcauuuuaaauuucacaucucauuaaugcuguaaauuuaaugcaaaugaaguguuuacccaaacugugaaaacauacagccaggauuaaugguggcuuauaaacagaucagccacagucaaaagcauggaccauaccaauguagaaaucccacgauucuaguuacaggauaagagacguaauucuaaacaguuccgaauuuaaauauauuuuaugaugcauauguuugcugcucucaaguuuugauagcagagcaguuugaaauuaacaguaugcaaaauauuacauaggggaaaauuaggcuauaauaaauaauaaagagcugguguuaacuaacucgcucuuuauuuauaaguugccugugcauauauaugacuuuuuguguagguaguaagauacuuuugcccacuuacuucauucuugaucuguucaccucacauacccuuguugugaccuaccucaacugugcuugguguggaguucucaaguccuuuccaguugcagcccaagggggcagacugcauauuagaggucaccacaugcagagcucagagaaaaucauaaagaugauagcuuauucagaauacuugauguuuugccagguuuaaaaaaagcaaaacaaaacaaaccaaaagagugagaacuaacugaaaacaucuguacacaguuaugaaaauaccaaauaauaauaauuagugguuuugccagccauuggcuucucaacauaauucucuggaauguugcuuuuuuuucaccucuaaaauuguuauaacacgaaaugaguuauaauuacuagaauaugguucuauuugacagauguauguguccauuguguuuuuuaaaaaacauaugcaggauguauaaguuuagaaacuuguucuuuuaaaaaucauuacacauauucucaggaauauuuuucucaugggauuugcauuauucuuuaugacacaucucuaauuuccaguuaauuuuuaaugcauaaaacaugccuccauuauuuaaaccuuuagccccaaaugcuaguuagaauacucugaccaauuccauguauuuggaggcagccuuccuccuccacuacccuaaccuauggcagcuuuaauuuucuuaucccuuaugauaaaugucgaagccucauguaauuaugauuacuaaaguccauuaacauaagaauuacuucuuucacauaucuaaaaauauaucaagaaaacuuagcaagcaucaugaaaauaugaauuuuaauguagauagcauucuggcacaugauauauuuuaaaaacuaugaguucuagaacuauaaacuauuuuaaaaucaaagaagacagccacuuauuuaaguggacaacauugaaucgagaccacuuacaaugugaauacguuuuguucagucaacuauaguuaauacuuaugggauacaugauauauauuaaucuuuggaagcaaaaaaaaguucuuuauagcugaaaauguuaaauaccaugcagacagauaauuuguccucuauguaaugaaagaguuagugcugcuuuuuaauuugaagaagcccauauaugcuuuauuuuauaaugaacuccaguuuugaggcaugcagaaaauaccuguaaauaaaugcauaucaugcuauagauguauauuaguaaacuaaggcuagagucaaaagccuauucauuuuagccuuucaaauuuuaaaagaauuauagaaaugaaguuuuauguuuacuauccaggaauaaagaaacagaaauaguuuaaaugacuucaguaaagauuauucuuuccuucaguagaaaugagauugauuuacuguguccuuucauuacuuuacaaagauuuaaaagagaccauucuucuagaggcaguuucuaaaugcauuugguuuaaagcacucaaugaugaaugaaaaggaaaaucaagggguacaugaaauaaagguaaucaaucauguuauauuagcuaggagaaauucaaaauuagaaaggcagugcuuuagucugagaggguucuuuuaaacauucccuauagccuuuaauauacaugauccuuuaagaauaaauaucgucaccagguacauucuucaguucaugguggcugcuuuauaaagauuuauccuuuuagguuaugaaaaguacugauguguaguuuugaguguuguuuuucuuagaaaagaacuuuaauagagccuacauaaauuagaguuaaugauaaauuuaaaguggucauguaauuuugacuauuuuauaaauaaucuuuccacaagaugauacuacaguggaguuuccaaucuggucauuuucuaauacauaagcuuacuagcauuaucaaauuaagaugaaaagcuuucuaauguuaaaaugaacccuguacuucaccuguaagaguaauacauucauagugucaaaucugaauacuaaaaguauacacuuucauaucauuuacuugguacacagacaauuguuauuaguaauuauacaucuuuguguuccuuuuuauaauaauuauugcugauggcauugguugcuaacugcuugggaauacuaguuuauucugacuggaagaaaguucaccuaucacugaaaauauaucucauuugaaucuaaaaaauaaauucacauaguccuggagacuauuucaaaaagguucauguaaaccaguugauaaucugccauuaaaaauaauccucucuaaucagucacaauagucagcacauaccagcugaucaguauuugacuuuagacuuuuucuuuaucucuuaacacaaucuugaauacuuuucaagucuagaacuagucugucuuugggauuauugguuuaguuauugcauucgcuauuggcaugggggaaaucuuaaaaucagaacuucaguuggagcuucauucuucuuuaacuuuucuauuggaagaugguuuugguggcuugaagaacucauggguccugcuuuggcaaacugaacugauuagucucugcugagaaaugucuuuuuaugguuuggaacauuuucagaaauguggaacacccccccgccccgacuuaacuucauagaaguucaguaaaaugcaguauauccuuuucucucucauacuuuauaauucacgaacacauugugcaaauucguuaugauaggcaaugaaggaaccacguuucccaaauuuuaucucccugagaaaaugggaacuaucaaucagaguguuggauguugcuuaggaaauauagaaauuauuuuauaauucagucuaacaauuuuagcauggaugaauaauaagagacaacuuacuugaauuagcaccaguuucuuaucuggucuaccucauagugaguugcuaauuucaggccucuuuccuuugcuaucauagaaaguuugguaguauuaauacaagagaaucuggcuaauuugauuaucaccauuacauuugagucuaaggucauaauaagagccuaaauucuuacuauuguacaucaacauauauuuaaaaaucucauuguaaguuggaaauaaaaaguuugcagcuaagaagcuucuuguuuagaaauaaaaguucaccauucaaacaagccauugaaguacauauuaaccuuugauguauauuugagauuucaacugaauaaauuaggagcucacuuuugccuucccuaagugagacaauaaagucaaguaaagucuaguuuauaagaaaucggucuuauuuucauaaucucaaaauuauaaucuccugacuauauauauauuaccuauaauaagagcuaaugaaucaguggccugaucaauucaggucuuugcauuacuucucacaguugcauggauuuuauuggugcuugggcuucagcauguuacaucucuugcaugacuauauaaugcuauuauuugaauuucaauuacuggucuaguguauauuuaaauuguuucaacacuuuucuuauaacacuuuuguuuuuaaaacuagaauuugaaaguacuucucauuacacugaaaauuucuguuacacaaaauggccuuuuuaagaaauuacuucuguaggauuuuuuuaaacuaagauauuaguuuaaaucuucuuauaauauuuguccuggcaaauggcaaagccaaagcuugguacuaccauuggaaagguagucauuuauuagaggcaagcaauuaaaaggacacaaguggacuaugaacaaacuuuucaauacagucaggaagcaggcuaucaacacuugggcuguucuuauugugucuguuaucauaauugacagcuugacguaaaacgcuaucacaugacuucuggguagguauguaaguggauaagaggucacuuuucauguaugcuggcuugaaaggaaacacauuuaaaggaaguuucagucgaaauaauggcuaugcaaauguuuagcucuuuggcuaguucuuaaauucaaaaaauccuuccauugucugucuuuugucauucccugguuuguucacuuaccuuuacugggaaucaaagacuaauauccagauaagcuguucuaauuaauguaaaaguaaaauuacauuuuauguaacguuaacuuuaaucaacagaaacacaaggaaaaaauuaucuucuuuucugaaaauauuaacuuagaucucaguugaaucagggagguagagggaauucugaagguuuuauuuacagauauuuuagcauuaaauauucuugaacugcacauaagggacaggguaggaaaggaacaaugacaggcaacugguguagugggugagaaccagggauuaggagucagaagguuuggguuuuaguguugaugugacagggcauuucuaaccuuggacaaguccuuaaaccuuggaaaggaaaaugaagagguugaacuacauaagcuccaaagucccuugaaaccuuaaaauuuacaaguuguaguagccucuaauuuaaaaacaaaaucuuucauuuucuaauacuuaucuuaugauuuaugguuaauaauguuuauucugcucauggacuaugcauacucauuuaaguuaauucuacuucugcuaauuaaauuaaauaucaagaaacauggguuucagaaauuggcacuagaagugacuuuuaagauaugaggaugaucuugaguaucuuuuuuuuuuguuuguuuguuuuuuuuugcauguguuguaugugaaacauacaacacaauuuuauucugaccauuuuucuuguucauaccauuccuucagagguuacaugcuauucauccagagaccauuuaauuugcuccauguagguaauuaauauuagcaauaaaauaaaauucuccuaauccaaaguaugaauauuggaguguuaauccuuuuaagcaucuguuuuccaccgcaaaaagagccuucaccccuuaaaaaucuguuucauugagggucuggagaaaugaagaaacacaagaaaacauaaaacauaccuuucaagauguucuccugagggccauuguaaacguaaaaagaaaaaaaagugagaagguaaauuugccuguguugauuguucuguucacaguuuaaugguuuauugguucaguugagauuuguugucaucguaggaacuguuaguaccucagccuguuugcugagucuagcaaaauagaacauuuugcuuaccuucuuucuuuuguucccaaagcuaauugcuguguauuuaacaaaagacccuguuaauaacaaaggaggacccccauuugaauaaacaaacuauuagucugaagucacaagcaauauuaauucuuuauggcuaucugcuacuuacaugauuauuugaguguaguuuaggaaaggauaaugauccaaaucuuagguguuuccccuuuauguagccauuugagaggaaccagauggccccuauccuuuuucuuuuuuucuuugaagcaaucugauuugaacugggccaggaacaagguucucuuuccagagaccacagaacuccacccuaagaacauaugcagugaaaacuucaccuucacaucuuucuuauuuguuuaaacuguuccaaccuucccccuuuacugauagcuuuuuuggaagauaaucuuacuuucuuaguucaccuuuuauuugguuuugaaauucugggcauuuucuagacaauagaauuucauauugguaugugcauauaaauuaaaggauuaaaaugauuuauaugagugugcauuuuuguaaggauaugcauaugaucaguucuuuuugagagucuauauuguuacaaaaauaagaauuguuccccaccuccacaugaaaacagacaauucuaacagacugaauuucuaaacugaguggcacuugguauuuuaaauuugauuacuauugggagaaaaaagcaauuuccuauuucuuaauaaaaaauacuuggaaaaauucuuacagcauucuuaaagcuuugaacuuagaaaaauucuauauaaaugaaaggcauguauuuaugugccacuuaaaauuaaaguuuuaaaauaaaaaaagagaauuuacagcugaauuaccuaacacugauucugucacaggacagaaacuaaggaaucaccaccccaaacucaaaaaagauuaucaccuauuauguuaaacuuauuuaaagccuaauguaaaauuauuuuuuauuaggaaaacugaauuaugcuaaaggcaagaauauguaacaugaccccaaaagaagcuuaaauacauguaguauuaaccuuuuaauauauagagucuguucacaauuugcuuggucaggaauaucuuggucaaauaagauuagaaauugauuuucuuaggaauuacuaucauggaaaucuuuggugaauaagugauuucuauuuuaaugauuuaauugcaucccccacccauaccaucacuuuaaaauuucacuuuaucagggaguuuuguuaguuccaagaugcuuuaugaccaagaagguuuauuaauugaaaaaaaccaacaugaagagagaggcucuugcucaaguaaccuggcuuaaguuauagcgugucuccucagaaaguucaagaaauguuguaaugguagugcacaaucuaaacagauaaauuaguuucuuauauuuuacauuuuuaguaacuaaaaggaaauucaaugcuaauuaauauauugccaauuuauuuggcauuaaauuauugcuaaauauauuuguuguuuauuuugaauguacuuaagcauauuuuucuguuugggagaaaauauuucuauugcauauaucuuaaauagaugauaaugaauagcuguagucagguuuauccacuuugggacuacuuuuagaaaagaaaaguccaaaaauacguucauuuuuaugugugcagcauauggucaaagauagcccauuugacauuuuugggggucguaaaacaaacaaacagacaaaauauuagcaacauuaacaacaaaaaaacuaacucauuuacaacacauccuucugaggagaugugguccuacaguugucugugggacaauaagcaaucagugagugguauuuagauuccccuggcuuugugaaagcauauuauuuuucugaaaacuucuccaaccuaagcugagagccccauagauacuaaucugaaguuaauaauuaacauaauuaauauguacuaugccuaaauauacaucuccccucuuccaaauguuugauucaaaacuagcauuuucaccagccugggcaacauagcaagaucuuaucgcuacaauuuuuuuuuuuuuuuaauuagccaggcaugguggcacgaaccuguaauuccagcuacucaggagagugaggugggaggaucacuugauuucuggagguugaggcugcagugaaccaugaucguaccagugaacuccagcaugggccacagagggaaagccugucucaaaaaacaaacaaauaaaaauuaaacaaaacccuuccauuuucauugacuagaguagaaucaguaagugauaaaucauuaacauucuuguuauacaaagccaaguuucuugaacuguuuuuugauuguuuucauuguacuuuuaaaacuuuuacaguaaaaaaaacuguaaaaaaaaaacagaagacaauuugccccaucacacuaaauuugauuagacgacccauuuugagaacuuuuaagaaaucuugccauauugcuucccgcuagacugaacacauuuacuucuuugaaauauugaaaguaugucaucugauuuaaaacaaagcaaaguguacuuuuuuuuccuucaugugaguauuuugguccauuuuaagaguauuuaugaccaggcacccguggcucacaccuguaaucccagcacuuuaggaggcugaggugggcggaucacucaaggucaggaguucgagaccagccuggccaacauggcaaaaccccaucucuacuaacaaaaauuaacuaggcaugguggcacacuccuguaaucccagcuacuugggaagcugaggcaggagaauugcuugaacuugggaggugaagguugcagugaacugagauggugccacuacauuccagccugggugaugaagugagacugucucaaaaaaaaaaaaagaauauuuauuuuucuuucuaauuuauuuacugauuuaugacuucuuuaugacauauauccugagcagaaucuacaugucuaucaaucuguugaucuaucuauguauaugcagggaauuuuuuucaguucuuuaaaucauaaaaucacuuuuacuugaaauccugaaauaugcaaauaacuaaaacacgugguuuggaaauuuuagcuaguauuuuuagagccucauagaucgauagaaaaaugagcaaaaacuaucuuucuaaaacuccugaaucacuauuacuuagugugugcagaagcucgauagucuaaaagggaaaguaaagauucuuaauagccuauuucuuuggccacaacauuaucagaaauguuuaaaauaguuuaucauaaauuuuaaguuuaugauaauuuaugguacuuugguuccagucaucaucuggaaauucucacugaaaagcagcaaacaagguuuaguggauuacugugaagaagucaucuuuucaauguaagaugcuguuaauuuacaguguggccaucugaagguuaaaaacgaugauuuucuacuguguuuccccccccccaacccagauaaguuuacuuucuuaagaauaaaaauaagcaauauaucuuuucaauaaaucugcuagcacuguagggcagcuguuaaccaagcagagcuggauaggguuacucgaacaaucucugaagggcagagcugaugauucggagaucugggaagaauuuguuucagcuuguauucagugcauuccucacuuucuucagauguaguaaaguauuuuaaaugccauuacucugaguuuaaaauaaaacuagaaaugcuuaucaacucuuucuaaacaaugccaguuuaagcaaaacaaaauuaguaaaagguuaaaacugaagaccuugaugcuucuaaacacaaguuagggcgaauguuuguaaggugggccuuuucuccucuaaacugcaugucuucuguguuuugcaaacugcaugcuuaaaguuauugauuauuuuauucagugcagauuauuuggugugaugcauagaaaaaaagcauuuuuauuuucuuucuaaaauauaucucucuauugaacauuaacguuugcuuucauuccagcucaauuugugcucuaauaauggcuaauuguuauguucuaagcacuuguuucucuuguaugcuuuaauuaauagagaagcauauugcaauagcuuuuucuaaaaaagagucuaggaauuuugcuuuucaagaauaagauuuuuuuuugcuuuuuuuuuuucuuuaaguugccucuugggaaaguaagguuaaugccauguacaguacuaguuugcauguguucauuuaaauacuaaaaacuguaguacugcucgauccauaucugacugcuagguuucaauugacagcugaggauuugugacuggaccaugaaucaaaacggcaggcauuuauaccccaguaccagugaggauacauugggaauuacuuggcaaagguaacauuuuaauuauuuccaacccuacacuuacaccuaaaaauuacaugagcuauaguguuuguuuuuaacuagcuuuacagaaaauauauguuaaaaauuuaguuguuuuggcuaugccauucuucuuucccuguccuccuccuuuauuucuuauguaaauggaacgucaaauuaaguugggacuauaguauaugcuuacugaucauuggaauuuuuaaaugcuauaaaauguuuucuacaauuuauacuguuuuuggugggggaggggguggaaugugacauuuagauuuuaggaccugaaaagugaaaucacagcuuuagugaagauuuuucagcuaccugaggauaaagcauugguuuucacauuguagguuuuucuuauuuuaacucuuuccucuacugcuaauucuaagccauuucacuguucauuuuuuuccccuguuguagggaaaaaaaauagcaaaaaauuuugguuagucaauuuaacuguuauugacagcacccauaaauuuuggaguaggaagauuguuggaaucaguaacuaaagaaggaauuuguuaaaguuuuaauuucuguuuguauacugaugugauucauggaagauugaccuuauuugguuggcugagaaaacuauucuaaaacuucauuuucaaaaccaguucugauacuguuucaugcauugccuuuagaaaguaaguauuucaaagucagcugcgcuuauguauuauuuauuuuauuuaagaacaaauugugucaaauugacaaauuaaauaauuagauucaugguauaaucauaaguaauaagaaauaaaaauuggcagaagagagugagguaaucccagaaggaguucaccagauagaguugacauaauuuuccaacccugcucugauguuaauccuccguuuacggaaagugucuauagaaagguacauacucagauagaguuguagaucgucugccuaucuccauauugguucacagaaacugcugaagaguagauuuuaaagaaucaaaauaauuaaauguccacuuuaauucagauaaaaauuaaggaaauaauucagauuauguuuuuaaaaacaaugacuuuuuauuaauucacuaccaugugacuuuucuucuugaagauugauauaaccuccacuuuuaaaagguauacauuuuuacauauugugauuuuuuuaacaagauuguauucauccucccuuuugaaaauaauacaauauaugcuuauaaaaagaagauaaacucaacguaaccaucuuauccaaauagccuuaaugauuaauagucuuaauuaagugaaaguaucucauuaaaauauucugaauuaauauacauuuuaaaguuuauuuaauugaauuuaaugaccuaauauuuccauauguuauuuaauaaaagguaauugaauuuaauaaccuaauauuuccauauuuuauugaauaacucucuuauauuucaugcucuaucaguuaacaaaaugacucaugucugcguacaagcuuaccauauuuauaacaauugcaaaccagaugacguguacucauguuuguaaaugcaccuauagcuaugcgaacuuccaauucuguggaauauugauuggcuuacuaaaucuaaaaauaggauagaccucuaaagcauauuuguaaguuguuagagauuuaaaauguaacuuuaccuaguuauuaguaauguuuuuguuuugagacggagucucgcucugucaaccaggcuggagugcaguggcgcaaucucggcucacugcaagcuccgccucccggguucacgccauucuccugccugccucagcccccuccguagcugggacuacaggcgcccgccaccacgcccggcuaauuuuuuuguauuuuuuaguagagacggggcuucacuguguuagccaggauggucucgaucuccuaaccucgugaucugcccgccucggccucccaaagugcugggauuacaggcgugagccaccgcgcccggccacaguaauuuuuuaaauaaaaacuugauagcccauggaaagagaagaugagugggcaauaaaucucagaacacauguauuggaggaaaugaaucugaugauuaaacucaguucuuagggcaguauuguugcugucacaaauccccuuccuggugaaaaauugaugugguaaucaguuucaggucauaguaagucagaaaaaaauacagaauuuauuuagguaaaauguuucuucccucucaaaaauuguaacuuuucuuuugauuaguagguaauggcauguagaauggucuuaaugauccuaaaagcucuuuaaaagguaucuugguuuuuuuuguuuuuuuguuuuuuauuuuuuagauagucucacuuccucacccaggcuggagugcaguggcacgaucuugucucacugcaaccuccgcuucccagguucaagugauucuuaacgccucagcuaccagaguagcugggauuacaggcgugcacugccacgcccggcuaacuuuuguauuuuuagcacacacuggauuucaccauguuggccaggcuggucuggaacuccugacuuaagugaucugcucgccuuggccucccaaaguacugagauuacaggcaugagccaccaugcccagccaguaucuugguuuguuucuucucuuucuauccugauucagaaagcacauaauugauaauggcagccaucacauuucuacauugaacagauauuauugaaucuuuauggugagcugugcuaaaugcuguggugaauccaaugcugacaguucuuaaaaucuaggugugaugcaguucagaauaaauaaauucaaaugacauagguugcuuugcuuuguuguaguuuucaaaaauggacacaacagaguucauauuugauaauacaaauagcccuugucgguggcaugauagcuuuauccaucuuuuuuaguuuaugacuugugguuauuuuuaaaacauugaaagaauuuugaaaaaagucauaaaugucuguaacacuagcacuuuuaaggcagauaauagacaucuaaaaucuucagggcauggcuauggcuuuagaaucaucugaauaaguugaaaauauuuaagaaauauaggucuguucauccaaagaauuaaauaauuugccuuugucacgauggaauaaauaaaauaucacagguuauuuuuguugugguagaugccuuuuaacaaaaggcaaucccuggagacuguuguagaaaaggacaaagcaaaacggguguuuugguuuugcuuuauuuugauugauuguuguuuguugucauuacuuucuuuguacaaucacuuuuccauggucacccucuuuucugcuuuauacuaauugcccuguugagguguuuccaugucaaaugcagcucuugucggaacugaaaauggcagugccaagggagcugugcaaguauaaucaaagcuggaagauuuccuccauccacccgcaaccccaaggcuuaagcauucccuuaggaaccaaagcugacucuuugggaaaguuuucacagccuuauuagguuacaacccugaagauguuuuguuguuuugaccuuaaaauuuugugaacuguuuugugaacugugugugugugcacacacaugugcaaaggaguugcuugcaccuugagagagucaauuuuucugccuaagugaaaggucaggaacugcaguuaacccagaguaaaauauugguugggugaagggcucacuucuaguauagucagaaugggcucaagaucuuaggaggaugauaggugaugaacugcuuaagguagguacuguuguguuugugcuuugucucauguggacaaauuaccuuguugcauaugugaguuauguggacauaaacauauacagcaguuacucccugacuggcuggcuuucuuaaagugauagucagaauauagccuguacugucagauaugaaagaucaauauaauugaaugaaaaagaaagcugaaggacaauccaagaauaauacaaacauaagcuauuuuaaaacauuagagggagugcuuuaugcaaaagagaaacugaauuuauuguuucauucucucuucucucccuucaccccuuucaagaaaacgcaaagccacaagugagugguuguaugugucugauggcuuauguaaacauagaagaagucuucagauggcuaaaauaaacaugcgcguguuaccaaaggauauguuuacacaaaccauuugcucagccucugaaauaaugaauaaaugaagauuuuacuaaaauaauugggaggauuuuuguguuucugcggaugccauaauugaauggcaccaaagagacuuuuaucagcuauuuuccguguuacauguguuagcaguuccuuucuguggguugaauacuucauucuguaguuacuuuacacauguuuuucuaagaaauugucguuuauuacugcaauucuagagaguugcuugauuucucaagagaaauuuagcagccaguaaagguuauuuggaucugguuggucaggagagggagggcaaaaaaaaaaaaaaaaaagaaaaaagaaagaaagaaaaaaaaaguguggggggguaauagcucucauuuuauccauguaacuuaauuugcauaacacucaccucagccauuuuccuugcuuuguucauaacauuuucuuuguaaaauguaugcucucaaaagaaugaauauuuaaacaaaaaauaacuuucaauaauggguugcaaaccauauguuuguauuacauauauguguuuguguguguaugcaucuauauguguguguguauguaguguguguguauaucuccacauauauguggcauacguaugauaagggcaguauguccuuagguaauauaaagaguuaacuuuuauuucaacauuacacuuagaacauccccgcgaauucacuagguuagcauuuccugcucucaguuuguuaucuugacacauaacuacaguacaacagcuggguuguuccuggaguuccuggggggagcuuuauucuccgagugcugaauuuccuuuucagcugucagcucuaaaguguguucaaauccucaacuuuuuauacaccauucugggccccuagcaccacucugggacuaugauagaaaugcugauaugguagaugaauggaagaaucuuugguucaagguggagaauugcaaaaaccaaaauuucacaugaucauuguuugguaaaggggcugcuaacuacuuuugucuuuguauaugaauauucuuuuuaaaggaauuacucuauucucaucaaaauuauuugcaccuguuaugaaaucaaaaauaaaaacauuaccauucuuaaaaaugaucuugauaugguuuucacggacgcacaacaucuguggucuggcuuuugaauaauauguugggauuugucguaguuuugccuaacuuucuccauuuauaaagaaagauuuguacaacacgacauuuccuuuuuaucuaggcaaacucuucagaacacuuccuaagaaauuaauuguauuccagccagacuugcaugcugccaucccacaggaaaugggucagcaauccauuaagaugccauuagauaaucuaauuuggaacuuaaucucuaaauuaaccaugcuccauacuugaagcguacuugagagaaagaaaaaaaguuuacguuugaaucgauaggggagccgaagcgugaagaaggcuguuuguuuuuucuguagcuguggucacgucucaagccgucugguaaccaggagaaaccagacaugauguaauuccagauugaacuugaacuucagggacuuagguugggggaacaauggaccauaggaaucaauaauguccauuuuccacaugauuauguuuggagcuuuaaguuaaccuuuaugggagaagcagcaggaucugcagugugaccaaaaugagaugauccugagacaagauguuagaggaaagaaaacaacuuuuuuccgugauauuuucugagcaggacugcagauuccagcaggauuagaaaaguucccgcucugcaguaaaccgguggccuguucagagcacucuuuguucgcuuagguaggacaaacuuaaucuuacguuuccugucgaugauuuuuggcagcgcuacuggagagggaggagcgugauucugaaaauucccaaauguaaaccuugcugauuaacccuuuguagugaaaggaaguauauuaaaccccuacuuuauuugaauauguuuuauguaaagugccauauuuacagauguaguucguccguaagaaaucaguucccucgacagccagugcaccauuuauuagcuuaccuuuuugguucucauuuuugcuagugcuguuaguagggauaugaugauuuuuuuagucauauuuacuuaaauaacaaagacuaugaaugaauaaauaucauaauaaacauaauaaaugauaaaagaaauggcaaaaucuuaaggucaaguaauugaagaacacgaauuuugaauauucugaaauugcagaaaguuacaauuauucucucuugcucacuuuguuucacacacaggaagaucuuuugcccauguaagaucuuuugcccuugugaacagaguagcaagcaugauauuaaaauguguucaguucuuuaaucauuuguaauuuuaugcuucagcauucugauacaaguaaguuucaccuuuaagagguaaaauugugcaaauaaugcugauuuuugcuuuuaacugaaaaucauuuauaaaagaaucucuuuuugcuuuguauaaaacuuauauuucuauuugauuuaguaugccuugggugauuuucucuagugaaaggcacuauuuugaagcaccauuuuuguagagaauuuuaucugcuguuaaagcaucacauaugcaaauaagaggagcaguaccacuuuuaacaauagcauugaaaagaagcccaggguagagaggaauacagacagaaagaggcuggaaaucaacaugugggcuucuccacugugcuguggucugugggaggagauaaaauaauugcucugagccugauaauuguauaauuuuuaauuggcuaaaaccucccacagcuaccugaguucuuauauauguaugcauguguguacuguaauuuauuuauaauuagucaucuucauaauaauuuuucaucuuucauuuucaguucuaaaauuugaaaaagaucaaacaauuuuuuuauaaguccuuaauuuggccaauugaggaagagcuuuuuucuuauuuauguuuaaaccgaacauuuuaaggaaguuuuuauuuaaguguagguugcuauaucgaaggcuucaaguauuauguaagaguuuuuuacuaaacgagugcaguaauuauaaggaacacauuuaauauuuaguggcagugcucccauauggaguggcuuuuucuugcccugugcucuuuauuagauaaaauauuucaaugguagaugcuauuauuuuacuuagaaagugcuagcacucacgcaugguaaaguuaacauucaauccacugugcccuaagaacaaaaaacuucugaaucaauugaauauaaauuaaugagguuugaugggcuaccauuuugauaugcuauuuucaaaaccguugguccccaaggaguagcaauaaagaaggcuauuuaccuacuuaguuaagaaacaaauauguuucucuuucauuacugugaaguccuauugcuugcaguuagaauaauuccaugagccaccugcaguuuaugauauuugguguuucccagagagcccacaagaguacuuugcaguucagguaagagcuagccagggagcuuucugauacagauuauuacaaauaguaauaaucauuaggaaucaucuugcaugcaaagaggaucauuccgacggcaauaaugaucccuaaaaacggugaaaauaaaucgaagaaacccaagaccuguauaaaacacuuuguguauuucacuuccaggcuagccucaucugaaguggaacucaacaaacaaauuauugacauacagccacaucugcacauauguaagacaaaagcaaauacugcauucagcugaaaagcaacuggaauuggaggaauaaagcacaguuauuugugcugaauuuugggcucaagaauuauacuuccacaggaauuucauugugauaugaaccucaauucacaaagucucuugcauaauucagugauaauauaacuucuaguccagugagaaaaguaaacuaugcuucacaggaaggggagaugagaaaaguuuaguggguagaaauacagauccuagaaugacauugcucgaauucaaauccugccuucuacaauuuaauagcaauacgaguugggcaagacacuuaacuuccucgcuucaguuuccucaucuguaaaaucaggauaauaauggucuuucucauagauuuguuaugaggauuaaaaguuuuaagguaggucaagcauguagaacaguaccuggcaaauaauacacauuauauaagugcuagcaacugguauauuuaucaaguacuauuuucuuuguucuaauacauaaauagauucaacuuaaguguuuguuccuucuacuggucugagcgagcauuuuuuucacaagacguaaucugcagccuuuguguuauauugaaguaagcaaccaguccgaaugcacccauguacaacccagggcagcacaguuuucccaacagguuuucagcaauuaauaaggagaacuguuuauugugcauuuuacaagaaaugcuaauacuuguguguuaauauuuugccaauaaaauuagaguguuuagccaaggaaguaaaaaccuuuccaucuuggggagaucaggaaauguugcaaaggaacuaaaggcaaaugcuucuuuuaaauuaaaauacuuauuuuauuuauuccccaugcuuucugggccauugcucauuuuuauugccaucuguaaauaauguggcuacuguuacaguugagguauguauuaauauguacaacucuuugugcuuuuuuccuguaauauuuuuuaagcuucuugaaagaguauuuacuaucuuuuaaguaaauaugguauuuucucaugauuaaaccaguauauaaauucuaaauggacaauacuauuguuccccugaaaaauauucguauacuggauacuuagacauuucauaaacuguuuaacuaguguguuaucucauccauuaucaaauacacacaggcuaguaauaaaugauuuuugccauucuuaaaauagcucuuauuguuucaucaccuccaaauaaauaauaggugauguaaagucuuugacuuuguuugguuucuggcucaauguaauggcuucauacauguuuaauguggcacccugugguuccuagguguuagugagcuaaaagguaagggcccaauucuuuuuggccuagaagacacacucccauaaugcauaauuuuaaaaaaacauaaccagaaaauguugguauggcugccgagagcaauuucugccuuucuuucacugaaagguauagcucuuuacucuuuguagguagaugcgaagaugaacuauuuugcccaguuuauccaggauaagacauauagaaauagugcaucuuuuuaaaaggaagaaguggguaucuucuuccgccuuaauccucacgcuguagaacucacccuaguagaacuucaacuagauuuguuucagaggagaugaauacauagaauuucagaucauuugaccacuuagaccagcuacauauucugugcacuagucucuuucgcaacauuagcuagguuauaauccagcuuguauggugcaugaaaaguucacugucuccugaagccaauuaauuuugccuucagaccacucuguucaaaaguucuuucuuauguuaagucaucugacuuccuguguaggcaauauaauauagugaaauggccagggaaaucagacagaucugagucauaacugagggcuaagugggagacuuugggcaaggaacuuaacuugccucaguuuccucauaugugaaacagagauacugauggccaucucaugagcucacugagaaaauuaagugguguagcauauguaaaacaccaaagaugguaccaugcuuauaguuaaguccucagcauggcuaucgucuggaaguuuugccuuugugcuguugcuacaaccugaagcaugcuuaagcggucuacauuccuuuccacaucaacugcuauaucuucccugucuacccuuagcuguucugcaaugacauaauuuggugaguuuuucaauaaguaaaugccauaaaguuagguuuucuuccacagugcuaccuagaagaaauacaguacuucagagguagucuuaccaauaacaaaaugaagcaggaccaucaccaguaaugcaucuuaagcucuaaauaauucauuugcuucuucccuuuuggggggagccaugucauacauuuggucaaaauagcaagaaaauaguauccaugauaucaaacauuuuauuuuuggaauuuugauuuagcucuuauguauucauuuuauaaugaacuaucucauuauaugcauaguaauagucauuaggaugagcuguacuuuguguuaagguacuaucaaauucuuuuguguuuuuuucugcuugauuuuuuugcaaaguaauuauaucuuuucuuuuuuaaaugguuauaucuacuuuauauuuucuaaagaugugcuuucaacuuucagcuaugcucaucuucucuuugccuaaacaaaugugauuugguaaugaaaaauuugauuaaaacaaaggaaaugcacacuuauaaagauauauugcugaaguagcugaauuugagcuugaauauuuugaaauccuuucaguuauauucucauuucuuuuauuggaaugcagauaguuggaaugaacauaagauuauccauauaguaauucucacuaugaauuaaaacuauuaagcauuuuacauguaacuaauuuguuuuuguguguuuauuuuauccauacaugugauuauugauuuuuauauagaguuagauguauaaaaagcacuauuacauuuuuaccugaguaaguaugcaauuuuagacauugcauuuuugaaauuaaauaaucuguauuacuuuaauuaaauauauuuauuuacauuguuaucucagucauugaauuaguuuuaucaaguuuuuuuuuuuaacaggacuaccaaaaauagcucuaaaaaaugucugugccuuauaguucugaacuuaaauuggcaauaagagacuuguaaaacucauauauggggucugcauaguguuaauguuugagauuuauuuucccccaaagguucauaaacaguauugacaaauauauugcacucugcaauuuugauauggucauaauguaggaugggcgguuugaaagauuuaaauaaacauuuaaauuaaauuugguaggcauucugcagcaagaguccuguuaguuacuagcaucaauuuauuuuuauugaacauuuuccaaagaauaaugacauaugucucuucuaaagaacugaguaagagagcuauugcaaaauaaacccugaguuuucugccauuaguugguagacuuguccauguaaggagccacaucuauuuucaaucauuaaaauauacuuuauaucccuaaagcaugcaaucuccaaaugacuuucuugagcucacuuaauuuggcacucuuguuaauuuugcaaagcaauuugcugcuuguugacauuguauuuuacugucaaggauuaucugcuuuaccuaguccuuuugcuuuugguacaugcuucuuacuucaaguuaaaaauaauguauaaccauuuuuguaauuuauuuuauuuguuaagaaauagcaccagcuaugcucagacucuauaaagauagaugugacuaggucguuuucucugugaaguucaccuuucaguuaguaagauaaucccagauagagauauuuaugaaguaauaaaugcuguaacaggaccauguacaaagugcaguggaaacacaguugaggguaaaauaaguuucaugauucauuauguaacauuguucccaaucaauggugcaaagcacaaaaauaauuguugaagaugugugugggaagauaaauaugugaaaacaguuaagcugcuuaguaaaaguuucaauaacaaguauucuuaagaguuacgauuuuucaucagauuuugaggacgugucuuuuuaguuugaaugugauuauuccugcuuaaucaauuuuuguuaaugcuaaguagaucuaauuuuaaauucagagauaccuauuuucuuuuuauaggggaucaaaucacaacauauucaugaguauauguaaucuugggugacagcuuuugaaaauauauagcugggugugauuugaaacaauuaauugauuuguuugucuaaaaagguauugagcaucuuccaugugcuagguacuuuacuagagacggacuuugcugucauugaguuuguagucuaauuauaaaaucccuugagcacaaauggucguugugauauuguuuugaaauguuaacucagaaauauguauguguagcaacaagcaacauuuuguaucgagguaucaccagaguaaaaacaguauguaucaaguuuuaaaaaaaauucagaauuguuccuuuagguugauauucuguaaagguuuuuguacuuuuggaauucaaauaugaacaaaugagcauaucuagauugauagcuacaacaauagugcuaucucacuucaugguuucaaaaguaaagcaaaggauguucagugaaauuuaaaaccucgaaaguauguuuccaugcuaggccaugacuaauaugaguacugaauugucaguuugauguuuucuugguucaugauuauuuaugcagcuguuacuuaacugacauucauucggauuugaguguuggaacaggcaauacauuagauuaaguguacccaaaaugugugcuguagaguuguuucaugauauguagaucugauuuuuuuuauccuccauaugauacuuuuuaaagggagauuaugcuaguagcaauuagagaauuguuuuccagucuuuuuuuuuuuuuuuuaacagccuguaauucagcauaggcgaaaguugaacugaugagaguaaggcuggaaucuuaucauuuacugccuccaacacccccaacccccaacccgccaucuaucacuccaaacuccucaagugcagagcagcucaaaugugguaucauuacugauggggaggagcaggaaaugcucaggcuucuguugcaagccaauguagggaaccaugaauuggaaggaaaagcuguggcucucucuaaaaguaaguuaaagaggguuagaauaagaaaacugcuggagagcuauagaacuaaucagugcaagcagagaccuuuguggccuccuguaaauguuuuuccucacgauggguauucuguagagaacaaaaaaagcuguguuccauuuugguucuaugauucuuauuuguucggucuuuacuaaaaaacucugauuaagguauguuugauaauugggcauuucaaauuguauguuaugcaugggccuaccuuaaacauguaguuuuuuuuccuguuguaaggagaaaagaaauaucuuucaccguacuuuucaauuguauucaacccaauaggcagguaagaaauugaaacccaucugaccacugaauugcuugugaauuaaagguaaaauaagauuagaauguaacuggcaaaguauauugguaccaacagauugcugcuuuucuuuuucuuuuuuuuccuguacaaaaaagaaugauauugcauuuauauugauuaauguaaaauauuuuagaauauccucaaucgguuagaauucaauaauuguuuauauaucuuacucuggauuuuucugccucacuuuagucuuaauuuucauuuaaaaaauagacuauagaguuuagauagguguaacauguauaauuuggcacauuuaucucauauuagacuguaauuuugaaaauagggauagcaauaauuugaugcaucuggaauuuauauuucucauauuguuguagauuuuaacauuguauuuuuuucuuuuuucuucccucccugcugccucucuccucucaacaguccugguaccugggcuagcuugguuccuuuccaagugucaaauaggacacccaucuuaccggccaauguccaaaauuacgguuugaacauaauuggagaaccuuuccuucaagcagaaacaagcaacugagggaaaaagaaacacaacaauaguuuaagaaauuuuuuuuuuaaauaaaaaaaaaggaaaagaggaagacuggacaaaacaacacaaaggcagaaaggaaagaaacugaagaaagaagauaauagaccagcaauugcagcacuuacaaucacuaauucccuuaagguugaaacuguaaugacauaaaaagggucgaugauauuucacugaugguagaucgcagccccugcaacguagccuuuguuacaugaaguccgcugggaaauagauguucugucucuaugacaauauauuuuaacugacuuucuagaugccuuaauauuugcaugauaagcuaguuuuauugguuuaguauucuuguuguuuacgcauggaaucacuauuccugguuaucucaccaacgaaggcuaggaggcggcgucagaggugcugggugacagagccaugagccagccauuuuauaagcacucugauuucuaaaaguuaaaaaaaauauaugaaaucucuguagccuuuaguuaucaguacagauuuauuaaauuucggcccuuaacccagccuuuuccaguguguaacccaguuugaaaucuuaaaaaaagaaaaaaugaaaaaaaaaggaaaaaaagaaaaaaggaaaaaaacaguuugaacacaaaggcucuauggaagaaaugccucuauguaggugaaguguucucucugcaugcaacaguaaaaauuaauauaauauuuuccccacaaaagaaacacuuaacagaggcaagugcaauuuauaaauuuauaucuaaaggggaaucaugauuauaaguccuucagcccuuggacucuaaauugaggggauuaaaaagaauuuaaaauaauuuugaacgaauuuauuuuccccucaguuuuugagggcauuaaaaaggcauuaaaucaagacaaaucaugugcuugagaaaaauaaaauuaaugaaaacacagcacuuauguugguuuagcugcagccuccuuggagguagaauuuauuuauuuaaaauuacugguugcaucaagaacccauaggguguacaaaagguucuauaaaaucugcauuauagagacaaagaggcaggcaaauccaugucacaaggguaaagcuuacaguuuacaaacugggaacgccaggguguaggauauaaaaacgcacucuugagaaaacaaauguaaucagggugcugaaaacuugcauggugcuuucagacauuagccuuguucaacaaauuucuuguauugacagauccauagugugcaugggcagacacauuuugccucuaugucucuuaaaauuuuaauuaaaaauacucuuuccaguaauccuaauuugcacgaagauauaauguccacauuacgugccuugccuugaaaucuaaaaaacaaaaaacaaaaaaaaaaaaacaaaaaaauacaacaaagugacaucacuacacuuguuuugcugcauuuauuaucauuuuaaaucuuuaccauuuuuaugacaaaauauuuuguacuccagacgaagaaaaaugugugacaucauggauuuuuuagacaguuauaccuuuaucucacauuuauaaagcauaucauggcuguguauaguugccgcuuaaaaauuguaaucgaccagcaauauuuucaguauuuugguguuuuuuucuauuaaccuuucauguuuuucaucuuccaauuaauauuugggggggagggguuucaaauuuauacgaauuaugcaauaccaaguuuugccuauguagguagugcuuuuagcuguauugguuauuauagguaaguacacagauuuaaaaaaaaaauaauguaugcuuuuuuguuuguuuguuuguuuuaauugaccaaaguggguacugcuauuuuugcagugugaugagguccuuuuguguacugagagauggacaggggauuuuuuuuaauauacauauauauauauucuggggugggugggaggauuuuuaacacuuugcaguguagcugugaagcagugcacccugagaugggccugggcugcaaagcgacuguucugccuacugugacaaacuucaacuuacacagguuccccucucuaacuucccaccuggguugcaagcugaacucauuacugguuuucauaacaacacaauaguaagaacaagcaaacacaacaaauucuccuggaggcagacuuggcuuaaaaaggcagacuuggcuuggugauaguuuuucuugaaaguuccagauccacaguggagagugagccugucucauauuuggcaaaaauauuuguugaaauguccacauaggggauguuggauguuuaacacuuuugagaguuuaacacaugaauauucuuucuccuagaaaacacauuagaccuguuggagggagucucccguauuccuuuucugccacuuuucguccccauuucauuucauuaaugauaggauaugauuuaccugugacuuacuacuucaaauggauggcagugcacuuggauuuuuuuuuaauauccagaagauugaacagaggguugcuauuguugaauguauuuggacugauagauuaaaaucaaaguucaauuuuuaaggaacaaaaaaguaaauccuguuuucauuuuaucuccccuuuuaaaacugagaaccagagcagaagggaaauauagaauuuuaagcaauuaaucuuccuguggaugaauuaaacccauuagaugcugaugggauuuuuuuaaggaaugguaccuuaacuauauauuugauuucguuuccccugagggcuagaggcugaauggaggcugguuuuauuuugccuuucccucaccgcccagucccauugaguguauucauuacuagaaggaaaaucuuucagaauuggugacacaugguaggcugucuuaaggaguccccuggcccccuuccccuaggccauggccuaauaaaauaaacugucaauuguucucacagcauaucauuuaauaaugaauacuuuagaacaaugcuuaugggcuggagaauuguauuugauuagcccauucaguuugauagcccaaaugcugaacagcacagcgggauccuagcagugcaaguucaaaaguaaguccaaucauuucugugauacucgcccugguagcaaacagaucaucucagccaagcucuucauguaucuuugaccuauuaggugaacaaaugaaccucacaggacacacaguauuuuuuaaaggcagacucgcucucuuuuuugccagugagcaguucuagcuaaccaaguuacacacuguggguauuccugccugccucuugaauacaaaggccuaguucaaguguugcuuuuuuuauuucaaaucaauuuuuucuucuuuccuuuuugagauaaaacuauuaaaaguacuacuauauauauaaaaucucaaaucaacuuuucggccuccuccucguguaccaggaaguauauucugacgaagggccccacuuuugcaggucuugcacgccccucccuuacccagaacugcagagcuucaggauggcgaaggucacccaagggcaugaguagggaguggugucuccaaccaucaguuccguggcacuguucagccuuugugugcugcccugccacccaccacucacagugccucugaagcguguuaccccuggagugacgugagcauuugaggcuugucuaaggaaaaaaauaaaaggcagugaaggagacuguacauaaagacauggcaaaaaucuuaauuauagcaauauaguuaucggguaauguucgggugggcagcuccauuaaaaaauaugugaaugaaucugugaagcugcaaguagcgagaagagcgaaaggucuucuuaaugaaccgccuaccuuguagacaguaauuuguacacuguauaguuuuguuaagaauuuuuuuuaaauuaaaauucccauguuuguaaagcuaacuuuuuaacaauuauaauggaacuauauguuguuuccauuuuuaaaguaaacaagaauauuccuuguuuagagacuggacuugaguuaaaacucuccagucucuuaaguuauguauuaaaaagaaaaucuguccauguuaggaguuauuucacagauuccugugcuugaaaagcauaggauacuaauccuuuaaaaaaguguaaauggagaaaaguuauauuuuaugaagguuauuuuguuguauuuaguauuggaaaaguugguuuccagagcauuucagaaugucgaagcaccacugucuuuuuauuaguauauacggccuuuagcaaaaguuuuugugauuguuacgugaugguauuuaagguuaaguuucacagagcauucaggauaggcagaaaacuaaaacagugcuaugucucacauaacguguccucagggagcagaaucuuggauuugugacuuguagcuucauaaggacucaacgaaagagauugcacagggacaucuucagcggugugacagcaggacauguucuuuaccuagauucaaauucuauguacugugugaaaugaugaaggcugcagaaaguuaucccauauucaguguacaguauucauuuuuaaugaaacaacucuacaauauugcuggcagauaggccccaagcaugacauucaauauaguuuacauguuccugucaaggucuuuuguuaacauuaaccagcugcaugcuuucuggacuuuaagaaauuggguuucuauagaaaacuuuuuuuuuuuuuuuuuuuuuaaugugcaggcuauucaaguucaauaguaaaagcucaaaaaugaauguucuacuccaugcugaaggagcugaaagcugccuucuucauauuuugcacuuucugguaguuccccuguuuuuucuaauucccuaaaauuguguggguggaguggagcccugcaguugggggguaacauggaccacugauuuugcccuuugacccugcacaaugaccuuugcaucagccaaacucauugccaugacaacucuuuguacuguguccgugccacagaucuguuggucacauuguuaauaguaaaggggacaaguuggagacggucaauuuuuacauuuuuuguugcaauuuuuucuucaaugguuguaaguaguuuuuuuuuuuuuuuaauaauaaaaggguucacuaguuaauacucuagaaauaucuguguguugcaauucaaauguauguugagauugugaaaagcgcuucagugccacuagcuuaccgguacacuagacuaagcccuugaugacuuauugcaugauacaguaccaggaacaacagguggccuaaauacaugaaaagcaguguaagcuagugacacuaaagccagucuuguauuacuguauuuuugacagaaugguuuugaaaacugugcuacagggacugauguggcaaauauaucucuuuaugcagaaggaagucuuuuuuuuucuuuuuuuuuuuuuuaagaaguauggcuuuuuaugcauccuucaucgagggcauugaaguugcauggacugauaaaaguugaugcaaaacaagaaagaaacaaacaaaaaaaaaaaaccagcaaaauguuuaccaaaaaacucaaacaaaugagcagugccuguucaauuucacagucucuguugaguucaguuguaaauauguuucaaaugacauuuucuugggaaaaaaaaucucuacaacauuguagaaugugagggguaacuacaucccaggcauagguuucucaaagcugcaguagauuaugucuucaucaagcuguuaauuugugcuuauaucauauagaacuuuuagcauccugggaagagcugcccccaccucaaugauauuucucugagaacaacuuuuguaggacuguguguuucuuuagauacauuuaguacaacuguaggugacgaguagucaguuauugcuugcuagcuacacaccaggguugauccauuuuaaaacuuuuggcauuuuguccucaugggccauaaauacagaaccuuguauuuuaauuaaauuuuuuuacaaaaggaggcacaugcacaaucuccauguaacaaaccuuuagcaguaggauguauuauacgacaguuacuuaauuucuagaguucaggccucugggaucaaccccagacugggccagaauguuagugaagguuuuauugugcccgguuggaggauaacguucuuuggguacuuuuuguggguugcaaaugaacucaauugccacaaguuuuaaacugguguaaaucaagcuugacuuaaugugauuguuacuguuauauccagccuauacugcuagcagcugcucauacugcagucaauuacuggaagcggauauauuuccuaugcaaaaacuguuuaaacaauaaaaugagcuaugcuacagacucuggccucauguuuuauuuuucuccucaucgucuccuugcuguucugccuacauuaauguugggucaguagugucccagaaauugaucuuggcccuuaacuuuggggguuuuguagcacugauuuaauuauuagcaucugggauaguuaauauuucaguucaauauuuaaccguauaucuguguauaucuauauaauccuuccuugcaguuccuaauaaauacagucaucccaagcuuucuaaacaaugacaguaaaaaaaaaaaaaaagaaagugcaguuauagaaucgcagaccucacucucugagaaaggccuuugagcaauacguugaagacgaugugugccaugaugacuggacuguggucucugugagagaaaaaccacagggcaucaaacacugaacagaaaagguaagccccggggacacccuguggcuguggguuuagugguuacaugaauacugcaggagagcaauuucuuccugcaaaugccugaaaaggagcagcaucuuguguuuccaagaagcagugcuacuuuucaacacaagcaggggugauguucccuuuucacagggagacauacacaagggcuaaaaccgaggaccgggucccaaauccagccucacugaaagcagcauuucugaauggagucagcuggaguucaauaauagcuaauugaaaaggaaugagcuuaaaugguuuugugauccaucugagugaugugcauaaaugaagcaaaaauaaugcaagcuuca

SEQ ID NO: 14005 - RNA, 764 nt, Homo sapiens
aaucacuuuucucaaaagcuuuuaauuuuuaguuauguuucaaguggagaaaugugaggcucaugguugcauaguaauaauauuuuaguaccaaaugaugucaccgugcuugcuacucuaaagcaguacagcaagauugaaaagaacacucgucugaacccaagauuucacaggucuucuauaucugcuucuaauaguuacuggcaaaagccaguauaaaaaauaauuuguugauguugguuacuuaauuaccugauuaaacugacacacagugaugaacaguuagucaccuaaccccaagucauacaccuuuuuagugccaaagcugucagaaucucacaccauuucccaaaguuugcuguguggaacccuaguccuugaaaagcauucuguggucaguuucauuuuacauuuuuucuccucuuaaaauuucagaguuuacagugugauauuaaaaguucuguuaagucuugcaauuaaaaaugcaaccgacuuuccuuuaaugagcauuuucuaaacauauuugucuguggaacccuccuuugcuauggagcaccuaauaacacaccaaggagcugauauucuauggaauggacuuugagaauuucuacauuuaaaaauauuccccuccagucuccaaggcugucuuccccugggcugguacuuugucuauacaaucuaauaaauauauaaaaauagaagcacuaacauucaucauacugaacuuuaaacacuggcauauaguaaagagauuccacuggcuu

SEQ ID NO: 14006 - RNA, 468 nt, Homo sapiens
auagccccgcuuuaaucaggagagauuguggcucuagugauuuuugacauucauugagaagguugaaauuggacauagacccuguguaauucaacaaguauauuugugaaauguacuucagaagaggcaaaauuaaaaucaccaauaacaaaacaccuaaccauaaaaaaaauaggccaauuaaagagcccuucgauugguaucagcuccuucugcagcucuaaaauuagaccgcacuucagggauucuggaucacacccaggccaauucaauauuucaaucuagucagcgugugcucuguccuaggugcuaaggugaagcaugugggagacaagaugaggaagacacagcuggccccuugcagagcucuguggcgguagacugccccagccccaccccagcucacaccaggugccucaugcaugugagggcucagccauuuucagagcaagcucauugucaccacua

SEQ ID NO: 14007 - RNA, 2515 nt, Homo sapiens
cccuuaguaccugaaaugcacauuuacuaguuuucuacuuuauucuauuucaucuuuuuaaaugaaggugcugucucacuaaauugauaucuugaccugcuaaugggucaugacacaugguuuggaaaauacugagugaaugcaaaaguucucuguagaagcuaaauuuaauaucugcacagaagugcuucagauuccuguguuuagaggucuuucauuauuucagccccuccuuuuaaaggaauuucauacucauuggaagagagugacuguuuugcagaaugugaucuuggucuguggcaccgcugcagaacauuccacugagguguuucuccucugagcugcucuaaguacaagucagucagcccuuggaagaaggacagguugggugcagaguaaguaaugccugccgggcugggucuguguucauaaugcauguugaauucuuaucuuagaucauuagggaaauagcaccuauuaagacagacccuuauuuuguaaauaaggucauggaaugaaauuggaaaguuucagggaaaaaauguguguaguucauaauuacuauuuaauuggucauugaaaacaugaagaaauggccuuuugauaaaauuacaauuagauagauagaauggguauuuccuaaagaguuauuuuuuucccugaaauuuuuaguagaaggaaaucuuaggugcaguguaagauaauaucuauugugccucacauauccucaugugaaugaaggaaaguuaaacauuauaaauaguuucuuuagaauauggacuucauauuuucaccaaucugaauuuuaucauguuuauaacguagagaacuaaggggaagcuaaaauuaaaaugggagagaguaugggauguaaaaauacuuuuuggagaguguuucagguuauguagagaggaagaauagcauuaugguuaagggccuaggcaucuaaggcuagacuaucugggcucaacucccaaauaugccauugcccagcuagguaaacuugagcaaaugaguuaacauuucugugacucaguuuccucagcuguuuuguggggguaguagcaggaucugcuuaguaagauuguugugaggauuagaugaguuuuauucauaaaccauuuugccaggcauauauuggguccucaugcuaauaguaauuaacucuaaguagggcauaagcacaacgcaccgcaguaaaaugccugacaguauaaaguauacaaauaagaaaagacacaaauaagguuacaaaacaaaaacaaccccugccucccaaccccccgccaagaaaacacacaacagaaacuacuacuaggagaagugauucuuagcaguuaagucaguggcuuuaggcucaaccaauuuccacaaagacuuugcuuaccuuucugagaaaaugauuucuuccagacucugagcuccuguuuaguguauuuacuccuuaugucauuaauuucauuuuuccccuaaacucaaugauaaacuucuggaaagcagagauccaaucuuacuuagcauuauauuuccucucucaacuucucuuccuggcacucaauauccuuauacaagcaccgauaccaucagacuuguugaacgagguugagcuugccuuaaguucuagucucuuagcccauuguuagugcuuggagagcccaggacacagaauuuauaaauaaagccagucccgcuuuucacagaggcaccccaccaucaccaccauacacacaacuuaaaaaugagcuguucauuagcaauuuugugauaagugcaauggguccaaaaggacccaucaaagaugauuucacccacaguguaccaggcgcaauaauggcuccaggcaacuggggccuggacuuuccccuuccuccuuccaauagcccccuucuuagcagaugagugggaaucccccaucucccaguggcugagcauagacuccacugcuccgauccagagagggaaguugggaauuggaaauauggccugagguuccuggagagugcaaagagggugaaggagagaucucuacuucucaugcucucuaccccauuugucuuucauuuucccauugcuggcaaggaaaggagggaguaguucuucagcuucccuuccucuacaacuugguuucucuucucucuuuuuuuuuucuugaguuucuuuccguagucuugagcccagaaacugcaggacaaaaguagugguguuaggaguagggauggaagguggaccuaacagauaacuucuuucuacuccucuuucucauauccacucuguuuuuuguuucccacuaggcuauccacaaucucaccacuggauacuagauuaugaugacagcuggggauccugggcuguuaguucaauaauggguggcauucaucaggaagacucuuaccagcaaugggccuauaaguuugugaggaauugugacagagauggguacagaaggcaggaaaagaagcucaguucucaagguaaccuugcucagccagcuggagcaagucaugaguugccugua

SEQ ID NO: 14008 - RNA, 92796 nt, Homo sapiens
auuacacuuauucuuccaucaguauuuagcauuauaauucaauaauuuucaacuauuauuggcccuaaaacuuacuucaggcacuuacuggcaaugccucuuucuggguuccauacccaaggaugcugauucaguggguuuggggguaugcucagauaucugaguuuuuuucccuuuuuagucaugaagauuuuaaaaccaagcugaaaaaaaguaccaaaaauacuucuauacauucuaccuuaauucaacaauuuguuggcauuuugucauauuugcuuuauaucucaacuuguaugaaugaguguauauguguauucacuacauauuucuguauuguuugaacaugugaaaguaaauuucaaauaucaagacacuuccacuuuuuuuuuuuuuugagacggagucuugcacugucaccugggcuagagggcaauggugcgaucuuggcucacugcaaccuccgccucccggguucaagcgauucuccugccucagccuccugaguagcugggauuacaggcacuugccaccaugcccagcuaauuuuuuguauuuuuuuuaguagagauggggguuucacuauguugaccaggcuguuuucgaacuccugaccucaugauccgccugccucagccucccaaagugcugggauuacaggcaugagccacugcgccuggcugacacuuccacuuuaauacuccagcaugcaucuccuaagaauaagaauauccuccuauauaauuagaauacuauaaucacuccuaagauaauuaacaguauuuccaaacuaucaucuauauuuugcauuuuaacagaagauucuagaccuaguugucucucucucaaguacagugggacaaguuucagauauugugacagaccaauggggaagauuuugggggagcaagcagcaggucuuaugagacaacccaaauaagccucaaguuagcuuuggguugacuucacaaaguucaucagacaaaugugcuaucuugccagaauggccacugcacuugacacacagucuaagcuaacgcagauaggucauguggcuucuaggagccacuccuacacacugauuucaacuauaagacaggggaaacacucuuuccuucccuaggaaacuucaaagaaaauccuccugcucucauuuucauaauaaaaaguugacuggugaauguacaaaaaggcauccauguaauuaacuauauacccugguuuaagugauaaaguuugcuucaguguaaaugaucagucaaauuacuccccucugugauuaaagaguuaaaauuguggcccagcgucaugcuccagggcagcuguaagaaauagagaucaugggcguuguagugugauaauucugcauacucucuaauauugucuucauaaaauagcaucagcugcugcugcauaugguauaacuuuaauaugcucuuuuaauauuuacaguaugccuauaaaagauuucaugaugacaguuggugguucccgugguaauuaauaaaugacaguacaacugugaucagaugguuuuaggaaagagucucucagaaugcuggcuuucacaaauccaggccuggggaugauuucugggggcaggguuuucuaaaccugagguugaccccaugucguuauuugccuaugugguuuuguagaguuuuaucuccagguucuucccaaacagcaaaaagugggaaagaagacagaggaguuaguaagaagguugccugcuagagcagauaugaauuuggaagugacuuuuuuguuuuuguaaugcaguuguagugcaacuuacuccuugacaaagaauauguagauaugugugaguuugguaggucuugcuaccugaagcagcauagguaguuaauaaaucccacauguggucagugucuucuaaguaguuggucaaucuuuuaccauugauuccacugaauucuuugauaguguuugcuugccucaggccauucaucaccacacuuugagcccguauugccuaugggauuuucucacgcaucucuauuugcuguugcauccaugugaaccauguuuuuuaucaccuaaggcugaggcuucccacgaugugucaaaaggugaaauuccagguggccuaaauuuucccauuuauuagguguagguacaaugaacucaaagcagguauguugaauuauuauaguauauuuguaaaccaacaaaaguuaauucuauaaaguguuuuggagccauaagauauaacagaaaguauuucuuuuguuacuuuugguaccaggauuuuccuugaaggacuuggagauucauuucuguauucaacauucucuucaccugagcaaagugaagaaguacugucuccuucugccuuuucaucuccuuucccagagcucagcacucuccucuuuccuuugacuuucugagagcucagcacuucccauucuguguccacauguagcugaggguagccauuagauugaagcucucagcuuuccucuucacucuuucaaaaucucccacuuggguacucucuggcucuucuuuugcuucugacuuugaagauuaaguagcuauucuccuagcaaagagaauccucuuaucuggacucuugauucuacuggugcucuugccccauacuuuaacucuuaauucuaacuugucuuucuucucuuuuuaugaucuuaucuuagagauaacucaugcuuccucauccuaaaacacaaacaggagacaauccauuaacucauuucaaaaccagcuaugccuacugucucuauuucuaaauaaucucucuucucaguuuaauuaccuaguuauuaaaaaucuacucuugaguuuuccaggaaaauccugcucacuaaaucuaauggucuuuucucaugccuuauguucaaccuuucuucagacuuucagaucccugccuguccuccaccaauuuccuccccucccuggacuuuugcaaacccuuugguaucaaagaccagauauagaucccuccuccaagggccugccaaucacucucauucuuccuuuguacuuuuuaguuucauuguauauuaauucaaccaaacuacuggacaccuauaauggauauagaguugugggaagcaacggaaagacaaacacaaauaagacuggauauguucuuuccuggagcucacugucuucuggggaauauuuauaagcaaacagaucauuacagcaugguaagaucugugauagaugagucaagagaauccuguggaagcccaauagaaggugccuaaguuagucugguuguucagcaguaagagacuaccagagaucugaaagaggagugcagaguuagcagcugagaaggcagggaaaaugaugggccagcaagcaguuuagugcuacuguaacauacacuggaaggaaaagcagaggaaggaguugagagauggcagcagagaugagacugaagaggucagauuguuaaggaacuuuuaugccacgcuaagcuuucauuuuacaauaaagacauggguagagugaugagagugguuagguuugcuuuuaugaaagaguucaugagugauauugugcaaaacagauggguugggggcaagauuagggauaggaugacuacugcuguaguacaggugaaaaauaaugacaaccugaacucagugcuguaggaaugcaaagaaaugaauggcuucgaaggaucuuguggaagugaaauugaucgaguuuggugacugggugugaauggauugagagggaggagacagaacuucuuaguuuucaagcuuagacaacagauguuucugaaauugcaauacuagggggagaaauagagcuggggugguaaugaaagauuuguuuuugaacacguugagucugaagguuuguggaaacauucuucugggaccugccauaacugggauuuucucuuugcuuuggaauagggcucuuuugauuuuuaaaaugccaaugagguaaaaauuugugggacagcaagagauaaaagccagugaaaggccuuuguauacucuuauuucuuauccaaagcaaugugcaaaucauauuuagauguuacccaccacuggcuucagccuuccaccugaagguaauugucauaauaguuacugagucauuucucaugccagauucagguuuaagugcuugacauauauugauuccuuugaucuucauacaaucuaauaugaugacuauuauuauccauuuuuuacagaugaggaaacgaaggcaucaguaauuaaguaacacauacuuaguaguguuagaaucagggaacaaaaccaggcaaucucccuccacuauauccuccuccauucugaggcgaagaguuuccaaucauucacaaagcaggaauucacaaacucugauucauggggaccaaauaugggcugcugcucguuuuuguaaauaaaauguuauuguugcauggccauguccauucauuuacauauugucuauggcgacuuggcaauccaaugacagaacugaauaauugcaacaaagacuagaccacaaagcuaaagcuguaucuggccgggcaugguggcucaugccuauaaucccagcauguugggaggccgaggcagguggaucaccugaggucaggaguucaagaccagccuggccaacauggugaaacccugucucuacagaaaauacaaaaauuagccaggcaugguggugcacgccugcagucccagcuacucgggaagcugaggcaggagaaucacuugaaccugguagauggagguugcagugagcugagaucaugccacugcacuccagccugggcaacagagacuccaucucaaaaacaaacaaacaaacaaacaaaacuauaucugauccuuuaaagaaugcaugcaaagugcgcuagacccccaauuugucauuucucccuucauguaugggagugaacaaggauagauguaugaccuuuguucuuauagccaaaucucugcagagaugucccugauaacuucccagucaaggcagaaacuucugauuuuuuuuuuuuaaucauuuagucuuccuguggcagaaauugugggccaaugauaaaaccauuuacaacuuccuuugcuuuaucugggguacaaagugacaacuuucucgcuaaguuauuaaugaagacauauauauauauauauuugaggggcaaagagauuaaaaauaaaaggggcacuauccaagagauuaguagauauuuuuuauuuuccuugcaaacaaacaagaaguagucucuuagaggaagggagacacagaaccuuaaccugauaugugugagaacagcaguacucucuuauuuuucaugacugguccuacagacuucgcacccauuugagccaucauaacaaguguguaguggggcuucuagaauuuauggcucuggagcccaauagagugcagggcuggauauauugacuuggaaguaguugaaacauaggagauucuugaaucauuucuuucucuaucugauccuuaaagguacugugguuguuucugcccuucgcucucuucuccuacugcaucccauuucuuggugaccaaauccacucuuacauucucaauuguuccugcuggcagagauucccugaagccauauugcaaccuugaacuugcuucccuaguucagccauagacgcccacuuuauuuaucuauugcuaggacauuuguuuccuuuuugcuauuuucuuuauaaugaacucucucaacaaaaaucucaaucuccguccuucaugcaaagagguuggcaccaucaaaauuguccuacuuuuaauauguuauuuauauuuugauagggaaggacuuuuuaaaucacuuuucuauacccauuuuacuucccuauuaucuugggacucuguuaauucuauuuacuuaaauuaagcuguugugaauagacucuacucacaauuuuuuuuuagaaagcaccuguuuccucugcuuucuacaucaauccacauuucuucaaaagaugagggaugaggaugaccuagucaaagccuugcuuccucccauauuggaagagucccugugugaacuuaugagccuuauuacuuguaauggaagcuacuuuauugugcuauugacacggaaagggagacucuuucuugacuuugaguccuggggaguggaaaacuuucaucaucaaaugaguuguuaaaaccuagaggauuacaccuguagccugacaaacucauauuuauugccuugcauagagagaugucacuccuaggcaagagggaggaaggaggcaucuuuuguaaauugaacuuccauugaagaauuuugaggagcaucuaagggaagcagguauccauuuuggauugguuguuuugaggugggauuaggaaaagagagauuuagccaggauuggaugcugucaugaggggaugauggcugagcaauuggguaucucuaguaauaaaugaaaauagccagcagucaggggcaucauuggugagaagucagcaaucaccuaaagaggggaucauuauggcacuuuauaacugcugcaugaccuuggcagaaaguguuuccugcuaauuuugcagcuggcuuuaucugugucuguccuccuugucugauuaguggcagggcuucuuuucucuuuucaguccaaauugauucucacucuuuuaauccaaaagagauuuuaacucuuucagcauccuagacucaacucaucagaacauucacuaggaugcguuuuccuacuagcacuuaaccaaguguaagaaucucagguucaucaugauuuaauugaauagaaacuucuagagccaccaucaaacaauccaaaguugagguaaagcaauguggccuaacagguuccaauguaguauacuuagaaccuuuccagaugccccacuacucugccuuuugauaauaccacugcccucacuaauagucuuuuccagcuuggagcaggucaucaccuuuugccaaaagccuaaggacucuucauugggaauagcauuguuucugaggcucaccaugcuuggaaucuguuccacauuuccagcccucucucuuuccauguauccuaccuuugagccacaccagagggauucuugcacuuucauuucucuauguuuuugcuuacacuuuccucuguccugaaauuucuuucccuccuuucccccaaucaaaauccuauucucacuugccugauacaggaaccauucuccaagaagccacccuugaacuaucccauggaaauuacuaguuucuucauuagcacuuccauaaaacuuuccuuguaacucuguuuagcacugcuauuguuuuuuucuccuaagcacacagucguuuuuguuuguuuguuuugcaguuuuccuugauauuuggggaaaaauguuuauuuuaccuacucucuacauucuagggauauuucuuagccugaaguuccuggcuucgcugugauccuuuggaggcauaggaagguggggcaacuugugaaacuucauauauauaaauuucauauauauaaauauauauguuccuguauguguguguguauauauguguguguguguguguguguguguguauuuguguauauguguacuuugcugggguccacaacuuucaucagauacucaaagagauguguaacccaaaagagaagagguuaagaacaacuuuuagaauauuagauuguuauggcacaggcacucugccacucaaacagaugggagagacaacuauaggcaaccaagaaaucaugaaugugcaucaaauaugggugcuuaaggcaugguacccagcugggcagguggagaaugccauccauccaaagcugccaagggcuauuagccaguacugauuaaacucuggacugcacugauuuuuggaaauugcacuaaaauccagauccucccuagucacggcacagaagcacaggaguuggcuguguuuacccucauaaaugcccugagugugccuuuguuagaagcuugguuggcaguggcagcaaugcuacuuguccuugucuacuuuuucuacuuccagauaaauauuaguuugauuaauaaucacauuucaguuugucccaggccccaugaaguagauuagaauucuggagggaaaaaauaugguacgaucuauaucgucuuuccauaauauacccaguaaauagaaaaucuuuucaaaagauuaccugaugccacaucucccucacccccuuauuguuacccaggugccugaauguauggguugcaauacaauauaaccaaugauuagcaugaaugauagaaccagaugacuugaccuucaguguaagggauaggcaggccuuugauuauacucaugaaaugcccaugcuaaaaagguucauguuuuuaaggauguuucuccugccucuucucuccuauucccuugcuuaaaaauucucuguggaauugauuuggcugauaaaagacaggcuaacuuauuuuaaaaagggacugaaaaauccaugcacuuccaauugucaugugcaaucauggaccugucaacuaauucuuauuuuggcaguuuugagaucacuugucacaaauuauucccucucacagggguaucugaagagaaagcaaaauaauaugcaauucauguagcuggauucagguggaggggauucuacuuuuaauaugcaauuggguagcuggauuugggugggggggggauuuuacauuuaauaugcaauucugguagcuggauucggguagggaggaguccacauuuaauaugcaaucagguagcuggauuuggguagaagggauucacauugaauacgcaaucagguagcuggauuccggugggaggauuccacauuuccucuuccuucaaagugauuguuuauaugaaauaucuccuucuuuucaaacagagaaaguuacaaaaauccuacuacaucaaaugauuuaugaaaaauaaagguaauucuaucaaaagcaaucgugacuagucuuucaaccucgcuaugcauauaucggggaguguauuuguuaaccugaaaggcaauaaaaucugcuuauggguaaaucaauuccuaccacuggguucuuuugggaauaucuaguaaucuaggucaguaauucuaaaacuugaguguguauuaggaucaccuaaaaggcuuguuacaucacggauugcugggcuacaccuaaacaguuucuacuacaguagaucugggauggggcaaaagaauauggauuucucacaaguugacaggugauaccgaugcugcuggucuagggaucccacuuugauaaccacugaccaaaguuuuuaaggucacaagguguuuauaauuaguucagaaaccaggacacaacauguuuaaaaauccuuagcaauacaagguaauaugaggccccaaacaggcaacaaugugcacuauauaagggcaguggugagagaacucugguuuggcaagauuuccacucucaaaucuggauaggguuaagaucaucagagagcagggcauucuagaauggggaaaugaaccaaauuaguuggagcuaagacuggagagguagguagggaugugucuguggagggcuuuuaagcacaucuuauaaggaauacagauuuuauacaacagguaauauuucuuccaccaacacacugucuccuccuguggcacgugggcagaaagaucuagcuccacauuacugcaaacgguuuaaccuuccccaaauacuguucagccggagugaggugggaaaguuaguagaucucugguguuuggugaagauaccaaguuagacugagagguggauuacuugcaucgcugaguccaaaaguugucggcuuuugcagggaugggaaagcaggaaacuuuuggaggucucccaaaauauaagaaaagauuguuuggguguggauuuagguugaggacaggaacaggaaauauccugggaugucugaggcaacccaauagagggucugaaguggacgagaccaugcacuacagugcaaugcuuuuccaucuuuacggugcaccccaggagucaccuggugaucuugcugaagugcauguacugauucagcaggccugaaauugugcauuucaaagauugugaguucccagaggaugcugaugcugcagaccgcgcuuugaagcaagguaccaugggacaucccagaacaccugcggggagagaggccugcuggccacaucccccgaagaaaggauacaugcaaucuuuuaagcuaaggcccccauccugucucucgggagaggugagcagugaggauauggggacaaugagaaggacggcucaaguagggcuggggaggggcagaggcgcccaggcgcgccaggugcaagcgcucuggagagugcggucugccuggguccgcggcucuggggcugcggcgcgauugcaggaguuucggcccucagcggcucccaucgcggcucccgggagcuaagcgagacggcgacggcggcagucgucccuccccacgcgggcgcgcgggcaugcggacacccacucggccgguccaggcccucaggcucccggaagcggaaggggagagcggcccggccugggcggcggcgccggaggaggcggagguggcgcggcaggaggaggggaaagagcugcuggcggucgggagagcggcggcagcgagaggcgagccagcggcgacggugagugugcaggcgcgggggcgaagcggccgcccccacccccauccccauccgcacccccacccccauccccggcccccgcuccgcucugccgggcccgcccgccgcuccuccgcgccgggacgcccucaccuguuccugcacgcccccugcaccugcucuguuuggaacccggggguuucucggugccuccccgccccaggccuggccuuuuucagagcgucuucugcuagagcuacagccccuugcuaagugcuccucccucaacugggggugggggguuccugcucuagucgagacgauguuggcuaguuauuuauuuauuuauuuuaaaucuguauccugaguuucucgcuuguaaacuacaguuucucuccccgcacccccgucuggagaccugcacugggaucccggguuucucugugcuauuccagagcuuuucauucauuccagacuucuggugugaagcugcagagaggacaaacaguuugcuccuuuauugaccuucucacuccucuccucuugauccaaagagguuuucggaaaauggcuuauggauggcagcaguuugcacuuguuacuguucacuguaacaggucgcuggauuguaacugcagaguccauuuaaguuacggucuuuuucaagcuauaugugggucacauuuuaagaucccuugagagucaggguggaugucuguaucaccagggcugagaggacaugaccaauuauuacuuuaaaauauugcaauauagcagucucuaaaaguagaagagaaaaaaaaaucaaggucauugugggcgggucauaaauuauauuguaaaguuacaguccaaaggcgacuaaggauaauuaagugcaauuuaaaaagauguguuaaauagguccucagccuacuaugcuaauauaugcacuuuuaaaaauucacugcuuuccuugugguaagaauaauauuaauaacagucaccauuugaugacugcuuaguaugcgccauuccuggauuaaaaggcuuuugguguaauauuaaauucuuccaacucuuuagauuuuacuuauuuuaaagguaaaauucggagagaugcucuguuuuuccuuaguuugugccaucucuuaaaagcaaaaagauauuugaagaauugaggugagaaauccacuggaaagaaagagccaaaugagauuuggugucguggaaagaaaaacuagauucuagucccauuucugucacuauccagcuguggguuuacagguagggcaaugacccauguuauuuucucuauaccaucagagagccagacuaaauuauuuaaggcuuauuuuagcuuuuccaugcuuacuuggaaaauguuuuuaaauaagacccuuuaacgugguuugaagguacauuaaaaacauauacgaaguauuaguaaaauaugaaaauauaaguuaaaauguauaauuccauaauuguuuugguguaguacucuuccagaauucaucauuuucgauggaaacaauucuauuagauccuuugacacuacugagauuucuguuaacauacuugagaagcuguaguuggaauaaaugaaauagagcgucauuuaaagaaaaugaugaggaccgugucacuuuugccuacgagguacuuuguuuaauaagagaaaucuaagcauuuaaaaaugcagacauauaaucagcuuaacaggaaguucugagacaagaaucaaugaaucauaacauguacuucuuauuugccuacugccucauuucuuuaauucguaaugaccgauucagaaccuguggaaaaaugcaugaauaaaauaaugguuuuauaaaaugugacccacauauagcuugaaaaagaccguaacucaaauggucucugcaguuacaauccagggaccuguuauagugaauaguaacaagugcaaacugcugccauccauaagccauuuucccgaaaaccucuuuggguugagaggagaggagugagaaggucaauaaaggagcaguuuauuguuuguccuccugcuagucuuauuauauagugguuuaguaaagaaacugcuugagaaguugaguaaugucucaacauggagcuguuuuucuggaauuguaauugaaugugacucagugaaaacuuuuuuagcauaggaggugacacaguggcaguaucaauacuaccaggcaaaagagggaaggcagaggaaaggcuguuuuuauugccaagaguuuguucccuaaauucaguuuuacuuuuauauuaaggaauguaaccuuuuauguuguuuuaguaaaacauuagggcucagauucaacuuuucacaugcauuaaauauaauaggcaauuuagcaucuaguagaauaaucagugcuuaaauaacucuuauuaaagguaaaaauacaggugaaauuguaaaacaguuuuuauuguugaaagugauuuguuaagaauucuugauaagucaagucagacuaguuuaaaaagcacauuuucauagacaugugaaucaucacugugcucauugauaggucccugaacaaaaauaccuuaguaugaugguacuuuauguguuuguuuugcucuuuagaccuaaccuaggcaaaauugugacauuuuugaaguuugccuucugccuuucaagcugcuuuuuccucugugcuauuucucucaggguagauuaaccuucuuccccauuucagagacucucuuaaccgauguguugccccuucuacaaaagggcagguuggguaaaauugauauuuuaccauucacuggugaauuuuauuuuaaaucuaaccuaaaaugcucaagugugaugucaaccaagcuucugauuuuaagcuuuuuaucuguaauuacagaaugaagaacuuuuucacuuacugcaggauuuucagcuucagcaagcaggugaggagagauuuuucuuaugguguuaguguucuuaaaucauggcugcuuugguaaagccuggugugaaggaaaucuaauuuagucuucuacccccaaccccccaccaaucucucuuggugugguggguacuagaagguaaguagcaggcuucccuuccuucuuggaagaacauacuugauucauacccaggaaaagccugggccucuucauuucuggcuuuuacuguaucugaagguuuuuuccuugugcugauuuuggaacaaaaguuaccuuuuuaaaucccugucccuauccuacauuuaaucuugccuuuucagucccuuuucccacuccuaucucccuaaugaaaauucccacagagaccuuuuguacugacugaaacaauauuugguggucuuuaauucguaucaccccacaccucccaagcuauuuuuacuuuuuguuagaagauucuaaugaagugagcuugagccagggagaauggagacugaggcugcagugggcugugauugcagcacuccagccuggacaacauagugagacccugucucagacaaacauacccaaaaaacaguggcccaguuaucuacuuucucuaaaguuaaagcaaguuaaugcaagcagggaaaaauaaagguaaaugccuguauuagcaguacuaauacuacuaguaguaauacuacuaggauaguguuagcaguauuaauacugcaguguaguacuacuaauacagucauguacauuuauuuuucacucaugagacuggugcacacaaaaacaaauuuaugagaagagcaacagcuuaugcucaauuuugcccagaauguaauuuaaagacuuagucuacagaguggauucuugaaaccauugauagugcaaguauuuuaugcuuugacacuuuguccacccacguuuuuacaaagucuuccuggaaaacucagcaauugauucagaaucccugcuugcauuauacauucuuuauuagcuucugagaucaaguacugauuuucuuucacacuuuauuccuuugcucaccaguccugcuuuuacuugaaugugauuuaguuuaggggcuucaguucauucauucuauuuuagaucaaaucucuauuuucgguuuucuucuuaaagaucccccuaaccaacguguagaaauacaacuucagcuaguaugauacuagccgaagggcuguaauauuugaaguuuuuuugacuaguucacagacuuuaaaaaaguagauaacggggcauuuuuuguuguucuuguguuuguuuuguuuuuuguuugagacaggaucucacucuguugaccaggcuggagugcagugcagucacagcucacugcagccuuggucuccaucucccuggcuuaagcgauccucccacuucagccucccaauaagcugggacuacaggcaugugccaccacacccggcugguuuucuguuuguucguuuuuuguuguuguuuuugagacagagucucgcucugucacccaggcuggagugcaguggggugaucucggcucacugcaaccuccgccucccggguucaagcaauucuccugucucagccucccgaguagcuuggauuacaggugcccaccaucaugccuggcuaauuuuuguauuuuuaguagagaugggguuucacgacguuggccaguuuggucuugaacuccugaccucaggugauccacccgccuuugccucccaaagugcugggauuacaggcaugagccacugugccuggcccccauuuguuuguuuuuuaacuaguggcuaggucuggcuguguugcccaggcugcuguggaucuccuuagcucaagcaauccuaccccuacucaccucccaacaugguaugaucacaggcaagagcaggcccugggguauuguuaaacuguuucauuacuuuuaaugauggggaccuagaaacguuguuucauucuggaguuuguaaaacuagaaguaaaacuuaucuuucacuuucccuuccucugcucucuccuucgcuccccuguaaaguuagcauuuuggaggcgcugcuuugccagucaauuucucauuuaagcgugacagcaacuguguaaguugacauuuuuaucuccauuuuacagauggucaaacugaagcuugaaaagaaacuaaagcuuggaaagugaauaagagacuaugucauaauuucucuuuuaacaucuguagaagauuaauuuuuuaaucuguugauaaucaacugaauaucuaugugauauuuaaaaaauugaauuccuaauuggcaaugagagcuugauuuuuauggagaauuauuuaacugccacacuugacuaauuuucagaguagaaugauaucagaagucaaaaaguuuuauaaauacguuuacagcuguaacucugcuuucuaaauucauuuggcuguaauuaauaaguuuaaaauuucauauauucaucuaauaagcauuuucucuuggcacuguggaaaaaaaauugguauguuugaaaacuuagcuuguaaauuguuagauuguauucuuucaggcguagcaauauuaaaaauauuuaaugacauuuuauaguuuugaaacuuugaaauuguuuuguuguuccaauuuuuugaauguuuaggcccaacguuacuuuuguuuuguuuuguuuugagacagggccuuacucuggcacccagacuggaaugcaguggcacgaugauuucugcucacugcggcuucugccuccuggguucaagcuucaagcgauucucgugccucagccucccgaguagcugggauuacaggcgggcgccacuaugccuggcuaauuguuguauuuuugguagagacgggguuuuaacauguuggccaggccagccucaaacuccugaccucagaugaucugcccaccuuggccuccuaaagugcugggauuacaggcaugagccaccaugcccggcccagcauuacuuuuauuaccacauagaugagauuucauuucucagagguagugguguuuaucuaguacugaaauacgaaucucauuucagaggcugugucugcaguguagcucugauaacuauaaauguaaaguaggauuuuucuugauuuuaagccagcaagugacugggauuugacucaugggugauuggccugugcuauaaccuacuaacguuacugacagaaacuacuauuuugcugaaacauuaggaagccacucucaagucauagacuuaguagcauuauuguuuuuggccaucuuucaaaaauguuugguuguaccacauuuaauucuguuugaauuuuuuucugaaauaauucauuuauuugccauugggguagcagcucuuuaacauuguuuuuuuuuuuguuuuuuugagaugaagucucgcccugucgcccaggcuggagugcuguaguacagucucugcucacugcaaccucugccucuuggguugaaacgauucucgugccuuaaccuccuaaguaguugugauuacaggcacacaccaccacgcccagcuuauuuuuguauuuuuaguggagacaggguuuucccauguuugccaggcucgucuugaacuccugaccucaagugauccucccaccucggccucccaaagugcugggauuacaggcaugagccacuauacccagacuuuaacuuuguaauucuguguuuagucucuaaaaagcaaaggugcaaccaaggagcccacuuuaaauuagcuuaaaaaguuaagaguagaaacaaaguucauuugacgaucuaauaacuauggaccauagaaaaguugacccugggaggauauacagguucugugccccccacaaauguauaaagggaaaagaaauguaauaauuuugauguauuuuuuacauucucaguauuuaauagucugcuguugcugugguaaccagcacacuuaacacacuuguaacuuggccuuuguucccugucuuggagaaugguuccacccuucaccuagagccuaagugugaaacuugggagccauccuagucugcccuuugcucccaauugaucacuaaguccugucaguuuuauuuauuuaaauucucccagaucugccccuucucuuuuuuuuaauuucuucuuucuuuuuuuauuuauuuucuuuuuuuuaaauuauacuuuaaguucuaggguacaugugcacaacaugcagguuuguuacauagguguacaugugccauguugauuugcugcacccauuaacucgucauuuacauuagguaguucucauaaugcuauuccuccccccucccccaccccacgacaggccccggugugugauguuccccuuccuguguccaaauguucucacuguucaguucccaccuaugagugagaacaugugguguuugguuuucuguccuuguaauaguuugcugagaaugaugguuucaggcuucauccgugucccuacaaaggacaugaacucauccuuuuuuauggcugcauaguauuccaugguguauaaugugccacauuuucuuaauccagucuaucauugaugaacauuuggguugguuccaagucuuugcuauugugaauagugcugcaauacacauacgugcgcaugugucuuuauagcagcaugauuuguaauccuuuggguauauacccaguaaugggauggcugggucaaaugguauuucuaguucuagauccuugaggaaucgccacacugucuuccacaaugguugaacuaguuuacagucccaccagcaguguaaaaguguuccuguuucuucauauccucuccagcaccuguuguuuccugacuuuuuagugaucgccauucuaacuggugugagaugguaugucauugugguuuugauuugcauuucucugauggccagugaugaugagcauuuuuucaugugucuuuuggcugcauaaaugucuucuuuugagaagugucuguucauauccuuugcccacuuuuugaugggguuguuuguuuuuuucuuguaaauuuguuugaguucuuuguagauucuggauauuagcccuuugucagaugaguagauugcaaaaauuuucucccauucuguagguugccuguucacucugaugguaguuucuuuugcugugcagaagcucuuuaguuuaauuagaucccguuugucaauuuuggcuuuuguugccauugcuuuugguguuuuagacaugaaguccuugcccaugccuauguccugaaugguauugccuagguuuucuucuaggguuuuuaugguuuuaggucuaacauguaagucuuuaauccaucuugaauuaauuuuuguauaaggcuuaaggaagggauccaguuucagcuuucuacauauggcuauccaguuuucccaacaccauuuauuaaauagggaauccuuuccccauugcuuguuuuugucagauuugucaaagaucaggugguuguagaugugugcuauuauuucugggggcucuguucuguuccauuggucuguaucucuguuuugguaccaguaccaugguguuuugguuacuguagccuuguaguguaguuugaagucagguagcgugaugccuccagcuuuguuuuuuuugcuuaggauugacuuggcaaugcggguucuuuuuugguuccauaugagcuuuaaaguaguuuuuuccaauucugugaagaaaggcauugguagcuugauggggauggcauugaaucuguaaauuaccuugggcaguauggccauuuucaugauauugauucuuccuacccaugagcauggaauguucuuccauuuguuuguuuccucuuuuauuucauugagcagugguuuguaguucuccuugacgagguccuucacaucccuuguaaguuggauuccuagguauuuuauucucuuugaggcaauugugaaugggaguucacucaugauuuggcucucuguuugucuguuguugguguauaagaaugcuugugauuuuugcacauugauuuuguauccugagacuuugcugaaguugcuuaucagcuuaaggagauuuugggcugagacaaugggguuuucuaaauacacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauaaauagcucugauuauuuugagguacgucccuucaauaccuaauuuauuaagaguuuauagcaugaagggcuguugaauuuugucaaaggccuuuucugcaucuauugagauaaccgugugguuuuugucuuugguucuguuuauaugcuggauuacguuuauugauuuucguauguugaaccagccuugcauccuagcgaugaagcccacuugaucaugguggguaagcuuuuugaugugcugcuggauucgguuugccaguauuuuacugaggauguuugcaucgauguacaucagggauauuggucuaaaauucucuuuuuuuguugcgucucugccaggcuuugguaucaggaugaugcuggccucauaaaaggaguuaaagaggauucccucuuuuucuauugauuggaauagcuucagaaggaaugguaccagcuccuccuuguaccucugguagaauuuggcugugaaugcaucugguccuggacuuuuuuuugguugguaagcuauuaauuauugccucaauuucagagccuguuauuggucuauucagagauuccacuucuuccugguuuagucuugggaggguguauguguccaggaauuuauccauuucuucuagauuuucuaguuuauuugcauagagguguuuauaguauucucugaugguaguuuguauuucugugggauugguggugauauccucuuuaucauuuuuuauugcgucuauuugauucuucucucuuuucuucuuuauuagucuugcuagcggucuaucaauuuuguugaucuuuucaaaaauaaaaaauaaaaaaccagcuccuggauucauugauuuuuuugaaggguuuuuugucucucuaucuccuucaguucugcuuugaucuuaguuauuucuugccuucugguagcuuuugaauguguuugcucuugcuucucuaguucuuuuaauugugauguuagggugucaauuuuagaucuucccugcuuucucuugugggcauuuagugcuauaaauuucgcucuacacacugguuugaaugugucccagagauucugguauguugugucuguucucauugguuucaaauaacaucuuuauuucugccuucauuucguuauguaccuaguagucacucaggagcagguuguucaguuuccauguaguuguucgguuuugagugaguuucuuaauccugaguucuaauuugauugcacuguggucugagagauaguuuguuguaauuucuguucuuucacauuugcugagaagugcuuuacuucuaacuauguggucaguuuuggaguaaaugcgauguggugcugagaaggguguauauucuguugauuugagguggagaguucuguagaugucuauuagguccucuuggugcagagcugaguuuaauuccuggauauccuuguuaacuuccugucucguugaucuaauguugacaguagagugcuaaagucucccauuauuauugugugggagucuuaagucucuuuguaggucucuaaggacuugcuuuaugaaucugggugcuccuguauugggugcauuuauauuuaggauaguuagcucuucuuguugaguugaucccuuuaccauuauguaauggccuucuuugucuguuuugauguuuuugguuuaaaguauguuucaucagagacuaggauugcaaccccugccuuuuuuuguuuuccauuugcuugguagaucuuccuccaucccuuuauuuugagccuaugugugucucugcacgugagaugggucuccugaauacagcacacugaugggucuugacucuuuauccaauuugccagucugugucuuuuaauuggggcauucagcccauuuacauuuaagguuaauauuguuaugugugaauuugauccugucauuaugauguuagcugguuauuuugcuuguuaguugaugcaguuucuuccuagcaucuguggucuuuacagucuggcauauuuuugcaguggcugguaccgguuguuccuuuccauguuuaaugcuuccuucaggagcucuuguagggcaggccugguggugaccaaaucucucagcauuugcuugucuguaaaggauuuuauuucuccuucacuuaugaagcuuaguuuggcuggauaugaaauucuggguugaaaauccuuuucuuuaggaauguugaauauuggcccccguucucuucuggcuuguagaguuucugccaagagaucugcuguuagucugaugggcuucgaucugcccauuuuuaguaugccuccugucuuaagugucacuaccccacccacuuacacacacacacacacacacacacacaccauuccccuuauaaguuaccauuuuuggggugcuuacuccaugugcccucaucauuucucacgggguuaacagucaaccuaccuaguugcauguagucaaugucagugcuuuaucaguccaccaaaauucagcccucagauugugucuuuuccuccuaaaaugcaaauuugaucauggcauuuuacugccuaaaaucccucagugguuuuccacuguguuccaggugaaauccaaacucacuggcaugguuuaacagugauuuucaaucugaggaucugccugugggucaugaaauugguuuaguaggcuaugaccagcauuguacauuuuuauuaaaguaaaauaaauagguugcagugguacccagcuguagugccagugacucaggaggcugaggcaggaggauugcuugagcccagugugcuaggaucgcaccugggaauagccacugcacuccagucugggcaacauagugagaccgagucugaaaaaauaaaaaagaguaaaauagaauagcaauaucaucacgugucauauguaguaaggguaaauaucacuuccuuaaacuuuuuuaguuauucauauauaucugugcguacuaguaauguuauaaaauuuauuagaguugguuguggucaaaaggaugaacaucuuaccccauucuguaugcagugauucuuguuauuucaguuuacucagauuuucucugccugccuuuaugccuuugcuuauucuguugucuuggucugaagagucugccuucuucaucuagcuaccucacaggguuuguugucuucaggaaucuuuuccugauggcuauuuaccauaagaaauacauuuuguaacacaaccuaugaaccaguauccuuaccauaugagauaacaguuuuguccccuugcucucugucuuaacuugucuuacuggucuugucuguuugcuagucugccuccauugaagauagagccucucuuuuucaucuauacccuguguuaaagcauaguagguauaguguauaguaguuaaguguugauugaauuaauaaaauagugaauuaguauauguuauauacaguacuuuacaguauguuuuuuuaagcuugaauuguagaaacugacuuauguuugacucucuuaauggcuucauuacaggaggauuaacuuucuuaaagcauuuuaaauuaaaacuuccauuuuaagcuguuuaugaacugugauuagauucuucuaccagaaucuaucguuauuuugugauuuguggucaaggaagugugugaugaaguccaaauacuggacauauaaugcuuauuugauuuuaugggaaguauaaugcuuauuugauuuuaugggaagugggugguuuuaaaagacucucagauauaauuguaaucaaaugcaaauucugaggggaugggugggauaugaaagcacagaaucaaauggaguugaauuucuuuuuuguuauuucuaaauuuaagacguuugucauuggcauuuccacaguuagaauauuuaguugcuuaucguuuuuuucuuugugagaaaucauuguuuguuaaaccaugaauagguucucauggagaacuguuauugaagagagauccauuuggugggauauaauuaaaaaaaaugaaucaaaagaaaaucucuaaaugcagauuccagaaaaauuacagcacaucucagugaauuugcaagugguaaguuugcuuuugauuuuacauggugauauauuuuggaauuaugggccauaguauccuuggagucuuaugcuuagaugcacuuaauugucaguuagcaaauguaguuacuuuauguuuauuuaaaaguuuuuauacuaaauuuuaaccaaaccuguuuucuuaaauaagacuuuuucuauagagaaaaauaaucuguaaauaauaugaguuucagaaacaucuuucugaaucguaagucuuauauggcuuuacagcgaauccuucuguacuucauuuuuaaaaauauuaauuuuaaaagcauuuacuauaaggauaauauauagugacaaagaggccuaaauuaaacaguuaguuuguaaguuuagugucucuuagguuaucuuuauuuuuaaguuaauugaaaagaauuuagaaguacaugguuguugauaaacuuagaagaacacauaaauauuugaaagccuuccuuuucacuacuccuuucucuuucagcccauugagaacaguuuggcuggucuguuuucuugcagucuuuucuuccugcacuugugcagaaauuacuuaugcacauaccugcauauuuuuucuaacaaaaauguuauauaaacuauucuauaaguugcuucccgaacacuuaauuuugaaaaauuucaaacagaagcauuggaagaauuuuguuuaacaucggaauaccuaugacuuagauucuuaccuaacauuuuaacaaauuucagcacauacucaucugucuuucuguccacuauguuauuaauaugggggauucauuucaaaguaaauugcagaugucaguaugcuuccucucuacauaauucaguauacauauugcuaacuagaucucuguauugguuuacagauucuuaaagguaaauuuacguaccaugacaugcaacaaucuuaaguguacauaugcugaguuuugauaaauucaucuuuguaacucagacuccauuaucaauagaaacaugcuuguuagcaccacagagaguucccucaugccucuuccuggucugucucuaucccugucucuuuccagaaaaaccgguuacggucuguucccucuccacuccuaauggauuuugccuauaucacuugcuuuauucacucagcaguauguuguggguaguuauaugcagaucuaaaucugccuucuuuucugccuuaaaaaaaauugcaauagcuuggaaauagucuacacuauggguguauuagaauuuauuugaucauucccuuuucucuacauggacauuuagauugugccauauuuuugugauuacagaaagugcuguauccuuguacauccuugucuguauauauacagucucaggaguacuuuuuagguaauacuaaaaauaaaacugcuguguaaaagaguuuuaccuuuugauacauacugccaaauugcccucccaggaugauuguaucagcuuacaugcccaccaauaauguaugagaguguccuuuuuuuucugugcccucuuaacauuggauaucaucuuucuaaaaguuuuucaauacaguagaugaaaaauguaccuuguuaauuccuaaucaguaaugauuagccauuggauuuuuuucccuuugugaauugcuucuuuauauauuuauguuguaugccucuugucggucauguguugcaguauuuuuuccaggaaugcuuugucuuuuaacuuugcuuuucauguguuuugggcuucagauguguuaauuuuuauguggucagacaugguugauuggucuucauugugaaggccuuccuuauuccaagaauauaaaaccacuugcuauucuaauaguuuuccuuuuaaugaaauuuagaagaaaaagauaaaucauugugaacugaagugccaggaaaaauuucaaauggagagugagauucaaauuggccuugaagucugaguugaauuuagaugaguaagcagaaugguaggcacauuucagacaggaggcauggauggaauaucgucgaacagugguaaacaggaccgcuuaggcuaaggugaagaaucacguaaaacuguaagcauagacauacguguucggauagauuucuugguaauuauuuuggcuaaucuuuaugcuuuucuaaaaucuacaucuugauguuauaguuuucugucauuuucauggugacuugaauauucuucuugaggagaauauauggugaaauacaguugccugaaaaggcaaaaaauagugguauuccuuuggaguaaguugaacauuauaaauauuuacucagucugguuuauuagaguuaaauuauaauuguuuuuaaaguuugugcuguaguaauuuacaucauuuagucacuguagucaacuauaguuaccagauagcaaucuuaaaaaauguugaaguaccaguauauccacuaguuacuuaaucagaguuuugaguuaagagcucaccauuuaauauacaaauuaguaugucagaaucuccagcuaaugaaaguauuuuaugaaugcuguccuuaagaccgaguaacagcauuguguucaguuugguuguugcucaggauguguaauaguuucucuucagccauaagccacgccugguagauauuaauugaguggagagaucuugcaccucuuccaguuaugcauuugugguuugucgucugauuuggagcacuuggaagaucacuguuuuguguucuacgacccaauugagaggauuauguggagcuaaguuuuaccaaucagguauuaaaaaaaauauauucaacaucuuauuuguuuguuguuuuauuuuucuauccugugcucacuuuuccuuagggaugcuugcucuuuuagagagugucaucuauguauguuuacauccaggaaaaauggacauauuuuaaacuauacuuuucacuauguaauuuuuuguugcugugagagaucucuuccagugaugaagaaaaauuuguucucuaguagaggagaauaaaaauagaguucaaaaauuaauauuugauaauuuugccagucguuuugcuggcucauguacuuuucugcuucuaauguuaauaaauuuaagcuacucucauauauacuuagugaaauucauguucuguuuuuaguccugaauagaacugaaaaauuaaagaaagaaagguacauaaaauuaauaauauugaacacguugagagagcacuugucauuucuuuuagcacuugauaauuggcaagacuaaaaaauuaacauugucuugaauguuucucuuuuuaacuguguagauagcuuaccauuuguauuugagauuccuuuauuaaaaugauucuuagcaaauuaaauagcaugcuuuauccugucugacuuucuucauuuuaaugauaccaaucugucuuuugauuuuuaaauuaaaagauaaauaaaugaaacuuuuauuaguuuaguggccugggcacuauuucuguuuuagaauucauacacaaguuagaacauaccggauuuaaacuauuaagugguauuacauuugaguucuuuuuuuguuuuguuuuuuguuuuuuuucugcugccccaauauuugcaggaacuagggaugagaaacuggggguauuccuuuaaaaucaaguauuccuuaaucucuuuuucuuuguuucaguagcuuuauagcuuugaagaacaugggcaaggccucuaagggauggugcccugaggcuuuucaauugauuaugaauuguucuuagaaugaaguagacugggauauaggcugaaaaucugggaaucacccuugacacuuuccccuguaaccccuaauaucuaaucaaccagaaaaacacacugguucgauucuagcaguugcuccuuucugcaaaccuaauuuuggcuuuugccuucucuuagccuaauggaccucugucuuuaauuuuaucauucacaccagagcuucaguaauuuauucacgguacacauuucgucauguuaauccccugcuucaauagcuuuccauugccgaagaauucagucuuagcauucuaacauggcaucuuuauguccuucaugauauaggcccauauuucuuagcacucacucuccacagaaagcuuuaugauuugugauggcagguuguaauaccucccacaauuucuacucuugcuccuccuauuccuucuguuugcaguauucuugucacuuuucauugcuuagauaacuuuuacuaaccuucuaagacugaauucagguuucacuucuuacaguaagucuuacuugauuccucguuuaacuggucccaucuucugugccccuacuaacauuuuguuuucaaaucuggaacuuaccauauuauauuaaaucuuuuuucugauucuuuuucccauuagacuguuccuuuaagcaaagaccaugucuucuucaucauuguaucugcagugucuagcaagugauagguguguaguggaggcucagugaauauuuguugaacuaagugaguucaacucauugugguaacauugaaguguuagugaagcucaugggucagugcuuccuagacaccagucagcuguuuucagacucuugcagagcauuuuacaacauuuuauuguuuuuugaguuuuaugaagaauuaugauucaguagauguagaauggggucugggaauauguauuuuuaaaaagcuccccagguguuuuugguuuucuuacaggcuagagaaccguuguccuaguuuauuauuauaccauuguauuuuacguaaaagguacccccuagacuuuauacagcaauuuauuauuucauccuuggaaguuauaucuaccaaaguauggauguauuuuuagucacuuuuuugguaccauauuuauauagaaguauuuuaaguccuuaagugucucauugagagaucuguuggcauauuguuaacacucaacuaaaaaaagccucauuuaaacaggagucuucuucaguugaucauaaugagauuuguugggcuucauucuaugaauuuuaguauuuuuggcaauuuguaauuaguuuucacuuuuuauugucauuuuucaaaauacuuaaaaaauguuuuauuguaguuuaaaauuaaacuagagugcacaaaucugaaguauacagcucagugaauguuuacauauguagauacacauaaaguaccacccaggucaagauauggaacguuucccaaccccucguucucucauguuccuuuucaguuaauauacaccccugcaaccacaagguaaccacuguuuugacuugugugacccaucagucuucugauuaaagcuacuaaaaauuuuuguacauaaucuuuugguggacacguguauucauuucuuuuggguuuacacaggaaguugcuggguuaaggacaaacuuguguuuuaaauucaguagaugauuccaguuuauaccugugauagcaguucauagugaaacauugaaauuauuugaagcuuaugauaaaauuugaauauccugaaacuucuguuuguuuucccaaguauuuauuguaaaaauauauauacaaagaaauaucaauaaauauaucaacuacagaaagaaaaugucaaauaugcaaagaaaacucaaugucauuuuauaaaaguugccagaaauacagguuuuagucaaauuuuucuauguaaguaauuauuuucuuuguuccuucuccuuaggaucauccuuccuuguggguuagcaggcaguuauaagauugcaaaaugggucuccggauucacuuuguuguugacccacaugguuggugcugcauggguuugauugucuuuguuugguuauacaauauuguuuuaauucccaaaauuguccucuuuccucacuaugaagaaggacauauuccaggcauauuaauaauaaguaaguuucuugaucuuuauuuucuuguauaauuauuuuucucauuguaaacguuuuugggguguagugccacuaugauaacuuuccuuuuaauauauuuaguauuuuagcagugcugucaauauucaguuauuuacuaauuuaugaacuuauggaaauaauggccuuuauagauuugcaguuagauaaaagugauaucuccauuuuuaacugcaaagugcaugaagaccauuuuguuaaaaauagaaaacugacacaguagugauaacuugcaugucucucuguauuuuuauuauugcuguuuuguaccuaauuacaaauguagauguuuuaagaauagagacaguauacauuacugagaagugagaauuucauaagaaaaguauugauuacgaaguugauuaugauaacacuuggaacuucuggauaguuauuagucaauuggugauggcuugcuuaugauuaaaauaaauugaaauuauauauuuuacauguacauggcauuuacaguuuucaugcacauuaccucauuuugaccucacacgaaccaugggaaauuuuauauauauaugauaaaacugaccgguacuaugcagucaguccuggauugagcacucagacuauucccuuuacauguacaguauguuuuuuuuuuuuaucgccccaacagaauuucucuauucuuacuaauuuaaaaauguagaauuaugguggccaaaucuguuuucccuuacuauuuuuguuuucugguuauuaauuuuaaaauuaaaaaguuucuaagucuuaauuaucaaacuaaucauuuuaagauccaucaaaagggacaguugaacaucacuaauucagaguaauauugaagauacccaguuaguuaaugaaaaaguuuaguuguagaauuuaaaaugguauuuugauccuuucaaauauagaacaugcaguaauuaaacgggagccuauucauuuaugccauuauuaauaggaagucccuguuauuaagggaucugauuuauaagaacuuugaguuacuaucauguaaaauaauaauuaaaauuaguaaugauuaaaauuaggacuauuuaagauaguccuccugacaguguuauuuggugagugaaaucaauuauuuauuuuuuaaucuuuugaaauuuuuucuccugaugguguuuguuaaaauauacauuuuaaacuuuaaauaugauuguugauaaaauguuuugaaggguaagugacuaauuuauuuaauuuauuuauuuuaaaguauucuauggcauuuccauauucugucugguugccuuagugagggccuccauaacugauccaggaagacucccugagaaccccaagaucccacauggagguaugguacucuggauuuaucaguuuugcugaugccagaauuacugucuuuauuuacauauuuuauugccuuuaauauauauugguuauaaaugucaucuaacaccacuuugaugucuuugcuuguaugugucuuuuccaaacuucucuacuuaaaauugcaacccugcucccccugcaccccggcaguuucaccacaccccaucucuuggcuucuguaucacauaucauaugauccucaugguaauuguaugagguagguaggcuggguggucaggagcauagauuguccuuccuggguuaaacaucugguuguuggugugcgauccagcccaaagacccagaaccuugucucugucaucuuauuaccauggaucuauguacagagauaauuuuagcuuuuuauucaccuuuguuacgaaucuggggaaaacuuaagucauaauguacuuuuuggugcugguuaccugauucuuuuguaaauaugauuuuaauuuaguaaaaaaaaauacaaaauuuuaacagugaaagauaauauugaaugccuagagaguugaaacuguagaauagugacauuuauucaggaauguuuaaagguugagcaguuucauauaacugaauucuucaaaaaagggaucuugaaguccuaauacuuuggugauuuuaacuauuuuuuuauugaauuacucugaaguauuuuacaugcguuucugcuuuuuuaaaacacaaugacuucaguauauaugugacccacuaaauaugaggcaauuugaauauaaggaaauguuccauuuucccaugagaagauucccagaauuugacuuuauaaacuuuugagcauauagaugaaacagucaaaugaaauaguuacauguuuguuuauauuacuugaauuguucauguguguauuugaaauaaaacaaaaugaacaccuucaguuagaaauauuuuuaucacuuucauauuuuaugaaauuuuauucaaguucuuaacuauguuuaaaaaugguuuauugaguauaauuuacaugccauauaauuuacccaguuagaguguacaauucuauggguuuuuguaugcccacaguuguguaaccaucacugcaaucaacuuuagaacauuuuaaucgaguuuuucacuugaauguucgacaugugguuuugucauuacuagagccauguuuuuugacauagcauuacaguggaaauucuuucaaguuaaaaaaaaugcguccuguuuugaugcagucucucaaaaauuuaccccaagcucuaaggauuccuguauucaguaaucagggucauguauucacucauaguuuuaguuugauccucccucuuacauugcuuuuuaaaggugaucugugagagacuuacugacauuuauuuccuacauugacaacugauucuuguuagggaaucucuguuaggacccaaacuuuguauugauuuagguaauuucaaguaauguuuuucuucucaaagcauuacauagugauuuuaaauguauuaauugagugagggucccuuaaaaugagagucuuuuaaaagacucauguagaaggugauuccuuccuuucugagggucaaacaaaccaagcauugcauuauauucauucaagcauucacagcauuaguaaaucuccagguuaaacaaaaugauguauuuacucacauuaaacagccucagucauggaguuugccuuuuuuuugguuuuguuuuauauuuugauuuuucucucccuuaaaaauguaucuguuagcuuuuaauuuuuuaaagcuaucauaaauuuucaguugaauucuuuuucucauagucuuuuuaaaaacauuauuacuuggcuaguacaaaaaucacuagacaucagaauguaucagucgccaagauccuuuguggacaugaguaaaggaaggaaagggaaaugacuaagaaaggcuuuagagauauguaggguguguuaagauggauggauuuuuuuucuugcuacacaaggcaaaagcaccuucuagaugaucaauuaaauugcuggauuuuugacaauagugauuucuccucuguucccuaaacauauagauauguauguguucauauagauaugugaaacugugaguuuuuacagguauuucucauuuuagauacuuauguaauaucuucauguuaucaaaggaaugacucaaguucuuucuuuaaaucaauuuaugguccagaccauagauuagcaaauaaauucuucuuuacuauaaaggcccguaguaaauauuuucagcuuuaugggccauacagucucuauuacaacuccucagcucugccacugaaacacaaaagcagccauagacaauauguaaaugauggguacaucaaacuuuguuuauggacccagaaauuugaauuuuaugauuuuacaugucacaaauuguuauuuucaauaauuuaaaauuguaaaaauuauucuuagcucauaggucauacagaaacaggugguagacuggauuugccugcagacuguaguuuguaucuguggucuagauuacaaaauuguaggcuuucucuaacuauugccaagugcucucuucugagaauacauuuuagauauaaaaugaagaauuuauucucuaggauauuauaugcugauuucucagaaauuaccaauaaugaauacaccguguuuauguuuuaaguggcugauaaaaacaaauuuuuauaucgccuuuuagugaaaauuggcucguuguggagcgccuccuuccugucuauauuccuugcaaugugugaauucaaaguuuuuuuguuuguuuguuuuguuuuuuuuuguuuauuuguuuuuuuauuauacuuuaaguuuuaggguacaugugcacauugugcagguuaguuacauauguauacaugugccaugcuggugcacugcacccacuaacucgucaucuagcauuagguauaucucccaaugcuaucccuccccccuccccccaccccaccacagucccuagagugugauauuccccuuccuguguccaugugaucucauuguucaauucccaccuaugagugagaauauggaguguuugguuuuuuguucuugcgauaguuuacugagaaugaugauuuccaauuucauccacgucccuacaaaggacaugaacucaucauuuuuuauggcugcauaguauuccaugguguauaugugccacauuuucuuaauccagucuaucauuguuggacauuuggguugguuccaagucuuugcuauugugaauaaugcugcaauaaacauacgugugcaugugucuuuauagcagcaugauuuauagucauuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauagugguuuugauuugcauuucucugauggccagugaugaugagcauuuuuucaugugucuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauugucucccauuuuguagguugccuguucacucugaugguaguuucuuuugcugugcagaagcucuuuaguuuaauuagaucccauuugucaauuuugucuuuuguugccauugcuuuugguguuuuggacaugaaguccuugcccaugccuauguccugaaugguaaugccuagguuuucuucuaggguuuuuaugguuuuaggucuaacauuuaaaucuuuaauccaucuugaauugauuuuuguauaagguguaaggaagggauccaguuucagcuuccuacauauggcuagccaguuuucccagcaccauuuauuaaauagggaauccuuuccccauugcuuguuuuucucagguuugucaaagaucagauaguuguaguuaugcggcauuauuucugagggcucuguucuguuccauuggucuauaucucuguuuugguaccaguaccaugcuguuuugguuacuguagccuuguuguauaguuugaagucaggucgugugauuccuccagcuuuguucuuuuggcuuaggauugacuuggcaaugcgggcucuuuuuugguuccauaugaacuuuaaaguaguucuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaggcaauugugaaugggaguucacucaugauuuggcucucuguuugucuguuguugauguauaagaaugcuugugauuuuuguacauugauuuuguauccugagacuuugcugaaguugcuuaucagcuuaaggagauuuugggcugagacagugggguuuucuagauaaacaaucaugucaucugcaaagagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauugauuugcauauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaggguaucaguuccuccuuguaccucugguagaauuuggcugugaauccaucugguccuggacucuuuuugguugguaaacuauugauuauugccacaauuucagcuccuguuauucgucuauucagagauucaacuucuuccugguuuagucuugggagaguguaugugucgaggaauuuauccauuucuucuagauuuucuaguuuauuugaguagagguguuuguaguauucucugaugguaguugguauuucugugggaucaguggugauauccccuuuaucauuuuuuauugcaucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucuuguugguuucaaagaacaucuuuauuucugccuucauuucguuauguacccaguagucauucaggagcagguuguucaguuuccauguaguugagcggcuuugagugggauucuuaauccugaguucuaguuugauugcacuguggucugagagacaguuuguuauaauuucuguucuuuuacauuugcugaggagagcuuuacuuccuacuauguggucaauuuuggaauaggugugguguggugcugaaaaaaauguauauucuguugauuugggguggagaguucuguagaugucuauuaggucugccuggugcagagcugaguucaauuccuggguauccuuguugacuuucugucucguugaucugucuaauguugacagugggguguuaaagucucccauuauuaaugugugggagucuaagucucuuuguaggucacucaggacuugauuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacagugaugggucuugacucuuuauccaauuugccagucugugucuuuuaauuggagaauuuaguccauuuauauuuaaaguuaauauuguuaugugugaauuugauccugucauuaugaugauagcuggugauuuugcucguuaguugaugcaguuucuuccuagucucgauggucuuuacauuuuggcaugauuuugcagcggcugguacccguuguuccuuuccauguuuagcgcuuccuucaggagcucuuuuagggcaggccugguggugacaaaauuggucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuaugugucuuggaguuuuucuucuuggggaguaucuuuguggcguucucuguauuuccugaaucugaacguuggccugccuugcuagauuggggaaguucuccuggauaauauccugcagaguguuuuccaacuugguuccauucuccccaucacuuucagguacaccaaucagacguagauuuggucuuuucacauaaucccauauuucuuggaggcuuugcucauuucuuuuuauucuuuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcauuucucuguauugguuauucuaguuauacauucuucuaaauuuuuuucaaaguuuucaacuucuuugccuuugguuugaauguccuuccguagcucagaguaauuugaucgucugaagccuucuucucucagcucgucaaagucauucuccauccagcuuuguucuguugcuggugaggaacugcguuccuuuggaggaggagagacgcucugcauuuuagaguuuccaguuuuucuguucuguuuuuuccccaucuuugugauuuuaucuacuuuuggucuuugaugauggugauguacagauggguuuucgguguggauguccuuucuguuuguuaguuuuccuucuaacagacaggacccucagcugcaggucuguuggaauacccugcugugugagaugucagugugccccugcuggggggugccucccaguuaggcugcuugggggucagggacccacuugaggaggcagucugccaguucucagaucuccagcugcgugcagggagaaccacugcucucuucaaagcuaucagggacauuuaagucuguggagguuacugcugucuuuuuguuugucugugcccugcccccagagguggagccuacagaggcaggcaggccuccuugagcuguggugggcuccagccaguucgagcuucccggcugcuuugucuaccuaagcaagccugggcaauggcgggcgccccucccccagccuggcugccgccuugcaguuugaucucagacugcugugcuagcaaucagcgagacuccgugggcauaggacccuccgagccaggugugggauauagucucguggugcgccguuucuuaagccggucugaaaagcgcaguauuagggugggagugacccgauuuuccaggugcguccgucaccccuuucuuugacucggaaagggaacucccugaccccuugcgcuucccgagugaggcaaugccucgcccugcuucggcucgcgcacggugcgcgcacccgcuggccugcgcccacugucuggcacucccuagugagaugaacccgguaccucagauggaaaugcagaaaucacccgucuucugcgucgcucacgcugggagcuguagaccggagcuguuccuauucggccaucuuggcuccuccccccgaauucaaaguuuuaacacugggauguuugggagcauugagcuaaguaggggaguggaauaugauaugcuugugacauuguaauaugcuauagauuaaaugaguuuuuauuucacuuagagguaaauaguacuaguuuaacuauguaaauuaagcuuuaguacuguugcucuugcaugauuuauuuucauuaaaauaacuguaagagaugaaaaaguauuuucuuuuaaaauaagauuucaaguauaagagauaauuucucaacuuucauauuauuggaacaauuaauuugauguagguuuuauucauacuuuguuucuucagagaugucuguagugggaguauuuucccaacgcuuuacuauauaaaaguccagcauguugauguugcuccugaccauucaacuaaaguaauggaauucaaacagagaaucuuaaaaaagaagaaaaaaaagagaaaaaaaagaaauaaaaauaucaauauugguaaaaaaaaaaaaaaaucuguaaucugaaaaaaaaaagaaaauugaauauugucuacuauuaucuuucacuuuuauuuagaaucuuucauuuuuugauuuuagacuuuucauaugucagcaagcauuuagugacuaccuaguaugugcuaggguccuacucuucauguacuaaaauucaaucugaauauaggaguuaggcuaaucuuacuauguccauacuuuuaaugagguuaugggauaguauaaacacagaugaugaaaauuaaaagaauuuuguaaaagaaaaauuccauuccaauauauuuaaaagauacauuuuuguauaauaaggcaauugucuuuucuaggaagaugacucuuccauaguuuucgcggaccuaauuaggacaguuuuuaaugaaaacaaaagccuuuucucuuaugcaaacuuuguguuuuuggcacagagcuuaaucgugugcuguuucacuccagauuagaggaaauugcuaguuggugguaguucaguguuuuaugaagaacuccuuuauuuucauuaaaaauaguaguugucuuauaacauuuuucacuacugaaacuauucugauaccucccaaacccauaugacauccuucucuaaccugucccauacacacucuuaaaugaaucuacugauguuuuuuaaaauuaaaugauuuagggaaaguguauguggagggaaaugccaucuguuuuucggaugaguuuauaggguugauuucaguuuacuaaucaauugaaaccagggucagcauuauuucuucuuuagagccuuuagaaaaugaaauuucuagaaaucaauuuguuuaaauaaaauuguuuuaguauaauaauuugguugggcucuaggguuuugucauuggauuuuacuuauauucucacaguauacccagaauccaaauacauuguuuucugucucuuacuuugacuauaacaauagugucuuauuuuuuuagucuuuuaaauuagaaacacacaaaauaagacauauguagaauagaacagcagcauuuauggcaaacacauuuauaccaaaggcuuagaagaaaaaucucuuagaguuuuauguugaaggcuuccuauaaaaucuucuaaacaacuguugguaaauuucagcauuacccacuugccuucauuaaauggauuuuaauuucuuuucuuuagaaagggaguucugggaauuauguaacaaguguaauuugaugagaccaaagcguucccaucacuguagccgcugcggccacugugugaggagaauggaucaucacuguccaugguaagaauaauucacuucuagcaaagaaaagagggguggguaauaaaauguaaaucuuacaacuuggcagcuuuaaacaacaguuauguuaaaguuauauaguuuuacaauaucuuaauaaggauaucuuuauuuagauuauaugguucugucaacucccaaagucauuuuuccacagaaauccuaucuuuucuaacagggagagauuugagccaaaaaaguaagaauuaacugcagccugauauacaaaaggauuaaggugguuguauuaaaugaggcaauguauauaaaacauuuacuacaauaucugacaaguaggauguacuuaaaugguagcuauuucuaauuguaauaaaccauaugcauccgaauguuuauauccccuuuucauuuguuuaauuaauaacauuucagacacccugauaaccucuuccuuaccccuuaaagcuuuuuaagcauuauguauuggauauagcuacuaccauuauguacuuguuggaaguaugugagugauaauuagcugauucugcagaacugcuaacaguuuuggucaauagggggcucucuuguaauauuuaaagaaaauguucaguugagaaauauaaucuucgaaaacaaaugcugcgugaauucuguauuguaucucauuuuaaagcugucacaaaaaucugugaacaagauauuguauuuaauucuguuuucuuagcauuggcucucuguauaaauauuuaaacugguauaguguagaauuugacaaauguaucuguauacauauauguaguauuuauguuuguauacacauacaugcauauaugcaaauuuacauaaugagccucuuaauuuauaauugcuuuuauuuaaaauugaugcaaguggaguuuagcuuuuucuaauguuagucuauuuagaguuuucuuuauuuuugauaacuuauuuugauagcacaguuauucagcaaacuucugguggaaauuuguuuuuuugcauagacuguuuaaaaagaagauaauuuccugaaauaggaaaaaguaagagcauuuucgauaaaagcauuuuguuacuacauaaaaauuuuaaaaauuucuaaaucugucaacaagauagaguaguguaugacauauaguugauauucaaaacugugccuugaauuuaaacguaaauaauuauuugggaauuacuugggaauaaagauuaauucccaaguaauuuucuuaagcucagugaucuguuugcucucacaauaguaauagauuuuuagaaagcuacgugaaacauguauucagauaauugcugaucauacagaaaagcucaguuuuuaagcgcuucuuauuguagaguuucuuauucacuaaaauacaaauguucaugauggaaguggauauugaugcuuuuuuuuucaaacgaaugcaguaguaagaaagaacuaggaaagacucacuuauuggugaccaaauaaggugcuauuuaaccuuaauucuaacguuggggugauuucucuuucugggccucuugcuuccauaguuuuagucaacuuuucagaaguugguagcagugagggggaaguacaaaggauuggaggaucagaaaggagaguagacaagggaccuaaagagauucaggaauuuuuaucauugaauuuccugauagagcacugcugaaauguucagagagcaggggaaauguacaguguaaauuggaagcaaggaaaauuuuugauguuuucagaaauugcacuacuuaacugccuaagacauuuuuagguuuggaggucaauucucacguugccucaagguuuucuguauuuguggcucugaucauucuuuuuuuuuuuuuuuuuuuuuugagauggagucuuacucuguugcccaggcuggagugcaguggcaugaucucaaccucugccucacugcaaccucugccuccuggccucaagugauucuccugccucagccucccgaguagcugggauuacaagugcaugccaccaugcuuggcuaauuuuuguauuuuuagcagagacggguugucaccauguuggccaggcuggucucaaacucccaaccucaggugaucugcuccccucggccucccaaaguucugggauuacaggcuugagucaccgcgccuggccugaucauucuuucuaaguagugcagauguuacaaaaagaacucauauagauugaauaccuuagugcuucuuaaagcuguucugguuaagaagaaugcugugaucauagacauuguuucucaaacuuccuggggacaggaaagauggaacaaugauaagucaucuuucaaucggcagcuguugaagagcacuuuugaguguauauuaauacauaagcacacuucucuuauaauccugcuugcaaauaacaaagcacaguagauuuucuuguuuacaaaacaugcacucuuaaaucuuaagaaaugccucucuaagguuuuucaguucaggucuguauuugacuuuaaaaaaugguuuaaugacaaaguuaaaaagagcgauuuaaguuaggaccgaaaccuguuacaucguuucuuuuucagugacaguauaauacuauuuugaaaugaaaacauuugugcaaagucauuuguagucuugaacuaggguuuuuugcuggaauuuuaggauacuuugacaauuuggauacaauaaauuuggaacaauaaaauauucagcuuaaauuagccuugaaaauuuuuuauuguaacauuaauccucuuuccuaguuaggguucacuguuguauugguggaaguauagcuguguguauuuauaaauaguuuugaauacauuuuuauuuucagcaaccagggguagauuuuuaaaaugaaaagugaaugcuuagcaguuaugucagagugguauguuucagcugguuuacuucagggcauucagauugcuuuucacagcuagaaugcccuaaaggaagagcaaaauacagggaagcaggguucuugcucucuuggccccuaugucuucuaacucuacauccucuggccagaggcuuagcuccuuuguucccuguuuccauaucagugacacaggagacuaccgucugcucuuccugucucgcugaguuguuaugaguugaagggggaucacauauguggacuuccuuugugaagugcuuuacaaauauaagaugguauauuuauaguuuucucuguauaguuuguuuuuaccuucaaguggccauagcauaucuccaugaaguuaagcauaugugauauuauuuguuuuuaauuuagucuuauugauccugaggugaacuucuugaaauuuaaaauauuguuucuuuuucauuuuuuuucuuuaggauuaacaauuguguuggugaagauaaucauuggcucuuucugcaguuguguuucuacacugaacuucuuacuugcuacgcacugauguuuucuuucugccacuauuacuauuuucuuccacuaaaaaagcguaauuugguaagaaauguuuauauugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccaaccugggcgacagcgagacuccgucucaaaaaaaaaaaaaaaaaaaaaaaaaagaaauguuuauauccacuaacauuagagcaguuguagcauacaauuauuaacaugugguuccuuuaaguacaaaagauuggaaacaaaacaacaaaagauuggaaacaaaacaacaaaagcaaacucccaaauuggugaauuuugaacuauauugggauugagaaagugggcccuagucugacauuuccuuuuaaugaaauucauuuaugguuauuuauuaguguugagcuuagaaagcaacacguugaaucuuucaauacgugugucuugguuuaaaaauaucuacaauaaugaaaaacaaagacaaaauguucuuguuucuuuucaggaauaaaaaugcagaauguaauuuuuaaagguucucaaauaguuacguucuugagaaagagaacuuuuuuucucccugccuuucaucaguaaugauaucaugaauuugcaggaugcuuuaaaaaguuauccacugagaauauaaugcaugcuaggacuauaguuuuagaaauguuucaucuuauuuauagauaaauuucugauauaauuggcauuaaaguuagaucauguaaaagaauguacauauucccuggaguaaucuguuucaaauaauugagccuaauaagaaaagcauuaaaauaaaauuccucaguaagauuaagguaauaauuuuuuuaagcgacagagaaguagaguuuagugguguuaaugaaaaacaaagacaggcuaagagguaacgaaugcauuguaguauagugcaguauuggcaaacuaugggccuugguuuaaauucagcccucugccuguuuuuguuaaaaaaaaguuuuacuggaaaacagcuacuuucuuuuguuuauauauugucuauggcugcuuuuguuuuauaagagcagaacugaauaguuguggcagagacuguauggucuguaaagccuaaaauauuaacugucuggcucuuuuacaguaacuuugccagccucugguaguggaaagaucuugucuuuguaaacagacauaccuaggauuaaagccuguuuuuucuuauuacaugcauaaguuuugacacauuguuuaaccucucugaaugguaauuuucuuccacugaaaaugugaauaauaaugagauuaaaugaaauaauauauguaaacuuagcugguauauaauagacauucaauuuauguuacauuugauuuuagugaaaacucucagagggaggaaacaauuuuucuuuggccuauuaauuuucaugaaaauuuuagagaccguuuuacaguaaccauuuauuacuggaagauugaugaccaacuaaggaaauuccaauaaucaaaugaaguauuaagacguuugaaauuacaaacuaauuuucuucuccaaaugaaagguagaaacuggagagaaauuaauggcaauuagacagucaccuuuuuuuaaaauggagaaauggauuauggguuauauuugaauauacgacauauauguguauauuuacaugcauaaugaauguuggaaaaagaucagcagcauaguaaauguuuauuaagagauuaaaaauaucaggaagaagaaaguauauaaaaagugaguauaaaaaguggguuuuaaaaagucaaaccagauuuuccuuagagccaucaauuguagaugcaagcaggugauuuuuuuaaauaaaaaucauaauaauauguuaguagcauuuuagcaaaugaaaaucaaaucauuauguugguuguuagaaagcuacuuuaggaaugaagcaguacauuauaaauaauucuagggaucugacaguuacuugugucuaguagugcugagcagaaaucguucucuuagccuaagucuuaugguuuccuuguuguaucaagcgguguacuuuuauaauuaccaccauauuagcaguaaugaaaugaaaacucagauuauguuaugaaauuuccaggaccauuuugcuuccuauugaggaaucgaguaauuuuuaguuuuguuuaugauauauuaucucaauguuuuaguuuuguuuauauguuaucucaaugaaugaaguaauucauacauauuaucaaguuagguauauggagagaagagcuuuaccacaguauuucccauuguaagaaaagacagacaaauuuaaauacauaaaauugaauguuuauuagcacuguucuaaccuacuuaaguuuaauagaguaaagcuaaauucuaggaccagaauuauaacuaaacuugaagaaaguauuuuauaaucuauguagcucuaaauauuccaaugaucugaagcaaaugaauguucaguaguuagucaauauacauugaaaugaauuccagucauuucauugauuuagaaguugagaguuugaagcuacauuauagacacauccaaauuucguuauaccuuuuugguggauugauucuuguaucauuauaaaauaugccucuuuauucuuaguaaugauucuugccuucaaauuuuuuuucuguuauuaguuuaacuauaucaguugucuuuuaguuaguguuuucaugguauaucuuuuucugucuuuaauacuuucaaccuaucuugauuacugugucucauaaugugccuuacagacagcagauauuucauuaaaaaauuaucuuuuaauaugaaacauuuaguaaauauuuacuuaguauaacugguauuuugucauuuuccuauuuauuauuugacuucaucuguucuguguucccauuuuucuccuuuucuuuccuguuuuggaauuucuaauuuaaaaaaaauuccaauuuucuauuucuaauggcuuuuucuuuuacucuuuuuauaguuuccccaaaagugaaaacauuauucugauuuuuuugaaguauaauauaaguuaguacuuuaccauugugcaccuaaugaaagcaguggucuuggaacacccucugucaucaucauuuuucauauuuugggguagaagguagauguagaaaaaaaucacaugauaacaagacauuauuguuguuacauauacauuauguguuauauuguuauacaaguuauauguuaccuauagucaguauuuguuuugaguuaucuacauauuggugcuuuuucuaguacucuuuauaccugagccuccucuaggcuuauuuuuucugcuuuuagugcaagucucuuggaacaaauucucucaguguugguucccugaagaugcuuuuauuucuccuucauuuuugaaggauuuauuguuuggcacagaauuguagauuggugguuacuuucguucaguuuuuaaaagauguuauuccauugucuuaugguuuccaucauuucuguuguaaagucaguuguuggucuuacuguuacuccaaugaaauauguuuuucuuuagcuguuuuuaugauuucuuuuggucuuuguauuuuagcaauuauucugugauucuaugaugugcuuugguauuguuuucuuugcacuuuuuucuguuggagaguuuauguaacuuugaaucuguggccugaugucauucuuaaguuguggaaauuucuuggccuuugucacuucaaauauuaccucugcucaauuuuuucuccugcaguucugggauucuacuuacauguacgugaagucucauugugcugcauauguucugaauuuauuucuuaacuuuccuuuuuuauucccccucugugcuucauucuggauauuuccuauuaauuuauccucugguuuacuaaucaccucuucugccaugucuaaccuacccuuaaauccuucuaaugaguucuuaauucaguuauuauauuuuucacuuuuagaauuuccauuugauacuuucuuucauugauaauuucuguggugaaaucaucuauuuugucaucuauuuuuuuaaacguguuaaucacaguuuuuaaugucuguguuugauaacuuuaacuuugagauccccuuguggguccguuucuguugacucuuuuuuucuucucaauuuccagauauuuggcccugucuucugacaugucuaaguuagaauacugagcauuuugcaugacaaauuguagaaagugugauuguguucuuuccucagauuugauuuacucuuuuuuuuugauaggauauaagagaagccucauuuuuauccaaucagggguuuguauaacaagaauuucuaaugcuaaauaacagaacauuggucuuaauauagcaguuuuuggaaagaugcuauuuauugcauuuauugguauuuuguaaggaaucuugauugcuggauuugucuuugugaaagacuaguuucaauuugccuuuauuccaauagucuaguccuucggggucucagcugaaaaacugagguguuuauuguggauugugcccuacaguuacuguuuuccuggccuuggagauuuugcaggauguucugagucuccgguucuacuugacuuuucauucaguacugaaugugaauugacagguacuuucagauaaaaagcagugcagaauauauggcucaccuuaacgccugucuacuuucucugagauuuuggccucuuaaguucuggggaguuuggcuacuugccaguaucuuuaaacagcuguguauuuauuaauuaauuggauuuuaucuggcuuuuaauaguguuuuuggugugaguguuggucucauacgaacuguuuccucauaggugucaauggcaauagcauuuuguuuaaaaaauuucuucccaggugauuuuaaucauugcugccuaauugcauaacuccaggaggcaacacucacaucauagucuauguaaacaguauccuguggaguugugcagugcaaaacuucuguggccauaaggucugagaagugcuguagaguagggaaugagacucaugguggacuucauaggugagauagagauuaaccaaauggggagaugaaggaggucauugcugggcaaaaaaaacaacaaaacccuugaggcuguaacuggaauaauugguuuuaagggcaaaucuuuaguaaaauuccagcaguauaacaaacuucucuaaagcuaaauaauaaaauaauguucuuacuucagcaguucuuuuguaaauuacauuuacuguguuuuucauaaagguagaaaaaaauuaccaauaauuucagaaccaaagucaccauuauuaccauugacauuuaaaaaaauaauguuuuaugguggaauauucuucaaaaaauacugccucaucaguguuuuuugcaagucuuuuccuguguuucuuucauuuuucucuaaaacaagcaaaaaucuguauccagcuguugauuauguguauaaaacuaugugugaauaaagacaguaucaggaacuucaucuuauuauccuuucuauuauucaggauauggaauaagauccccgaaggucccuaacuaucuuuggauauugcauuaaugauuauuauacauauuuuuugugggaguaaugaugcaguuaaagcaugugguggacuuugacccuguguucuucugucagccagacugaagcaaaagcuguagucugcauuuucuuucuacccuuucacguagauagguggcagcauaguaucuuuucuagcccaucuuuaaauuccaaagcugaauggaauugccugggucagaagagaaaguguuaacuuucuuguuuuucuuuucuuguuuuuuaaggcgaaaguguuuauucauuaaacaacaacaacaaaaaaaaugaguugcacuuugaccauugauguaauggcacuuaaccuguauucaguagaaaacugguacguuguauguuaugcucaugguaaagacaguugagagaaagcagguuguucacaaauucugggaaaugaacagauugggagccugauuuucuuccauuucucucuucuccucgccuucuguuuucaggagagcucuuucugagcuggauuauuuuaauuucuuugcaagugccccauuguuuuuuauaguaacuuaaugcuuuuuagauuucuucuuaaucuuuacuuuuaaaauauucuuuuaucacgaacguucaaagauuuauauguuuuuaccaugugaaguuuugaggaaauacuugaauuuaucuuuuguugaggaaguaaggacuaagaugugcaggagauaaggaauuuauaguuuaucaugaaucaaugcccaaauuuaggauuuauuuuuuaagcuauagauauugauuuauauucugagucuuauacuaaaaaaaggccugugaaccuaaaaagaauuaguauuuacuaucuuuaucagaaauaguaacuuaaaaaauccccaaauucucaguguaaaaaaugcaugucuagaaaaauugcagaaacuugaguaauaguuuuguuuucuaaauaaauggagauaaauuaaacauuuuuuguuagaaucacuaaaucaauaaagauuauaaacuuugagauguuuggagaaguuuuucagauguuagacauuaaauuaguuugcaucauuugcauuuaucauuccaguauaauguugaauuuuacuuaaaaccccucucgaaaguaauguuugacuuuaaauauuuauuggcaugaaaaucauugucuagguucuaaaaccuguagauuggguaaugauuuggcauuuaagugaauaaaauagauggauuuugaagaaaaugaacuuucauuuuuuaccaagguccauauuugacuauuucacauaguuacuuuaaaugcuuauaagcagaugccuagucauuugguauauuaugaaacucuauuucauuuuauuggauacugguuauuuaccaaaacuagaaaauuacgguuuucaauuaaauaugaaggaaaguaccacuguauuuaaagaguauaccuucuuaaauuuauuguauguuuauccaugaauauuuuauugguaacauguuuucuuuuuauauuauucuggauuuguguauuacuuggauuaguggaaaaugucuacuccuaugaaauauuucugaagggauaaauaguaugguugccaucuuacagguaagguaacugaaauucagagaaguucaauaccuuguccaaucacaaacuugccacuugacagaggugugauuugggcccaugucccuaagucaugugcuugcuauuacuaaauccuauucaaacucccauucaauacuacuuuuugcauuuuucccccaaggaauuuuuuagcaauauuauuguaggauuaauaauauuaaauauauuuaaaaauacuaaacaucauaauaucugcucuucagagaaagcucagugaaccuccugauugguagauuaauauuuugcuguuuucauugaggcagucuguuauaucuuauaaaggcaucgcaguggguuaaaaauauuuuuuuaaauauguuccugcuggaaaucagcugcaggcaaaguuuacuauuucucuacaugagaaaauacaagguuuuuaaaaaaauaauuuguggcuauuacugucagagauuauacagcuaaucuuugaugguauaccacuuuaauucuaaaauuauguccuuuagcuucuuuuuagaugaaguggauucugauaauuucuaauuguuguauacuuauuuuuaugugaaggggaaaagcauacuaacugcguuuaaggcuaugagagcagugggugacagaaggggaagagaggagagagaauuucaauaaaggaaaugcugccaaaauucagaagaggaaaauaaauaauguuuagcagccuagccaacucuucugcuaggaagauacauuauuauuauuccaauuggcugauaucuaauaguguugcuagggauuugaugucagaacuguuccuacagaauuauuugccuagccuuuuggcuaacaaaaaaaagaaauagccagaagacuuggcugcagguagcuuugaauauuuguaaaucuuuucauaauuuauuuuaaucuuuuuguguaaucuguuuuaaagucgccugaguacuucugcuauuuaaaaaaauauuguagccuuaauaauaacuuuuauuuucuuaauaucuagaaggucauuuauuuuguucacugaagaauggaaaaaaauugcuaaaauacacauuuagcuuuuuagauuuuuggaaagaauagccaagagucaagaauagccaagaguauuguggaauuaaaauugauaugagaugaaaauuauuuuuagugcuaauauaaaaguaauuuggcuuuuuuguuccuguuuccugagaugcuacuagagauauuccuuaguaacauuuuuuauuuuuuuugcuugaaaagaauaaugucagauauaguuuauauuucuaaagaaauaagaauaaucuauuuauucuaacaauugccaauuccauuugucaguauaucucuacgcuuuuagugagagauggaacacagaaaccuuauaauaaaucuuaauccuguccuacaacaccagguugacugaguauauguccucauuaaacauguuuccauagucaguuauaaauauuaauagcauuuaacauagaaaauuuagcaguuuuuauuucucuguaaaacuguuacaguuacugugaauuuaaaugguuaaaaccuggcagcaauuuuauugucuuacucuucuuuuacuuuuaccaaacacuguagcacugcauuaauuggugaauguaguaaggaaguauguuauccuguucucuuauuggauugcccaaacuuuucuagaauuuuuacugcuaaaauauggucaggcagacaaaauaauuuuucuggaauacuucacccucagccaugaaccugacagucagaugcuagugaaauacgcucuguaagacaauugcauacauaugauuaccaaaauuuaguagauaauucugaacacucaaugacagccauuagggagguauaaauaauuauuuguuucacuuuagauauuaauugccauuaggauguaauaagacugagaaaaguacauuuuaccugagcguuggguugggaaguggagggguuuuauguagaauaagcuuguaacuucuuuucuuauguuuuagaauauaauaaacuuuagcuaagggucauuccaaaaagugcucauacccauacagguaucaugggauuuuauuuuaggauuaaauuaagauugcuuauuuuaaugugagaguauuugccuuaugaaccuacccucagcaugugaaguugguuauuuaguuauuuugaaaauucaaaucuguaugcuuuagauaucucagaugugaucuaagcuguuucuguuauuuuuauuuuuuaauuuuaugauuuuuacugucuccagguguuucuauucuuuuaacaacagagaaaaacaaaauccuuuaccaguggguacagugguucucaguugggaggagguugacuuucccccacagaaaacauuugguaaugucuggagauguuuuugguugucgcagcuaggggagugcuacuggcaucuaguggguggaggccagggauucugcuaaauguucugcaaugcacaagaguguccccuguaacaaaacauuauccagccgagugucaguagugcugagguugagaaacuguucaguaggaggaagaucacaaagaaaaaaaaaauuuuuacuuuucagaguagucuuauaaaaacacagaaaaguacguauaagcugugguuuauaaauaaaaauugcuucaaacucauugauaggaaaauugucauuuuauauauaaaauuuuauuuguaaaacacaguuuuuuuauuuuaauaaauugugaggaacauuuauuaagucauucaguacauauuauugagugucuauucacuuccccuucgucuaggcucuaaaacaaaguuccuguguuuaaggagcuuacguuccaauuagagaagacaggcaauaaacaaauauaugguaaacaauaugaguauuaugacguauaauaaagcaggguacagggguggauauagucaaggaagaccuuucucuagugacgcuugaacagagaccuggaacucaagcaagucacuguuguugacauucucaaggaacaguagggagaccaguguaucuugaguggagugaguuagggacagagcaauaggagaugaugaguugagaguaguaagggcugugauuggacuggagacuuuauuaagaugguuagugguugggacuuuguaagcuguuggaggguuuugagccauuacacaaucucauuuacauuuuaguaaaaaaaaccugauugcuaugaaaaauaaaggacaaggauaauagcaagaagaccagcuacuaggcugcuaaaauaccguccaaauaugaaaugauuauuaguagugguagaagcguuuacaaguggucuauuauaguuugaagagcuaacagaauuuggugauaauuugaaugugggcugugagauagaaugcgaaacgucaaggauauuuccagggcuucaccgcccaaacaacuggaagaauggagauaccaguuaccgagagggggagccugacggaagaauaguuucugggaagaaguuaaagauuuggguuuuacacauguuuacucugccugcuuaacuuccagggacagauguuaauuaagcagcuagauacaaaaaucuggauuucaaugggguggucugagcuagauaaauaaauuugggagcuuucagcauaaagaugauauuuaaagacauggaaacugacuggagauuuccuagaaguaauucgaaauagaaaagaaaagaguucugaagaccaaacuaggcacucaucaguuuuugaaguuggaaagacgaaagguaauaagaaaggugacuaagacugcagccagugaaacacgaguagaaugguggugagagagggucaagaaacguggugguaaauugaaagagaaauuaucaugauggacuguggaauauaaacaaguagggaguugaauauauucuggaaagccaaugacauggugguugggccaaggaauuggagcucccgucgggguugagaauuuguuagcauugauagucaacagggaguuagcucaaaagaaagcaugugguauucauaaggugacauacuugaaauuguaauuauguuaugaguuacaguucuuagaaaugauaagguauaguauauagucuuagaauuugaauugagauuaggauauaaguuuauaggaagauaugagcugaaggaauucacagaucaaguauuuaauuauuuguuagaucauaaauagccaaaucugacucuucuuuucauuuagcuugcauuaagagguggugccccccacugccuaguuuuguaacauuuaaaaauuuuuaaaugauacaguucuaaaagauuaugagauaggaguauaggaauauuauuaauauuucaugagagugacccucuccuccucugcugguuuaugugugaggacauaaguauguuuauguacauguugccuauguguuucuuuuucuguguuuauugcugcuauuauacaugugaaacaguccuuguagauacuuuucucugucucuucacauguugagggaagagacaguucuuuguccaauuuucuuuguuuucauucauucauuuaauaaauauuuguugagcuggagcugauucuacauuccaggcacucaugauugaacaagacaggcaaaaguccccaucuucaagaaacuugcauacugcuaagagagacaaaacaacaaauaaauagauauauaucagauggagauaaauacuaugaaaaaaauaaaauacagcaaggaaauagggaauacugggauuuucuguaauuuggucaaggaaaaggucucugauaaggcgauauuuaaguagaaaccugaagaaagugaggggaguaugcuugugguugucuggggaguuuucugggaagaacaaaugcagcaguccugauuugaaaguucgcuagcuaugucugagaaauagcaaggaggucaguguaguuguaggugagccaggaagaaagugguagaugagaucagagagguggucugacucuuccucuccuuuuuuccugucucucacauccuuuucugugucuuauuugacaaauuuuugucucuguuuuuuauaggccauuuauaacuaacuuuuauguuuuauauguauuuuaagaguuugguuuucuaaaauuaauaaaaguauuuuuauauucuguauuucacuguuacaacuuuuuguaccuuuuauauuguaaaaugugauacacauaugaaggagugcauaaaaauaaaaacaguuaagugaaucauccugguguuucuuuugggcaacauuuggaagauuuauccuuuuuguuacuuuagauacaguuuauuuucauuguugugaauccucauaauauuucauuuaauauaaagccauuuauucguucuguugauggacauuuacuuuguuucuaguuuuuggagguuauaaauaaugcuauugugagcagccuuguuuauuccuccugcuguccaugugcauguguuucacuuagauguauagcgagaagugcugguguucgaagguuaagugguauguuccuuuagauaguguuaaacaguuuuccaaaauaguugcacccauuuaaacuccuaccaguagaguauaugaauucugauggccucauauccuuacuaauacuuaaaucuucuuaacauuagccauuugguauguaugagcaguacuucauuguguuuuaauuuacauuucucugaugacuaaugauacugaaccucuuuucauauauuuacugauuauaugacuggccuauuuggcaaagugugccuauuuaaguauuuuucccauuugacuuuuucuugguaauuguagggcguuuuagauuaguccuuuuuuuggaauguguuguaaacaucuuccacucuuugguuuaucuuuucacucucuuaauggcauuuuuugguaaacagagguuuuaaauuuuaauguacuccaccuuaucaaccguuucauuuuugaguaguguuuuuuggguucaguuuauaaaauauuuuuuauccuuucuaaaaccaauguaauucuccuuuauuaucaucuagguacuauauuuuucugucuuucccauuucuaccuggaauugaauuuugugauucucaugagauagaagucaggguuucaguuuuuucauagaugaauagucaauugauuuagcaccauuuauugaaaagauaauucuuuccccuccacucuguagugccaucuuucuccuaaucaugauucauaugugugugugucuguuucuguuucuuuucuagucuguugaucuauuugucucuccuuguggagagacaauaccacacugucauuacaacugugguuuuauaagaaauguuaucuaguagaacaguaguuuuuaaccuuuuuuuaaauucccauuuuccuccuauggaaauuuucuccucucaccaccccugugaaguuaaauacuaagaaaaaagauuuugucagauaagauuguguagagccacaaaccauagugauagcuaagacuuuuuuucucccucuaagaaccaguuuucucccacuugggagcaaaacuugcccugucgagaauacaugcaguagaaccgacuuuccuaccuugcucuguuuauaugagccucaugguauucuuuguguuuguuuuuuccuaugaaauaaagaaacagcuuagcaauuucuacagacuaaagcaaaguaaauauauauauauauguguguguguguguguguauacauauguauguguguauauauauaaacucccaccaguuguauauaguauguaaugugguuauauauaagcaaccugaucaaauugaguuuauccuaggaaugaaaggugguuuuugcacuagaaaauaagucaguauauuuuaucacauuaacagauuagaaaaaaaauucaaauagagcaucucaguguaugaagacaaagauaaaauucaggauucauucagguuacacacucuuaguaaacuagaacuuaggagaacuuucauaaucagauaaauggucuuucuucccgacccccuuaaaaaaaaaacacacaaaaucaaccaacuauagcaugcuaagaugaaauguugacuucuucccuccagguuggagacaaggcauugaugcccccacuaucaccauuauuauucuuaaauauacuacuagaaauucuagccagugcaguaagacaagagaaagaaagaaaagguacaacugcugaaggaaauaaaacugucauuacacauagaugauguaacuguauaaaugauuuaucuauagauucuuuuggguuuuuaagaaaguauaaaaaaugugacuaugaaacaauauuuuuaaaaaucuauuuuuauaugcucacaaacaaaccuuuagacaaugaaauuaauagcaaaugccauuuauaauagaaucaaaaaacaggaaauugcugaauuaaaucugacaaagugcaaguccuuuagaagaaacuuaacgaaagguaauggagagaauauauuauacgugaauguaugcaugaguauguguuguaacuugaaaauguaacuuuaaaauuuuuaugcaaauacaaauuaucuggaauaaucaagacguucuugcaaaagaguaagaugggaugacauggccuaccagguauugagacuuauuacaaagccguaauaacuaagacauuugucaccguugcagggauaaacaaaccaagggaacaagaguagagagcccaugcauguauggauacuugaucucaggucacugaagaaaugacagcuuuuuagauaagucauuccggaacaguugaauauucauauacaaaaaguaaauucagauuccuaucuuucacugugcacaaaaaaauuaaauaauaauucuaugugaauuagugaccuaaaugugaaaggcaaaacuuaacaaagcuuuuaaaaggcuuuacaagauaauauaggagaaugccauuauuacuucagcaucaggaaagauuucuuaaauaggauauaaaaagcacuaaaggaaaagauugauacauuggacuacguaaaauuaagacuuuaguuuauaaaaaggugccaucaagagagugaauaggguaguuucagagcaggagaagauauuugcaauaugcagcugaaacauagcaauauccaaaauguaugaagaaggaguuaguaaccuuuaccuuuaggguaggggugagggagagccagcaauggggaaggaauacacaggaggcucuacuugguuucagauguucuaauucuugagaggauacuguuacuuuucuucuucuucuuuauauauauauauuuuuuugagacagagucucacucuguugcccaggcuggagugcaguggcacgaucucggcucacugcaaccuccaccugccagguucacgugauccuccugccucagccccgccuaguagcugugauuauaggcaugcaccaccguacccugcuauuuuauuuuuauuuuuauuuuuuaguagagacgggguuucgccuguuggccaggcuagucucgaacuccugaccucaggugauccacccaccuuggccucccaaagugcugggauuacaggcgugagccaccguacccagcccaguguuacuuuucuuuaaacugaacacauguguuuuaugaauuuaucuguauaugagcacauuuuuuaacaaaaauggaagaaauguaaacaauaaagaaauacauuuauugauuauauuaguuugcuaggccugucuuaagaaaauacaacaaaguggguggcuuaaacaacagaaauucauuuucucacauucuguaggcuacaacuccaagaucagggugucagcagguuaguuuucuccugaugccucugucuuuggcuugcagauaaccaccuucucucuguccccacauggucuuuccuccgggaacauccauggugucucucaguguguccaaauuuccucuucuuauaagggaaccaguuggauuggauuagugcccacccuaagggccucauuuuauuuuagucacugcuuuaaaggcuuugucuccaacuacagucauauucuaagguacagggguuagggcuucaacauaggaauuuugggggaccuaauugagcccauaacacugauuauguaguaaagaucucggauagcaaauggguuccugugauuuggauaaaaauuuuuaagccaauuuuuggauucaaaaaguguuaaaucuaaaaaaaucuaagacagaaguaaagauguacucuagagaacaguguuaagugacucaaaauauggauuuagugcugaugauguuaauuaugcaugugugaacuuggaauacaguuguuuuuuugaaaauguaaaagugauaaaaagcaauuucuagauuaaaguuuuuuuacuacuguauuuuacauaaauacuuuaaauauaaauguauaaccaaaugaauaaauguaauauuauaaguagaucuuuuagucucaucuccauccuugacauuuauaaauuguaguuggccaaaaauuauuuuaaaaucuuuucacugggaguagaguggauggauuuuauuuggucauagaugguaauuuuaguacaguaagcucugcuauaaugcaauaugugcauuccuaaaaaucaccucacuguguaaaaccgugcauuaaaaccacagggcuuaccacuccgaaacuuugucugugacacuuaaaaggauaggaauauaauaaaaacaacagcacucuuuuauauaaauauuacgugauuaagaaauacauaaauacuaugauaaacauggcacuuuaccuugagaaagaccugaaguuuucuuauggaagugagcaucaggaggguugcagaaugugaauuauugugaagugauggaagggagggucugugaaauuggagggaaaguuguaauacuaguuguggguggguguggcucauagcauggaagagaaacugagguggcugguagauguuugacgggugaguguguuuuguguauuccuacauauuuugguucaucuggguacaauuuuuuguguucaucuaggauuuuuucacagauaaaaguaugcauaagaaugauugccauggucaaacuuguuuaauguaucaauuauguuagaacaaauuuguguuuuuaaauaguguuaaugcagaauuuacuuaauuuuuuaugucauccacaggcccaucauuuugguuuuauauguuuuauagggauucuauauuggguucuuuuuacugaaguuuugaaaugauugccuaauauuuaccugcuacauaacguuuuaagugucuugcugaauucuaaguuuuuccaggcuaaugaauaaguaauguggauguggaaucagauuuuugcuugagucugguggugacucaauauaauacacacagaaaaguaucaguucuucuguuucaagcaagcauacuaucucugguggccuuccuauuuuugaaguugcuguuaggauacuuuaauccuuaacaugaaucaguauaaaagaaagcaugugggugguuguguuuggguguccuuuccauccacuuggugcuuuuauuuucugugguuguuuuauuccacagcuuagcaacagcagauuuccaggagaagucuuaguucuucaucucucucuccuuccucuggucugguugguugguaacagugagaguaaaugaaaugcuuuuuguuuuucugucuucccaccacagugucuuugguuuacuuuuaggacccucauuuucaaucucugagccagaagaccugccuuuaaaucacagcauuucaauuccucccuccuaucuaggcauuccuuuauguuucuacaguacucugcaugcaucccuguuauaaaauguaucacauuguuuuggaauuuuccaaaguugagcucucuuucuaaauaaacuguacuucuugaggccauggaccauauuuuuaucauuuauacauuucuguuacguaacacaaugcuuggcaauggugguugggugacuggauggaagaaugaaugaaguaggcuugaagagagcuguacuuaugauccuauuauauaugauuucucuucauuuuguccacguuaaugauuucuagauaucuuggucacuugaacuuuaguaauaugaaucaugcuguguauucaaacuuuuuagcagagaaauaauaaaauuccuuuuguaaaccaaagauuguacaaccaucuguguuuuguuuuguuuuggguuuuucuuuucuuucuuucuuuuuuuuuuuuuuuuuccccaaaauagguucaaaaaacaaacaaggcuaacuugcaccuaagauugaggaguuuugaugcaguagaguaguaaacuccuguauuuuccagcuugcuauuguaaauuaaaauaccuauuuuugaaauuuuaaaauauuuauacauugauuucaauagaaguauaaaagagggagagguaguucuuuuaagauaauaaggaagauguguuauggcucaauucuugauuauuauugcgacuguaagcaauguaagcaacucugaaugguuuuuaagacuuucuuuuucuuuuuaggaccucuuuguuuuuagacaugaauuggccauaaugagacuagcagccuuuaugggcauuacuauguuaguuggaauaacuggacucuuuuacacucaacuaauuggcaucaucacaguaaguauauuuuuaauguaaaguaacauuuaugaauauauuaccuaauuaugaauguaauucucaaaaguuauaggaaguuuagaaaucaaaggagaaaauuacccaugcuuuuuaauacuuucaugugccuauguaauuuuaaaguaguuauaaucaaguacaaaguauacacaauuuuguauccuguuuuuaaaagcuaacaaauacaguguuuuuauaugacuauagacaucacguuuauaguuuuuuauugauacacaguaucuuacguauuuaugggguacauaugaguaucuguuacaugcauauaauauauaaugaucaaaucagaguauuuggggucuccaucaccuugaguauuuaucauuucuauauauuaggaacauuucaaguccucugugcuaguuacuuuaaaauauacauugcugcugacuguagucacccuacugugcuacugagcauuauaacuuauuucuucuguguguuuauaaccauuaaccacacucucuucgucccccgcuccacccaugcacccuuuccagccucuuguaucucucauucaauucuugaccuccaugagaucagcuuuuuuggcucucccauaugagugagaaaauaugauauuugucuuucugugccugguuuguuucauuuaacauaaugaccuccaguuccauccauguugcugcaaaugacagaauuucauucuuuuuauggcucauaguauuauuccauuguguauauauaccagauuuuuaaaauucauucaucuguugauagacacuuagguugauuuccuauccuugcucuugugaauagugcugugauaaacgugcaagugcaggcaucccuuugauauacugauuguuuuuuuuccuuuggauaaauacccaauagugaacugcuggaucuuaugguaguucuauuuuuaguuuuuuaagaauucucaguauucuuuuccuuagugauuaggcuaauuuacauucccaccaacaguguacaagaguucccuuuucucugcauguuugccagcaucuguuacuuuuuguccuuuuaauaaaagccguucuaagaugauauguuauugugguuuugacuugcauuucccuguugauuaaugaugguacuuuucauauaccuguuggcuauuugcauaucuucuuuugagauaugcauauucauguccuaugcccacuuuuuaaugguaccuuuuuuuuuuaauuguugaguuccuuguauauucuggguagugucccuugucaagcaaaaaguucaaguguuuugucucauucuacagguugucucuucaauguguugauuguuuacuauacagcuuuuuaauuuaauagagucccauuugucuguauuuguugucugcauuuuuugaggucuuagccauaaaauuuucaucuagaccaaguccugaaauauuuuuccuaaguuuuccucugguaguuucacaguuguagguuuuauguuuaagucuuuaauacaucuugaguugguuucuguauauggugagaaaugggguccaguuuccgucuucauucuuaugcauauggauauccaauuuucccagcacuucucauguauucaaaagacuguuuuuuucccccaauguauguucuugaugccuuugucaaaaaucaguuggcuguaaauauaugaauuuauuucuggauccucuauucuguucccuuggucugugugucuaugugucugcuuuuauacagauacuaugcuauuuugguuacuguagccucauaauauacuuugaagucagguaaugugaugccuccagcauuguccuuuuugcuuaggauuuuuuugacuauucgggcccuuuuuugacuuacaaauuuuaggauuguuuucucuaauuguaugaaaaaugauguugguauuuugaugcugauuauaucaaaucuguagauugcuuugggcaguguggucauuuaacaauaauucuucugauccauuaucaugggauagcuuuccuuuguuugucucuuccuuuaauuucuuucaucagugcuuugcaguuuuccuuauagagaucuuucaccuccuugguuaaauuuauucuuagaguguuguuguuggagcuauuguaaaugggauuguguuuuuucuuucuuucucaguucauuauugguguauagaaacgcuacugauuuacugauuuuuguaugcugauuuuguauccugugacuuuaccgaauuuaauuaucagauugaagaguuuuuugguagagccuuuagguuuuucuugauauaagauaccaucaacacaaaaggccauagaugguguuuauuauauuguaguauguuucuucugugcuuaguuuguugagaguuccaguuccuuccuuuucaauuuuuugaaauaauuugaggagaauugguguuaguucuacuuauuuuaacacuugguagaauuugcagugaaguugucuggguccuggacuuuucuuuguugggagacuuuuuauuacuacuuugauauugucacuuuuuauugguuuguucaaguuuucuauuucuacccaauucaguugugguagguuuuaugugucugggaauuuaucauuuacucuagguuuuuugguuuguugguauauaguuguucauaauaaucuuugauaaucuuuguauuucaaugguaucagcuguaaugucuucuuuuucaugucugauuuuauuuacuuggguccugucucuucuugguuagucuugaaagugguuuauucacuuguuuaucuuuucaaaacaccaacuuuuugucuuauugcuucuuugcauauuuuuuuuagucucuuuugcuuuuacgucucaucuggucuucauuauuucuuuccuucuacuaauuuucgguuugguucauucuugcuuuucugguuccuugaggugcaucauuagacuauuugcuugaaaucuuucuacuguuuugauauaggcauuuauuacuguaaacuucccuccuagcacugcuuuuguuguaguccauagguuuugguauguuucguuuucauuuucauuuguuuuaagaaagugauuuccuaccuaguuucuuucuuggcccacugguuguuaagaaccacguugcuuaauuuccauguauuuguauaguuuccaaaguuccuccuguuauugauuuuuagauuuauuccacuguggucucagaagauacuugauacaauuuagauuuuuuucauguuucuugagacuuguuuuguguccuaaccuauggucuaucuuggaaaauguuccauuugcugaugagaacaauguguauucuguagcuguugguugaaauguuuuguaaauaucuauuagguccaguuggucuagagagcaguuuaaaucugauguuucuuuguuaacuauuuuacuagaucugucuaaugcugagaauccuguguccaaguccucaacuauuacuguauuagagucuaucuuucccuuuaaaucuaauacuugguuuauauaucuggguacucugguguugggugcauauauauuuagaguuguuauaucuucuuacugaauugaucucauauaauggucugcuuuguaacuuuuuacuauuuuugacuuaaagucugcauaucugauauaaguauagcuagcuauuccagcuuacuuuugguuuccauuugcuuggaauaucuuuuucugucucuuuacuuucagucuaugugucuuuacaggugagaugaauguuuuguaggcagcauauuguugugucauguuuguuuguuuauuuaguccauucagaaagucuauauguuuuaaauguagaguuuaauccauuuacauuaaagauuauuauugauaugugaggcuuacuccugucauuuuauuaauugauuucugauuguuuuauauaugcuuuguacuuuucuuuuucuuuuauuguuuaucauugugguuugaugguuuuguguagugguaacauuagaguucuuccucuuccuuauuuguguguuugcucugccaguggguuuuuaauuaauuuuuuauaaaaaaauugagacagagucuugcucuauugccuaggcuagagugcagcauugcgaucucggcucacugcaaccuccaccucccagguucaagcaauucuugugccucaaccacccaagaguggguuuuauacuuucauguguuuuuaugaugguagcuaucauccuuucguuuccaaguguaggacucucuuaagcauuucuuguaggaccagucuagggaugauaaagucccaaagcuuuugcuuguuaucacgugccuuuuuccuuuauuuaugaaggauaauuuugcuggaaauaguguuuuugucugaaaguguuuuucguuccgcacuuugaauguguuaucccauuuucuccuggccuauaaaguuucuguggagaaauacacuguuagucugaugcagauuccucauaugggacuugaugcuuucuuucuugcuguuuuuacaauucucugucuuugacuuuugauaguuugauuaugaugugccaaaucggagaagaccuuuuugcauuguaucuguuuggggaucccugagcuuccuauacuuaggugucuugaucacuugcuagacuugagaaguuuucagcuguuauauccuuaaguagguuuucuagguuuguuguuuucucuuuaucuucugggacauuacaaauuaaaguauuuggucacuucaugguauucaauaugucauguagucuuuguucuuuuuuuaaaugcuuuuuucuuuauuuuugucagacuggguuauuuaaaaauaccugucuucaaguaaugaaauucuuccuucuccuugaucuauucuauuaucgaaacuuugaaauguauuuuguauuucauuuaaugaauucuucaguuuguuugguucuuuuuuauuuguauuuguuuaguaaauuccucauucagaucuggaauuguuuuucuaauugcuucauauuuucuguauuaucuuuaucucaaugagcuucuuuaauauuauuuugaauuauuuuucugggauuucauauauaucuuuuugauuguaauauuuuauuggagaauuauuguauuucuuuggagugccauauuuccugcuuuuuuauguuucuugugucccuauguugauaucuaugcgucuguuguaacagauguuuuuuccaauuuuuugaauuugcuuuugugggagaggacuuuuuccuggacauguaucuuuguguuggcugguuggggcccuuugguuuugauucugggaaugugcaguauuauaguugcuguaggauuuguuuggcugugaauagcaucagugguaucugugauuucaucaguggcuuagggugugguuguuaguggauguuguggugaaauuuugcuagggaccggguugccaggugggcuuguccuuaguccuuagugguggcagcagcaagugggccuguccgugggcaccaggguggcauuggcacugcuguuagcagguccacacagaccaauucuugggccuccacguggcuuguucagguguggauaguggcagcaaugcgccaggcagguggacagguucucggguccugggaaaugggcauggcguggguaauggcaauaguauuggcagaacaaaccucugccucccaagugguuuguguaggcguugacaauaucagcaaugggcugggugggccagcccucagaccugcagguggcaugugugggugccagcuguggugguaguagcaggcuggguggcccugaccucuggccccugagaggaguguucaggugccagcaaugguggacugggcuguagaugguccccaggcuccuggacagugugcuuggguacuggaguuuggguaugggcagaccuagccucagcuacugguguuugggguuggggagaccuagccucagguccccuggugguacauucacccaguggcugugguaggcauugguggggugaucuccaggcccaaggcaaaauguuuggguggggauggcauccauugcagcccugcuacuggggaggacgggguugcuuucaguggcugcagcuguaugcagcgggcuggggauugcacacuuugcuuguacuucagccuggcagugccagcccacaauggcugcuguggguggggguuugacauuggggcaugugaaaaugcacccuggauuugcugcugggaucagcaggguguuugccaguaguuugugcuucagccuuggugguagcagccaacugcagcaguggcugugggcagggaauaucaguggggcuccagaaauguggagaugcaggggcuguugggcucacuggcaggauacagucuggugagggcuggacucuuaauauggugccuuccuggagcugcuuagggcucaaaggcugugcgggacccagcaugauccuccucucuggagcgguaccuucauguauucuccagguagcucccauuagucuugagacuugugaggguuuaggggcuuuccucuagcuaggaugcaggagucugcagugggaauguugggcaguaggggucacugacuuacccuuuuccugcacuggggagccucuccauguccccagccaauuuugacuaaccaggcugccuugcuuuccugucaguccuugcuuuaggaugguguuuccauucacuucucuguugauuuccaguguucucucuuagaugauauauuuuacgugugauuaucuacucacuauuuugguucuucuuugugaaggaggugaguaccaguuguuucuagucagcuaucuugaagcccaccuacacguuuuuguguggacguacauuuucauuucuuugggguauauagaaguggaauugcugagucuaauggaaacuacauuuaucuuuuaaagaacugccacuguuuuucuaaaguugcugcaccauuuugcauucccacuagcaguauuugaggguucuaauuccucuacagccuuggugacaauuguuauuaccugucuuuuaaaaaacgguaauaccucaucauaguuuuaauuugcauuucccuggugaucuaaugaggucgaguaucuuuucacaugcuuguuguccauuuguauaucuuuggagaaauccuuugaccauguuuuaauuggguugccauuuuacuguugaguuagaaagguuauguauuguagguauaagucccuuuucagauauauuauuugcaaauaugugauuugcaaauauucucacauucucuuaguuauauuuucacuuuauuaacagugucuuugaagcacaaaauuaguacuuuuuauuguuucaauuuauuuuuuucuuggguaguauaugcuuuuugugucauaucuaagauaccauugccuaauccaaggucaacaaaauucacuccuauauuuucuucuaaggguuuuauuguuuuagcuuuuauauuuaguacuaugauucauuuugagcuaauuuuuguacauugugugaaguagggguccaucuuuauucuuuuacaguagauaccuaguugucccagcaccauuucuugcaaagacaauucuuuccaccauugaauagucuugacaccuuuguugaaaauuaacuagauauuuucuggacucuuaacucuauuuuauuuaucuguaugucuaucuuuaugacauagagauaucuuuaugccaggaccacacuuucuuaauuacuguugcuugauaguaguuuugauacauuuuuacugaauauauucugauaaacacuuaauuucuuauccacaguauauaugcuauacaggcauacuuguuauauugugcuuuguagauaguguguguguguguguguguguguguuuguguguguuuuaacuaguugaagguuuguggcaaugaugcauugaguaagucuuucgguacaauauucccaacagugugugcuuaccuguuguuucugugccacaguuugguaauucuuguaauauuucaaacauguucaugauuauuauaucuguuacuaugaucuaugauuggugaucuuugauguuacuauuguaauuauuuuggggcaccacaaacugcgcccguauaaauggcaaacuuaauugguaaauguuguguguguucugacugcugcauucacuggccauuccucuaucucucuucuuugggccuugcuauucccuaagauacaauaauguugaaaugaggccaaauaauaauccuaugguggccucuaaguauuuaagugaaaagaagaguugcaugucucucacuuuaaaucaaaaacuacaaaugaugaaaccuaaugagaaaggcauguuaaaagcugagacaggccgaaaacuagaccucuugugccaaauugccaaguuaugaaugcaaaggaaaaguuuuugaaggaaauuuaaaaugcuacuucacagaacguacaaaugauaagaaagugaagcagcuuuauuguugauauggagaaauuuuugguggucuggauagaagaucacacaagccacaacauuccauuaaaccaagccuaauccagagcaaggccccaacucuucaauuuuaugaaggcuguaagaggugaggaagcuggagaagaaaaguuggaagcuagcauaaguuuguucuuaaggcuuaaggaaagaaggcauuuccauaacauaaaaaaugcaaggugaagcagcaagugcugauguagaaguugcaacaaauuauccaaaagaucuaagaugauuaaucaagguggccacacaaaacaacagauguucaguguacacaaaacagccuucuauuggaagaagaugccauguaggacuucuguggcuacagaggagaagucgauaccuggcuucaaagcuucaagguacaggacagacugacucucuuguuacgguuaaaugcagcuggugacuguaaguugaagccagugcucauuugccauuccaaaaauccuaggcucuuaagaauuaugcuaaaucuacucugccuuugcccuagaaauggaaaaacaaagccuaagugacagccacaucuguuuacagcauggcuugcugaauauuuuaagcccacuauugagaacuacugcucaggaaaaaaaguuccuuucguaauauuacugcucauugacaaugcaucaagucacucaagagcucugaugaagauauacaaggagguuaauguuguuuucaugccugcuacaccccuuaugcaugccauggaucaaggaguaguaauuucaacuuuuaagucuuaccauuuaagaaauacauuucaugggcuauagcugcuguagacagugauuccucugauggaucuggagaaaguacauugaaaaccuucuggaaaagauuuaccauuuuagaugccauuaagaacauuugcgauuuaugggaggggaccaaaauaacaauaugaacgggaguuuggaagaaguugauucuaaacuucaugguuaacuuugaaggguucaagacuucaguggaggugguaacuaaagaugugcuagaaauaacaagagaaauaagaaguggaagaugugaccgaauugcuacaaucucaugaucaguguugaaugaaugggaauuugcuucuuauggaugagcccaaaaagugguguuuugagauggaguuuacccuuaaugaagauacuguggacguuauugaaaugacaacaaaggauuuagaagaguauauggacuuaguugguaaagcaguggcaguguuugagaggauugacuccacauuuuuuaacgaaguccuacuguggguaaagugcuaucaaauugcaucgcaugcuacagagaaaucguucaugaaaggaagagucaaccuaugcagcagacuuuauugguuuuuuugcuuguuuguuuguuuugggauggagucucucucugucgccaggcuggcgugcaguggcgugaucucggcucacugcaaccucugucucucggguuuaagcgauucuccugccucagccucccaaguagcugggacuacaggugugcaccaacacgccagcuaauuuuuguauuuuuaguagagaugggauuucaccauguuggccaggaugguaucgaucgcuugaccucaauauccaccugccucggccuuccaaaaugcugggauuacaggugugagccaccgguuuauuguuuuaauuuugacagccaccccagccuucagcagccaccacccuggccaaucagaagcugucaacuuggagguaagacccccuaccagcaaaaauauuacaucucccugaagguucaaaugaucauuagcauuuuuuaucaauaaauaauuuuuaauuuaagguagguauguacauuguguuuuagacauaaugcuguuguacacuucauagaguauagcauaaacauaacauuuauaugcagugagaaaccgaaaaauuuuugcuaccggcuuuauugcaauacucgcuucauuguuuagaaccaaaccugcaauaucuucgagguauuucuguaaguuauuuaugguuuuuguguaucagguuugauucugacucucuucccuucuaucaacauguuaauucucaaauugcaaggguuuuuuucuguaguauugaacguuacauuuuauuaagguagagagauuugguuaugaggugauauuucuaaaaccgaguggaaaccacauuuguugaauaaugcucccuccaaaaguuucaucucuuucugcauauguguaguaaccucucagagcacuguaccagacacugcugguaucuauagcaauuacaccucuguaaaacaaucaaaaaagaauuguuaagaaagagaaagcaagagagaggauauauucuauuuguuauccuaaccuuuagucacuuuacuuucucuugaauacgaguacuuuuuagaauuacaaugaauuuuuaaaucucuuuagcugggauuucauagugaaccucaagcguuacccuuuugggguuuaaaaaagaaauuaaaaaggguuuccagaauauacucuuccucacauugauuuaagauucuuugaggcuugauuauuuaaaagucuaaugcauucgguguuuaauuuuaaaucgaaugaauuaaauuagcacuuaaauacuauuuaauauuuuaauuaaguuaaaauauagaugaugcuuacuuuauaaaauaaguuugcuguuuugugauaaaauuaagauuacaagaaauuauacaucugcacauguuuuugucauaauucgaauccauggaucucucuuuacaguguuaagugacgaauuugucagguugcauaagaaagaagugggagaaagaaucacaguaaauuuaauccuuccauugcagucuuacuuuuucccuacucuugcacccuaaagauccuagaggcauuuugggaaacuacugauacggauaucauuucauuacguaaacuauuuuauugcauagcuugaauauagaccuacuagacaucaaacaagcaaaauaaguguugucucuuugggauuuagcuugagguuucagggaagcagcauaucacuuuucaguaauuuuuuaccauuauucauuuuuacuuggaauaaauaaaucauuuaucucaucuuccuguugauagugaaagauaacaggauaaucauagcagugauaaucugaugucauuuuagaccuagcaagaguagauuaucugugacccagauaaaauaauuagaaauuacuuuaacuuaaaaauaguggauucuaaucucauuuucaagguuaaaagauuucaacacaaccagauguuucuguuaaauagacuaaucugaagcccaauucaaaaggauuaccugugauuauuuuucgauuuaauuuuaaacaggauuuaaauauacguuuuugugcguuuuuacuacaauuuauauuggaauaaaaauguuuucaaaucagucuacuucgaggcauuuuuuauuaagggaaacagguuagucaaauuauuuuuuagacuucagacuguuuagccuguuuuuugguuuuuuuuugcuguuucugaaucaaauggauagugauguuauuuaauguaauugauguugucugaauuauugagcaguaguucacacauagccaacaauaauguccauucugaugagcaccaauacuaauagugcugggugauuguauuugucauguucucagucacugggcuuggagagaguuaaucaagaagugcuguaacagcugguacagcgcauucuggugagguucugacagugagcuauuguguaccaugacacugcucugacaguuuaucuaauuuuuauauacaagcauuuuuguuuucugggcucuguggaguuuauauaauaguguaagcuuuugaugaugucucuggagauuuucucaguuguggugagguuggggguagggugagacagauguauuuaguugcaauuuuguaaaagacuaaauucucaaacaaaaaaauagugauuuuugcauuugguuucacaggugcuauuguuggauucuauuugaauugcugaagauagcuuaaaucaaagcuuuucaaauuaagaagaaaauguuuuccccccuaaauacuggcucauauuuaacucagcaaguuaauguuuacuuaaauaaauacaggagaaaucauaaaugcaggggugacaguuuuaacuuggcuaccuuacucacugaaaaguaucuuguguuccaagugugaaaucaguuuaaaggagacugucuaguaaacagcauuuuacgaaucagucgauuuacuugccuuuuaaucuauacacagaaguguaguccucaaaugauuaauuccuauaguuaaauuuugccuaguauucugccaaauuauuuugaauuaauagcauucaguacacucuuuauaacaauuauguuugauguacucagcuccaggucagcauugcagacaugaacaucauugcuaauuaugcugaccccagcucacauauacuucuauaaagggagcucuguaaggcauuuuugucuuccucugaauuuuugcuugauaaaaauaaaauaaauguauuucuaauguaguauucccaauuguaauauuauaugaaagauuuuauagcuuuuuuaaaaccuagaaaguuaauuaaaauuuaaagugucccuucuuuuuaaauaugcuuuuaaugucauauaguaaaauuggguauaauauuuuuuagaauuuuguauaugauaaguuuauaaaaaacuagguucccccuugccaagggcauuugcuuaaauaccaaguuauauuucauauuuacaugaaauacucuuuuaaaaaaauuaucaaaauuauuuugauaauuaugguguguggaauugggcuacucuuuagcauaugcauguuccuauguaaaagcauauuuauauugcauaauuucuguuugcucaguguaauaaacugcuuguaaguauuuuugauaaaacuaauuaaaaagaaaucuuuuucuauaauuuauuuauauguccuuaaaucacuacugauugcuugagugauuaaauagaugcuuaaaaaguguucguaaggaaacuaaacauuuauggguuuuccuuuuacuaacaauuuuuccuagauauucauuuuauuauuucaugaucugaauccacacaaauauuuaaucugacauuaaaacauaggacugcagaaagcaguaaaucuuauauuuaugguuugcuuaugguauuuuggcacaauaauuuauguacauuuuauugauauauuauuauucccugaaucucagccaaaggggcauguuaaaugcccaucuuauuucuacuaauaaccaaaaaucuuaucaaaguauaauuuugguguuaaaaguguaagaguaguuaaauuugaguuuugauuauaaacaguuuuucagcuguuccaaauauucugauuagugcgagacuuauuucuacaaaacauuauuguauauaaucauccuugcuggcuuccucucuauguuacuauauaauuauuuccuguauacuugacuacuuuuacuagauuguaaguuccaugaugcuaaggacugugucauaauagauacuugguaaauuuuugauagauggauaaaugaaugaaugaaucaugguuuacauauuuaggacuuguuuuuucaacuggauuauaagcucuuagagggcauaggauuuuauauguguagucucuuguagucccuauuauuuuauuuuucauuauaaaaccacuuguuuguuuguuuaaacauaauguugaaaaguuacauuuugagguaauugagguauuucuuuccaagcccucucaaaaaguagguaguaggcaguaucacuaaaaucuuaagacugccauuuauugaggaguuauaagggguuuugacauaauuaacucauuuaauccccacaaaaaccuaugagguaagcguuauuauuuggaaauggagguauagaguuuuagcaauuuucuuuagauuauacagucagaaaguggcauuuaagauuaagagaagugugaggauuauuuuggaaagagauuuucagugucuauaaauauaagaucuguugccuucucacuuuuguucuaugauugauucgauguuuaugugaacuucagaucccugauaaaagacauagcuggucuuuuguuggaaaugggugcuuaaagaaccauucauuucaaaugaggaaaguagaaggaagacagagcuaagauuaacaggacauuucccucuuuugauugaaaacaaaacuaaaaauaaggaaucaugcuauuucuguucauguccaauuaguuuagugcugcaaauuuauauuaaguugaccauuuuguacaguaugugcugcuaagugcuauggaaaaauuuaaaguuaaaugagcuacuguucauauacuaaucagaggugcuaagaagugaaaugaaagucuuucuuagaauuaauauaaauuaguaauagauaaagcaggcaaaguuuuucucuaauugugaaaaacuugccugaguaguguuuuuaauuuuuaaauuuuugauugauauauaauaauuguacauaguuaugggguacaaugugaugcuucaauauuuguauacauaauguaaugaucaaaucaguaauuaacuuauccaucaccucaaacguuuuucauuuauuuguggugagaacauccgaaauccucucuucaggcuauucugagauguacaguacuuuguugacuguaaucacacugcugugcaauagaacaccacaauuuauuacuccuuucuaauuguaacuuuguacccaucgaccauccucuuccccauccuucacuucuuucuacccuccccagucucugcuaacuacuguucuauucauacuucugugagaucaccuuuuuuaagauucugcauaugagugagaacagucaguauuugucuuucuuuaacuggcuuauuucauuuaugcaugugaucacaaaugaucguacuucauucuuuuuuuggccgauuaguauuccauuguguauauauaccauauuuacuuuauucaucugcuguuagacacagguugauuccauaucuuggcuauuaugaagagugcugcaauaaacaugggacucugacauacugauuuuauuccuuugaauauacaguugucccucacucuccaugggggauugauuucuggaccccacagggauaucggaauccauugaggcuccuguuccuuauguaaaaugguguaguauuugaauauaacuuauggacaucuucccuuguacuauaauucaucuucuagauuauuuauaauacccgauacaacguaaauacuauguaaauaguuguuaaacuauauuauuuuaauucauauuauuauuuauuuuuuuaaauaguuuuucuuaaaguauuuucgauccaugguugauugaaucacagcuacagaacccacaaauauggagggcugacaguguacccagugcugugauugcuggaucauauaguaguuuuguuuuuaacuuuuugaggugccuccauacuguuuuuuauaaugacugcauggauuuacacuuuccccaacaagaguaaagguucuuccccagacuguguaaggguucccuuuucuccacauccuugccaacauuuaccuuuuguauuuuugauaauacccugggauaauucugauugggaugacaugauuucccauugugguuuuugauuuacguuucucugauggcuagugguguugaacauuucuucauauaccuguuggucauuucuauaaucuuuucucuguuuuagaaucagauuuuuuuuguuuucucucucuuuuuuuuuuuuuuucuguugaguuguuuguguuccuuauguauucuggguauuaaccccuugucagauguauaguugcagagauuuucuuccauucuuuagguuguuucuucaauguauuuuuuuuuuuaagagacaggauuucauucuaucaccuaagcuggagugcaguggcaugaucauaacucacugcagccuugaacuucugggcucaagcaaaccucccaccuaagucccccaaguagcgaggacuacaggcacaugccaccaugccaugccugcuaauuuuuuaaagguuuuguuuuguuuuuguagagacaggcucucacuauauuggcugcacuggucuugaacuccuggccucaagcaauccaccugccuuggccucccaaaguccuguaauuacuggcgugagccaccgcacccagccauucacuauguuguuuccuuugcuaugcagagcuuuuuuguuugauguaaucucauuugucuguuuuuuuuuuuguuguugccuuuuuuuuuuaugucuuaccuaaaaaauccuuauccaggcaauguccuaaagcauuuccucuauguuuucuuccaguaguuucauaggaucaggucuuaacauugaaguuuuugauccauuuugaguagauuguguguauagaacaguguuuuaaacucuagauuaaaucaccauagagucauuagguaacuacguguagcagacuuggaagcaucaacaagaccuauaauaauaaagaaugcaggggauaauugagguuagauugaacugucuucaaggagucuaaugaaaagaauuuucuuacuuuccucaggucugcaguuuggcaggucuagaaacuccauuuugaaauuguuugcaggguuaaacagguccagaggcaauggcucuuacuuccagacucaaaagagauagucauauaacagauuguuuauuccuuuaugugcgauugucaggugugccaaaggacucuucagcacauucuuucuccuguaugacaacauauguggcaaaguguugcuuggugagaaugaacucaaaacaggaugaguuaguuggauggauuguaucaucaagcgcucuaugccaagaggacuggguucucaggucuguuaaccaggaaaccucuggugauaaauucuugcucuuuaucccaccccccugcaaccucucauuuuccuaacaucaagccaagagauaucucuuucuccuuuucucuuaggaacuuccccgcccccccauuccagguauaauuuuacuacuuaggauacagugguaauagucaacauaauuuuuuagacuagaccugaaaaauaauuucuuauguaagaucacccaucagaagauaaaauauuagauaaaauagguagggccuauauuucuguaugucuugcuguuucuaguucauuauuuuuaagaacauccaguuuuuaaaauaguaaaucauccucauauaucucuuggucauguagacugaggaaagucuuagauauuuugaucauuagacuguaaucgagguguaaauauuuauaaauaaaaguguucugguagacgacacauaguaaaaacuuguuuguuaucauuccuggacaagugaauuucucuggauagcugaguuuuacauauaacugaggacuuauauuuuguauuuaaacuccuugaggauaauaguuaucuuauugguccuuucaugaugagcacuaacuguguugagucuuuaguauugaaugaaguuaucugcaccaaaauauuuuuuagugguuuuuuuuaauuccaaaaguauauuuaacuuaauuugacacuugaggauaacuugugguuuuucauauucuucauaguaguaaccccuguccucuucuaguuugcuguuucuguccugcuagugaaugugauaaccuaauuuguauugcucuggguguguuauauguaagcaccagugcaaaaacuugaugacauguuugguugcuaaaauacaaauuguacuuauaacaguauucuggauaacagaguuacagacagaugagcauuugccauuucuagaggaaaaaaaauagccuauuugggccagccucacaaauccuacucauaaaguaaugguaagcaucacauuguuugaaagaauaaccaugcuuaugaugauuuaauagauaguauuuuaguuauuucccaaaacagauucaagaaagguaucaaaaacacuugaaaauaaaagcuuuuucuguaugaaaucuaaaucugaaaucuuuaaaguugauuuuuuuaaugccacaaauaaauccuucaggauuauaaacaaguuguaauuucuccauaguaaaaauugcccuuaaucuuagcuggugagaguagucugaccuuucauuugccuuauauaccauggaauaguuuauaguuuuuaaguguuguccacaucugugaucuuaggccauucauauaccuuuccuaauagcuauucuauuucagcuuucucguugacuucuaucucaucuuuuucuucguacuuuuguguaaguuguuuuaauugcuuuggaacaauguguuacuaucaaaacucuaagaaaccauuaaaaugacuuacuuccuuuacagauguggaaccugaagcccaaauuuccucuaagacccuaaucaguguucucauauguuuguagacuguguuuucauaaaguaagacauuuugaggaaauugcaacggagcagagaaagguuaauuauuaauacaauugucacuggauaccauuaauuacacagcuugauaggaaaacuaaugaauauagaauauguagcuaaucuauaacuuuuuaaaaauuccuggaaaauguguaaaugaaacuauguuguugguuauuaguuaucuuaaaaauagauccauuuucucugauuuucucuuacauaggcuaacuguaguuaugcaacuauucuuaaugagaauuuaauauuaugagcuauuaacaucucuaaagaguuguuuuugagugaaggugcuguuuauuagcaucauuggaaaaguuuugcagccaaauaaguucuugggauuuuaccuguagcugcaagaguuugcaugaauaguacugcuuaaauaaguccaccuauguauaaacaaaguguuaagguaaaguaagggauaaaaagaggaaaacuucuccagcuuuugguguauuugaaugaauguacucuuuugcacuguuucaaaauauauuuaaaauacaaauaaauaucuaaaaauaagauuguguaauuuguguuuugauuauuuggcuauugcuuauaacaauuugccagucuaaugauaagucuucugauaacagaaaccagcauuucuggaagcaaucuucuguuuguugaaauuuuuuuuuuuacauauuuguguuagagccuuacagaaagcauacaauuagggaauuguauuaucaaaaaaguuauuuuuuccgcuaagaaagaacucuggucaguuuaguuuucagaauaauagauguuguaauauggcaaauucauagauugccuuguugaguuuuguuguuguuuacagaaacccagaaccaguagcacccugacucuuaggcaguuuucuguucauuaguuucuuucauaugucauuuuaguauuuauuuuuuaaugcauauucacugacaguuaaauugaaaguagauuguagacuuucaaaggaauugucaagaaagcaaguguaauaaaagguuauauuuuaaugaagugauacugucauaauuuuugugagguuuuaguauuugaauagguuuuuuuuugcauaguauaauguugauuuuguuuuuccaaggggauuccagcaauguaugaaagauaauuuaaaauucauaauacucauauauaaacuguuuaaaucuauagaauauuuuuggaauaagauuaaaaacaugauagaguggauacagaauaaagacuuaauaacuuucuuacaucugaauauaauuuuuuauuuuuaauaggauacaacaucuauugaaaagaugucaaacuguugugaagauauguaaguauaaaacugaaguguauaguauuauuuaaaauuggaaagaacuggacauacuugagaaauaugugcauaugguagauagauaauauaaugauggcuuuuucuuggugcauugucugaggccugugcuaggcaagcuaccccagucuuacaguagggguuuuccagccaugguaguuuucacacuaaaaugcugaucauucuugugccuugucuaacuaaaguaaguuaaauuauuuguccugaaaguacaucaaaagagauuugcuacuguguuguugacacacauucuguuaauccugagauuuuccucugcuucaaaaguugcgcucgguugauugacgacacagauacaauaucugcuauccagaguuaaaacucagcugcaugccauaaugaaagaaaagcuguauuuaugaugcugggacacaauucaucagaguccaguaauggauccccagccaaucuguauuguuuuagcugacugaagugcaccaugggagugcugucuuucacuaauaaugcugucuucuguagaucgaggccccgaaagccauggcagcagaccuucucagaaguuuuuggcacucguuggaagauccugugguucauuccuuucaggcagaggcaaccacugcgaguucccuaccacuuugccaaucaugucuaaacagauggauggugggcacagauggguccuccaugcuggcaaugcguuacagguuuuaugauaauagaacuaugacagucuucaagucaauuaaaauccacccaccagucuuaggcaucauaaugugccccaggcuuuauuuuaauagugaucuugauccuguugugggacuaauacaagaucuauauuuaaguuuuaaagcauguuuacuuucaaauuagcuuuccacagggauuucuugaaaugcuuuuguuauuaaacucaaaaggcagugauuaggaugaaauaauuguacauaauuuauuuuaguacugacaguguuacagauucuaauuuaugguaaauuucagauguuuauuuaaaauuuucacuuuuaaacaguaaccaaaucuaaauuuaauuauucagguuuuacaaaaguugauacaccuucuuauaguauagguaaauuuucuuuuucaaauccaauuuaaaauaaccuuuccuuuuaaaugugcugcaacguuuuuaaaaaugcagcagcauaggagugaacaacagcaacacaaaacgggcauugguuucuuaggaguggcuugcuuacguuuucuucuuuuuucuucaccaaaaccaacaugaaaguaccacugaaguaaaacaccaacuaccuaccuuacuauaaaggaaauguuaaaauuuuuuucacaauaauuuuuucaauuuucacuauuacuguuguaauuauugauugugauuaaaauauuugcucccaggagaacuccugaccagugggcauguauuccuauuuuauccuaagauuuuaaugagcaaaaaggggagagaauuugcaauaacuucacaauuaccuuuucuagugcaguuauauuagaaugcauauguuuuuaaaaugcuaguauaacuagauaguauauaauguacaguauaaagaggaauauugugcuuuugaaaagaguauacuuuuuacuuuuauuuauguacuaguagauguaaaauuucacauugaagguuuauauauauuggccaacucauauagaaauuuuauuuauaggaagcuacuacuaaaaaaagucacuaacuuuguguaccuauaaucccuaaauuaaaauuaaauuuuaauuggcuggcuguaauuugcauugagagaccuuuuacuaguagcuaguguuaggaagugaaccuaaaauaagaaaauauaaugaucuguguuuaucauuagccuuguacaaauguaaauuacuaauagugauguucuuuugcaaggcauagaacauuuguaugaaaagacauuuaguaugcuuugaaaaaaacucagcuuuuaguuuuuuuccauuagaauacugcaaaacccauauaucuuuuuaaaaaauuuauguacucacagucuuucccuugaagagaagauugaaaaagucuacuguucauaaaccaugcuaacauuuuccuuuuagcuaguuuugaaaguaaggaacaauaccugggaaauaauuaaacagaagguuaccauugucagccaguuggcuauacugugguuaguucuuucagaaauuguaaauaucuuguagcauauucugaaauaauagaguaaguucuucucagagauguuaauaucauguuuuucauguucuaauuagaauacuuuauuacuuacaaacucagaaauacgaacagaaauacagcagacgaacauauuuauugguacugaaaagagacguaguaaauuaaauagaagaaauauauuuauaaagcuuagugaaacacaaaauuagaauguucaugucaggcacaaggguuuggauuuugugcaagcuaauuuggccacauuuggccuggugacagaacuguucauaaggaaguaauauauagauaagguagguagauaucaguugaaugccuuauauuguauacauuccuuucaaauaaagaccuugagaaaacagcagagccaagugaagaucaccuaaagaacuuuguggcuaauuuauacuucauguaguagcaguggguacugggcagggucucuuucccacucugaugauuugugcucuuauuuuuccuagauuuaccucaucuagggcauauucuuuucccucuuccucuuuaccuuuccugguccugaucccucuguacucaguuccccuaaauuauuggacuacaaacuaauauacuagaaaagcauacacuuauuuuauuugaaugcagaaaugcuaucuaucaguauauauacauaagaauguauauuacaguauaucuauauauacuuaacacuguaacuuucaguauuccccaguuagcguaccuaacucuccuguggguuuuguuaauucuuauuagacuacuagagaaaaaccaacuggcaguuugcuaagcauaucuacugguguuguuucugcgcccucuuuuggcuaauugauguaauuauacuggcucuaaagauuuacugccccauaaguaaauaguauagccacauucugaacauaucaaaaguacaaacuuaggaggaguguauguacaaaaauguaaaauuuuaugaaaaugaacauguuuuuaugauguuauuucuaguucauaagaaugugaugacugcuuugcuucauuuauguacguucccauuauauucuugcugucaaucaaucacaaauuuauaucagauuaggauaaacuaagccauuuuauguauuuuauuuuaaaccuuauuuuggcagaguaauuccuuagaauuggaaaagcuguuacuuugaaauuaccaauuuauuacaaaacauagaaauguauuguagcuacaaagacaaccaagcauuuucuguguuuuaaugaauaucuaaaaaacuacauuuaguuuauuuuacucaguuuugaaaugauuuuuuuacuggcucuauugccuuaaaauaacuaagagauuaaugauucuuuguauaauuuuccuuuucuuuguucuuuuuuuuacauuucgcagaguuauaucuauaguuuuaguaacaauuucuuauguauucuggauaacugaaaacaacuaaagguguugggcauuagaaaauaauugugagcaguaagauuacugauguaauauguauguuggacugaaguauuucuuuauaaacauucuauuugauuuuaagcaaaauguauguuaaagcauguuuuuacaucaguaaagucauuugucgaccuucuggaaaugaaagguuuuuaccuagauacuguaaguuacaccuccuuaacaaucauauuugucauuguuguuuucugcaaacaaaaauguuuaugggcuucauguaggcuuaagauuguaggcaaaaauggacugaguucaggacccuucaagcaguaggcauucaguuacagagcaguugguacuuuguaacccagacuuacaguuuaaaaauaucaaguuagcugauguuucauuauaauaaaaauacuauuuugcuuaagaguuguauuacaaauauuugugcuuaacauuagaaauagcuguuuuaaauuguaguuaacauauuaacuuuuucagaaaaaaagcaugguuuauuuuuaauaaugaaauagagaacauaauacguaauguucaguauaacagcugaguuaaaacaucugccaggauuaacaucagugcguuuuugccaaugcauagaggcauuuuucucuaaguaugauggcuaaugauaacuauucuuuguuacacauucaagucacucccauacaaguaacuagugggugauauguuucacuccaaaggguguauuaauucugaaugcuaaucaugaagacuuaaguuaggacaacacuucaaaccaggaagugugaacugauuuagauuauagcuacacaauuuucuguguguuagaucaugggguaguuugaguguuuucacauguauugcuauaaaaucacaauguaccaagcucugguuuaauaugccauuaauacuaauuaauagagcugcuagucucucucuggacuuuucucuagucucugcuucucuugcgcuuccuguaucaauagauuacuuagcucaaguuuaccaaguuuaauaaccuauaguuacuuuauugaauaaguuucugacaugaccucuaauauacauagauauaucuagaauuuauuugauaaaauucacacauacaaacauugaguaguuugcuaauagauacaaauauuagauuuucacacaacucuacuacugcuuuaaaaauauaaguauugguaaguguagcaaauaagccauguacauuuaauguguucuacuugcuaguauuaacuguaugauuaaugaauguguuauuuaaugcccaaguuuguuaacuuuuauucuagaaaucauccucugaauuuauuauaaaucacagauuucauugugcucuauauuuagucauucucaguugaauucuagaauauuccacaguacaguauaagaaaguauuagaaccaacuugcuugaacuauuuugaaccaguguuguaauucuauauguuaaucaguauuuagcauuucugcuccuuuugagaugaugaugguuuaacuucaggaaagugacuuuucugacuucuuuuauuaucauugugcaauuuuuagcaacaaaacucacuauaucuuugucaguucuucagauguuacaauacugccugcuaauuugaaacagaaauaacaaugguauuuuaaaaagucauugauauuacugauacuuuccauuaucauuauauuuuuuacuauuauuauguucuuuuugccuuguccacccuagagaauagguacaaaugaguagugaguauccacaaacuuacuaagauggagagaaggcuagauggugcaugaauaaucagcaucucagcaacagaguugacuggagccaguuucugacaucagagaaucucuuugcuguaaucauuuuagccuuaucucuuauuuauaccauuuuuaugggaagaguuguuagugcauauaagcauuuaguuugaauuauuuaacuuaaagaauuuauauugcgguuucucuucaguuggucagaugccuuuuauaaauauuuuaguuuuaaauauaauuguguagaguaugaucaugugaaguguuaaaaauaauguggaaaacucagcuauuuaaugcagaggagaaaugaauagguugaccaaaguuugaaaaaacuggcaccuuuucuggaaaucucuuauugcaaagaaaagauacugaguguauagaaaauuuugucaccagaggaaaaauaaacaauauauaaggguggcuuucacuuuaacauuugggauauuuuggaguucuugauaccucgaaggucuccauuucuauugguauuuugaauaucuguaacauguaaugucguucuuauaacaguucaacacugauuuuuuugguaucgauagcuuuauauauaaacaaagaugcggacaaaauagcuuaacagaaguugugggcuuuuuuguggcuuugccugccuguuugaccaaauacaggguuuaauuguuugcaggcuguuaacuaaagggaaagcuuaccugcguauugcaagcuauauauucuugccaguauacauuggaugauauuuuaaccuacuggugccugaaguucguguuuuauaaccucaacaacuauaaaacauccuggugcuauucacuuuagcauugagugacauuuuuaauuccuguaccaaagaguuaauuuucuuuuugguugacugaguuuucuucucacaucguuguguauuuauaaaguagaauuuaauguuacuaagaacaguuugauuaacagaucuuauuuuuugcaugcugcucuggcaauuuaauggauuuuaaauguuucucauuuggauuuuuuuuuagguaggcauguauggauuuuaauuuuguauuuuaauauagcuuggcuacuuuaaaagguaguuugauaggcugaaauuacaaaagauaauugaagcacuuuucacaaguuguuuuauuucugcaacaaugaauaaaaagguaagaacucuaauuuauauaaaugaacuauauagcuuauugggcacuuuagugaauacugaaacaaaauacuaagaugaagaguuaagguucguucucauuacaaaucgaguucagcguguguguguguguguguguguguguguguguguguguaaucuuuaguggcuuuaaagaauaauauugccauuugucuacuuugcaaauaaagauaacagaacaccuuuaaaauauauguauguguacauauguguguguagauauauagagagagagauacggagagacagacagacagagagagagacagagagagagaugcuuucccaagaggaaaugcauauguaccuugauuuaagcaaaacugauaacagaaaauugaacuuaaugaaagaaaaaagucuggauaugguuacucacuuuacauagaguaagauuuuuaaaacuaauuuugcuuaguaguuaauuuuacaaaaaugaagagaaacacccuuuaaguguacucguaauuuaaaacaccuuugaaauguaauuguccaaauguaaugcugcuauguauauuauuuggguuccagauuuuucccuuuaaaauucucaaaacacucaguguccuuacaacugcagcuaaaaugguuaaucauucuggcaagaaggugacaguguguauauuggaaaggcagacauucacauuugaaaauauuuugcauuauuguuagcuaaaaucaaccucuccuugaauguagauacaauauaugguuuugcagucaauucugaauggaaaaaaagaaucaagucugaaauuuaugugaaauguggcuucagaucauuugaacgauauguagaaaucuagaugaacauaucauuagaggugaaagcaaaauuugaaagccuaaugagaugaagcaacauuaucucucucuaaucugccaacaauauucccuagauuguguugccacuguauugauucugaguaauuuggcuuguuuaugcgugauuuaaaugcauguggcugaaugcaguaauuuuucaaguuauugaguaguagagaauucaccacuauucacugucucccagagaugaacauauaaaagaaaaaaaauucuacuucauauauguaagaauaaagcaacuaaaugauacaaaaguaaaaacuuccaccagaaucagagauauuccgacaagugaauugugagucuaacacgggaggacaaagcuaggcucuugcaaggacagagcacacguggaucaugcuguaugagcucacuuugugucccuggaauuaguguuuuuuugugugugaucuaacuggcaaguuuaaugaauagccaaaaucuauguuauucuugaggcuccuaaaauuaugugugaaccccaaguucugucuaguauuauaucccuaaaaugcuuuuaauagugguauguuacaaguggcauaagaagauccuguuuuuaaauuugucaggcauuuuauuauucaguacauaauauguauagaucugagugcuguuuuccuugcauugucuauuauuuuuaccuugucuuuccccuaagagaauuugaagaaaaucuucaccaauauuucuaguguugaugguaauuaggaaaauaguaguugagagauguaagaauaguuugagaagagugaguaaaaugggugaaaugacaagugggaaccauguagcugagauguauuuguuuagaugaaaagucuacacugguucuuaaugugaaaaucaaaccauguaucuaccuuaagaacaauguuguuguuuuuaauuuauuguagcgauuuaguuuuuuucacguaauauuucuauuuucuuugcagauuguuuuuaauuuaaauuguggaauuuuuacuucucaaaauguauuaaguacuguauuuuuugaaaucuuauuuuuaaauaaauauuuuuuaaaaacguag

SEQ ID NO: 14009 - RNA, 3886 nt, Homo sapiens
guccagugucauaagucuaugaagacauuccagaaaugcuuccagcuagguuaucuccugauaguaccuuuaaauuaugagacaaaacaaguaagggaaaaauauaagaacauuuuucagaaugcuucauauacuaaaauuuaaugcauuaaaauauccagaauauuuucagaaccuguaauuuugguacuugcugaauaaaauuuauaauacaaaguuuuauuaaauagcaaaaaacagucauucaaacauagaaaccuuacuaccuaauucaaaaugcaugugaguaaauaauuuugccugaagauugaauuuuuggggguuacuuucauuagcaucucuggauugaucucuaaaccugguaguagucauguauuuuuccuuccucauaauauagguacuuguuuggcuaccagugauuguuccucuucccuauauaaacuacuaaaauuaacaucacuguuccuucuucaaagucagagaccugacauuaaguacuuuauaugaggaguauuguuaaaaaggaggcaaccaagcaaguuacuccuuacaucuguggaaagacuuaaucaucagauagaagucaaguaaaacacuguuuggguugcaaaaguaacuauaaguaugagaaucuuuccuacaaauauuucacguagccugccucccugccugccugcgugccugccugccugccugccugccugccugccugccuuccuuccuuccuuccuuccuuccuuccuuccuuccuuccuuccuuccuuccuucuuuccuuccuuccuuccuuccuuccucccucucuaucuugcuucuuugcuugcuggugauuugacacacauuaaagaagcccauuuuuauggucucgcuuauuucuuuuccuucuuuagauggagggcuuuuacccaaacuuggagaaaaugcaucacggaauauuaguaguggaaaggauuuuagcaaucaucuaggucggguccgucauuuauagaugaaaaucuuuagauggagaaagguuuuacaacuuaacauucuacggcuaguuaguggcagagcugagacaaggucucaaacguguaccaauaacuagacuaauaucauuuccucuaucguucuaauuuaaaacuacguuucaagucaccuuucccugaaaauguuauguacccacuuaacauuuucagacugaauaaucagcaucuuugcuguugugguuuugcuuuucaaagguaauagugggauagcucuucaagcugaaacuccugggauaaaggaauccugggagccagcauguaggauguguccaucuucaugcuccgucuucaccuugcacuggcacuccuccaccagcaucaccaccuugaucacggaggaaaguucagugcaguucaguggcaagugcaucguggugaacuuggcaggcaaacagugagagcaggagguaugggagugcugcgcggcuccaggaaaaugaacagacccgcauuucccaaagcaaagguuguucugaacaacuacuuuuucacagccuucguggguuauagucuaaaaagcaaacacauuuccauuacguuauuuugaauuauuucuuuaacacacauaaugcagaagcuauggacuguaaaucugaggauaauuuaaaaauuucaaagcuuuccaauuuuggauacaauuugcaauaugcaagugaugguaucuauaagggcacagaaccaccucaauuaaauuuucuuuauugaguaaauuauuaaacagccuuuagggaaucccuaaguuaacauaaaaaauauuuuacucuacauuauucgugcaaaaccuuaagcaauuuugucuaauuggaugugagcgauugaaaaauucuaaugguaauuaucuuacauaaguaaugugccuuacuuuuuuauuccucacagggcuuugugcauaguaggcucccaauacauauuuguuacauugaucguagaauagaucagaacauucuagguuuaauucuauccuauucugcaagaccuguaguacauucaagucuaugaaguuguaugcaagcagaguuacaaugcauaugccugcaaaucauuguauauuacaucaccuuuaccucucauaacuccaagcaccuagcuuuauaugccuuucaaaauauguaagagucaaacaucuuaguuuuaauuuaauuagcaauagaauucaaaagaagaauuucaaaagaaauuugauugccugauucuuagggguaauuuucuaauugcacauggccaacagaguagucauuauuauuugauaauugacuugccauugcuacauauccuugccuuuucaggcagaauacuuaacugccuugaacagucaauugcccuauucuauugcuugcuuaauuggguagcauuacucgacuauaaaauuuuacucuacccugcauguuuuugguucaauaucuucauguuuaaggaccuaaugcaaguucucaauuuuaauuuaacauuuggaauguagauauugccagaggaaguagacaguaggaugucccuuugucuuaauagcauggaauugaucauaauaacuacaaaucagccaacacaacaugaaucaggagaaagguacuucuaaggggaggagauaugaucucacaucaagauugauuuuuuaaaaagcucauaugagaaaauaagugaaagaaaaucacuuuuuugcuaucauaauacuagaaaugauaugacaacuuuugccugagaaccucaacguacuuugagguugugggauagcuuuagcaagcuauuaaagaagucccucauaaaccuauaaaguaauuaaguauggacuauggggauuaagaccaucguaaauggauaugagaguauuugggaaggaguccaaugcaccccacuuuaucaacaaauggaguugaccugcucauccacauauuaauagagugcagaaagauagcuacagaggaguucuggugauuacucuaaauucucaguuuccuaacugaggguacagucugacuuauaucucugaguagaucaccuccaaugcaaaaauaaauaaauaaaacagagcucugugucuucagugugaaugaaugauuacugauauugacaguaucaucauaucauucuugcagcauuuccacaaugccaagaaaaaauggaaaggccagaaggaaacuuaaucuuugccaaauccuaugaugaaugcccaaggaccaaaucuguaguuaagcuagagucaggcuccugacagccuuuuccccuacucuccauccaucccagcuguccacuaccaccugcaaacucuuaccugcucuccccccagaacacauaccuggcugaagggcacuguccugcaggucucccaauguacuucauggcuuuugaugggcaagaugacccccugagaagccggaguuuuucugaacaugaaguggugccagaauuucuuggcuucuucccgaagaggagauuucuccauuuucauuccaucuaucggcuggaugagggacugggucccaggugggaagggcucacuaucugagucccuggauggaugcauuucucucucaggcuucuuccagaaccugccaaaucuggacagcaucuucucucucugccucuggccuuccccugcagggcugguggcuacaagguguggcacugcgacaaacagaucuggcuucuccucagcuuccucaugguugccugugggaagcucucuuugauuccuuggcaggaguacgggggaaagagaacucugauucuggcggccauccuggugccguguggucuuuccuagaggcaggaguaccagcagcugaaauaagaggagaugcaugcugucaggggcccaagcuucuuuuguaaaugaugaggcccaaaggagaggcucauucucugc

SEQ ID NO: 14010 - RNA, 143696 nt, Homo sapiens
cugugcuggccugccggcuccgggggcggggaaaucgaguagcugcacucaggccccgcccgagacccggagggagcgccgggccguccccuuuugcccuccuuugcgcugggcugagcccagagccgagagcaggagucggcucugaguucccugcuugguuuuuggguggcagcagccagaggaggaauauggcgcucuuaggcagccgagcggagcuggaagcggacgagguacgauccgauggggauugcgggcccggccccugaagcccuggacaggaguccgggagagaagagugagcccggcuaggacggccgaggccccgcccccuugguccccucucuggggugggcuggcgggcgccgggugggggcgcccggccuugguaggucuguccccgcuggagcuaggagggucccugcggcgcgcggagcggacgcagugccgagguucggagcgccggccccgcgagucguggggauggaggacccacguccugccagcacuuggaugggcgugagggcgcgggaccauaggacccgcagcucugagcuguuccgggccggcccagcgacgccugggcuuuacgaagucugacccugaaguccuggcacuggcucucuggguguucguggaaucaucccucgaccugggaaucucaccuucuauggaaguuuccugguggcagaaccgaaaggcuuacgauugaugaaaagagggggcagccugaggaacaaugaguagagggguaccugccgcgacagcagggcagggcugccaggggcuggggcuggagggcuagagccgcagcccaggcuguggugcuucccucucccuccacggggccgggacacuuccccuagcagguccucagagucggugguggccggagggaaaccacuuugagaaccgacuccggccuccuuugguuucaacuguguuugaguaauuagccacuccuucagucguggcgcgcccgggccugagcacccaggggcuagcgcgccggaccuguugauuuauugacuauucauuucagcaccuggcaacuccagagacagcgcucucccugcucuugaaguugagaccgaggcuccagcagcagccagcacccacagcugcuguuccugccaucuuaccugacuugaauugugcgagucgcugccuuuagaaggcuuugguuucaaaugaugcaauaguggacgaucuggaggaggcgguuaaguuucccguccaucucuuuagugccaggaaucuccugacaaggaagacuauacuuuaaaugugcuccguaaaauaaacaaaaaacaaaaacugaacuacagcuccucugcaugacagagagacaagagggcaagccgggcuguccagacccuugcuuacagccugucccuugcauugaggaucccaagacuguagaaugaaauauuugaaucccgaucuguuuguaggagauuugcugugcuuagaacuauguaauucucuagauuagggcauuguugaggcggugcuauuauuaauuaacacugggauaauagguguaaacugggacuguuucggagauacuuugacaaauggucaccccagcuaugcucacugccuacuagaugaacgguugagaugcauuagccgaugaggagggaaguuagguuucugugggugaaacucuggguggaaguuagguuucagaguagcagagagccuggcacacagauacuugguaaauaaauauuuguugaaugaaugaaagacugcagaaaagauguugcuuaauaacaacucaguuuuugccauaucauucauuuauuuuucuucauucauuaacuauuaggcuucuguuacaugcuagguacuguacuaguccuaguugaugagcaaaauacaaauugaauucuuuguucaugccaaauuuacuuuugucccucacaguuuaccacuuccauugcuauaaacugagcaagcguuuauugagcauuuacuuugggcucaaacuugguaggugccuuagagaaggcauaguuuugccucuuuaugguucucagucugauuagggagauaugaccuggguacaagaacucuaaaaaggagcucaaguaaauguaagcaaguaagaaguaguguguuguagacuggauacccuugauuuauuuguagaaagucccuuaccguaaaugggcuugaagaacucuaaccucgaguucauaagacccugcucuucaauuuuacugggugcgcaaauagcuuauuucagcuaggaagcuuuucacguauuuaagaagagucugauagucuuuauuugauauugauaguuuuuaauggccauuauuugauauucugggggaguuaaaagggacaaagugauauaguuggaaaaguaccagguuagguuuuuagguaaccugguucuucucuuuguucaucacuuauguguguaaacagcugacuaggugccaagcccuguacuagccuggagguacaacagugaacaagacagacaagguccuucccaugacuguugaccuugauugagcaagucugucaaccucagagggcucuuucaguucccuuaucugaagaaggaggggcuggauuagcccuaaguguucuuccagcucuaaagaucuggguuuuuauugagaugggggagaggggucgggggggagguuggggaagagggaguuucuuuugggagaagggcuaauaauauggaaaucuuuuucuuuaaaaguacccaaggaaugaaugauaaugguagagaagcucccaugguagcugugggauggagguuuucuuggcuaaauugauuuuuuaauuuguguuuuuuaggugcuaguaugauaaauucgggagcauagaaguuaggacuugcauccucauuggaggcaaaaauugguuauuggggagcacaagcaucuuagauauuauaaugguguguggccauuuaaagcucaaucaacaaaagcuuguuucuuaauauuugaauuucucucauuggguuuucuuguguauuacacuagcaacauugauaauggauucauggaagauguacagaauauauucaaggucaauccaacaaauuuauaacguagagauggcugugguuggaagacuuucucucuaguugccugaucuugaagucauuuuaguugguuaccuucacauacuuaugggcuaccauugggugccuuguggcuugcuuauauuuggcccucaaauauaaggauuugagaauugaaugaaaaucauuuauauuuuauuauuuaauucaauuaagauuauucagcucaccaauaauuaucucaagugccaaaaaggaaaacauugacaguauuugaauuaauaucuagcagcuaauuaaguuaaaaauuuucucauaugaggccaggugugguggcucaugccuguaaucccaucacuuugggaggcugaggcggguggaucaccugaggucaggaguucgagaccagccugaccaacauggugacacccagucucuacuaaaaauaacaaaaaaauuagcugggcgugguggcgggcaccuguaaucucagcuacuugggaggcugaggcaggagaaucgcuugaaccugggaggcagagguugcaugagcugagaucgcaccauuguacuccagcgggggcaacaagaguaaaacuccaucucagaaaaaaaaaaaaaauuuuucucauaugaaacaaaaguucacuaaaaaucacuuuucaaccugcguaacgcagugagacccugucucuacaaaaauaaaaauaugaauaguuagcugggcaugguggugcccgccuguaguccuaaguuauucuggaggcugaggugggaggaucacuugagccuaggagguugaggcugcagugaacucugaucaugccacugcacuccagccugggugacagaccccguuucaaaaaaaaaaaaaaaaucacuuuucagaaaaugauuuuuucaauaguuuuacuuuugcuggaaaauaacaguuuugaauguuuuuugaaaaguugauuacauugcuauuauguagguauagaaauugauaauuuguauauauaauuugaugcauuauauuuaacauuauauuaaaagucacucagcaaauacaguuauaaaguuaaauguucauagauuuuuuuuuugaguuggagucucccucuguugcccaggcuggagugcaguggcacaaucucggcucacugcaaccucugccuccuggguucaagcgauucugcugcuucagccucccaaguagcugggacuacaugugcgugccaccacguccagcuaauuuuuguauuuuuaguagagacgggguuucaccauguuggccaggauggucucgaucucuugaccucgugauccggccgccucagccucccaaagugcugggauuacaggcaugagccacugcgcccggccaaauguucauagcuuuuuaaacauuuuuuucuuuuuuuggugggggauggaguuuugcucuugucauccaggcuggagugcaauggcaugaucucggcucacugcaaccuccgccucccggguucaagcgauucuccugccucagccucccgaguagcuuggauuacaggcgcccaacaccaugcccagcuaauuuuuguauuuuuaguagaaacagaguuucagcacguuggccaggccggucucgaacuccugaccucaggugauccaccuaccucggccucucaaagugcugggauuacaggugugagccacugcaccggcuuuuuuuuuuuuuuuuuuuuuuuugagacggaaucucgcuuugucacccagauuggagugcaguggcgugaugcaugugccaccacacccggcuaauuuuuuuguauuuuuaguagagacgagguuucaccauauuggccaggcuggucucgaacuccugaccuugugauccacccaccucgaccucccaaagugcugggauuacaggcgugagccaccgcgcccggccuuuuuuuuaaagacagagucuugcuuggucacccaagcuggagugcaguggcaugaucuuggcucacuguaacgucugccucccgggcucaagugauucuccugccucagccuccggagaagcuggaauugcaggcgcccaccaccacauccagcuaauuuuuguauuuuuuucaguagagaugggguuucaccauguuggccaggcuggucucaaacuccugaccccaagugauccacccgccuuggccucccaaugugcugggauuacaggcgugagccaccgugcccaaccuuacacuuaacuuuuaaaauauuuauugagucauucugauccuguuauugaauuaaaaaaguaagcuuuauacuuaggcuccuuugaggguugauaaugaaaaaaauuaagacacugacuaggaaauaaauggcuuaugugacauguuuuuaccgccugcuuuuuggcccaggaauuuuuagaucuaauucugauuuggcuaauuucucuuuggaaguuuagaugaaguuuugauaaaauucauuaccacaauuuucuuucuuuucuucuucuuuuuuuuuuuuugagauggacucucucucuguugcccaggcuggagugcaguggcacgaucucagcucacggcaaccucugccucccggguucaagugauucuccugccucagucucccgaguagcugggguuacaggcaugcaccaccacgaccauccaauuuuuuguauuuuuaauagagacgggguuucuccauguuggucaggcuggucucaaacuccugacuaaaggugauucgcccaccugggcuuuccaaagugcugggauuauaggcgugagccacugcucccagcugagauuuauucuuucauuccaccaacguucauugaacgccuggcagguccuaacagucuuuaaaugcuggauguacacacuaaaacaagacaguuauuacccuugaggagcacaacgucaagcaaaacacuuaacacaagucacuguacuauuucuaucuuuggguuaggguagguuuuagguaggaaggucauauaauuuaucauucaaagcagggcacucugaguaaaugagcgcuuucaguaauugcacuaagacaacagguacaaacagggaugauuggcuucccuuguuuaggguccggcaaagacuugaaaggagagaugguauuugaacuagguuucaaagggcaagugggauuguguugggcuccccagugggaaggccuugggggaaguugagaugggcgggaauaagagagcacuugguacagugggaaggagagugucaagggcagaaaccaaaaaggcugacuugggucgugagucauuguguccugaaugucacgcuaaggaauuuggguuguaucuccuaaaaaaugggaaccuggaagguuuuuuuuuuuuuuuuuuuuuuuuuuugagacggaguuuuacucuuucacccaggcuggagugaaguagugggaucucggcucacugcaaccucugcccccacagccuggguucaaccgauucuccugccucagcguuccgaguagcugggauuacaggugccugcuaccacgcccagcuaauuuuuguauuuuuaguagagacgggguuucgccauguuggccaggcugcuuucgaacuccugaccucaggugauccaccugccuuggccucccaaagugcugggauuacaggcgugagccacugcaaccagccacauggaagguuuuugaugaggcaauuguuguaagauugcugauuuuaggaagauaaaucuggugaaguggaugaagccaggauguggagguggcagaaggaggacaaaaggcuguugcaacaguuaguguggaagaugaugaguaaugaaguagaguagaggcuguggcauuggacagaagaggccagaguuaaaggauuucucagaacgugaaagaggacuugacuugguggccugucccccaguuugagggucaguggugcagugagggaggagccauugaguaauaauucuggguuccuuguguggcuggguaggggugcuguccccuaaggagaaggaguagaguuuauuccuguuuccuuucagcuggguaggagauggggaaggacagcaagcagaugaaacuaaccccuaugccucacugaauuuucugauugcggagcaugggccauuuguucaugaggguaugcauuugggcagaauuaagaaaggguguuuguaaauugguaaugcaaguuaguggagggaagcagcaucacuuuaccgucagucccaacuccagcucagguuaacaaacagacauucuccugaaauguuuccugaaauguucaaucuugagucucuugaaacccuguuuuuugacagcuguuuuucuagugaaacuuuuccucccccuguaccuggauacccacuuccuucccuucaagucuggguaacacauaugcuucugcagacaaguaucaguucuuccugugcuagcugcuugccuucuuaucucaguuuccugcccaugggugcuguuaccagucauuuagugugaaucugauacugugaguucagugaagcucagaguuuccaucuagccaucuguugacagccgaccaaucuccagucuuggaugccccaguagcaucucaggcggagucuccugaaguuacuuuguauucacuucccaaagaugaguaccuggggacuccugugggugcuuuugaggcuuccugggggagagauuuuccuuuuuugagccucccauuggccaccaccuuagucagcacucuccuuuucucccccugugcuucguggaucugugcugccuccugaugcaccaaguccguuuauacccagagccaccgcggccaguugcuguauuggugaugucaucacaccucucuaaagggacuucugaaguggggagugccuggcaguuccuaaugccaucaugcaucuucagcucuuuauuuaaagacuagguguguaguaaaugcuuuuuguugugaucuguggauguguccccuugguacugcugauauuaugcugucauauacauagggccuacguauuuuaaaauauuuuggugaaaugauacauuguauguuuguuggaucugaagguaacuagugagugacaauuuucagucugacuuaauguguugaguauuguguuaggugcuggacaagcaaaugcagcuccugccucagguuauggucuaguggagaguggggacauguguguucugagaaccaccugguggaggagggaugccaggguacuuugugagcacagaggagggcaccucuccugggagagaggguagucaggaaugauuuccuggaggaggccauuucuuagacauucugagucaagaagaaugaguagggguuagccauggagaagugauguggggaagggggagcucuugaagugucuuccaggagagggaauagcgggauaaggugcagaggugaggaagauccuguggugcucuggacagguggagugucaggaaucaaggcuggaaggguacuuuguuaguucuccagagaaaugggacauaauauauagauagaugagaggggauuuauuaugggaguugucucacaugauuauugauaugguuuggcuguguucccacccacaucucaucuugagucauagcucacauaauccccacgugucaugggugggacccaguaggagguaauugaaucauggggguggguuuucccaugcucuucuugugacagugaauaagucucaugggaucugauguuuucauaaagggcaguuuccccgcacacacucucuugccugcugccauguaagaugugccuuugcuccuccuucaucuuucaccaugauuuugaggcuuucccagccguguggaaaugugaguccauuaaaccucuuuuucuuuauaaauuaugcagucuuggguauuucuucacagcaguaugaaaauggacuaauacaauuauggagcgugagaagcccuaccauaugcugucugcaagcuggagagcugcagaggcugguagcguggcucaguccaagcacagaggccucaaaaccauggaagcugaugguauaacucagucugaggaugaaggcuucagaaccugggggacuacaggugcaaguucuggagaccgaaugcuggagaaccuugaguucugauguccaagagaaggagaaaaaggacuucccagcuccagaagagggaaaaagcaaauuuggcuuuccucugucuucuuguucuaucuggguccucugcugaguggaugguacccaaaacuuugggugaggguaggucuuccuuacccuguucauggauucaaaugccagucucuucuggaaacacucucccagacauacccauaaauaaaaucuuuaccuguucucucuaucuggguaucccuuaauccagucaacuugacaccuaaaauuaaccaucacagguaagaagggccguucagagacuuucaugucagauuguggagaucauggugugcaucugcggguuucagugaggagugguggggagcaagcaguauuuuagguggcucccuggcaaggcguggaggcugauuggagguagacaagcccagagugacggaggcugguguuuuguuuuguuuguugaaugauuauugggacucacugacgacccaaggguaccuaauaauuaaggcaacaugauggguaagauaugguguggaucccucugaaaaaggcaguuagaaauauggacacagacagcuguaaccuggagugcaggguagagucuagagaggguucaaguguccugugcuccaaggagaagagggcugucacagggugguccaccuggacauucucucuccugccugcugcccaccccaccugcugacuuguuuccagaccaagucuuuacugacuagcugugugacuuagagcaagucccuuaauguuuuugagccuuguuuuccucauaggcgacacgaaggaguugaaacugaugaucugucuguaaaaguuccuuugaguuuuugacaugugucuucuagaaggugacauucgaccugggcuucaugagguggaauuucagcaggcagcaagggaggagaucaccccucauuccuucaggcagagggaacagcaggggaacugcgcuccucaggcguggugaaguaggcuggaggccaugugguuggagcacaguauaugcccccuuuaagugauuaaugcaggagagcugcugugaguguguuccagccagauugaucagaaucuggccuugaaugcuuagcuaccgaguuuggcuuuucuuuuuucuuuucuuuucuuuuuucuuaaagagacagggucuugcucugucacacaggcuagauuagaguggugugaucauggcuuacugcagacuugacccccugggcucaagggauccucuuggcucgcaugaucccccagccuuggccucucaaagugcugagacuacaggcauaagccaccaugccuggcccugccuuuuaaaaaaauuugcuuuuggccaggcgcaguggcucaugucuguaaucccagcacuuugggaggccgaggcagggggguaucaccugagaucaggaauuugagaccagccuggccaccauggugaaacccagucucuauuaaaaauacaaaaauuugcugggcaugguggcauaugccuguaaucccagcuacucgggaggcugaggcaggagaauugcuugaaccugggaggcggagauugcagugagccgagauugagcuauugagcuccagccuaggcaaaaagagugaaauuccuucucaaaaaaaaaauugcuuuuuuugacaguggagacacacaugcacccuucuguauuuggggaauauuuuugcuuuucuucuucuuuugggguaaaggaagcaacaauaaugauuuccauuuguuugguuucacuuucccuuucccaaccccauuucuaagguacaguuuuaaacggaugccuguaaacugaaaugcagugggugguuaaggagacagacaaggucagaggcacuuggguaauuucacagguuuauauuucaucacauagacuuuuaccuucggacuaaguucugagauagaaaaccaacuugagccacggugcucgugugggcagcaggaccagucacagcuucuuugaggaaaugcuugguccuccuuuuuucccucccuguuuucucagaccacuuuguccuggcauucuggacaaccaugagucacaguccuuacacucagaaccaaaggaaacaaaccucagagucucacauuguuuuucagaccaaauggaguauuaucuuuuugagaggagguagacaagacagaugaggacagagagggagaguccucaagagggggaagugaggccugacuccaaaauccucccccaaaaguacucauaugucacccccugugcagaaucaucaaucaagggcucauugacccauaccagguccuccaugugcagagcagcacugaguuucugagagaguggccagcugggcuuagauucuggcuucccauuuccucucugacuuugaacaugugauuucacuucugacauucuucauuuaugaaggaugaagucagauuauauuuuauaaagcaccugacacauagaagguacuacuaaaaugcaaauuuacuuucucuuuaugcuuuuaaagucuugcugcuacugguucauuaucuauggauuuaaugaagaaucugcagcuaacauuucaguauguugaaauauauuuuuaccuuauuuuugcagucaauugaaaagagaauucuacagaagaagcagaagggaagugauuggcccgaggucacucagcuggcuuaggcacagaaucaggguuagaagcuagauucccuaacucuaaacccuuugcccuuuacacuaggucaagcagccacaaacuucucaaacuugacuaagagguuaaaugcagccugcccaccuccugccuauuuuuguaaauaaaguuuaauuggagcacagccauacccauuuguuuagguguugccuauggcuacuuuugcccuacugugguacaguugggaaacagauguguggcucacacagccuaaauauuuauaugccuuuuauggaggaaguuugcugacccugguacuagguggucagcaaacuucugaccuucugggguguuuaaguuuguuuguaauguauuguaagccuuaugaauuaaaugugcuuguuuccuucaugugcauguaagcaucaaaaaauaggaaaaauagaaaauuacuugacacaucccauuaauugguuugguuguaaguucuggagucaguuggacgugggcuugaaucccugcuccuccauguauaaccugggauaaguuaacucaaucuaucuauuccauauucaccagagaaauggcgauaauagaaccuguugugaggguucagggaggccuaugcagcgcuuaucguggggggcccagaaguuggcuuguggcauugucaaggcugcacucuguggcugcucacaggcauuguguaaagauuggcccagccagagucuugcagaaaaaccuuccucugugauggaguccuguaggauaaauaagucaccucucaggcuaauacccaggacuccagcugggaaauucuucaaguuuacauccucccaccuuuccuuuccuuuccugagugggaggggaaaccacuucacacaaaagagagcaguaaacaggggcucaaagggccaucuguuccagcucuaucuaaaacugaaaaguguuaauauuugucagcaagggaggugauaaugccagcaauauuuuggaaacagcauuuggucgcugacacauaaaugguguuguaaccuuuguuuucuccaaacauuuuggucaaugucauaaaguucuuacaggguuuucagguagcaccuagauguugguaggagacuauggccuguaaaagguauguuuguguucaguuacugaacguaagaggcuaaaagguaaaggaaguaagagugugcaagcauuccugagcccuggagggacucuaggguucuugcugugcccuaaagcaguguacugcgcuagacugcuuuuuuuuuuuccagcugcuagcagcugacaauagacugcucuuucuaaaaugcaaguccauuuucgccuugccucuuaaaaucugugcacagcuucucauugccuuuaaaguaacaugcaaauaccuuagcaugacauaugauaaaaacuucagcagaauuaaauuuaaaggaguucaauugagcaaugaaagauucgugaaucagucgaucucuggagccagagcaggcucggagacugcagugcagccaugugguggaagaagauuuauggacagagaaaggaaagugacgugcagaaaacggaagugagguacagagacagcuggauugguuacagcccacaguuugcuuuauuugaacacgguuccaaccguuggcuacauuugauggaccaaaacucggugauuggcacaaguguagguaaggucuguuuacaccuccacuuguagcucacgauguacagagaaaccuuuaggccaaacuuaaaauauguaaggaggcagcuuuaggcuaaacuugauuuaacacauguaaggccuuucuuagcaucuuccuaagugguucucauauuuuagugugcauagaaaucaccuggcugggguacagguggccuguuacaaugcacaucccugugucucaccgccagcgauucuugcucaguagguccuaggaucuugcauuccuaacauggacuuuuaacaucagccauucugaugugcuugugguuucuuuucucaugcccaauuuccuaaaagguggucauuucuucccaacuuuuucauacacuguucccccaccuggacaauucuuuugaaucauuucagaccucccucagguaccagcccaccuccaggugcucagcaacuaguuauaugucauuacaugaguauaugcucucugagaaauguguuaugaggcaaugucaucauugugccagcaucauagugcacuuacacaauccuagaugguacagccuacuacacaccuaggcucucuggcauggccuauugcucccagguuacaagccuguacaacauguuacuguacugaauacuguaggccauuauaacacaaugguauuuguguaucuaaacauagaaaaggcacaguaaaaugugguauacaauauaaaaaacaguacaccuguauagggcacuuaccaugaauggagcuugcaggacuggaaguugcucugggugagucagugagugaguggugagugaaugugaaggccuaggacauuauuacacauuaguauagacuuuaugaacacuguacacuuaagcugcaccacauuuauguuuuuucuuuaauaauaaaccuuugauuaauggaacuuuuuugcuuuaugaacuuuuaaauucuuuaaaacuuuuuggcacuuuuacaauaacacuuagcuuaaaacacaaacacacuguacagcuauacaaaauauuuucuuuauauccuuauucaagcuuuuuucuauuuuaaaaguuuuuuacucuuacuuguaaacuuuuuuuaagaacuaagacauaaacacacagauuagccugggccuacauaggguaaggaucaccaaugucacagucuucaggggcaguaacauggcuggagcugucaucuccuaugacaacaaugccgucuucugaaauaccuccugaaggaccugccugaggcuguuuuagaguuaacucuucuuuuuuuaauagguagaaggagaaggguacccucuaaaaucacgauuaauaguacaguauaauaaauacauaaaccaguaacaguuguuuuuauuguucuguacuauacauaauuguaugugcuauacuuuuauauaacuguuggugcaguagguuuguuuauaccggcaucaccacaaauauguagguaacucauugcacuguguguuauaauggcugugacuaggcgacaggaacuuuuuagcuccacuccaaucuuaugggaccaccgugguguaugugguccaucauugaccuguuguaguuacacggcuuuugucuguauuuagcauuccuggcugccuugagaagaacuauuccuucuuuggcauacaugcuguggcauccaacaggaaugggaugugggcauuaacuaugauucuuuccugucuguaaaauucuagccuuaugaauguacuuacaaaaaguaaacuuuacacauauuugcuaauuaaguuaauggccacgaauaaggauuuaaagggugccaggcacugaggcaccaggcugcacucagcaacugugaagcaggcauuagaauucccauuugauugaucaggagacugaagcucacagagagguuaaguuacuugaucaaaggcacauuggcagcaaguggcagaacuccacugugucugcugccuugcaagcuugcccauguucuuuccucuuucccgcaugccuugcuaggaacagauaccacaaaucugaaauucaggugugucagggaagaggcugauuuuuuuuuuuaauucuuuguccuacuugagacuuuggauccagugacggucccuuuuguucaacugguaauggcuuaaaagugcaacuguuugugcauccuucuagcaggaacuuaaacauguuggauaaauagcagcugucuuaaggaaugaauagaaaaucaggaaaagucaucauccauaugaacucuacauaucaucugcuuucuugcaaauuguauuaauccguucucaugcugcugauaaagacauaccugagacugggcaauuuaugaaagaaagagguuuaauggacuuacaguucacuguggcuggggaggccucaccaucaucgcagauggcaaggaggagcaagucacgucucacgugcauggcagcaggcaaagagagagcuuguacagggaaacuuccauuuuuaaaaccaucagaucucaugagacuuauucaccaucacgagaauagcacagaaaagacuugcccuggugauucaauucccucccacugggucccucccacagcgcaugggaguugugggagauacaauucaagaugagauuuggguggggacacagccaaaccauaucacaaauggaacaaauuauucauguggacaauguguuuccacaagagaggguggcccuucuucaccauagaaagcagcaaaggaauuccuuuaaugcugucuaacaaugugagaguuuuauccucucaggagggagacuuuaccucgguaauccauuagcauuaucucaauacacuuaaacacgcccagcuuuauuaaggugugcuuugcauuacuccuuuuacguauaacccaaaaaaugucugagacagaucucaauuuagagguuuauuuugccaagauagaggauacgccugggaaggagacacaguugcaguaggaucugugcccugugcauuuuccaaagacgauuuugaggaguucaacauuuaaaggggagaguggcagaaggggaaagcaggaaagaaaaaaaagagguagauaugcagugagguaaggggucacauucuugugaggcuuugauuagcguucacuggauccacauguuacaugugaaaggagggaguagaggaacagucaguuaugcauucugcauuuuaaaucugcauuuuacguaaaacaaaguaaacauagaguagaggaagacgucaaacgugcauuugucucuggguggaugguaggaugacuucuagucuugucuuugucccauaccugugaagauaaguuguuaaguuauauuuucagggugagauugaacagaacucuguuuuaugguaaagauucuggggcccacaaggcauuuccuugugagcaauuugugaaggagaccaccuggggagauagguggccuucuaucauugcagcuaucuguuuaggaacagaagggaggaaguuuuugugugacucaguucccaagcuuaaauuuucucuuuggcaugaugaguuuaggucccgagauuuuauuuuccuuuaauguaaguguucaagucaguggauuuuuaguaaauuuacagaguugcauagccaucaccacaauccaauuuaagaacauuucuaucauccuauaaggauuucucuaaccauuuuuuucucacuuuaguacacuuguaauacuuaaaauaauuaaaaaauuaaaaaucaccaggagaaaguaaaguuucccagacagaaauaaaaaugagcagucauuauauaugauuaggauaaagcacaaguguuaggugucacaaaucaagaccgggagagcacgggugcuuuugggucaguguuuggcuuuggcucucacacuggacaucaucaggggggucaagggcuguaugaauuacuccugcccacaugaauaauuuguuccacuugcaagaaagcagaugauauguaguucauauggaugaugacuuuuccugauuuucuauucauuccuuaaggcagcugcuauuuguccaacauguuuagguuccugcuggaaguaugcaaaacaguugcauuucuaagccauuacgagugaacaaaaggaaauaucacuggauccaaagucucaaguaggacaaagaauaaaaaaaaaucagccucuuucccggcauaccugaauuucagauuugugguaucuguuccuagcaagacaugugcgagagaggaaagaauauagguaggcuugcgagguagcagacacauggaguucugccauuugccggcauugugccuuugagcaaguaacuuaaccucucugugagcuucagucuccugaccaagcaaauggggauucuaaugucugccucauaguggcugugugcagcucuggugccucagugccuggcauacuuuaaauacuuauuugcauccauuaauuuaauuagcauuuguguauaaaguuuacuuuuuguaaguacauucauaugacuagaguuuuacagagcaggaaagaaucauaauaagauuauuuaaaauacugcaacuagccauauugaacauuuugguauuaaauauucauuuacugauagucauuuuauuuuugggaggaaagguuuuguuuuuauuuuaaaauaccaacacugguaaauguccuuuuggaggacuggcugaagccagguaaccaagggcaaggcacuuugagccacaguuuccucacuuauacaguggggcuaaaugauauaauguaugcaacuugcuaccugggguagauaaggaacauucacaaaaauaaggauaauuauacuuuaaaagcguguaauuaagugcuccuagaggucugggguguucacauuucuaacaacuugcuuauuuaguaauaauagccuaugagaguucccugacuccccucaugggaugugugacuggguguggcuugucuguucggcugccaugcaugcucaaaccccuuaugggugggggagcacaaagaugggcaggugcagaagcuggggcaagugccccugggcuccggccucacggcagcauccaggggugggugucugugacucccaaagcccaaguggcauguguuguguuacagugcgcucuuuuaaccuugccauccguggauggcuuaaguguuaaccagcauaguguccucuugguacccaggcccuuguccaguguccaggaagaaucagguugcacauggacuugaaggaugaaugugggggcuuuauugaaugguggagguggcucucagugggaugaauggggagcuggaagggggauggagugggaagaugaucuuccccuggagugugguuguccagcagccaaucuccucuccaaccauccccagcugaacuccucucgacgacauucagauacuccuucucuucucuuugcugugccauucugccauucuucugcucuucuguucauuuccuuguggagccgggguuuuggcguuuauauggguacaggauaggggauguggugggccgaaagauaacuuuugggugcaaaaccaggaaugcccauucucauuuagggcugcggguuuccaggccugagaauggggccuuugcuggggaacugcucucuucuauccaguauuucccugucuccuguccauaucauauggauguauugguauuucucacaacuuugauagaaaacauugagauucuugguaugcuuuuucaucuggcaaucuaucaaaauguaguuugauuucacaaaugguagaaaugacuuuauuaaggugucggguuccauaagcuuaauuguauagcuaauuauauuugaaauuuacaaaggaaagguacuagcuuagaaagaaucauuuuuuuauguuuuuuuuuuuuuuuuuuuuuuuugagauggagucucgcccugucgcccaggcuggagugcaguggcgccauaucggcucacugcaagcuccgccuccuggguucacgccauucuccugccucagcuucccgaguagcugggacuacaggcccaugccaccaugcccggcuaauuuuuguauuuuuuaguagagaagggguuucaccguguuagccaagauggucucaaucuccugaccuugugagccacugcgcccagccagaaagaaucauuuuuuuuucccuaaagguuuucuugucuuuaccucccuuuacaguuuauggcagaggagcuuacauuuuaacuuaaaugaaggugccccuguuugauauaugcaaguccaguccaagaggguacuucaggucuguaagcuccgggaagcgaguaccacauggcaauagauuaggcucugacauuuuaagacagagggacaugugacaugccuaaugaacucuuaucucuuuguuaaagaccacaaagcauuccauuucaacuguggcaauuggagacaaucaucucuuccguaacucuguuacgacugaccuguucuguugucucuagcuguuucucagcuuucuuaauuuuggcaguucuuuauuuucagauugaccauucagcuuugucagaugucacuauagauuucucucccucucucuuaaugagaaaugauuuuaagagauaguguuuuagccauguacgcuauuauugucauacaaauacugauggcccuuugggcuccccuccaagcauuuagagcaaagaguaaacagaucaauuaagauuuaguaaugaaacucagcuuuagagaauggcaaaucaagcagacccccaauauccucauuuuaauaaaguccauuuuggaaugaaaaagaauuagaaaaauaauuuagucuuauugcugaaguuuagcuauuccuuagccuucuaagauuccuugacaaaacagaauucucauaauaagcuaguucuagguauuagaauuuucugagaugggauaaauugugagaaauuuaaaaguuccccaggucaaauuugggacaauuugagcaacaaaauaauuaagaacaguggaguauuacgggccauagaaaguaauaggaauccuugagugcauauggaugauaaagaaauaacuagauagcuaaaugagggagauggaagacuuuugcuuuaguagaaugccagagacagauuggcaggaauggaaggagugcugagguuggaagcucaguuucagcgucauuguaaauaaugagucaggcaguaccacccuaggugcuaaaucuagggguacuuugggugaggaacaugauguuuaccuaucuuacacuaucucaccggagacuucuuauuaguugcaagacaaauacaguaacuaugcaguggagaaauaggacaacaccuugaccaggugaccaaaauuaacaucacagguggaaggagaugaacaucugugccucuggauauaaaugcccuuaggaggacacugucuguucuguagucgucuaaccugacucgaaucacaaggaaacaucagagaagcuuuaaaugaggaacaggaagauacuacuguuuaaaagagagaaaggcuguagucuccaagacugcugguaucauaaaacauaagggcugugaaaauguuucagauuaaaggaggcuaaagaguugugacugccagaugugaaagcugagccuagacugauuccuguucuguaggggagaaaaugcugugaaggacauugcugggucaguugacagaauuggauugugggcaauaguguaaaguaguuuaauuuaugcaaguagagaacuccacuguggccauguaagaggauauccuuauuuuuaggaaacaugcacugaaguauuuagagguaaaggaccacaggguuuacaauucgcucucaaaugguucaggaaaaaaauacuguuuggcuagauugauugaucgauaggaagggaaaaggagguggagagggugagaaagcagauuauaagcagauggggcaaaguguucacaauagauaaauuugguaaauggcacacagguguccuuuguauauucuuuuuuuuuugagacggaaucucguucuguccccugggcuggagugcagucacgcgaucucggcucacugcaagcuccgccucccggguucacgccauucuccugccucagccuccugaguagcugggacuacaggcgcccgccaccaagcccggcuaauuuuuuuguauuuuuaguagagacgggguuucaucguguuagccaggauggucuccaucuccugaccucgugauccgcccgccucggccucccgaagugcagggauuacaggcgugagccaccgcucccggccuguauauucuuuuaaaaauuaaaacaauucuuaauuauggguacauaauaggcguauacauuuauacgguacaugugauauuuugcuacaggcauacaauguguaguaaucacaucaggguaauugggguaucuauuacuucaagcauuuaucauuucguuguguguauauucuuauucuggcaacuuuuugguaaguuugaacuuauuucuaaauaaaaaguuuuuaaaaaguugucuagagacugaaaguaaacaaacaaauacacugggcaugaaaggaucuuuuuuuuuuuuuucuuuuugagacggagucuugcucugucgcccaggcuggagugcaguggcgugaucucggcucacugcaaacuccgccucccggguucacgccauucuccugccucagcccccgccccgaguagcugggacuacaggcgcccgccaccacgcccggcugauuuuguuuuuguauuuugaguagagacgggguuucaccguguuagccaggauggucucgauuuccugaccucgugauccgcucgccucggccucccaaagugcugggauuacaggugugagccaccgagcucggccgaaaggaucuuaguuauaaaacaaauuuagcugaaauguugucuuaccuuaauuggcuugaauuuuucucuagguacguucgauuugcuugucucgaaguaauacuuuacccuuuuuaauauuauuuaaauuguucauuauuuuuacauauauaguaauacauaaaauuauucucacuguaaaagauuuaaauccuucagaagccaaacaugauuuuugccuuuacuauauucccucccuuccucuccucagaagagaccagcuuaaguaagaauuugguugugacuuucuagucauagaaaucugcaaaucuggcuuuuguuaaauaaaugcaaauccagcuuuuauuaaaauaaaugggauuuuguacccuacaccuuucccaggauuacguuuuucacuuaauauauuuuagagauauguuuucacuguuugcuuuauuuauauaaugucugaagagaguuggguaauuguacuauaauuuauuuaauuaucuauugaagaucauuugggucuaauucuaauuucuuucgcagcacaguguguaucauaaucuugguacaugaaaccgugguacaugaaaauuuuaauaaugcauccuggaaguaguauugcugugucaauguauguguguuuaaauuuuuuaauagguccugcaaaacggacuucuaaacagacuguaaugauaguauaugcuuauuuuccggcaucucugccaacuguggauauuaucaaccuuguaaauuuuugccaaucacagggacaaaaauaauaugacuuuuuacgugcacauuuccacauuuauuggcuaguggauuucuucuucaguguacgagugcaugucacacccuuuaucuuuuguccuuuuugguugucuauuccuuaugaccuguaggaguguucuuuguuuauucuaaauaguaauuguuuugccuguuaaagugccuuaauuauuuuauccuagccaguugcuugucuuagaaguuuaaaauuuuuauguagcaaaaucuuuuacucuuuucuuuaaggcuucuggucuuuguguuuugcuuagaaagacugucccuguuuuaagauuauuuuaaaaaauacccauuuuuuaaaauuuuuauauuuaucucuuuauauggaaacuuguauauggguuuaauuucauuuuugucuuaguagacaaccaauauccuuagcaucaguuauuaaauauuuucucucuacuguaaaaucguaacugaauaauaaaauuccgauaugcacaggaaucccugucuguauucuuuauuauguucuauugaucuguauauauguuccugugccaauuccauaguuucaauuuuucagggcaaauccuacaauuuuuuuuccuucuugauaacuuuagaacuacuugucagguuccacugagaguucugcugcgaaucuuauugacugaguucucuguauguaaaaaguucuccuggcaugaaaaggaacucaggcuauggaaucaaauaggccuguguauaaaccaguuguuagcugugggaaugauaauugcaccuguuuuacagaaaugucaaguuuacaugagacaaugcauaaaggugcaaaagcuaaugcuugguguacagacaugcuuacaaaauauuauguauaucuccauagugacagagaaaugauauguucugugacaguguuauagcuuauuaaucagaauagccuugcauucauuuaagaaauagcauacuuauauacacaugugaauaaaauuucugucuuuagugauauuccacuugauacauaaauaaacacauuaguguauuccuguacucauucauuuauuucuuuauugauuccuuccaguaguaucuuggugugguugcuguggguaggcguggcgcuuggugcuuguggauagagcuuauagauaugccuuaugguaaaugccgccuggagggagggcagacgugaaacaaauaguuguaccuaauuuuguaauuacgauugagaaauacggugugaagaaaaguuacagugucuguacagcucuggcucaguuugaugaaguucacuuugucaaauagcucaguuuguugaauuuacaaaauuugcuucucaaacaucauuuuaaaagcuuuaaugagaaugaguguagaucagauucugaagcuggacucuguggguuuaaauccugauucugccacuuauacaugcuuugugaccuugggugaguuacuuaaccucucugugcuccaguuucaucauauguaaacugaguagaguaugaagccacuaccgaggguuuuuaugaagagcaaaucaguuguuauauguaaaaguuuguggagcagugucuggcucauagaguguuguagaggguguguuagccauuauugugacuucguuagcauccaaauuuuuaacaccucauauggaauuuuagaauuauuuauuuuucccaaauucuuuuaaagaccaccuuucucaugguauaacuuacaugcaguaaacccauguuaagaguacgugcuaagaguagcaccauguuaagauuaaguuuuauaaauguaugcacccauuuaauccccaguacaacuaaggcagaauauuuccaugagcccccaggguuccuugguaucuaucccucugcagucauuucaaauuccuuuuacugcauuuguuuuaccagagugucagucuuugucuuuuaacauguuuagaauuuuuaauucauuuuuugguggauaauguauaugaaauuugagauacuaguuauauggucuguuauacuaauuaucacuucuggcagucucuauuuuuugcgaguuuugaguaagugucuauguuuaauugcuucuuguuagaaaccaaaaugucagcauuuuacuuaugauaguauugguucaccaagcaauuuggugaacaaauuaauuuauaguuaaauuucuuuuaacuguaaaacaaguuaauuuguuuuacgguauaauugaaaguuuguuuuccuacauaauaaaauauguagguaagucugugugugguggcucaugccuguaaucucaacacuuugggaggcugagguggguggaucacuugaggucaggaguuugagaccagccugaccaacauagugaaaccccaccucuaccaaaaaauacaaaaauuagccggacuacauggcaugugccuguagucccugcuacucagggaagcugaagugggagaauugcuugaaccugggggcggagauugcagugagccuagauugugccacugcacuccagcgugagugacagagugagacccugucucaaaaagaaaaaaaaaaugcagaagaggcauuuagcuuuuugccauuuuuuuuuuuuuuuuuuuuuuuuugcuguugcaggggggauguugguaggaguggaggauaauuuagucuuagcagaaauuaauauguagaagucuuaagcuuuucucccuuagauugccccaaaaggacagauuuaacuucucagcaucucugcuuugcuaauaccaaaauuaccuauaaggauagauaccaagagagggagggcacuguaugagugguccaguauuuggacacacaacuuuucccugcaguaaucauaaugaaaguaauaauuuaaugggagcugacauuauuucguacuuacugugaauaggcaucauguuaaagccuacguacaucucauuuaauucuucaaccccaugaguuugauggcacuguuauucccauuuuacaggugaugaauaagaaucuuagagaaguaccuugcccaagaccacacacaguggguuuuuguuguuguuguuguuguuuuuagauuuuuuuuccuuuuaguuuagaaagagaaaaggaaggaaauaaagaaaguuuguuaaaauaacuauugcauaaaaggacaucugggcuagaugcugggauguaccucuuccagaauagggacugaugauuuaaacaaaaaaaaagacaaaaaagaaagaaaaaagaaauaaauuauucuucucaauacuguuugggauaauugcauuguuuucaucuuuucaacacacaaaacagccucuuugggaagcacugugaugagacuggcaagaauggcuggugccucgacucucuagaaugguagggggagcccugagagaggcauucuacuaaaccccacugcaagcauucgcauucuuuacuccuccuacuuuuggaauugggaaggaccagacucaagcuaaguucucaauauauuaacuuuuagggauacccacugccucuccugacccucuucuagcaaacuccccugcuggccccuuuuccgccagcuagcugcagcaaccauaccaagggccaggaggcugcuugguggucucagcuaagcaaaagcgggguaucaucaucacuguucgggccacacauaguugguaagugauggagcugauagcgggacucugcagucuuuguucuuaguguuauuucucccuugaauuuaaaucuugaaggcagugaguuuuuugggcuaaauaauuucucguauuugccaacccuuugaacuuuauagauuuuuaacauuuguuucucacucuauccucaaagcauccaaugcgguagggaaggaaaccugauguuucauucauugcgcaaacguaggcaaacuuuuucuguaaagggacagcguaaauauuuuuggcuuugaggacucugugaucucaguugcagcuaugcaguuugugacuguuacaggaaagcagccuuagacaauaugucaauugauugaguuguggcuguguuucaauagcacuuuauuuacaggccgggcacgguggcucacaccuguaaucccagcacuuugggaggccaaggugggccgauuacuugaggccaggaguucaagaucagccaggccaacauggcaaaacccugucucuacuaaaaauacaaaaaaauuagccggguuugguggcauguacuuguagucccagcuacuugggaggcugaggcaggagaaucgcuugaacccgggggguggagguugcacugagccaagaucaugccacugcaccccagccugggugacagagugagacuccgucucaaaaaaaaaaaaaaaaaaaaagaaaagaaaaaaaguacuuuauuuacaaaaaaagaaaaggcagcagguggaauuuggcccuguuuguaguuuccugacaccaauaguaauagacugaucuauuuggggacaucaggacaugucagccacagagaaggugacuuaggauucuuagugccaagcauugugugugguccacuuccuaaccuuucccaggcugcagcacacagugccacucacgaguaccuuuaggagauucaaggcacaacaauaauagugauaauaacucaucuuucuacuggaugcauuguucuaagugcuuuucacaucugacauuaaucuauggacagcugagugacaugggaaauugagguccuaaggaaaauagcuugcucaaggucacagagccaguggguggugaaacugggauuugaacccagauagagugguucuaagcuugugagcucaagucccuuuaccuucucucucccccauuauaggauuucucaguuugagaucaucuuugaagccuuacucuuugggaacugccucuuccgaacacucauauugaguggauaagguucuguguucucuuuuugagacauuuauuuuggagcagagcuacaaguaaaggacugcuaacucugccaauuuucuguuacagcuggauaguucaaggguggagcaagaucaugcaggagguuucuuuuugcucaucccuggucuacaccagagacuuucaacugcagaagcacuuuaauaacaguagagaugauuuauuaagugucuguuuuguugauacugugcuaagugcauuaaauauauaauauugguuaaaaucucacaaugcuguaaauuaagugguauuauucccauugcacagauggaaaaguugaggcucaguuauggauaaguuauuuaaaucucugagccuuaguuuccucauguggacauuaugauaguccuaucuguuagggucacuaugaagauuaaaugaguuaacacauguuaaggauucugagcaauguuuggcacucaauaguguuaccuguuauuguugcuguuauuauuagaacauaguaguaauuguagaggugaaaugcucacuuuuuaugaguauuugugaauuagaaauaagcacgugaguauucaacauagugccuagguguuaauagauggaacuuaugauuauuuauaggaagaaacuguguaaaguucuguuccuuuuaauuuaaaaauaccuccacuggugaugguuuuaaaauuaaacauuaaaauauuaaaagucagucucuugguuuuguuuguuuuuguuuguuuuggguaaaauugcucccugcaaaaacagccccagauauuccuguuuacuguaaauuagguagauuggauagaguuggcacuagaggauagauaugcuugacauaguaaaugauuuacaagguggauuguacagccauaaaagcaguaacuuagaaauaugcacaggagaguaaaauaauuugcucauuuauguuaaauuucagugauaaccuaauuguaaaaaaguuuuauuuuacauaugcacucuauuauauaccauauaucacuaugcauauuuuuuguauauacuuauuucucugugggguuauguccagaacugugaguauucuaugauaauggcaacuuaaaguauuuguucaauguuaagauugacuauauacacgauuuuucuuuuaaguacugaccuuaggacuuaaccccugccuuaagcugcagcucaacucuauaaugaaaugcagaaaaggaacauuuuucccaccuccauaaauuaaauaaccgauaauuaauuaaccuuuucauuucuuuuuuagcucucuaaucuauguguuaguagaaacuaaagcaaugcuauacaauucaaauuuuuuuugugacagugacaucuggugguuccuuuuuaauucucgugauuucucugugcuuggcugguuguuggaaauuccgaagaaucauugugugaacugcuucgcuuggcauuuaacacuagcuagcuauugagaaucaaguuagucccauugacguggcuugaacuuugaaaaccucagugcuccauuuggacgcagcccuucucugaagggaacaccagccuuccuuggaugaaugaacauuuuagaauuugugaugggcgaacacugucuugggaaggauuucucuuuaauucagagaacuuaggauuuugaauaagggaugguaucugugccagccucucugcuuuacucaugaggaggcuggagcccugagaaauagaguguguuggccaaggucucacugugucuuccaaugucucacuguguugggcaaugucucacuguguuggccaaggucucaccauguuggccaaggucaccugcuucuuggugagcagagguuccauaacuuauggguuuugugcuaccagggagcaguguggcauugggcucugugcucauaaauuacguuguuguuguuuuuagacggaguuucuuguugcucgggcuggagugcaauggggcuaucuuggcucacugcaaccgcugccucccggguucaagcaauucuccugccucagccucccaaguagcugggauuacaggcaugcgccaccacgcccaacuaauuuuguauuuuuaguagaugcgggauuucuccauguuggucaggcuggucuugaacucccgaccucaggugauccacccgccucugccucccaaagugcugggauuucaggcaugagccacugcgcccagcccauaaauuauguuuuuuaugcugggcaacccacuaguaagaaaggucugggagugaaaggcuagaggguaaaggcuagagggcaaagggaguuaacauuuuucacuaccuauuugcuguaaauaucccacacccggcuuuucucucauccaaaagaggcucagcaucuuugacaugaaaaagaguuguugaggaaguauaguuagggaucccagccccaucuccugagucuacugguuggucccauaucugagaauuuaauauccugugaaguuguauuuauugagccuguuuuaagucggaccuguucugugaguuaucucacauccuuacaaucccagugggcggcuggaaucuuuauuguacacaacaggaaguagaggauugaaaggcuggacucaccuagggucagagguggagccaggauucagucccagacaggucuaaccuccaagccuaaauuuaugcuuuccgcucuacuacacaggcuguguaauuaaaaucacuuguguauuuauuuauagugcguaguacuuagggaguagaggcagauuugcuuccuagacacuugagcacaugacauggacuuuguauugugacuauguggacacauccaggaguauuuugugcuugugagagaagggagggcucaugucaucaagucaugacuaccuugaugggcacuggcuccaugccaggcacuuuccccucugaucuccuuugguccucccaacagcuuccuagggugggugcuaugggcaucucuaauuuacagaagauaacuccagaguggaagggggaaaggauuuucuauagggauacuaaggaagaaaaaggaggagagaaugggugaacagcaggccugaagcacacucguguuguaucuggcccucccaugcugaaguugauaaaccacauggugagccaggcaggugcaauuaacccacuccuuucuucaaguucauuauaacccugcugccaaauccaaaggacuuuuauaggcuaaguaagauguccuacuaauaaccucuuaaauuucuuaaauuuuuccacauagugacaguugaaaucaaggcacagggcccuuuauacuagcaaacuaccugcucccagaggggacuuugguuagucagucaugguuccaugguauuuauauaucagcauuuguuucuuacaaaugugacauugaaaaugcuccuguauuccugaggucuuuuuaaauuuuuucaaaaaaagaucuuaaaggcauuguguguagaucacuuuuaggcugcuuuauuacuagcacuuuguaaacacugugagugaagauggacuauguuuccguuucuccucugcuccuuuaauccauaauagugagcucugugggcauuauuguucucucaacuguagacaacaugacuguaguaaacucuuuucuaccuuggggccuuaccuuauacauuuccaccugccuaauuccuuccccaccaagcuccuuauguccucccuuccucuaucuccugaugaagugaggucccuuuaccuggugguuucaucaugggcguauccuccuucucccagaagacuuccuuaaagcaaggacucuuuugcugcaguuucacuagcgcuuggcguaucgaugcugguaguuccuaaaugcauagaaaguaaucuuucccauuaaaaugcccguuacuccauauccccaguuucuacuauuagaucugugauuuuuugguaaaaaugaagcuuuaaaaaacauagaaccuuacuucaucaacccuaaggccuagagaaacaaagcaauacaaaggaacacagaacuggcugggagcguuggcucaugccuguaaucccagcacuuugggaggccgaggcgggcagaucaccugaggucaggaguucaagaccagccuuaccaaccuggagaaaccccgucucuacuaaaaauacaaaauuagcuggguguaguggugcaugccuguaaucucagcuacuugggaggcugaggcaggagaaucgcuugaacuggaggggcggagguugcagugagccaagaucgcaccauugcacuccagccuggacaacaagagugaaacuccaucucaggaaaaaaaaaaaaacagaauuuacgugggauuauaugagagcacuuaccuggcacaagagcaaccagggaacuauauuaauccuacaccuggagaacauggaaaauuauuuuuaaucucaacugaugaauguuuaaaaauuucuaaagcaugagcuuuauguuuuggcagaugauuuuacuguuguuuugcuguuauuauuuuuuuaaucccuauuucugaaaaaauguuugaaaaucuccaguuuuuucuaagucuauuaaaaaaaucuaaaaaaauuauugccuggaauuugacaaaccuggacaaauuaagaagauaaacuuaguguuaguuuuuuuucaggugugauacuugaaauuugagaaggucauguuuuguucccugcaaggaccaacaacagucguuacagguggggacuuggaaugugagugugucuaaugugugggccccuauugcuuucuuucccuuugauuaagaauucuguaggucaguuaagguuucacaaaggacuugcuuugaugcuaauccuuuaaggaggguaugaggggugcuuguccuuugcaaacccaguuaugggggagcugaagcugauuauuacauuugccaucaaagaacauugaugcucuuucaugcaauaugaaacuuaaaaaaauguggcacugcagauaagaugcgacuaguugguaguccuugggauuuaguuggagaguuuaaaugcuguagaaggccauggacuacuuuuugaacuugacaaauagauuacagagaauuggaugauaaaugugagcagaaugaaaaauuauuccuaacagaugagcucaggguacguauauauuuuuaaaaugaauuuugcacaauaauaaagguguauuuuaaauuaauucugacuuagaaaaaucaguacuuuauucaaguuuuaauagggagugaugugacuugaguuuaugcauuucucauaugauuccuuuaacuaggaaugugcuguuucucuuuaugagagaaauucaauauuugaggaauccuccaggugugucagucacuaugauaaugcuucugaugucagucugguuucccauuuuggacaucuugauuuacaggaguggaugccauguagacacguguuuguauuccguagaaccuaauacccauggcucuuagucccugccucaguccuggggggaaguuggggcauccucuucaugucucaucuccaugggaaugguccagauaugccccaaaagaauucaugacuugccagaguucucaacaguuguagcguucuuugaguccaugauaccaaacacacagcuucauuggucaguggaauggaauguugggugggaaagcuccagugagaaggggccugguugugugggggugggcaccugcccaccuguggucuucauugaggaggaagguaucugcaagcccucucaaaccuugucaucuuugcuaaagugcggugguuaaaugagcgugguagaaucuguucucaggccugugaagucaucccuaugagaaagaugguaaaauggaggacagggcugagggugaggaggaggaacgcggaggaggagggaggaauguggaggaggagggaggaacggaguucuagagaagcgauacagcuuuguggauuuacaguaccuggcguuauuuuuugucauguuacuuccuacuuccuuuuccuucuugcaguaauauuugucacauauuccuuuucaaaccacgaagugaauuaaaaaucagauagggaggccugaaaaauuuguaaaucuauuuggucucuuuggcaguuaauggagaguauugacauuacuacuguuaauagcauauuugucaucuuuacucuuuguucucuagagauaaaaauaauguaaacacuuuugucauuaauaucuucauuaagauucuuaaaugaacaucaagaaccugcucuuccacucaaauguucuugcaugcauuuuugcuacucagaauaugacaaagcuagcgaguuaagauggaaauuguuuggaaaagccuuaguaggugaugcagcuuuccucacucugugucaguucuacgaucaggauggcaguuucuaugaucuggaggcagagguaggguucaggcugaucucccaggaggcagcaggcccugggugcuggccuuauaucugucagcucaccuagggaauccuucaacuaacaggugagcccauuuuuuaacgugcaaaaugaaacugcucaaggugaggaccuuccaccuccagacaagggugcucagccaguuaguuagcuaaccaugauuugcuaagaguccaugaaguacagaguacugugcugggcuggaaagcagauucauaaagaauagaauggugcuugacuccaacuagagagucaagauaggcucuugaacaaguuagauacuguuuggaggcaguguauuauuugggagccaggugugguucaaugaaaacaucuguuacaccaggcccuacaguaguagcacuucaagguuggcccugguaugggaguagggcaggcaaaugcagcugccuuuaaggagggaacuaaacaccgagguuuuccuguaacacuuuguauuuguuggcagugugagcucuccugucuuacuuuacuuauguuggaaggagucaggaugcuccucugagugugcguguuguaacuggagggcacacggugagcccaccaguacuggggagcuaagggaaaccaacacuggaggagcacuaggaaauuuauggugaguauggagaagcaaagagacuuugguggaaacaucuaguucugcuacaugaagaauacaugcgugacuacugagggccaggugggagacuguggaauagcugucagugccaaaccuaggggcccugaugggaaucucacacaaggaaaaggagcuuccugaggcagcagcagaaaagggauagaauuugaacugaguguggggaccaagacagacaggagggaaaggaagcacuggucuuucuguagggauauggaacagaugcaugagcagucucugccuuuugguguuucauccuccacguggaccccacaucacuuuucccaaggaugcaggaaacuguauuugcugguacccagggagagagcgguuggccaucuccggguccaaguauaauuucccagaauuggaaauaagagucucauaaagauauaaaugagcaugucaaaauuuuauuucauccaccaauuaggaaaccagugaaaugguaaauugauccaaacaguauuugaggaacuaguauuuauaagcuuaaggaagaauguuagauuaagauugcuagguuauacauaaagcuggguaauaccuuaaagcagggguccccaaugccugagccguggacugguacuggucuguagccuguuaggaaccaggcugcacagcaggaggugaguggugggcgggcgagcauuaccacagcuccaccccguguuagaucagcgguggcgugagagucucaggagagcuaacccuacugugaaaugugcaugcaagugaucuagguugcgcacuccuuaugagaaucuaaugucugaugaucugagguggaacaguuucauccugaaaccaucuccucacugucccccaucaucuguggaaaaauugucucccaugaaaccagucccuggugccaaaaagguugggaacugcugucucacugagcagcaaaaucauaaucuuugagguagucuuuuucgccacuaaaaauccuguaagucaacauguaacuucacagugugcggacuccaaucagacagcagauggcaaaauuaaacacaaauacacucuucuagagaguuaaauaauccuugggaggcuuguaaaacaaugcuaccauauuacauugagaggauauggcaccccuucaucucccacccccuccccauccugcccaacugucuaauuuccaaguuuuagauaguuuguauugacauuaauaaaaugcuuugguuuuaagccugagauugaaccccaguuucuucacuguguaauguugggcaaguaauuaaacuacaacuggcuuaacuugcuguauguugggaggaacacaugaaauagcuuuuguaagguuguaaggugccuggcacaugauagguacucaguaaaucuuaguucuucucuucaccuuuccuuuuuuaaaauuaagacacuuccaccuuuugucuggccuuuauagaccacauaugcuuuauuuagaaaacucucugccccgugauuacuguuucaacaaaauggagaguuucgauauucuugaaaucguguuuuuuuuuuuaaauaaaaaaguuauuagauacagggucuuacuauacuguccaugcugaacucaagccauccuucuaccucagccucucgaguagcugggacuacaggugugcaccaccuggcuugauauucuuuuuuuuuuuuuucuuuuuuugauggaggggugggaauacuucuuguuuagaugaaaauauuagucuuaucuucuuuacacggaggguuggcuucccaaguuauccuuugcgucgcucacucaguaaguauuuuaguguccaugcugagguuugugaggaggaggagaaggcacagaaggcucccaggagugggcuguccauguacccuauuguugguaagugcagagggagucugcagagcugccggagggacuaugagcugggcuuaucauagugagauuuggguuccuggagaauacguuuuccucccuucucuguaacuacucacaugauaaccugugugcuggcccuugauuuuaccucccuuauggaguaugauauuaauguagauuaauaggucagggucccaaacucaaacucaguucugccacuguuuacaacuuuuuuuuuuuuuccuugagauggagucuugcucuguugcccagucuggagugcaguggggcaaucuugacucacugcaagcuccgccuccugaguucaagugauucuugugccucagccuccucaaguagcugggauuacagaaaugcaccaccaugccuggcuaauuuuuguauuuuuaguaggaaugggguuucaccauguuggccaggcuggucucaaacuccugaccucaggugauccaccagccuuggccucccaaaguguugggauuacagguguaagccaccagguccagucgguucuucuuuuuuuuuuuuucuuuuuuuuuggagacggagucucacucugucacacaggauggagugcaauggcaugaucucggcucacuguaacguccgccucccagguucaagcgauuauccugccucagccucccaaguagcugggauuacaggugcaugucaccacgcccagcuaauuuuuuuguauuuuuuaguagagagagggauucaccaugugggccaggcuggucuccaacuccugaccuugugauccacccgccucggccucccaaagugcugggauugcaggcaugagccacugcgccuggccagguucuucuuuuuaguauuuacacuuuuguuuuuucugccucaccgcagaauccaguauggucuaaaccuuguucaguauuaauggccacacaagggaaaagaucccuagcccccuuuccucauuucugugcauaacucuaaaugaggugugauacgguaagucccuuggcgguccagguuccauucauucauucauucauucauuaggcaacaaguauuuauugagcaaacccuggugcgaagcccugguguuuuuucuguguauguaagagccugcucugauggagacagagggugaccaaguaaacaaggaagaucauuagagauuaugauaagugcuaugaaugaaacaaaugaaaugaugaggaacuuuauguaagcugcuauuccuaguaauuuuaauuagggugaucagagauguucuucuugaggagguggcuuucuaagcugaaaaucaaaggaugagaaugagucagccaugggaauaauugagcaaaggacauuauaagaaaggggacagugcagagagcugugggauguuugacuuguccaaggaacggaaagaaagaccuguggcuggagucgagugaguaaggggauguggucagaggcuggcggggcuguuuuagggcucuguagauagggagaaugaguuugggauuuuucuaaaugcaauggaaagcucuugaagaggucuagaaaacuggaaugguguaugcuuauucaaaaacaugaaguaaaagaaugauauuguugucaugugaagaauugaauggagggugucaagcacaggaguagggagaccagugagguggcccuuuggaggucucguggcuugggcuaugguaagagugguagggaugucagagaaggaugcuuggaagauuaagcuggguugugguggaccccggauaccuggaugaggagcuuagguuugguuuuugcagcugugagggagcuguugugaaugugugaguuuuugagugagugcauguguauuuguaugugugacugugagauugugugugagucacugugucugaguguggaguguguguguggucuucugagugcauaugacugugugcguuucucuccuguugcagcugugaucaggccaguggcaugaagcaaagggcuauccuguguggcacagaguaaacugggggaaaggcugguggcagggagacgagcugagaggguggugcaauaugugaaaugaaggcccagaggaugcucacuuggcuagccauggagaaagaaaagacuacaucgggcaaguccucuuauuuauuuuacucuauaguugggaagaaugagauuuaggagugaaagguaacuucauaaaagacgucauagucucuuuaaauuaggccaguuugaucacuugcugaguauuuuaccagccuuauuaaaaaaaaaauuaaacgucacugaaaugcaucugcuugauuucuguaaacagaauuccauaagcguuaaguugauugauucuacugccugcuauaccuuccugccaggaccacucuccccaaugcguguauucauuuucucuuuuagaauucuugagaaacccauugagaauucuugagaaacucauuguauuuuuuauuucccccaggacguuuucgaagaugccuuggaaaccaucucaauguaaguaauaacauaauaaaaaguauguaguaaggaaaaauugaugguugucuuacauaaaaaguaaauauuucauucucauuuuuuggagaguacggcaauggcuauuuucagaaaaaaaaagucacuuuucuauaauuaaagaggaugugauuauauuuaagaaaggaucuaucuaauacuuucagauacauuucugaguauuauuucuuguaacaaaauaaaauauuucucaacaaaguauuuguuuauagcuaacucuuuuaauaguuguucauauuuaugucagucucauuuuguagauuuuuguguuugguuugcacuuaguuuuauuaaaagcauucacuguaagccuauauaguuuuuguaauaauucuaaauugcuaaaucauauuagaucaaauggaauauuacaauuuacuuaccugcuucuccauuguuagacauuuagguugucacuggcuuagaaauguagaacuaaguuuuacauguguauagcuuuguuauauuuugaauuauuucuaaagguuaacauaacaaauguaggauuacugaauuaaaagggaugaauauguuuauuguucuuuguauaucucuaauugccuuccuguauuaguuaacuucagcuucuauaacaaaacacaauagccuggguggcuuaaucaacaauaauuuauuuucucacaauuuuggaggcuagaagucugaguuaagggugccagcaugguugggauucugguaggggcucuccucuuggcuugcagacugccuccuuguuguguucuuacauggccgagagagugagagcaaaagcucucugguguccuuuuuuuuugagacggagucucgcucugucgcccagguuggagugcaguggcacgaucucggcucacugcaagcuccgccucccagguucacgccauucugcugccuuagccucccaaguagcugggauuacagcucccgccaccacgccaggcuauuuuuuuuguauuuuuaguagagacgggguuucaccauguuagccaggauggucuccaucuccugaccucgugaucugccccucuuguccucccaaagugcugggauuacaggcgugagccacugcgcccugccugauguccuuucuuauaaggguguuaauccuauccugaggaccccacucuccugaccucauuuaaauccgauugucucccaaaggcuccauauuuaaauuccaucacauuggggguuugggcuugaacaugugcauguacagguggggguagaggggcaccguuuguuuuacaguacuuccacaggaguauuaucaauuuacuuggcuaccaauacuauguaagcaaagugguuuaaacugucacauuaucaucacuggguauuauuucaaaaacaguuuugcaacuuaaaugauaccuacuuuaguauuuuuaaaaauuauuuuaaaaauacauugcaucuuuuguaugacuucuaauuuucuuuugucucuuagcuuuuuucagaauguuucucuuaacauacuuauggacuuuaaauuauauauacccuaaucuuuugucauauuugcuauagauauuuccuccagacugcaauuuuucuuuauuuuaguauuauacauuuuuauuuuguccaaaaguuucauguuuauaugauuuuuuaaaaaaaaaacuuaauugugauugggauuaaccuauuaauuaggagcaguuucagacuuacagaauuauugaggagguaguacagaguauuccuguguaccccacccagguuuucucuauuauuaauuucuuaaguuagcaugguacauuucucacaauuaaugaucaauauggauauauuauuguuaacuacaguccauacguuauccagauuuauuuaguuuguaccuaguguccuuuuucugccucagcaucccacccaagauaccacuuuacauuuagucgucauguccccuuaggcuccucuuggcugugacagucucucagacucucguuuucggugaccuugacaguuuugaggaguacugucaguuauuuuguagaauggcccuuaauugagauuggucuguuuuuccccccucaugauuugacuguggucauguguuuuugggaagaagaccccagauggaaagggccauucuuaucacaucauagcaaagauccacgauaucaaugugacuuagcacuaccgauguugaacuuggucacauggcauggguaguguuugucagguuuuuccacugugaaguugcccuuuuuccccuccucccuuuuuauacaguacucuuuggaagauaaucuguuuaugugauuuuuaagaaaucacuucuauggugggcaagugaucgccauucagaaaucuuauaauuauucaacccugcuccucccuugguguuggcaggaauugagcuugggcuauaguaggugaucacaguccaggggauggaaaaggaucaggccuuggggcuggugauuggaguucaccagaggagacacugcuuuucccagcgggagcuagcaugccacacacaacagagaggggugcagaccucacagaggaggacgggucucacugaccagugggagcagugugaccccugagcagugcacauugaugcuugugcuucucugagcucccacuggcuucaguaggcugguaguggcuuuaccuuugggaccucaggaaggcauugcaagcaguuuuuuuaacaucuauuaguuuuuaaaaaaaucaaaccacagaaauaaacaaaagcccuaaauucaacccagcugaaguuaauuuagauuccuaucucacaccagcccuaaaauugcuagcccacuauuccagcaccauuuguuagguccaugagggaaacaauuuauauuugauaccuccuuugucaaauaaguucauuaaaauaauaacacacuguuugggggcuuuccauucaguuccuuugaucuagaugccuguguuugcacaaaaacaacucuuuuguucaaccgaguuagaugguuuaauauuagcauugucugguucucagaacaucauccaaaaugacuccugugauggagaugcuuuugauucgugacuaucagaaaccccuuuguguacuuuuuguuuuugcuuuaaaauaaauuuuauuguguauauauaagguauacaacaugauguuauaagauauauauauauauauauaguaaaauuguuauauagaagaacaaaugacgauaucuaucaucucacauaguuucccuuuuuuuuuuuuuuuuuuaagacagagucucgcucugucgcccaggcuagagugcaauggugugaucucagcucacugcaaccucugccuccuggguucaagcaauucuccugccucagccuuccaaguagcugggauuauaggcgccugccaacuacguccagcuaauuuuuguauuuuuaguagagacaagguuucacuauguuggccaggcugaucucaaacuccugaccucaggugauccaccugccuuggccucccccaaagugcugggauuacaggcaugagccacugcgccuggccuaguuacccauuuuuuuuccuccuguggcaaggaagaaaaaucuaauuuaauuuagcaaaaauccugaauacaguguacuauuucuuauuaacuauaauccucauguuguacauuagauuuuuuagcuuguucauccuucauauuugcuagagaaaccccuucaugugcuguuaaaguggggaauucgagaagcauugucuuggugucuuuuauucuacugucaacucuguuauaguuuuucucauccugaagacugcagcuccuuaacacugccucaguuucuaaugaccacgcauucucccuucauugccuccagaacuucucuguggcuguauuuaucugccagcaguuucuuccucuugucuaauuuuaacuucccuguccugcucaguuuaacaaauccaaagguuuccccauuuuagaauguaucuugcucuuuuagguuucuggugugcauuauuucucguguccuuuagacugucgcuuaaacguuuguguguccuuuucaauguugcugaauuguuccacuccucucaccuugguuauagcaacacauuauaggaacccuucuccuaauagagagagauagagcccaaaaucagaagggguagccagauuaggugcuggaguccauacacgaagaaucuuguagcagaggccuccauucagagucugcaguugauuuugaucugauuuuaauaaacuuugccuuuuggucuugugcguacuuuugccuuacagcguucugagagguauuguaagggggguuguuuccgaagcagagcuuguuggugaugacaaaaaauggcagugagagaacaaagaaaauauuacacacagccauaaaacuccaaagcacagcggugugguuucauuuugccuucaugcacacaacuacauguaucuuccuggggagacgggacugaccacacuugacagucagacuugaacuguagucccaguuugccauuuacuggcugggaggccugggcaguuucucugagcuuguuuucuccucucauagauuuauugagaggauuaaaugaaauuuaaguuaaaugugauaaugggaguaaaacacauaguaagugcucagugaacaucgguacuuuucugcucucccuuguaagaguguggguucuccagacaaauagaaccaauaggagacauaaaaugucuauauaugaagagauuugcuguaaggaauugacucaugugauuauggaggcugagaaguccccaguucugcaguuggcaagcuggagacacaggagaaguaauggacuucuaguccaagucagaggccucugauuauaaauacauguuaauuguaaaaaauuucuucaguuguuuuuaugugaacuuuuuguuuguccuaauuucaggguuugucaauauuucucacauuuccucuuaaauuggugauacuauaacauucccuuugugaauucugcaaaacuuaguagaguucuuuuuccuuacacuuacugaaccauauauuuugaucuuauguuucuggugcagagagcaagugcuucaaucucuguaucaagaugcagugcucuugccaaccugaugauuaauuucuuccagugaguauuuucucuugaaugccuaaugaaaggauucacacuaacagaugaaggaggccuuaaauuguuuccacaaagcaaauaguuucuuauuuuucuuuuucugccuaaugaauuuaccacucucaacacagauuuuuccuaccucuggaucuuugugguaacgauuguguuauuuuaacuauuuugagaaauugcuaguuuuucuggcaguuucucaaaauaguuaaaauaacacaaaauaaaauaaaauaaaacuguuaaaauaaaacugguaggucauacaaaaaucuccaccauuuagaacuggaggaaaaauuagagauguacaaaaauguuaguaguacauugaccauguucuuuuuaaaaauuaaaauaggccaagugcuauggcucacgccuguaaucccagcacuuugggaggcugagguggguggaucaccugaggucaggaguuugagaccagccuggccaacauaccaaaaccccaucuguacuaaaaauacaaaaauuagcugggcuuuguggcgcaugccuguaauuccagcuacucaggaggcugaggcaggagaaucacuugaacccgggaggccgagguugcagugagcugagauugugccacugcacuccagccugggugacagagcaagacuccaucucaaaaaauaauaauaauaaaauaaauaaaauaaaaaauaaaaauuaaaauagucugugaacuuuaugaccuguucggcauaaggaggugaccucuuaaggaccuguugcaugauauauagaaauuugucacaaauaacaugcaguucuagauuagcuauaguuucuugcuuccuuauuuaacaguuccaugcugguuugcacuucuagugcucugaugacggagugucccuuuucucaguguuagugcccaguugccaucucugacaauguagugguggguauaauaaaucuguugauaauuaacugugauauggcaugugaagaguaaauauuguguuuugggaauuccaaaagaaagcuaucuuuugguugggagaugggggugcuggcauuugcuuuggguuuugagggauggguggcauuucaguugguagaggcagugcagagggucagagguggggacaugcugggugaacaguucugaggacaguggccagagcacagagcaguggguuugaaacaccaguggggcccuggacacaaaugaaguugggucauggaggauuccuggucuugucuaguggggagaauggacuaaccacuuacagucaucgugauuugguguuuuguuuuuguuuuuuuuugauaggaucucacucugucucccaggcuagaguguaguggcgcguucucaacucacugcagccccaaacuccuggguucaagugcuccucccaccuagccucccaaguagcugggacuauaggcaggugccaucacgccuggcuaauuuuauuuuuuguagagaugcagucucccuauguuacccaggcuggucuugaacuccuggacucaagugauccucccaccuuugccucccauaguguugggauuacagacaugagcuacuguaccuggcuggugguauuuuugauuaaccucuuucucauaaaaaccacugugggcaaugggacaaaaaucuaaccgggaguccugguugggcacugauuaauuaagauuuucuuuucaugguaguuuagagaagucaggggagacagaucaaacuuauguucaaagacuguuagaacagaugcagguuuaauauauucucagcaguggucuuucauauuccagagcaucuuacggaaauuucaaauuuauccuuacauagaaacucauauguguucaauggaauccugagguggugugaauacaguggggauguaugugucuauuuucaagaacugcucugaauuuguacuuaccuguagaaggugaaauaggcagauuuuuuuagccagguaauuagaagcuuacaauagaaauaaaaauauuuugaucgcuucuuggccuuuugucuaagaucaaguguaguauaaaaauauuuuguuuuauaacauuucucacaaacuuuuuccuucuccacaccuucucuuucgaaccauaaauuguagaugagagugaaguaaggcuuuuagggccauuuuuuuuuuccccucauuagguuagaucaguuggugauacaauaguuuugccuguuuuaauuaagggugaauaucggugaaugauaguuggaaaacaucugauauuuuucuucagagugguuaaguuauaaauaguaacuacagggagaguuagauuuguuuucauuuuucucugcuguuuuuuuuggccccaauuuuccccuguagguaauauaaauguuacucaagucuggaaagggaguuuuguccucucuuaauuugauuuucuuaaccaagucgacagugauuuuauuggaucuaagaugccauucauauuguuaucuuauauauuccuaaggaaggaaaaaaaaaaaaacacaaugaggaauuuuguaggagaccuugcauaaaggaaaggaaaaauaaaaucaucuugcaggaaggcacaguaaggaaauguguauauuucaaucuugguauuagguagggaaggaaaaaaaacccucuaaugagauucuccacucagagaauuuuuuuaaacagcucuauugcaauauuaauuuauaucucauauauauuccuauuuuaauuauacaauuuaaugcauuuuaauguauuuacagaauuauagagccaucaccacaaucuaacuucaaaacauuuuuaucgucugaaaaagaaaucugugccuuuuuauagucauuaucuauucccacucuuagcuggggcauccacuaaucuaauuucugucacccucggcuggggcaaccacuaauuuaauuuuuguagauauuuuauauaaauggaauaaucuaauauguauuauuuugugucuacacaugucauagaauguguaguacagauagaugcuccuugacucaugaugggguuaccuccugauaacuucaucauaaauaaaaaauauaguaagugaaaaugcauuggauacccugacaaacccaucauaauguuggaaaauugcaaguugaaccauccuaaguuggggaccaucugcacuucauuccuuuuuauggcugaauaauauucauuuauaugaauauaucacauuuuauuuaucuguucaucaguugaugggcauuugagucuuuuccaguuuuuggcuauugugaauaaugcugcuauaaacaauuguguacagucuuuguaugaacauguuuuaaauuaucugccauacagacacagaaguggaauugguaaguugcauggugaaccuauguuuaacuuuuuaaugcccuuuagaauuugaauuguaagcugguuuggagucugaauacauauaaaugguguaacccccaacaacuucaagcagguuauuuaacuuuaaguggaucagguuggugguguccucagguaauuggcagaagcaaaugcagauccucucccuaagaacauaacuuugauuuagggcagucaaaguugcugucaauuuuaagauguaucuugggguuagggauauuccaugaugaaaauuugugugucauagagucaaugguauauaguaaauggaaauaaaaguucuuuaaaaagcucaagguaaacagcauuccugguguuuuuuccuuguuucuguuaccacugggcuugcuucucuuuguauuuucuuuuguccuguuagaucuacucuaauggucugcuguuguguuuagaccugccacugugaaguucuucauauaaauucacagggggaaggagaauguguguaguacacguuuuaagauauagauccuauaaaugcugcuuuucacuaugaggagugacaagauuucaucacuugaaggaaagccucugaaggaaagcuccuuagcaacacuuuggugcaauuaucucaucuuaccaaggaggucccagcagagauggaagacugagucgugguugggguguugcuggugcaaagugaaugaccagugaaccccuaugagcaggaucuuugugacugugguugccuuucugcaggcucaguguccucucugacuuucucagcccugguagcaaugcucagcuugugucugaaagccaggacuuugcucuuacacugaguuccuugccuccuccauaaguaaccuucuugacauggcugcugcucccugcugcugucuugggcuauuuugguaguuguaaugggaaagagguccaaucauugcuucuuuuaucacucacuaggauguuucacaaacacauuaauuuuuaugucccaaacugaacucuugguauccaccuccuuuguuuaucugaaaacuuugccuuuucuguaaaugucuccacccaccauccacccauuuguucaagucagaagcuugggagacaucuuugauuccuuucuuuucuuuuaauuuccacauuaccaagucugaugauuucuaccuccaauauauauuucccauccguucacuuuccucucucuccgcucuauuacauuagcuuaagugacuauaagauuuugcuuggacuacuuuaagagcuggcuaaugguuaauguguguucccgcuucuuuuguucucucccucuacuuuuccaacugcaccccacuuacucuccauacagcagcccaaguuaucuuauuuuauuuuuuuugagauggaguuuugcucuuauugcccaggcuggagugcagugguacgaacucggcucaccgcaaccucugccuccuggguucaagcgauucuccugccucagccuuccugaguagcugggauuacaggcgcccgccaccgugcccggcuaauuuuguauuuuuaguagagacgggguuucuccauguuagucaggcuggucucgaacucccgaucucagaugauccacccaccucggacucccaaagugcugggauuacaggcgugagccaccgugccuggccuaaaauuauuuuuaaaaauaagauaauuugcgucaggcacgguggcucaugccuguaaucccagcacuuugggaggccaaaacggguggauugcuugagcccaggaguuugagaccagccugaccaacauggcaaaacccccucucuauaaaaaauacaaaaaauuagccagguguggugacacaucuguaguuccagcuacuugggaggcugagaugagaggaucauuugagccgcagaagucgaggcuguguugagcugugauggugccacugcacuccagccugggugauagaguaagacccugucucaaaaaaaaaauuuuuaauaugaccaauuuugaacaucuacagaaaguaaagaggauaguaaaccaaaccuuauauacuaaucacuuagcuucuauaguugucaacucaaggccaaucuuauuucauccauauccuauccccagauuauuuggaaucaaauccuagacaugauaauuuauuucuaccucuaaauauauuaaaauauauuucuucaaaacaaagacagucucuuucauaauuaccauucagauaccaagaucaggaaauuaacauugauauagagcuauaguuuaaucuguaugcuuuauaugacaucauuuuaucuguauuuagcuugcaaaggucgcuuuuuaaaaaaucacaagacuguugucacaccuaaaacauaauaauauccguccaguaacuggucagugcucaaauuucuccgacugucucauuuauuuuuuuaacaguauguuugugugaaucaggacaagagugauccuuuuagaaauuaaaugggaugaugucacugcuugcuuaaaauccauccaugaguuuuccugucuaaagcugaagacccaaucuaccuuuguucauaagguuugaggugguugggcucccacauacugcuucugccucaucgagggcaacucuugcccucaugcaugacccuccagccacaagccuuauacaguuuuuugugagaguaaacccugugcugcuccggauuggagcguguuugcccucacucuuuugagggcuuuuugcuggccauccuccacucucagcuggcguguccucccacuuucucagugacuccaccaaaacaguuagucuucccccauuucucugucuuggcaucuuguuuguuucuaucacuccauuucucauuuugcaguuaauuguuacuuguuuuuugaucaucuguuuuuuugagcuccaaguucuauaacgaugggucugaucuacuuugcuugucaugguguacuuggcaccuaugcaccaugcuugucacauaguaggugcucaguauauauguguugaaaaaaugaaugugugaaauuaauauacugucuuaguccauuugggcugccguaacaaaauccauuagacuggguaauuuauaaacaauggaaauuuauuuccucacugcuuuguaggccgcaagguccaagaguaaaguggcagcagauugagugucuggugagggcccauuccucauagauggugccuucuuuguguccucacgugguagaaggaagcagaaaauaguggaaagaggggaaagaaaaaaaaaagaagaaggaaaaagggcaaagagacucccucaagcuuuuuuguuaggguacuaaucccauuuacaaggguggaacccucaugaccuaaucaccuuccaaaggccccacgccaucacuuuggggguuagguuucaacauaugaauuuuggagggacacaaacauuaaaccauagcauguacuauuaagaaaauauagguggauccucagaguagacugcuaggauuugcaguaaauuaaagaaaaaaauguagccaccauugaguuccuaaugaguauagggcacagugauaauugcugugauuauucaaaugguuaguuaagggaucuuuuggaauacacaguuaaaaaaaaagacuguggcugauuguguucauaaacucaaaugcauauauaauuaaauaaaguccaaauguuugggcauaguaaacacuauccauaauuguuggugucuccauugccauuuuucucugaagggcugacucaguuuucacuugacguuugcauaaaugagugucagaaucuuaaaggauacagugagcucauugccuuuuguuaacuuuuuacccuguuucaccugacauccuuuuuuuuuuucugacgccuucauccauucccuuuucaucuaccucacgauaaaaauaggaaccuaagaugacuaauaaaacacccaaaagcauauacuugggagcuuugucuuuugaaaugcgccaaacuucuucauugcuuguguuccgaaaaucaucagccucucuggucuccuuucuuuuuccuucuucccucuuucccccuuuugucucugcuuguggaacauuauucuacgaccagagaauagaacuccucaaaggcauagugauauuugguuuagguacauuuuugaauaguguauaguucaguaccaugcaugaugcacaucuaauaaauagucugaagacuuaauagccaucaacaaauuggaagaacccugaaauugccuaaaacugaagagauauuuggggauuuacauauaacuuuuauuauuguauaaaguaauuucuauguuauuuauuuuauuuuuauugucuagaaugaaaauauucauaccagcagcggucuuuuaaaauuaccugaugagcagaauguuauaguuagaaugaaaaauguuaaaacuccauauagcucugaugaauuaaccuuuucaaaggugugggcauaguauuuggucuccccuguaggcaauacagcuauaagcuuuugauuuuuauuuauuuuaguaguuaggaaaguuuucugcaagcguaacuugacuuuuaugcagcaaaaaaaaaaaaaaaguguguguguuuguguguguguguguguguguguguguguguguauaaaguuaugugugucagaucucccauuggcuuaagggauucuuugccauuuaaaaauuucagcuuaauuugaaagaaguuauacccauaauguguaguuugcuuugauuaaaauaauuuuauguaaucacuguaagaaaauuaagccugugauugguauuuaaaaaguguauuuuaaacgauacauucucuuugucucgguacaguagauggguccuguauuuucagcagaacuuaguuacuaaacuuguauaaggauaccuuuucagacaaucccauagaaguaaaaauuauuugguaauauguauuuaaccuacaaaauaauuuauuugaaagcauuuuguaaaacugcaaagcguaaagcaaacguaacauaguauauacauauaauauauugaagagcacugcuguuuuuguaaaagcauuauuucuuucaugauguaagacauuuucauauagcuguuucauacagucucacaauggcuaccuuaaacuauaaaaacacuuuuuaaagauuuaaaaaaagaacacauuaaaaaaaaucuaacaaauaucuaagaaauaaaauuaucccuggucauuucccaguucugagaccuacuccaucaaaacagggaaaaggaaggagaggaugccuucauugcaugguucuuuuuuuuuuuaaugcugguuuuaugaauuuauagacaccccagguuuaacaagccuuuauugaacacauccuuuacaucaagcauuaagcuauuuuaaggggacagacuugacaaaggggauguggguauggaaugggaguguccaggaagucucgaguccacauuuuuucuccagucaagucucaauguugacacugagccaggggccagggugcaaaggggagagguucacaugugcagggauguguugcuuuguaugguucuuaguaauaaaggacaauaguuggagauguuauuguuuaaauauuaagagcaaauuaaggcauauaauucuaucuuuuuuuggguagagaagucuguuucaaacauggcaccaauaggaaaaaagagugauaguuuugauuguuaugacaaaacccuuacaagcccauuucaaagagaaaauacuugaacauauaugaaagaagguuaacacugcaaacagacccagaaagagaauacuuugaugauaauauuggcaaagggacauaagcagacaauuaaaagaagaaauacagguccgucaggcugcuacauuaauuuccuauggcugcuauaacagauuaaaacuugguguuuucacauaauacagguuuauuuucuuacaguucuggaggucagaugucugaaguggguuucacuaggucaaaaccaaggugucccauggccgugcucccuugagaggcucuagaggagaauccauuuccuugccuuuuccaguaucuagagcuacauuccuugcauucuuuggcucuuggccacauccugcaucuucaaagccagcagcauagcaucuucaaaucacucuccuuccauggucccaccaccuucuguuuuuuugugucucucuaccucccucuuguaaggaaauuugugauugccuuuagggcccacucaaauaacccacaauaaugacucuguucaggaucccuaauaucuauaaagucucuuuugucauauaagguaccauucauagguauuaaggccuggauaaccuugggugccauuauucagacuaccacaccuaucaaauagcaugugggguggaacgauacacauauguuuaucuguguauguaugcaugaagccugugcaaggacauacauaugguauguuugggauuauuucaguguguugagauuacaggguauuuauaauuuucgaaaaguuccuuuuauauaacuguuuugcauugucagaauuuuuauggaauguauuuuauuagugaucagaaaaagcuaagaaacucuuggaaagaugauuuuuuaauagacaguuuuguaagaacaauuuuagauuuacagaaaacuagaaaauguaguagaguucccacagacccuuauaccuaguucccccuacgauuaguaucuuacauuaguaucguacauuuguuacaguuuaugaaccauuuuggauacacaucacuaacuaaaguccauacuuuguucagauuuccuuagguuucaccuaauauccuuuuuuuuuuugagauggaguuucacucuuguugcccacgcuggagugccauagcgccaucuuggcucacugcaaccugugccucccagguucaagccauucuccugccucagccucccaaguagcugggauuacaggcauaagccaccacggccggcuaauuuuuuguauuuuuaguagagaugggguuucaccguguuagccaggauggucuugaucuccugaccucaugauccgcccgucucggccucccaaagugcugggauuacaggcgugagccacugcgcccggcccaccuuuuguaauuucuuaaaggauauguuguaauugauuaaauacuuaagaucuguacacauuacaucaauuauucucuuacauguuacauauuauccacaaaaauguaguuggaagcuggacuuaauuaauuuugaaaggaaaaaagaaaaauuagaugagagauauuuauauugauggaaaaaugaaggugugaaauguacuuuacuaauaauuuugcauuugggcuugcaguucucuuuuccuuccuugaaaaagccugaacuucacaacaccaggucuuuucauguuucuaaagaaucuauaguuuucuuuuguaguacagcgcacaugauauuugcugucguuuggugaauaucuggcuccccaacuggacugagagcuccaggggagcagggaccuugugggcucugcucccugcuauauccccugugccuggugcauaguaggcauacagauacaaauggacugucauugcauaugcucuuuugaacuuuuagaaauaugagugguuaacuauaggguacauuuuuggguaaauaaucauaacaauucugugugaaaaggguaauuuaaaauaguaguaucaaaaauacauuuagcugucuuguccccuccauauauacuacauauauauauauauauauauauauauauauauauauguauauguauguguguguguguguguguguguaugcgcguauauauauagagaggaagaaaacuagaaguauauuauugcaaaacauuaagagugguuaucucuggguuaugagauuauggcuggcuuuaauuuuuuuugagauggaguuuugcucuuguugcccaggcuggagugcaauggcgcuacucagcucaccgcaaccugcaccuacccaguucaagugauucuccugccucagccucccuaguagcugggauuacaggcaugcgccaccacgccuggcuaauuuuauauuuuuagaggagacgggguuucuccauguuggucaggcuggucucgaguucccaaccucaggugauccacccaccuuggccucccagagugcugggauuacaggcugucuuuaauuuucuucuuuguuuuuuagcucuuuccaaggaauuuacuauuuuauaauuuggaaauaccacaauauuuuaccugguauuacuuuuuguuuuuuugagauggagucucgcucugucauccagggcagagugcaguggcgcaaucuuggcucacugcaaccuccaccucccggguucaagcgauucuucugccucagccucccgaguagcugggacuacaggcgugagccaccacacccagcuaauuuuuguauuuuuaguagagaugggguuucagcauauuggccaggcugguguggaacuccugaccuugugaucugccccccucagccucccuaagugcugggauuacaggcaugagccacugcgccuagcccugguauuacuuuuauaauuagaaaaauuagugaguccuauacuaaaaacguuucaauucuagcaugugcaagagcccuugaggcaagauaagaaauuugugaagucaacgaccaccuuauuccccaggagagcuuuuaucuauuuaaaccaaaaaaguauagcugaacuuuagaacuauguucuaucuuagggucuuugaacuaguauuuccuaugccuacuaucuucuaguuucaucaaaaccacuucaaauauuguugaucaauuaucaauuuaaaaguggaguuuuccaacuaucuugguaugacugucaugucauauauguguuuaauucccuuugcuaauuuaacuuuugugcauuaaucuaaaaacuuaggggaaaaguugauuuucucuuauuuaguauuuuuuuaaaguccaugauauaaaaucugcgucucagucggcaauaacagccuacauuuuuccuuaagacaaaagggaucauucuuuuuuuuuuuucuuaauugucccuuuuuagauaggacaugaaucccuggauuaggugaaaaaucaugaaaauauucugugguuuuuauaaauccaggccauuuguauguuccuugccuguuucucuagauaauuaaacagugauggauuagaauuaggcugcagcagagauugggggaaaaaaaaucucccggcaucccuuccugcagaagcauccgcuacagcagugaguguagcugccacuuuaacugacaugucuuaaauucugcccuggaaagcccugggaugcugucagcugccucggcaacuacuuugcuugugccugagaauugagagucucacuggagaccaaggaauaaaauagaaauugaggauuuuuguuggcucuaaaauugagguuugucucuucuuuuaguuggcuuaaaaaaaaaucugguagaagagagggaaagacaucuucauagugggacuauauucauuccuccaaaguuacagcugcucuaaaucugugaguaugucauauuuauuuagcaguuccuggguuuaugauucaaauguucucuuuaaaucuaugaggguuuaauuuaaggaaggcuauguaaauuuuuuaaacuccaguuaaauuucacuggaaccugcaguuuuuguuagaugacauugucuucauuaagagcuucaugucaagccugcuuggcuuccccucugacccuccccccaaccuuuuuaaaacuuccuaaggugagugcugaaauugaagaaaauagugugacuugcugcggaggaggaucuggucuucccgggaugccauggcugguuuauugcugcugcaaggugugcgucugggcggcugagacuccugcugcagaacaauggcaggaugaugcugguucacuuuguauuuacuguuugucuuauguccucugcugguuucauuauagcauuuuguuuuguuuuguuaggguaauuagaaccuuagagauuaguaaaguggcuuguccucagaaauagcauguguugauuguccuagacucucaccucugaccuugcugugcuggcuuuaguggucucuuuguagcagauuacaguaaaugugagcuaccaaaaagugaccuuuguauggccaccuuuuaaaauugugcaucagaaucaaugcuggguauuuuuuuugugugugugacgcagacccuggagucuaaacaucuguccuuagucaucgugucccauuuucccccuuuggaauuuccuggacguuagaauuguauccuugcugaauuagugagugaguuuugagcauucucuaaagauaaguuaauuuuugauucucaccauaacccccauauguuccugauuugucuuuguugaauaaaagucauauuauugaacagauucauauaauuuggcuacugauuuuguuccuuuaucuuaaaauuacauuagcugaaaugauuuuuaaaaguugauauguucagagaucaguagucaaaauacuuuuaaacaccaacugguaacagucaucguuguagaugcagaauauguuugacuuaggcugacauauuauaggagcuuuuugggugccaguauuuugguugacuuccugcaggguaaaauaaaucaaggauuuaaaaaaagaaauuuucucuaccacccagagaucaaacaucugcuguuuuuauuuuuaaacauuuugucauaccuaaaugcagcaacuuugaauuuaauuaggaaggauugcuaaaauuaggaaauucugccuuacuuaaacuugcaaagaucuuauauucguucauucauuucauucauucauucauucauucauucauucaaaaauguuuacaucuguuacgaagcucuugccaggcucuggggauaugaugcugaacaaaauauuguaucuucccucauggagcagauauuuuuagcagaugaagagggcauuaaaaaacugauuaccuaauuucauuaaaauugugguaauuuuucaccuguagaaguguaaguacuuuguggccaaacauauaggacauauaaauaccugcaacuaauucugccccagaucugaagguacagaucccuagaaugcuuaagcuggaaagagauguuggaaaugaguuaacugguucagcaagcauguggucagugcuauaguaagugcugaguuuaggucaguaagugagaaaugguucugcuuuggaggagcucauagucuuaguggaagaggaagggaaauuggcuauguuagaauguucugucaucaauuucccauuuuacuggagaagaaacaaccuagauuauuuuuaaaaugucuuaugugccaggcccaguaucuaugguaaaucuguuuuuggcuuuuaaaaaaaaucuucaacagcaaccauguugauugaccuuaaugcucccauuuuccaaaugaggaaaacgaggugcacaaagacuaacucaguugccuagggucacucagaauccugauuguaacuccaucaugcuaaaaguuggcaacucugugcuccuugaagcugcuggauuaugucccuuagucauagguugguugggggagcccccucguuuuuuuuuuuuccuuuuucuucuucuuuuuucuccuaaagccacagugcacuccuaaauaucaugcuauuaugaaacaggaaaaugcauaguuuuuuuuugccucaugcccagaggucuuccuaacauuuuguacuugcuuuccaccuguuaacagcacauauacauuuaugucuuugguucacuuuagaaaggacaggauugcacuuaugggcagauuaugcuucaguggcaggccaguuaaggaacguggaaaacaugcacccuagaagaggaaugcuaauggaaaaaucaaggguuucuugaauuuuagguccagaaugcuguucaccaacaucagcaauucccuauagggccgccauguucagaguuguacacaggacuugucuccuguaaugaguuggaauucuugcaaauuugaaaauugaggguagggaguaacuuuucaggagagauauuauagcacaucuugauucuaaaggccauuuguccauuuccuuucugaaugacuguuagaauguucuuccuuagaaugaagucuuccuuaucgaagaugaacuuuaccucucuacagccuccuacccacugaucuuaagauaaaaccacucuaguguuuuuacaaaguagucuuucaaauauguaaaauauucucccuaccagucccugguggaucuucguauauccaagcuacacauccucaguuaugucacuucucucuccugugacauauuucaugcuucucuccauucugaucucuuugaauuugaccugucauaguuucuagaugguuacaaccaaaacuggacacuauuucuaguuuugucuggucagccaagagugcaaaugggucauuuguuucucaugaugcaguaauguuauucuucuguuaauguuuccuaugcugcauaucaauagcuguguaacaaaucaccacagagcuuaguagacuuaaaacaauaacaaucauuuauuugcuuaugaaucugaaguuuaugcaggucucagaggaaaugacucaucucugcccacuuggaaucaccugggguggcucagcuggagcuggaggagccauugcuaugauggcucacuuaccuggcuggccaguuaguauugguugucagcugggaauuuagcuagaacuguugucaggggcuuuguucuucuccauguuguugcuugagcuuccucacagcauagcaaugugguucugagcuuuaguauuccaaaugacaagaaguagcaacugcuagucuuuaagauuuggaccccaaacuaacacaguguuguauuggucaaguagucacagagaccaccuugauucaagaaguggggccauagaccucacuucuugacaggaagggugacaaagaauuuguggccguuuauaaucuaccacacuugccaaauuuuuggucucuguccuucucucuauuuccagcugagucauacaccuuaaacuccucaacuaaaaccccaagaguuagauuugaauuuuuguuaaggugagucuccucaccuuaaugagauaccccucugcagacuaacaucaagacauuaaccaaaauguuaugugacucuggugauuuauuuauuuauuuauuuuuugagauggaguuuccugucacucugguugcccaggcuggagugcaauggcgugaucucggcucaccacaaccucugccucccagguucaagcaauucuccugccucagacucccuaguagccgggauuacaggcaugugccaccacgcccagcuaauuuuguauuuuuauuagacacaggguuucuccauguuggucaggcuggucucgaacuccugaccucaggugaucugcccgccugggccucccaaagugcuaggauuacaggugugagccaccacgcccggccuggugauuuauuuggguaagaaaugacuuaacagugccauucuacccaaguucucugacuuagccagagaaauuuaggugguaauugcagaagagcaaacagaacaugaguuugaugugaauuucaugcaugguuuacuuuucuuuugauguuucgucagucuacagauguggaaagucuuuagugaccaagugguauggauggauuucuucggugaucauuuuagauuaauggguuauagaauauuuuauuuugaguuauuauagguggcuguaauuuagaaagcaggaaaguaugaaaccaagacuugaauuucucuugugguuuggggcuguagucauuguuuucuuaguuaguaguugugacagaauuugagcccuucauuccagcaauccaggacccaauauauagcguuuauuugccaucaccccuccuuaauauuagcuuagguguuuuuguuuuuauuuuuuaaaguaauagcaucccuguauagcaaaaccauuucauaugccugcuugauaccacaggcugaauaaauacagcacauuaacuauggaaacagccacauauugaagaacuaaagaaaaacucuagaguuuaauuacucgaauauuuauaugcuccuucuucaguuuuguuuguuuuuccuacuaauagauauuuguagggagagcccuuauaucuacugaaagcugcuuguuugugaaugaagguuucugugaugaaauauucauggguacuuuucaugaucuacauaugugacauaaaaugccaaguaggaagacugaauuugaugcaaggggcuaauugcaucaggaagaaugucauucauucaucaagcagucauugaacaucucuggauuaagaaacagauaguuccuguucuuaagaagcucauaagcuacucacuguaauugaaaaguagaccaauaauuauacuaugaguuguaaacuccaaccagagaacccagagaagaaacauacuaucuagccugagaaaaugacuuuuuggaagccuuuauuuuuuuucuuccuccauggaucaugaggcaaauaaaaggaaaacuuguugucagaauugucuuuagaaaaacuuuguuacucuuuguuuuagguggugauauuuuaaaagaaaagacaaugucccccccauucagugucccacugaaaaccuguauuugcucuacaucugaaaauaucugcauuccaacguggagcgaugcaaugcaaauggcaaaugcugccucaguggccucugccccaugacugcaggaagcauuaagcagaacugcugaauagcaggaauauaauggucugucuaaugggaaguucuuggcucccauaacuccucuaauaacaucagcaccacuauacuccucuauaacuccucuaauaacaucagcaccacuucauucccuugcauuuaugugauguuucaguuuaaaaagcgauuuuacaaaauggagcacguucuuuccucgugguaucucugggagggacauagggcagguguuguuauugcugcuuugcuuuugcagauagggacacugagacccacugaggugaggaaguggcgcaaagccacacugcccgccagugacuggcguaccuaggacaggaacacaguggucugcuaugugucccagcaugccuucuccuaaaucacgcuccagucaugugguaagagaggauaauucauagauuagguaagaaguuuucagucagaaauaagagaacccuccaauagggaaaggauuuuuguuuguuuuuaauuuaaaaaaucagcaaagaaaacuagcaaaaugaaacaggagcugugccuaucucuugccaauccaacauuccauuguuguuuguuuuaaauaaugugaaggagucugauuugcuugccuaaggaaagaauuugaaaagauacaggcucugguucuaaguuuccaacuuggucaguaauuugcuaugacuaugggcaaggaaaacagcagcuguuggaguaguuucuuuugcugaaagagauaguaagcacuaccuuccauuuucuuucuaaaauuuuuuuuuaaaugaaaagaaaauguuuuuagagacuccagccugggcgacagccugugcacuucacagugcugcccacugcagcuuugaacuccugggcuuaggcuguccucucagccuccugaguagcuaagacugcagguguaugccacuacauacguccaauuuuuuauuuuuuuguagagaugggcuauugcuauguugcccaggcuagucuagaaguucugggcucaagugauccuccugccucagccucccaaaacacugggauuacaggugugaggcacuguacccagccugcuuuccauuuucuuagugaguagcgucuuugacaugaaguuaaagccagguacuaugagugcucaccugauuuuugguucuuacgaaagugcuuuuuuucuguagacaguuguuaaauugguuuccuugcaggggcgaugaccaguggagccuuauauucugccaucuugcucugccccuuaaugaguagggucugaaucaugcuuuguauuguauaugaaaauguacuuguauucuuuucaacuguucuccuuuacucuggaacuuucauccccauugaggacagaaaagcacauuaaguggucaauuaaaaauuacaucaucuguucaaauuuccagcagucuguuuuggagugacucagguuuucugggagaugugggagggguaaaugcccaguuaaguaaaaacuuaaacucuguaucaggcuuauaucuuccuucuuaaaagguuuucccucucucuccuccuucugacauggcguugggugcaggaagaggugguguacagauggccccugucuggggacugcugccugguagagggccccauccuguugucuuugcauuggccucucuccuugcugccucugccaccaaaggauuucuggacuguuggugugccuguggcccaagggcuuggcauucuccacuggcauugguuggcccacagguuccugagauccagcggccacucacauuuaaucgcugucucugcccuuuguuacagaaucaucaugccaauaagcagucuuuuaaaaaaacauuuuuauuuuaugauaauuccaaacuuacagaaaaagugcaagaauaacacagagaacuucugaaugcccuuaauucaguuuuaacauuuugccauauuuguuuuauuauucuauguauauacauuauuagguauuuucugagucauuugagaauaggauuuugcuccagagaagguggucuagaaggaugaaccaaaaucuuucuagugaauggagcuuucauauuccuuucuuuucucugcuuucuuccaauucuucuuucuuucuuucuuucuuuuugagauagggucuugcucugucacccagguuggaguguagugacaugaucacagcucacugcagccucaaccguccuguuucaagcgauccucccgcuucagccgccugaguagcugggacuacagguaugcaccaccaggccuggcugauuuuucguauuuuuuguagagauggggucucccuauguugcccaggcuggucucaaacuccuggacucaagugauccgccugccuuggccuugcaaaaugcugggauuacaggcaugagccacugugcccagccugcauuucccguuguugauauucuuaaaaguguaugucuagaccaucagauaggccaggugugacuggucugacuagaggagaaugauguuauccuucauuugcuccuuuguuuauuuauuuaaucaaccagcacagugguauugaagaucauuaccugcaagacacuguacuaggugcugcgauacaauccugccuuuaugaaguuuguacucugauuaagagauaauuauauuuuuaagucagaguuaauuaggcugcuugcgguggcucaugccuguaaucccagcacuuugggaggucgaggcagguggaucaacugaggucaggaguuugagaccagcgugaccaauaugaugaaacuccguuucuacuaaaaauacaaaaauuagccagguguggugguggcaugugccuguagucccagcuauucaggaggcugagacaggagaauugcuugaacccaggaggcagagauugcagugagcugagaucccacuacugcacuccagccugggugacagaacuagacucugucucaaaaaaaaaaaaaaaaaagaguuaauuaaaagaaacuuacgaaagauuacuauuuuccucauucuagaugcuauaguuuucuuaauacagcuuaaguuguaucaggauucauauucuguuguguucacaaauucauuuaaaauaauucacaacuuuuuacaauguuuuuaagucacaucucuuuuauccuguuuuuauucaguuagauuuuauaaauuauaaauucaggaauuuauaauuuauucucacucagguaucaucuuugagagcaggcaugcuauuauuuuuugugcuuuaacaucugauaccaugccuggaauauggcauuccuaaauguuuauggauaaaaauuaaauuuuaguuuacuaaauauaagucauccacuuagagcauuaucuuuuuaaauuaugguucauucacugcuaucuuuuccaguuucauuguuuugcagaguuuuuuuuuuuuuaaccuugcauucucuauuuuaaucccaguuucugauacaaauguaaaacacaugauaaagggaaguaccucuugagagaagcuguucaaacaguuaugaauccaucuauuugaaugagcuugucauuccccauuuuccauacagagcuaagggacacuuggcaaauaucacauucacaugggccucaugugcuacauuuuucucaucugccaaagaugggaaacacggcugguauuagagaacucgugagagcgccaucucuuagcuuccuaugagggcugauuccuucaauaaggcaugaaucauuguucguuuuuagcaaagguagaugcaugaaggaccagauugagaugguaaauaugcauaaaguaauaaguuugaaagcaguucaggaauauaauaguagaccuauugaagcauguuaucaaugcaggaaauagaaaagauaaaauuagaaaaaccacauucaagaacugacuuuuuuaaaguagugaaagguuggaagacuucuaaaaggucuaaaauaacaugagaaacacauugaguagugauguauucugacuucuucauguggagagggccaaaaauaauaaauuauacuguucuugcauauuucuuagauaacuauuuugaguuaugugugauaaaaagggaugaucagaggguguuuccuuaaauuaauauuugaauauucccuucaugaauauagacuuaaauuacucaaaauauaugcuuaacuuuuuucauuauuguuaaaaugguacauuaucauuuuugaaaaaauugaaaaaaaaacauugaaaaguacaaagaaucuaaagauuacccacgcccuacaaauaauacuaaggguuacaguuuugauugaggaaggcuuuguaagaagucuaagcauagauuauuuagggagaaguuuaucuaguuuaucuauucgccaguuucucguuuaauagaacaguuauauccuuuguuggugcuugcccuuuggccuuuuucagcuguuuuuccuucgugaggaacagggccagaguggagagaaaaaguugaaaguauauuccuuugauucugaaugcacuggugacaggccuggcaaaaugggauuggaguuggcaguaaaaugauacuuggggaguaucuuuuuauuuuugggcucuucuugcuuucucauugucagcagcagcaccuccuccuuccucugaucaucggccaugagaacagcucuuugaggaaucauccuugggcagaauuuggucugggaagcaguuuuuuuuaguaagaaagacaaauguugucuauguagcuaauacuauuaagcaauagauuuccaguggugugucagaguccugcauuucauaauucuaguggauaccauuuuuuauuuuuaaaguuuuagauuugaagguacaugugcaugucuguuacauggguauauugcauaaugguggggauugagcuucuaguguacucaucacgcaaauauugaacauuguaucuaaaagguaauuuuucaaccuucaccuccauccucccuccccucuuuuggaguaccaagugucuguuauuuccaucuuuauuugcauuuguaccuauuguuuagcuuucagaagugagaacccaugguauuugauuuucugcuucugacuuauuucaucuaggauaauggcuucuagccauucaaguugccgcaaagaugauuucauuccuuuuuguggcuacauaguauuccauucuguaucuauuccacauuuucuuuauccagucaaccauugauggacaccuagguugguucuaugacuuugcuauugugaauaguacugugauaaacauaugagugcaggaaucuuuuuuauauaaugauuucuuuuccuuuggguagauaccaggcagugggauugcugucucaaaugguagcacuauuuuuagcuccuugagauaucuucauacuguuuuccauagagguugaagcaacguuuguucccaccaacaguguacaaguguucccuuuucuccauaagcaauccaacaucuguuguuuuuugauuuuuuaauaauagccauucugacugguauaagaugauaucucauugugguuuuaauuuguguuucucugaugauuagugauguugagcauuuuuuuuuucauguguuuguuggccucuuguauuauuuuauuuaagaaauaucuguucaggccuuuugcccaguuuuuaaugguguuguuucuuucuuguugaguuguuugaguuccuuguagauucuggauguuagucuuuugucagaggcauagucugcaaauacuuucuuauuuuugagacagggucucacucugucaccugggcugagugcaguggugcgaucuuggcucacugcaaccuaugccucccagacucaagugauccuuccacuuaagccuccuuaguugcuaggacuacaggcaugugauaccacgcccagauaauuuucauauuuuuuguagagacaggguuuugucguguugcccaggcuggucuuaaacuucugagcucaagugaucagcccgucucagccuccaaaagugcugggauuacaggcaugaggcaccacacccagccaauauggucauuuuaaugauacugauucuuccaguccgugugcaugggauguuuuuuccauuuguuuguaugaucugugauuucuuucaucaguguuuuguuguucuucuuguagagaucuuuuaccuccuugguuaaauguauuccaaggauuuuuguuguggcuaacauaaaugggauucaguucuugauuugguucucagcuugaacauaauugguauauagaaaugcuacugauuuuuguacguugauuuuguaucuuuacugaaguuguuuaucaaaucuaggagucuuuuggaggagucuucgggguuuucugucuuuuugggaggagucuuuggggcuuucuagguauaugauuaugucaucaauuaacaaagauaauuugacuuccuuuuuuccaauuuggaugccuuuuauaucuuucucuugccugauuucuuuggcucggacuuccaguauuauguugaauaagaguggugaaaguggguguccucauuuguuucaguccuuaggggaaauguuucaacuuuucccaauuccauaugauguuggcuguggguuugucauauauggcucuuauuauuuugagguauguuucuuugaugccugguuuguugaagguuuuuaucaggaaggcauguuggauuuuaucaguuguuuuuucugugucuauugagauaaucauacgguuuuuguuuuuaguuuauugauuugcauauguugaaccauccuugcauaccuggaauaaagcucacuugauugugaugaauuauauuuuugauguguguuggauucaguuugcuaguauuuuguggaggauuuuugcaucuguguuccucagggauauugguugguaguuuucucuuuuuguuguguccuugucugauuuuaguaucagggugauccuggauucacagaagguguuauugcaccuccucaaauuuuuuguaauaguuucacuaagauugguaguagcuugucuuuauaugucugguaaaauuuggcugugaaugcaucugguccugagcugcuuuuuuuuuuuuuuccagaagauuuuuuauuacuaguuuaauuucauuacuuacuuauuauuggucugcuugggauuucuuuuucuuucuguuucaaucuugggaguuuguauguuuucaggaauuuauccauuuccucuagguuuucuaguuugugugcauaaaugaguucauaggagucucuuaugaucauuuguauuucugugguauugguuguaauaucaccuuuaucauuuuugauuaugcuuauuugaaucuucucuuuuauuuucuugguuagucuagcuaauggucugccaauugguuuauccuuuugaagaaccgacuuuucgguucauuuauucuuuucuuuuuugagauggagucuugcuuuguugcucaggcuagaauacaguggcaugaucuuggcucacugcaaccuccgccucccggguucaaguaauucuccugccucagccucccaaguagcuggggcuacaggcaugcaccacuaugcccugcuaauuuuuguauuuuuaauggagaugacguuucgccauguugggcaggcuggucucaaacuccugacaucaggugauccauccgccugggccucccaaagugcugggauuacaggcaugagccacugugcccagccaguuuauugaguccuugccuuuuuuuuuuugucucaaucucauuuaguuuuguucugaucuuuguuauuucuuuucuucugcuagcuuuggguugguuuguucuuguuuuucuaguuccuugaguugugauguuagguuguuaauuugaggucuuucugucuuucugauguaggcguuuaauuaaugcuauaaacuuuccgcuuagcacugcuuuugcuguguaccagagguuuuaguauguugugucuuuguuuucauucauuuaaaagaauuuuuuuauuucugccuuaauuucauuguuuacccaagaguuguucaggagcaaguuguuuagguuccauguacuuguauaguuuugagaguucuucuugggauugauuucuaauuucaucccacucugguaugagaaaauacuugauaugauuuucauuuauuugauuuuauugagacuugcuuuguggcugaguauaugguugauucuggagaauguuccaugcacaaaugaaaagaauauauauucugugguuguucaguagaauguucuauaaaugucuuuuagguccauuuggucuguaacccaguuaagucccaaguuucuuuguugauuuucugccucgaugaucugucuagugaugucaguggagguguugaagucccucacuauaauuguauugauaucagucuauucucuuaggucuaguagcauuuguuugauaaaucugggugccccaguauugguugcauguauauuuagaauaguuaaaucuucuuguuauauugaauccuuuaucauuauacauaauguccuucuuugucuuuuuuuacuguuaguugguuuaugucuguuuuacuugauaugagaauagucacuccugcucacuuuuguuuuccauucucauuuuaugucuucuuucucccuuuuacuuugagucgaaagguaucuuuagccaguaggugggucacuuguaggcagcagaugguugggucuuguauuuuuuuuaaaaaacuaguuugcuacuccguaucuuuuaaguggggcauuuaggucauuuacauuuagguuaguauugauaugugagguuuuauuccugucauaguguuguuagcuaguuguuuuggaguuucaauuguguaguuguuuuauaagaucugugagcuuugcacuuacguguucuuuuaugauggugaguauuguccuuucauuuccauguuuagaauucccuucagcauuucuuguaggauaggucuuguggugacagaugcccuuaguauuugcuugucuagaaaauauuuuauuucuucuucauugaugaagcuuaguuuggcaggaugugaaauucuuggcuggcauuuuuuuuucuuuaaggaugcuaaaaauagaccccaaucucuucugguuuguaggguuucugcugagaaguuugcuguuagucugauggguuuuccuuuguaggugauuugacccuucuuucuaguugccuuuaaaauuuuuucuuuaguguugaccuuggauagucugaugacuauaugccuuggugaaguucgucuugcauagugucuugcagguguucucugaaugucuuguaucuguauguucaccucuguagaaagauuagggaguuuccugaauuauucccucaaauauauuuuccagguugcuuacuuuuucuucuuccuucucaggaaugccuauaagccauagguuugguugcuuugcacaauccuguaugucugaaaugcuuuguucauuuuuaaaaauucuuuuuucuuuauuuuuguuuggguuaauuugaaagaugggucuucaagcuauuuuuuaaaaaauuauuaguuggugauaugaauuggaggucuuuaagcucugaaauacuuucuucugccugguccagucuauuguuaaaacuuucaacuguauuuugaaauuucuuaagugaauuuuucauuuccagaaguucuguuuuuuguuuuguuuuguuuuguuuuuguuuuauuuauuuauuuauuuauugaucauucuuggguguuucucacagagggggauuuggcagggucauaggacaauaguggagggaaggucagcagauaaacaagugaacaaaggucucugguuuuccuaggcagaggacccugcggccuuccgcaguguuugugucccuggguacuuaagauuagggagugguaaugacucuuaaggagcaugcugccuucaagcaucuguuuaagaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucucccuacacagacacggcaaccauccgauuucucaaucuuuuccccaccuuuccccucuuucuauuccgcaaaaccgccauugucaucauggcccguucucaaugagcuguuggguacaccucccagacggggugguggccaggcagaggggcuccucacuucccagcaggggcggccgggcagaggcgccccucaccucccagacggggcggcuggccgggcggggggcugacccccccaccucccuccuggauggggcagcuggccgggcggggggcugacccccccaccucccugccagauggggcggcuggcugggcggggggcugaccccccgacuucccucccggauggggcggcuggccuggcgggggcugacccccaccucccucccggacgggguggcugccgggcagagacgcuccucacuucccagacgggguggcugccggauggaggggcuccucacuucucagauggggcggcugccgggcagagggacuccucacuucucagacggggcggccgggcagagacacuccucaccucccagauggggucgcggccgggcagaggcgcuccucacaucccagacggggcggcgggucagaggcgcuccucacaucccagacggggcagcggggcagaggcgcuccccacaucucagacgaugggcggcggggcagagacgcuccucacuuccuagaugggauggcggcggggaagaggcgcuccucacuuccuagaugggauggcagccaggcagagacgcuccucacuuuccagacugggcagccaggcagaggggcuccucacaucccagaggaugggcggccaggcagagacgcuccucacuucccagacgggguggcggccgggcagaggcugcaaucucggcucuuugggaggccaaggcaggcggcugggagguggauguuguagcgagccgagaucacgccacugcacuccagccugggcaccauugagcacugagcgaacgagacuccgucugcaaucccggcaccucgggaggccgaggcuggcggaucacuggcgguuaggagcuggagaccagcccggccaacacagcgaaaccccgucuccaccaaaaaaauacgaaaaccagucaggcguggcggcgugcgccugcaaucgcaggcacugggcaggcugaggcaggagaaucaggcagggagguugcagugagcccagauggcagcaguacaguccagcuucggcucggcaucagagggagaccguggaaagagagggagagggagaccguggggagagagagggagagggagagggagagggcgagguuuucuucucccuucuccuugucgccguguguuccggugucauggcaccggccagguggaaaccacaucugcggaucauugggaauguuggccaugcuucucgaaccaguuuucucucacggaggaccuagccgucgcguggggcuagaaaagguccugaagcaacugaagauuucucgccagggcuacacccugguguuaucugaaggcuucuggacugaccccgccuccaacugcccggcuggguguccgcaacaggaucuacagcuguccuaucgcaaaauuuccucuuucccuauccacaaaugccaugucuccuauccucucuguguaugcaguguuugagaauuuuuauaguucagggaaagaguccccagaguguucgaaccgugccugagcggccgccgucgucucccggcaccacuggcccugcagcagccaguugagaagggcggaggcugauuccaaugaaguggcagaacguuaggcggccucuccaaaaagccagcuacgucgccguuagccaagguuugagggucuucuccuucucuucgagggcccaaccuccccuccagauuuaguacaccagaggcgucgcagcaacggcugcugccugcgcgccucagcuaggcgggcucuguuuuuguuuuuuaaaggauauuagucucuucccucauuucuuggauuacuuucuugguuucauuguguugaguuuucaaccuuuucuuggaucucauugagcuugcuugcaguccauacucugaauuauuuaucugccguuucugaguuuuuauuugguuaaggucuguugcuagacagcuagugugacccuuuggugaugucacaacauuuagauuuuucauggugccagaauuuuuauguugguuucuucucaucuagagaggcuacugcuuuuucuuuuugaauuuauuuucauuuagaugggcgucccccccaccucccguuuccaccucuucuagggguguaacuauagcguuaguauguuggguagggucuuuuggguucgcuucuaaggcccugcgcgauucugucugcagguuuuauauuggucugugcaguuugaccuggaggucaguagguggcgccuauggguaagagccauuugccgcacaagcagauggguauauacuugauuuuuauuuacugugaugagaccucuguuguuucaggugaugagcuggacagaggagugccuggugccuugagguucuuguucagguuggggaggggggacauagcugggcagaacuggauucccuagcuugcccaugaguaucacagugacgagcucaagcuccagcccuggugggggugacucgggggagcuccuggugagaugugccaaggucucugcaggauuugagagggcuccacuggcuugauggauaccauuucgacucuagauuacaaacaugguggcuuccagagcacaucaguuggccuaucuacacucauuccuuuucuccccuaaggagagauuuuaacguugauggaaaaccuugaaggacauauuuuuauucauuuuugaaauuuuauuuuaguuuuaaauauggacuagcuuuuaucucauugcgcaggaacauaacauauuguguuggauuuauuggggaaguuaaauuugaauuggcucugcuaucuaugauuugauugagagaaaaaguauaaacaaagauagcuguaagcuuuacccucgaaaauaguuguaccuagugauuaaaauuagagcaguauucaaaugaauaauaaaaagauaaguaacucaauuaaaaaugggaaaauaaucugaauagacauuacuccaaagaagacauacaauuggccauuaaguacuuaaaaaagauucucaacauuauuagucauuaagcaaaugcacaccaaaaacuacagugagauaccaccauaucucauggacaaaaacaaguauuggccaagcuguuaagaaauugggaaucuaguacauuauuggugggaauauaaaaucacauagcuggccgggcaugguggcucaugcugguaauccaagcacucugggaggcugggguaggaggauugcuugagccuaggaguucaagaccagccugggcaagauggcaaggcaccauuucuacaaaaaauaaaaauuaaaaaaaucggaaaaaucacacagccacuuuggaaaacagucuaguaguucuucaaaaugucaaacauaaaguuaccacauaauguagcaauuccacauaccauaauuuagcauuccauagcaaugcuagauauauaauuaagagaaaugaaaauacauguccacacaauaacuuguuuguuuuuuuuuuuuucugagauggagucucacucugucacccaggcuggagugcaguggcacaaucuuggcucacugcaaccuccgccucccggguucaagcaauucuccugccucagccucccgaguagcuggaauuacgggugugcaccaccaugccuggcuaauuuuuguauuuuuaguagagauggaguuuugccauguuggccaggcuggucuugaacuccugaccucaagugaucugcccuccucggccucccaaaguccugcugggauuacaggagugagccaccaugccuuggccaagaacuuguacaugaauguucauaacagcauuauucguaauggccacaaaaugcaaauuauucauauauuaucaacaaaugacuaacaaaaugugguauagcuauacaauggaauaauauuagguaauaaaaaggaauaaaguacuguuacaugauaccacaugaaugaaucuugaaaacaugcuaacugaaaaagccaagcauaaagaccauacuuuuuaugauuccauugauaugaaauguccagaauaggcaaaucuauagacacaaaaaguagauuagugguuguuuaggacuagaggagguggaguggagaaugaggagugacugcuaauauauggauacauuuuggugacaaaauauuauaaaauuagauuguggugauagucugugaauauacuaaaaaccauugauuguaaacauuaauugggugaauuuuauggucugugaauuaggucugaauaaagcuguuuaaaaacuuaaaaguuagagccguuaaaauagggcaaaauaagggcauauauuccaauguacuaauagcuguaauugaaguuugguguguuauuuuucguagccuccaguauaaagauuuagcauggcucuuuugcaaggguacaugcauaucagugcaguguucagauauuaaaagccuuuauugaaggaaauaagagaagaccugaauaaauguguaaagaugugaagaugcaauguuauaaagacaacaauucucuguagauuuccuaauaauguaaugaauucccagucaaaacuccagcaggacuugcuuguaauauuauaaugacuaacucugaaauucauaaacaagaauguagguguaauaauaacaaccccacaaaaagaguguuuaauaaaguagagaacuugccccaguuggcuuacaggucucggaaagccaugauaauaaaaacggugugacuagugcagagagaggcaaauaugugauggaacaaaagaaugcccagaaacagaccugagcacguauggaaaauugcuguguguaagagauugcagaauaauccaguaugucaaaguaucauaauuauggaaucaacgcaugucagugaggaaaucagcaagaugguaaaccugguaacagcauuuggagaacugaggaaagaaaaaguguugaaauaagguuuguuaugcacaacacugguuaaccuccggcaagguaauaaaaccauaaucuuaccacacagaaauuauuugcauaucuaccagauuaaaaaaucuacaaguuaacauaauuuuacagaguauagguuuuaauaguaaauagcaagccaaacaagauauauacucccuagggaauuaaauguuccuugggugggccugucagacagugcuccaaggugaccuugagaggacaugcagucuuccuuuugccuuguuuccaagcucuuauaacaaguagaugaguuauuucuugcuuauccaugcaggaaagaauuaaauguagcucagacuguacacaaaaauggauucuagauuauauuuguguguuugcaauaguauuuucucuacuuuauguauuugaagcauuucuuauuaaugaaaugagaaaaugcauucuuaaaacacuagacaguacuuucaauaaauggguuaugucuauaucuaaaaaaauccuguuuaauaaaaaaauuaguuuguggcaugauaugcuuauugugauauuaacauaaaucuagaaauacuguagaauuuccaugaauucguguacauguguauacaaacauaaagaacuugaagaaucugaaucuaaucuuuuauaccucagaaaagaugaauaaaauguaacauuauuuuguuaauaauuauuauauucugcuaaagucaagucuguugugccagguaaagauacaauaauuuuagcuuuuauuaacagauuaauuuaggcacaguaauauuuuaacuaguuuguuugagcauaagugauuccugaauugaauaucauuagaacacaagcaguucaguguucuacuuaaggagugggagggggaaacuuaugaaguauuuaaagaagcaagacaaauaaaauacuugacuggaacaagugggaaguucuuaguuagaggugaguuggcgguuucugauuggcuaagcuuaaguuuuguuuuuacuguuuacggugaguugaguuuccauuugcucguauaggaaccaucuuugcugaaggccucccaauucauuauuacuguuuuuauuuuuugagauggagugucacucuugucacccaggcuggaaugcaguggugcaaucuuggcucacugcaaccuccgccucccggguucaagcaauucuccugucucagccuccugaguagcucggauuacaggcacccaccaccacgccuggcuaauuuuuguauuuucaguagagacgggguuucaccaugcuggccaggcuggucucaaacuccugaccucaagugaucugccugccucagccucccaaagugcugggauuacaggcaugagccagcgugcccagucccaauuauuuuagcacuuugaaacauauaauauuuaccuggcacaccaaauuuauguuuauaucuaguguguuauauauggcaugucaaaucauugggggaaaagauguguuuuuuuaaaaacaaucuugggaaacauggcaaaagauuagggaaaaaauuacacagcacuaucuuguaccauuuauuuaaauuauaaacgauuaaauauaacauauuaaaaaguaaaacacagguaaaacuauguuauauaaucuuuguagagggaagguuuuucuaaguaugcccucaaaaucaggaauguuaaagaaaagggugauaguuacgacuaaguaaaaauuucaauauuggggagacuuuuauuaaagcuaaaggcaaaugugaaaaggggauauuuuaacaguacauuucagagacuguguguuucuagcccucgaaaaugagucuguaaaugaacagaugggcaagaaugguccaaauggguagauagccuuuucagucggucacuuccucuuucccugcuuguaaacggagcugauggucacugcccagagucuuauuuauggaagugguaccuguauucucagaauaagaaguuuuugugauggaaauaacuugucuucuaaugacauuuucccuuaccuguggaguuuucuucccucccaccacccacaccuaaccacccuuguaagaacaacuucaguuuuccccuaugugaugugaaaaauuuagggaacuugauauauccaagauaaaaaugaaugucuaguguaaaauauuagagugcauugggaagucugaacuuccaaugggggaaaaaaacaaaaaacaaaacuccacuuaauugaggacacugcacuuuuuuuuuuuuuuugagauggaguuuugcucuugucgcccaggcuggagugcaauggugcgaucuuggcucaccgcaaccuccgccuccuggguucaagcgauucucccugacucagccucccggguagcugggauuacaggcaugcgccacgauaccuggcuaauuuuuguauuuuuaguagagacggaguuucaccauguuggccaggcuggucucgaacuccugaccucgggugauccaccugccucggccucccaaagugcugagauuacaggcgugagccacugcacccauuguacaucuuagaauuaaaaaacaaaaacaaaaacaaaaaacaaccacaaaaaaacacgcaaaacuucuccucuuuuuuuaaugacuuuaccucuuuuuuuaaugacucuagcucuucucugugaaauguguacuguuaaggugaguggaaauggaaggagauuggcaauucuauuguaauacagggcaggacuuacucuuaaacucuuucuggaaauuuccuucucugaguggaccugcccccauugugugccugucagauaucugugggucaacaaacuggccgaagauucugcaaggcaaauugguccuuaccuucuuuauguuacuucagcuuucugugguguguauuuagugggaaauuagacaguuuauuaaaaauaaaguacuuuacaaaauaaguaccauugccuucgggaauguauuuuuuggaaauaauuaggcaagugaguaaaggggcuuauuaacaguaguuuguaaugccaaaacuuugggaguaaccuacaugccugaaaaugagggacagguaacaaauuaucauuauuuccagucagcagcauguugcagaugcuaugauaaagcaacucuggauuuauugagaagaaaagauucagaauaauuccuauauguaauccauuauacuguauaccauaacccauuauaauaaguaucuuuaauaaaguuuuauuaaaauauguauagauuuacuugggaaaaaaccuggacggauauauacaagauacaauccuaucuuuggguggagaccuguggaguaauuucaguuaacuuauuuuuuguguacuagaaugaaaaaauaaaguuauuagggcuguauuucaggaauguuugacacauaacaguagauuuuuguuacuugauuuuuaaaauugauaagaaauggagguaagauguauaaaaauaauuggaagacuuauguuguguaauugcacugguguagacuuuucucacaggacaaagaaauaaaaaaccuugcucugccuuuuuaauuaacagaucuucucacucagauauggcaacaagcagccuucacuuugcaucaugugauacacaacaggcgcccagacagcgcggagcgucuacugucagcaggucaggaaggguugugggcauuccugggggaagaggggaggacagucccacccuugaaggaauauaauacugauauuugcauagugcauugcguuugacaaaccaaugaggucaggagaggccuaggcaaguagagugcccauuuuauaaaucagggaaggagauacgguggcugcucagggacucagugaauagguggcacuguuacaugaaagcaaaacaaaauucaacuuuggggcacaacucccuuucaagucgcuuuuaucuuuaaauauuuuuagcuauuauuuuuauuauaaaauaauaaaucacacugccaaacauuggggaaaauggaggaaaggagaaacaaccauaaugaugaucacuugaacacagaauuuugguguauuuccuuccagucuuuuuccuaggcaugugcuucuugauacaguuguaaccauaauagauuuuuucgucaaauauuauauuaugauuauuucuuucuuacauuuuuugcauaaucuugguuuaaaaauauauuuuaagaaguguucauuguagaaaauucagagcuauagaaagcacaaagagaaugaaauauguauuacuauaauccugauuauuuuuguguguauucuuuuucuccucaaauauagagauauuaaauuuuuuucuuaauuggaaucauauuaaauauacuguucaguaaucuacuucuuaaaauuuaauauaucgugauauuuuccccuuccauuagauauuuuucugugguaucauacuugguuaauuuuuguuccuuuccagaucauuuuagaauuaacagauucucucuuugaacaugaagguuuuuuuuaugaguuauuaaggcagcucuguuaaagcuguucuaguacaugagaaaguacuuuucauccauccuuagagguuuauuaaacuuuuagaauuauacagcagauccuuuacuuagcauuuuggauuuugcauuugaaauuucagcuaugcguguguucuuuauacucauggguuugguaguuugucuuaggauucuacccucgcaauauauagaaaagguuacagaauggagauaaagugaaaauaacuucuaaggaucuuaaggcauuuguuuuccauauccuuuuuuuuacuguguguguaaaauuccugcucauggaauuuuguguuuucuucaaaaagaagugcucuuccuucauaguuauccucuaacucauucgauaguuuccuaaguaacuacuguaucaacauuuauaaugcugaguuugaaagcucuaauaaaauaaauaaaaauuacugaaagcauuaauaaauaagggcaugacacgcacaggcagcaacaagcugcaucuguagacuggaagucuuuagcaugcacguaguuguugaagugaugaaccacaccuguauuucccagagagccauaacaaaagagaagagaauggaggaaggaaccuuuugggaacacagaacauugaagcauggcugagacagugaccguucaaacaagagcuacauagaugugugagagaggaagacuacaaguugguggccacaggacaggcaagggacuugggggaagggugaguucuggaaugcagucagcagagccagguguggcaaagaggucuucauggauacagguggaaaaguauccuuugcauuucauaguuaggucauuggagaccuuuagcucauaagguuuuagggaaguugaggcaggagucaggcagcauggcuaaaggucagugggagguggggaaguagggagagugagcaucauuuguuuucugaagcucuugccugugaauagaaggagugggagaaggguguguuaggagagaaagcaagauugagggaguuaucuuucuugcuaguuuuacuuuaaauagaaaugaaugagauuuguguauauuucugagucgggaaggagucaaagagaggaagagguuaaaguuauauaaaagaggaaauggaggugaaauauaagaaauaauugagaaguguuuucaugauagcacagggugggcaucccuaauccaaagauccaaaauacucuagugagcauuuuuuuuuuuuuuugagugucaugugggugcucaaaaaguuucagauuuuggagcauuucaauuuuggauuuucagauuagggaugcucaaccuguacucacauuugcaguuuucauagucuuuuucuuuuuaaaaacuaaacaacagacauucucacucugccuuuuaauugauaggucuucuaaugcauguguugaagaauaaacauaaugugaagcagccuaaaaugacacuuggcaaaguggaggaagcuuggauguggacaagaaguguggcucuuauggaguuagucugaacagaaaaugauagcgccauaccucauauguuacuccuccugguacuccucauuccacaacuagcuauuugcuucuuaacacaaaguugugaggcagccaaggagagaguuugggucaccauuuaacaagugagacaccccggaugucaagugacauagccaagugcaacagccaggcagugguggaauuacaucuugaugcuccaccuucuaauuucugggcuggugcaccuuuaagaaacucauuugccuccuuacuuguaaucccuuucacuuguuuagucuuacagaguguuuugacaaccaugguuucuugcgauucucccuccaaccuugaaagagccaagagagaaucuucccacaaaaggauccucauauccagagaaguacaugaucagcuaaaaugccuugucacucucaaauucuuggaauuagaauuuccugccauuguccuaaagggcaccagugacaaacuuuaagacauuugacaguuuuguguucaucacuucaaaucuguuuacaaacuaguuguugaaacaacuguguuaaggucccuggaaaaaugaggaaagacucugcacccuggccagagcuuugucaucacuuuacuuucuccucuuaccacaucucuucauuagaggugggagaccuguuguuggcucaucaaauauguauuuuuccauaggaaaugggcugaacacaagguuacucaauuuacagucucuaagagaaagugugucuuuuuuauuuacuugagaaagucaucaaaacagaacaggggucuagggccuuagaauuaaaggaacggagagaaaaccuuucauagacuucuuuguaguucacuuaccaagccuagauaugucagcccaguguggguacagaacuuugguagcuuuaguuaccaaaucaagguuggcauugggaaaucccagaauuacacagggaguucuggcugcuccggagacugaguuccagagacugguuuagugggaugaguuguccaaauggcucaaucaugaagguuacggcaaaauguuggccaagggcuuuugagagaagagggugacucucccuuggauugguuaguaaagaauguaggauagagggaguuguuuaaugaguacagaguuucaguuuugcaagcugagaaaguucuaaagauugaagugaugaaccacaccugugugguucacacugugugaauauacuuaacaccaccgagcugugugcuuuaaaaugguuaagaugauaauuuuaugcuauguguauuuuaccacaauuuaaaaaaagaaugcaggacagauuucccagcuguuauuacauaaagucuagcuuuuaccuccuuuguguuagaagagugccagguguauuuuccaugccauuaucacaucuguaccauucccucuuggaacgaucccucuuaguuuaacaacuacgacaaaagaaacccuugacugagcucgggaaagcugaggcagguuuuugggaauacaucccaccuucugacuguacuuacguuacucuuucuugcuucuuccgaauucauuuagccuucaccuaaugaucuggcuuaguugcuuaaccagaguaguuaccaguguuugccaagaagccauuucaaaauaagcuauuuuuauuagagacauauugggcaauguaaaaguguuaccauauguaacaaugcaauacugaaaagcaacuuauuauaauugugcuuauuaacaaaucaggauaggaagaaggggcauuaagguauaauaauuuaaaggaauuuauauaucauguuuugguuauguagacuaagugcuuuuuuaaaaaaaugaacaaaacccaacucuuucuguuaauuaacagaucuacuaaaguagacauagcuugaagcacugcggcacacagggguggcucugggucagaacucugcucuucuagggccuagacgcagagaccccuggcacccaaggccucaguucugaugccauucucuaacaaaagagaccaaggcuccuggcucauuccagcaccagggcagggaaaguacaagaugaaccuagaagaucuugugccagaaaguaaagaauugcugaaaaaaaggacagggcuugucgaaagaacaugggagcaacauaaaggagcuuccaauugccaaauccgggacaauuugagaaagaaaauaaauaaugacuguaaugaguuauauagcccacagaaucaauuaauaugaauguguucauaguauauaaauaauuggguaaacaugucaguggugggagggagagcucuucccuacucauucugacuaauguagaagaaaugaugggaacggaaaauugcuguuugacaaaccacagugguaauggguacagacaagaacacucaguggacacuaaaguuagggggcaauguguguugugaaacgggguaucugcagagucuugagaaccuccccugaagaugcuuagugacucccaagggaacaguaguaaccucacaguagacaccacccuagcuaugcggucaucaccagauaugugcaugcagcucguagcccugauaucaugcacugagaacucggcaucacugcugugguuuucuugcccaaaaugucucuuguccaaguacuaaccaggcucgaccuugcuuagcuuccaaaaucagacaagaucggguguguucagggugauguggcuguagacucuugcccaaaauguguagccugaaucugaucaugaggaaacaucagacagaccaaagggccaugcuacaaaauaauugccagcacccuucaaaaguguuauguaagauguuaucuaggggaacugguuauacaaacucuguccuauuuuuccaacuuuuuggaagccugaaauuauuuggaaaugaaaagaaaaaaaaaacucugcuuccccauuugagucugaaggaugagcacccuauuauucuuucuuagauguaauauuuauaucauuccuuuuauugcauuauguauuugcauuuuuaccuuuuacaucugcauuuuuaucuuuucugaugcucauaacggcaauguuaauaauaccuguuggguggauauugucauauccucauauacuuuucauagcugaggaaacaaagauuuggagagguuaaugacuuucuuggaagucucgccaucuaacacagcccacuguagacuaugagcuuauggggucccuccucucccuuggauaacuaaugagaaaugguagcaggaguuucuguagucuggcuguccagccacaguugcuucugagauucuggacuccacacagcugaaucaauagaccugagacuucuugccauggagcucuugagggcagggaggucuggaguccacaggugcaggggacuuggauuuggauuggcuugcaaaagaacccuggauacuuccacacaaauuaguaaaagucucugaagaguaaacuugucugcccaucauucugugcauacagauucuaaguguuuaguucucacuuuggaaaaaagguuccuuuuuggccuaaguugaaauauugaugcaagagucagacguauggagaucaaauucucagcuucguuauucacaaagacuauguuggagaauguauuauagcuuagaugcguggaaaaaugggcuucuuuuugacauagcucugaauggaauuucagcccuaaagugcaggccucccuugugagggucaugguugggcgguguggggcaguagagccugcccuacuagcucacugcaucgcugagagaauagacuuuucugcacccucuuucccuguaagaaaggggcugggccauuuaugcccuguguuucuuuccaacucaccaaucagauaauuaauuccuuucucagaggaggaaugaagaggggaggagggagaggaaaguccaggagcauucaucuagugaagucccuacucagggaaguccgaggugucggagauaaggauguuccuuuccucaggguacagggagggcaccucuuggaugagggucuugucaccugcuucaggggagaagggugaggggauaugauuauuauauauugguuuuguagacuuuuauuuauuguaacacaauaaaaucccuuuuuuaccuuuuaaucaauagaucuuaugaaucagauauauuaauaguagaaggucaucagauuaugagcaaagugcagagaaacugccaggucaccauguaugugugcauaugugguucuuagcaggggaguuggggcagguugacacuucuggagaauuguaguaaugccucaauauauauaaaugcuuauacuuuuaauuccaggagcuuccuccaucuuuacaacuacuuuuuauaguaguaacugcagacuuaaugaucccuaucuuacagauaaggaagcugagacuuacagagguaaagugaguuguucaagguuacagaacugggaagugguagagaaaagacuuuuccuuuguucuuauuuaaaauacuacuuuuauguuucaaaauuuuuauaaaucaguuuuucauuguaaaaguaaugugagcagaguucagauaauuuggaaagaggagaaaaaagucaccaguuauuucccugucuaacauaagcgaguaaaaauuaugauugcuagaggaaagagacaaaaccuccagaaaaguaauagaaaauggccuugggaggcugcagccuaguucucuaggaucacaguuucaguggaaccaauauauugugggaaacauuugacuucucuugaggcaaaagggagucaggaaaugaauaaaaggaucugauuccagagcccagaugcucauuuacuaugaaguuuuuuuuguaaccaagcuuauaaaguaauuacuaaaguaagaauuggaauguaagugauaaugauauaguauaguuccaaauuuuuauaaguuauguguucauuauauauauauauuuaaaauagacuaaaaaauucauccugccuuaacuuaacauaucuuuuaaauuagaaacaugaggagucgucaccucacugaagauauauauuaugaagggcacucgggcaugucucuagcagggcaggaauaugaauaugugggcugagcaccacaguuuuuggagaguuagacaugguuguuaacuugcauagggcuugaaaguucacaaaacacacucauaacaaccauugccuuugcuucugcagacauugugaagugagagcacuucaaagaugagccuagggacucagggaaguuaagggacauugugaaggucacaaggcuagagaauggcuuggcugacuucuaauuuccaguccaggaaucuuuucauuauuuacaucaugcuauacuugagggggaugcuaugcugaugagccucuugcaaaaaaugcuggagugcuuuuuuuuuuuuuuuuuuuuugagacagagucucgcucuguugccagacuggaaugcaguggcgcgaucucagcucacugcaaccuccgcagugguugggauuacaggugugagccaccaugcccagcuaauuuuuguauuuugaguagagacgggguuucaccauguuggccaggcuggucuggagcuccugaccucgugauccacccaccucggccucccaaagugcugggauuacaggcgugagccaccgcaccuggcuauacugggcuguuuuuaaauugccuugcucaucauuccggucugguuggacagguauggugagccaauuuccaguucaugugguagguguggguagcuacuuuagguucuuaaucugaggaggcagaaugaugagcaucuguuuuaggaagagaagaguaaccugagagugguaucccagugugucugaugugugcuggaguuugagaaccauggagucaaagcaguaguaggaaggcauucuuggagagcauuucagaauucagaucugaagugaugagagucucaauuaaugugauggcaguggaaaugaagaggaacacguguguccgagagauacuugacagaagucuuggccauggugaaaguugcucuccuggucauuccuuacagaacccaugguagcccuagugugcuggagagggguguuaauuccaggugagcaucaucguaaaccacucagaagagcugaguuuaugugcucggaggugcugagcucccacuuuguguaucuaaguggggguguguauaguguauccucccaggugacaguguggccagcugagaugcagagguggauguuuggcaagaggacuaguaucuguucacagucuguuuccugguaaugaaggaugagguguaaccuuagcgagaauuggcaggaguuaaaaugggaacaccuaauauucgaagggaacggauguugagaaaaagagugaggauuucagagcugauguauuuucuuuuguucaaagaauaaaauacauccucucugccacuaugguuucuggcuuuugccuguuuucuguccucauuuucucucauucucugccuugcucaucacauucccaguuuagaauccccccucugcccucaaccuagauauucccaucgcuggcuccauuauacagcaauuggaugucaccuuuuuggagagcuuuuccugaccauccucaguaauguugggccuucuccucaccccugccucccaccaaaacuagguucucuuccagaccacuuaucccaaucagggaugacccuggucaguucuuggucuacuugugcaaaucugucuucccuucuccaguagaaugaaagcucuuugagagccuggguuccugugugucuuguucauugcuguaucgccagaaccuagaagaguaccuggcacauauuuagcauaaauauuaguugaaagggcuuuaggcaaauauuugaugagggggacagagguaggcgauggggaaagaaaugggucuauagaccccaggcaacacacagugaccaaccuggacuggacgguagagaugagacaggauaaauucaagagauguucagaauguaacacugacaaaauuucgugauggacuguuauaggaggugucaggcaacuuucuugugaaaaaucuugccgugagagguuuaugaacuccuagcauucuuacaugaucucuucauucacuggaaacuuaagggcaaagcaauucuuagcccuccaucaagagcuugccucgguucuacuccauccuagaggaggugucucaaacucuaggcaugaagaagucucuguuucuacucagagcaguuguacccguccauccacccauuuaccacucaacauauuuuuugagcacguaauauguucuagguauugucgaaggcacuggugcacaggaaugacuaaaacaaccuccuugcauuuauguccuagagaggaaagacagacaagcaugucuacaaaugcuacaugcacaagauacuuuuggaugguaauaauggugggagaaaaaacccugagacaggaugggauggggucagccaggcugcucugcguuagauuagaucugaauaacaagaaggagccuugagaagaccugcgaggagagagggguucuggccuugccuucauaaccuauucgugcuagaagagucacugaaggggcacuuugcuuucauguuuuaaagaaugaaauugaagagguuggugggauggaagcucaacuucaaauacuuaccaaguuuauuuauuuuuauuucauuuuauuuauuuauuuauuuaguuuuugagauagcgucucguucuguugcccaggcuggagugcaguggcauggucuuggcucacugcaaccucugccuuccagguucaagcaauucuccugccucagccuccugaguagcugggauuauaaagaaugcaccaccacacccagccuagcuaauuuuuguauuuuuaguagagacgggguuucaccauguuggccaggcuggucucaaacuccugaccucaaaugauccaccugccucggccucccaaagugcugggauuagaggcaugagccaccgugccugucucauuuauuuauuuuuuuugagauggaguuucacucuugucgcccaggcuggaguacaguggugcaaucuuggcucauugcaaccuccaccuccuggguucaagugauucuccugccucagccucccgaguagcugggauuacaggcaugugccaccacacccagcuaguuuuguauuuuuaguagagacgggguuucaccauguuggucaggguggucucucacuccugaccucaagugauucaccugccuuggccucccaaagugcugagauuacaggcacuuugagccuguaaucagccaccacacccagccucauuuuauuuuuuugagacaaagucucuaucgcucaggcuggaguacaguggcgugaucauggcucacuacagccacaaacuccugagcucaagcauccucccacugcaaugccuguagcugggauuacaggcacacaccacaugccuggcuauuuaaaaaaacuuuuuuauagagacgagugcucacucuguugcccaggcuggucuugagcucccggccucaagcauuccuccugccucagucuccuaaagugccgggcaugagccaaacaugcgugcugguuuauuucuuaucagcaguuuuguuugccaaaucauccuacugcucauuuacuuauugaaauauuucccuuuugcaagucguuacacaaaacauuuuagagauggcuuuaaagaacaaaaucucugucaaucauaagugauuaauauauaauuuucaaaaaaggauaaaaucaugacucauauagauacaaaaaugaacauguuaaggauuuuauuuaaucacugauuauuaauuauagaugaggacauuuggcagauguuauaacagguucaaaggagaaaucaaaacagaacaaauuucugugaaguaaaguacuguugaaauuaauaugcaaauucaggaaaacuaacuuauuccacggucggggagggaaguuaguugaaccucuacuggccaggacaaaauuaacaugccuauagacaacaguuauuuugcacugcuauuaguuaccuacgauuuacagaguuguaauuucccugagaaucagaaucuaauuaccuguagaggucuccucuagagucucaacagugcaugguuuuccaaugaagcacauuuuuuuccuauguauaaccagccuguccugucuccagaauccacacacagacacacacacagacacacacacacagacacacacacacacacacacacacacacacacucccuucggacaacuugcugaucguaaagcuauagaaauucucugugcuuuuuucuugaucuuuaguucaucaucaaccaagguggaucucaagaguggccucgaagaaugugcuguggcauugaacuuauuucuaagcaacaaauuuacagacgccuuagaauugcuucgccccugguaauuuacuuugucucuuuuagauaaaauaucuuucagauguuucugaugauucuuugaugucaugcuuguaaauuaauuuagcuguucccaucugaauauugauaagcuaauuuaguucagaccucuuuacuuuggucacuuuuaaaauucaauuuagaaaucugaguuuucaaauauaauuaauagaaaauuucugauuguuuugcauauuuuaaucucucuuguucagauauugucaucuuauaaguaguuuuauaaggcuucaauuuugcuuucuucagugaaauguuuuuauguuuguuccuuuuaaauauuauugagaaaauuuuccuuugaaauggggaggggaaaaaccagaauaugcugaucucaaugcuauuaagaaauuuaagauaagaagacuauuauugggguucucuauuuguucgaaaaacaagcaauuuaauuucaauuaauaguaccuguuaaguuuucagauguggcaauaaaaccugugcuugccuguuuacucggccuuugucuugacaagaauaaucguacauugugcccucaaacacuugcuuagaugaagcuuagaccucauaugauaauuuccaagauuacuugggcauaaaagucggcaaucucguuccuuacuuugagugguuaccagggugacuggacucuggucaugugaaucuuagagauugauugaccugcugaggagcugcuaugguaauuguguuaagauuuagaauagcuguaaucaagaugggucagcuauuguuucacagguuaagaacaaaugaugaaaucgauaaugaagcccuguagucuaaggaaauuuuccaguguugucuucaauauuugccucacaaucuccaccuugccuguccucugcuuuuuuccuucuguccuccucugucccucagacuucuuugucuccugucucuaccuccuuuugucugcuugucuuucccucucucagucucuccuucucuuuucucagccuacuugccugucuucuuuggguuuuuaaaugcuuuuauugaugagccauaguuguaccuauuuuuggaguacaugugauaauuccuuaccuguauacaguguucagugaucgaucagguuaacuggguuauccaucaccucaaacauuuaucuguucuuagugucaggaacauuuauaauuauucucuucuagcuauuuugaaauaaugauaaauuauuguuaauuauaauuucucuauuauuaaauacuagaaguuauugcuuccauuuaacuguauuuuuguauccauuaucuccuuugauuuuuauucaaacgagucuuucucugccacugacacacagcuggucauaacauggaaugaaaauaggugauuuaguguuguguucagucagguuagucuccgauuuuuguacauguuucaguguuuaaauggcucacgccuguaaucccagcacuuugggaggccgaggcagauggaucaccugaggucgggaguucgagaccagccugaccaacagggagaaacccugucucuacuaaaaauacaaaaaauuagccaggcaugguggugcaugccuguaaucccagcuacucgggaagccgaggcaggagaaucacuugaacccgggaggcggagguuguggugagccgagauugugccauuguacuucagccugggcaacaagagcgaagcucugucucaaaaaaaauuaaauaaauaaaaauacuuuucccucacuugaaucauuuuuuuuuuuuuuuuugcuucuugaaagagcuuucaguuaaaaaugugagguuugaaaccacaauuaaugauuaacuuugggcugcucugauuccuugugguucuuuugaacagauagugcccucaauguucaggacaagcugcaaauuaccaaaggauguuuagacuauuuccauggaggcaaagaauaauguggcuugcauuuguuuugcauggcagcaggcuguuaugcauuaauauuuaaauuaaaaacaaaaccaugcauuaccauuuuaaaccuuauaaauaauuaauacagcuuaagaaguuuugagaaaauaaaugauguucucauagcccgagaaucuggaugucugccaucuauuaggacuaguucuaguuaacauccuuaagaauccugaagcaguucucacuguaacuugaugauuugaaauaucaagaacuuuaaucaggaacuucagauaaugggauuagacuagauacaaggucugacaacuacuuuggucauggcucuugugaccagccuaacuuauuccaaaaucuuguuugcucuuggccuuuggcuggcgaggagagggauuauuuuauauaagccuuuauuuuugaaaaaauauaucagaaucucucugucaaaaaauacauuuccagcggccuuuauuuuagcacuuauuucagagccaaaggccgugugcugccccuuuuucaacagaaaacaguuugcuugcaaucugccugcaggcugcccucuuguguugaaauagggaaaugcauauuguccccuucaaccuggaacauuuuguucugccuguguggguuuacauuggaaaguccuugguacuugaguuuuuaagagguuacuuuucaccacccauauaauuucagugauuauggugaaggaauaaagguuacugugcaagucaggacaugcauuuacuaggauuucuuaugaucaguauuuccauugaauuaaaaugucugaauucccuguguucuucccagggcuaaggagaguauguaccaugccuugggcuacaguaccauugugguguugcaggcuguccugaccuucgagcaacaggacauccagaacggcauuucugccaugaaggacgcuuuacaaaccugccaaaaguaugacgagucauuaaauacuuaagaugugacugcaaacuuuuaugccugugugacaaaaauaaugucauuugccugaccaaaagcucuguguuugaaauuggccacaguuacagaaaagaaauucagccucgaagcugaaggauucccauuuggcaucuacauauuccacuuuucuuuuugauagccuggggucugagcuacagagaucugggggggauuucggggggauuucagugggauuagcagcaagcaucucucaauguagaugacauuagguacugcaugccaaaccaagccacacaaggaacauucuuguuuuaagugggagaugcaaauucaugagggaauguuuuauuuguuuaagaaggaccuguuuuugaacacuuuuguuuggugaaaaugagauagauuuuuaguuuuauuuuaagcuuuacuuuguguguauaggaagacccuaucaaaauuuuuuucaagggguaaguuauuuugauaucuuuuaaaaaaugauagguguuucacaguauggaagaugcuugguuuguggacauuuaggaauauucaagaauccaggaauggcuggcugcagcacccugaucagauggaugggaggaaaugaccccuguugcugucaauugcuugaugugccccccauaggacuagggcagaagguucaugaucagaagguuaacaugggugaaauuacauccugauguaauuguguuguaagcuccucaaaugaagagagcuuccaaauauugcacuuuaacuucauuuuuaaccuguggagaauuuuaccacaaauacugauuuuaguuauagggauaagggaagguacuuuggagguuaguuuucauugguguguguggguuuccccacgugguguucaguagcacagacugaguucccacaaauggcuagccagugcugcauguagaguguuggaaaaggaugaucuguguccuauagacuucaggguuuagaguuucagcuuuuugacucuuuggugugauagugacugaaaugaacgucaaaugaaaaugagcucagccugauuuuuuuuuucuauuuucuaucucccuuuuuauuuauucaauguagauacaggaaaaaauacacaguuguagaaucuuucucaagucuucuuucuagaggaucccuggagcaacugagugaagguaaaagucauuuaaaagaucacuuuuuuccuugauuuuaauaguuaaaugaucaucucauaaaauuccauccugaaguauauaaaguaaauggaaugucuuuuucucuucccuaucauacucacccucuggaagaaaucauuguuaauaguucauuuugaagccuuuucuguguacauacucaaauacauaaauaagguacacauaagguuuuuguuguugcucauggauuguucauuuuuuuuuugcaagcauagaaucacauaauagguguuguccuacaaugugaauuugacauugacacuuccccagaucguuacaugugaguguuuaacagcugugugguauuccauaggauugauauacuguacuuuacuuggcuuuucucuaugguuuuuauuuuuucacugauaugaauaaugguguccuagaauccuuauacauauggauucaugcauuuuaaaaaguuauuucauaagauagauuccuaaaaguggaagaaccaggacugacaguuugaaaacuuacaauauuuauagguauucccaguuuuuuucuacauauaggucaguuuauauucuuagcauucaucuuugagaguuucaguuuuccacaagcuauuaaacauuuuuuucaaagugaaaguaauuuugauaucuuuuaaaaaugauaauguuucacaguauggaagaugcuugguuuguggacauuuaggaauauucaagaauccaggaauggcuggcugcggcacccugaucagauagaugggaggaaaugaccccuguugcugucaauugcuugacgugcccccugggacuagggcagaagguucaugaucaguucugucuuuucaguguuacacucuaguccacaauaguuuacaagaaaggagcaucuaaauauuccuguagaaggaaaaaaaaaaguccuucaaaugucacuauuguagaauaaagcuuuugccaucccaggagaaucugugccuguauugccauugucaaacauguucucugaagagguaacacaaaauacuagaauauaccauacuagagaacacaaaauacaaagcuacuagaaguagcuuuggcugauuagagcaagagcaauucuggauauugcugucagaguaguuucuaauggucaaguguaugucagacauauuuuugaguguguuuuauuaggaaguuuuguuuauuuuguuagaugaguauuaucaacuuguuauggacguuggagaacuugggaacauuugcaugaugugaagcuagaguauugauuauaggagaggaauuaugagacauuucacaucuuugggacuuauuucaaaggggcaugauguugaccccaaaaccauggucaaacagaauggcauuucauuggucauucuaggcagcugaaacccaucaucuuuuucuccagaaacugaccuccaacuauuuguaagaauguauuuauccucuugacuucggauagaaugugucugcauauuuuccaucuuugagcugcuuauguaaauuagucccguuagaccuaaaguucacuaaaauggguuaaugagaaaucaaauaggcccaaaagaaauugaaccuuuuuguuguauucuccuuucuguuacucucucuaugguuucccucuaguggcccauugaccucugccucccuuuuuccuuuuaguaugaaggcugauauuugagauuuuuuuuagcugcauuuuggcaugaaugacaugguauuuuuuguaugaguauaaauaauaauaauaauuuggccgggugugguggcucacaccuguaaucccagcacuuugggaggccgaggcggguggaucacaaggucaggaguuacagacgagccuggccaacauggugaaaccccgucucuacuaaaaauauaaaaauuagccaggcaugguggcgcacaccuauagucccagcuucucaggaggcugaggcgggagcuugaacccaggagguggagguugcagugagccgagaucgcgccacugcacuucugccugggugacagaguaauacucugucucaaaaauaauaauaauaauuugaaaaauaagaugauaaugcuccuuuuuuuuuuuuuuuuuuuuugagaccaagucucacucuguugcccaggcuggagugcaguggcaugaucucagcucacugcaagcuccgccucccagguucacaccauucuucugccucagccucccgaguagcugggauuacaggugcccgccaccacgccuggcuaauuuuuuguauuuuuaguagagacgggguuucaccacguuagccaggaugucucaaucuccugaccuugugauccgcccgccucagccucccgaaguacugggauuacaggugugagccaccgugcccagcugauaauccuccauuuuuaaaaagcauccuguaugugcuauauacuguccuuguugcuuuucuuaacauuaaccaaucuaaccuccucuuuguagacuuggaacugaucagaguuauaaacaaauggccaggauuccccaccuagcagaguaggguuaacugaucaucugccuuucccuaagccacaacucuuucacuguaacccacacuuucuccuauaggcaaguagagaagggcaugaaaugugucauauacggaugaaggaaauaaugaauuauuucuguguuagucaucuugaaaauagaugauacuguguuguuauauuuuuauaaugucuuugaacaauggcacuuuaggaaaucuggaauaagguagaaaauuacuuuuuacuaauuauaaaaaguaggcugggccugguggcuugugccuguaaucccagcuacuugggaggcuaaggugggaggaucccuugagcccaggagguggaauguauuaguccauuuucacacuacucuaaagaacugcccaggacuggguaauuuauaaaggaaagagguuuaauugacucauaguucugcauagcuggggagaccucaggaaacuuaaagucauggcaggaggcaaagaggaagcaagguaccuucuucacaagguggcaggaaggagaagugcguguaggaggaacuugucaaacacuuauaaaaccaucagaucucgugagaacucacucacugucaugagaacagcaugggagaaaccacccccaugauccaaacaucucccaccaguucccacccuugauacaaggggauuauggggauuacaauucaagaugagauuugggugaggacacaaagccuaaccauaucacagagguugcagugagugcagaucaugccccuguacuccacccugggugacagagcaagaaccugucucuacauaaauaaaaaaaauaaacuaauaaacuugugacuauagccuauuaugaaauacagguuuauuuagacuuucauaucuaaauaaacuuagcuuauuuagcuaaguuuauuuagcuuagcuaacauuauuucagugcaucaugaagauauuuacuccuguggacuaaggaauuuauaauuaagagauauucugguaguuaccuacucauaagugccuaauggcuaauuuugagaacuaaagaacuaugcaauguaaaucaaccacagugaaagaauaagacuuuuauaaauuaagcuguauuuuauucuuagugaguuuggcugucaacugcaacccaaacagacuuuguguucaagggagcaugucaaaacauuguagcuuuagugugugauuuguuuuuccucuugguaauuuucauuuacauccuugagugucugguugucuacaggagugaguauauuucauuaaacuuuucaugguuuuaauguggaacauacuaguucuuuucucuuguggcuggcggauugccccaaauggguuucaaauugccuuuacaaacagauauuuaaaugcaaugagugccugggaugugaaagggauuuaauaugacagauacuuauuugcagaauacaaaguucaaacucucaugccuuuucugucugccuuguugucacauccccaugcugcucuuaacuuuguucaucuuucacuuaacccugaucugcccacccgucugcucagaucucugcagggacugacucacuguugcuuccugaaucaagugcagacucuaacauucaaggccacuuauaauugagccuugacugagcccuuccagccucauugaugucuccucccuugacuggcuuuuccugaaggugcucuuggcuuuccuugcuccuguuaccagcacaguccccuccgccccggcucccccaccgcugccaucaccaccacggacuucauccccucugcauguaccccaagccagcaaucuguauuccugagcagacuuucauagcucauaauuccugguucucacucuguuacagaauuaccuaggaagaggauauucaggugacuggguaaaaauaaguuaccaguugguaucccgcugaacacagcuagaaaaucacuaggcacacuuugaggagagguguucugaaggacugagacccugacuguggaugugcaggcucuaacuccucaaguuuggucuguuaauggcuuuggccccaucuuucuguguacuguugaagaccuuagcugcagaggugcuucuuuguaaauuaaacauuggaauaugagcauggcaggaacuugaaccaauuuaugagaaccaguggguuguauguguguguaggguggggguggcaucuauguguauaagugcaagaaaguacuuguugucaucuaagucuauuuagcacuaaucccaauaauaagaaauacccuauuuucagucacaguccacauaaaaaugcuuucuucuuucugagcuuuuaccaaaaagcagugacacggaucaugggcaguaaucucagugcacguaguuagcacugauccagugcuuacucuguaucaugagcucuaugugcagcacuucauuugauccuucagcugugaacuagaggcggcguuaguggccuuuauaaaugaggaaaccagcagagaggggacgaggucccauagcucguacauggcagagccuuuuuagcagcucaggcuccuaaauaccccaggcucguuuacuuaaauaucaugccacuuugcaucccauggauagagcaagaaucugcugacuuguguauggaaaaaaguaaagguuugucucuccauccucugcaaguauaaugguugguugggaagcuaggguguguguuuugggguacuccgcaggucccugggaugcacagagccccaccuaaccccuuuuugugaguaccuuguucuugugcuagacaucuacaugaucaaauuagccugaaacugggguagugcuaccucuuucuauaucaggucuucaugugugaggagucuuaacguggccgugcaggacauuucuuuuucaccgagcucuagagaauugcugcuuucuuuucagguagcuaaugugucugguuagugucaugguuaccauaccuucauauuuuagaagcuagcauucauacauuuaauuuaguuuuuuucaacuuuuaaaacugugugaaaguuguuuuuuuuuuuucuuuuugagauggaguuucacucuuguugcccgggcuggagugcaauggcgcaaucucggcucacugcaaccuccaccucccggguucaagugauucuccuaccucagccucccgaauagcugggauuacaggcaugugccaccacgccuggcuaauuuuuguauuuuuaguagagaugggguuucugccuguuggucaggcuggucucgaucuccugaccucaggugauccacccaccucggccucccaaagugcugggauuacaggcguaaaccaccacgcacagccaaaguuuuauguuacuaauuaaguuaaaaaauaagugguuuccuuuuuuaaaaaagugcuuuuaaauguucauuuccccuugugaguugaguuugcgucucugauacgaagugacugacucuuugcaguuacauuugaauggggaugacuucccugaacacuucacacauuccaggaaaaucuuccugacaaagugagaacugggguuaucauuccacuuuuguggaagcacaagggcaaucuaaguuuuggggucucucuuggguucauuuuucugccagucuuuccugaacaucacagagcaaucacuuuggaugugugauuuuacuuaauauaauuuuauuuguuuuuuguagaggaaaugcaugcugaaaucuguuaugccgagugucuccuacagaaagcugcacucacguuugugcagguaaugaauauuuggcuuggaauucguauuggcugggaagacugccagugcugcauagaaaaauguggugcauucuaugucaaagcuucaguucuuuugacuuagaguuguaauggcaaauauuuguuauucugauaaacuuuggcugaaaaaagaugcuagagagcuuuguuccuccucuacugcacuuaagaaucuauuucaaauugcacuccacugggaaucauugcccuuuaaagacugugucuuuaaagaaacuuuaggccaggcaggguggcucacgccuguaauccuagcaguuugggaggcugaggugggcggaucaccugagguccagaguucgagacaagccuggccaacauggugaaacccugucucuacugaaaauacaaaaaaaaaaaaaaauuagccaggcaugguggcgggcgccuguaaucccagcuacccgggaggcugaggcaggaaaaucacuugaaccugggagguggagauuuccgugagccgagguccuaccacugcacuucaccuugggugacagagcaagacuuugucucaaaaacaaaaaagaaacuuuaaagaaacugcuuugcaaccgucacaucuaauuuuaagaugcaucuguguggaaaccgggagaguauucuccuuugcgcuuucuacugguagaguccgcacaugggaguggcccgggcagaggaaguguccccuguuacaccacuugccucagucaaguucaguuaugcaugcauagcauguauacuucaaauuuuauuuuuccccuucuuucuauauucucauucuccuuucuuuuauuucuuccuuuggaagagcaguuuuuagaagucacuaaacaauccuuuucuuaugauccauuuuaauuucaccucugggaacugauacagucaguaccuugccuauuucuguaucuuccaaugcuucuguaaaacauaaacuuucacauaauggcuucaugggugguagugauggcuacagugagggugaggugggguagagauuguaagaaaucagaaagaaauucagcugugaaauggaaaaucuucccucacucacaaucuuuuuuuuuuuuuuuggugggggagggguggcagggugguuggagccucauucugucacccaggcuggaguacaguggcaugaucucggcucacugcaacgucugccuccuggguucaagcaguucuucugucucagccccccgaguagcugggauuacagacgugugccaccaugccuggcuaauuuuuguauuuucaguagagacaggguuucaccauauuggucaggcuggucucgaacuccugaccucagguguuccacccaccucggccucccaaagugcugggauuauagacgugagccacugcgcccagccacaaucuuuugaauuauuugacaguugcuucuuucuuuuccuggagguuuaccucuuggguuggauucugguuuaguaaaacggaaucacuguagcccaugacccuguuuccuaaaacccagacauuacaaagacugguugauaacaacagucuuacugccucaguaagcaucauaaugauagucauggaggcccaaguuuuuuucuguuuuccaaacagggauuuggcaaucaaaucugggauuugaaggcuuauuuuauauuuggggauuugaaauuaaagagauauccauguuuguccccucuuccucaugacucccacccagucaccuuuauauucaugcugcuuuagccuuuuaaagauugugcagcuccgucucuuccuaucauuguucuagaagaagugcuuaucuacucuuuucuggacugcacagcaaccuagugacucucccucucuaauuucuuuuaccuucagcucauucccuauucugcaguugaggguugaguaaccucuuaaaaaugagucucugaccuggucacuucucugcuucagcauucaguagcucugauugauugaguauggcaguauucuguaucagaaugucacaaaugagggggguacuuuuucaaacaaaacugguaccuccucucuauguucccuacccgccccccgcaccuuacagguguccuugaaagccacugacggguuugcauacuugaguagcauggcuggagguagcuuucuuaacuccuuggucauucucuuugcaauagauucuucagcaguguggaauuacauaugcacacauggccaaacccaucaugauccuuaaugccacccugucuuuccacuugaguuuuacuuugcuuacaaaauucacaucugcuuugccuuucuauaccuguccaguuucuaauuauuuuugugcuuaaagcaccaaugcuuccaggaggcaugucuggcccuuuccaugccacuacuuuguguucucaugacaucccaugcaugaucccguccccgugcauggcucccuccccgugcuugacgcccucccuuaacauauuguauuacuuucaucuguuuuugcauuugggugccugguauaaaauaggcauuaaguuuaaguuugaugaauccugaaaugagauauguuuguuuuuuuuuuuuugagguauauuucaagcuaauuuaagaaauucuuuucugguugguauuggauuuuauguaaucauaagauuccuuaauuuaagaagauaaacauugaauuucauaucuauugauucuuauaauaauuagaacauuaaauauuuaagcaauuaaugaaauuaguaaaugaaauucaguuuuucuuuugcuacagaaggaugcuuaaguacacgagaaauacauaucagagcaucuuucuuuuuucuucuuuuuauuuauuguuuugagauggagucucgcucugucaccaggcuggagugcaguggcgcgaucuuggcucacugcaaccuccaccucccagguucaagugauucuccugccucagccuccugaguagcugcgacuacaggcacccgccaccaugcccggcuacuuucugaauuuuuaguagagacgggguuucaccauguuggccaggauggccuugaucuccuaaccuggugauccacccgccucggccucccaaagugcugggauuauaggcgugagccaccacgcccagccagagcaucuuucugauaucaauagacuagaaaaacuuucucucuggauaugcaaaacguaggacugucuccacuaguaccaucuauuagaguaacuuccuucaagugguuauuugauguaauuuauugucuuagaauccuagaaugcugacccugaaaaugccauucaucuaggccaacagccucaauuuuauggucgaugacaaucagauaaacagaauugaagugguguuguuuuccuaaaacaaaauuguguaguagugacagccacuucagaaaccagaccaguuauuuugggccuagaaaugugugugaguaaaauucgcaacauuaaaaagacucugacugcuaaaguacucugugaaagaaggaccauugucccauuuacuggguguaauguacuggaagguuuggccuuagagcagauuguuaaagucauccauuuuacauucuguuaaacccagaagaaaauugcucaguagaugucaauguuuauuaaaauaauuuggaccgcauauggccccuaauuggugaggauuaccuccuuaguaauauaaaauaaucgaaggauuuuacaaguauuuucuuuuuguuguccucuaauguggaagaaaaauuaccccaaaaacuuuuaaauguaaagcaagaguauguguuaauuucaaaauuauguccucaaaauacuuuuuuuuguuuguuuguuuuuguuuuucuaaucacacaaacacacaacuguggggacaauuuaaaauuuuuugcuaaauaaucuaauuuuuuaacugaauuauuuucaggaugaaaauaugaucaacuucaucaaagguggacucaaaauuagaacaaguuaccaaauauauaaguaaguuaaaaaguaagaugugguuuguaaauaauuuugugcuguguacuccuuuguucuucacaguucuccuaaauuaaguuugacuaggauuuuuuuuuuuuuuuuuuuuuuuuuuuuuuuuuugagacggagucucacucugucacccagguuggagugcaguggcgcaaucucggcucacugcaagcuccgccucucagguucacgccauucuccugccucauccucccgaguagcugggacuacaggcgcccgccaccacgcccggcuaauuuuuuguauuuuuaguagagaugggguuucacuguguuagucaggauggucucgaucuccugaccucgugauccgcccgccucagccucccaaagugcugggauuacacgcgugagccaccgcgccuggccugacuaggauuuuuuauuugguguugguaaaaaugaacuuaauuuuuuguugaguguguauucaguguuauaggacaacagaauuuaaguuuaaauacaauuuuaagagcuagcugaaaauaaagcuacugacauaauuucugauuagauaauuuuaguuuucucucuccuuagaacaguuuauaaauuuaaaauuauaguaauaucuuugguucagacuccagagcagcacugcccaguagaacuuucugcaauagauggaaauguucagcugagguggcuguagcguuguucauauccuuauugauuuuuauccaguugucuguuauuuacugagaguguuaaaggcucuaaguuugaaucuggagucaucccuuucuuccuuuaguucugucaguguuugccucauauauuuaggagcucuguuguuaggcuuuuauaauauguauuuauaauucuucugucuuccuaaugaauuaaccuuuucaucaucuugaaaugucucuauuuaacuuuggugauauuccuugucuugaaaucuguuaugucuaauauucauauaggcacucaugcuuuuuauaauuagucuuugcaugggauauauucuuuuacuuuaaaccuauuuuuguuuucauauuuaaauuguauuuuuaaauauuuaaauuguauuucuuguagauucacauagcugggcaguugaauguuugcacuugugacuaccauuuugcuuuuucucuuugccucaucuguucucucccccuuuuuuccugucuucuuuugcuuuaauaacauuuuuagaacuguuguucucuuagcuguagucuaauuuuuuugugguugcucuaguguuuauaauauuguuuuuaaguuauuacagucaacuuagaguuaauauuguagcacuggacauaaauuauaagaaguuugcaaaaguguaauuucauuuaccacauuuugcccuuuaugauauauauauauauauauauauauauuuuugcgaccgagaccuugcuuuguugcccaggcuggagugcaguggugugaucucagcucacugcaaccucugccuccuggguucaagcaacucuccugacucagccucccgagcagcuaggacuacaggcacauaccaccacggccagcuaauuuuuguauuuuuaguaaagacgggguuucaccauauugaccgggcuggucucgaacuccugaccucgugauccacccgucuuggccucccaaagcgcugggauuacaggcaugagccacugcgccuggcccuuugugcuauuuuuaugauguauagcagauuuacauauauuuuaaacccuacaaugcggugucagacuuucucuuuaaucaguuauauguuguagucuucucucuuuacccauauucuuaccauuuuucauauucuuauucaaaaugguaaauauauuuccuguuuacuuucagacuaaagaacuuccuuuagcauuucuuagagggugucagcuuucaacaaauucuguuuucauuuaucuuaaaauauauuuacuuuuuacuuuuucuuuucaagcuuauuuuugcuaacuauaguauucugagucgauggguuuuuuuuccuucuuucagcccuuuaaaacuggcguccuauuguauuaaagccuguguuguucaguuuuucauuuguauuauuguuccccuauauauaaugugucuuuucuucuggcuuuuuugaagauugacuaguuuguaucuuugggucucaguaguuugacuaugaugugccuaagugugguuuugagaaauuuguggucauaauuuuucaaacuuuuuuuuucugccccauucuuacuuucuucucuccugagacuccuacuuuuuucccuucauuuuccacuguguaaaaauauguuuuaaauguauauuuugauuuuuccacaauuuguaauaguuacuugugggaaaguuaaucugacauaagcuacccuaccauuacugguagcagaaccaaaauuuaguauuuuaagagguacuuucacugaaaauccuuucacaaaacuguguuucauucaaaauccuggaagggggugguagaucuuggguaccugacaugcuguuguauagauuucuuugugaaauauuuuuagaagguauaaacgaauguuaaauucaaugcuaauugcuguuuuagucaucaaaaccuaaaaauacuaaaggauuaaaauaggacuguagaggcaaagacauacagguauaccucagagauauuuuggguuccaggccacuacaauaaagugacuauugcaauaaagugagucacacaaacuuuuugguuuccugcugcauauaaaaguuacguugauacuguacuguauucuguuaagucugccaauaccauuaugucuaaaaaauauacauaccuuaauugauaaacacuuuuuugcuaaaaaaugcuaacaauuaucucagccuucagcaagucauaaucuuuuuguugguggaggucuugcauccauguugauggcugcugacauucaggguggugguugcugaagguugggguggcuauggcaauuuuuuacaaaaggacagcagugaaguuugccauaccuauugacuuuuccuuucauaaaagauuuuucuauagcaugcaauaccacuugauggcacuuuacccacaggagaacuucuuucagaguuagauccaugcucucaaaucuugcugcugcuuuaucagcuaaguuuauuuaauauuccaaauccuuuguugucauuucaacaauguuuguggcaucuuuaccgggaauagauuucaucucaagaaacugcuuucuugcucauccauaagaggcaacuccucauccauuaaagugucaucaugagauggcagcagucagucucaucuucaggcuccacuucuaauucuaguucucuuucuguuucuaacaccucuguaguuacuuucuccacugaagucuugaaccccucagaaugauccaugaggguugaaaucaacuucuuccaaacuccuguuaauguggacauuuugacuuccuuccaugaaucacgaauguucucuaugauagguagaaugaugaauccuuuccagaagguuuucuguuuccuuucccuggauccauuagaggaaucacuauggcagcaauagccuuauaaaauguacuucuuaaauaauaagacuugaaggucaaaauuacuucuugauccaugggcugcagaauggauguuguguuaguaggcaugaaaacaauauaauccuugcauacaucucuuucagaacucuuaggugacuaggugcauuuucagugagcaauaauacuuugaaauaaauguuuuuuucccugagcaguggaucucaacaguaggcugaaaauauuuaguaaaccaugcugugaauagaugugcuaucauccaggcuuuguuguuuuaauuauagagcacuggcagaguagauuuaggacaauuguuaagggccuuaggauauuuggaaugguaagugaacauuggcuuccauuuaaagucaccaguuccauuagucccuaacaagagucagccugaccuuugaaguuuugaagccaggcguugacuucuccucucuagauaugaaaguucuagauagcaucuucuuccaauagaaggccauuuugucuacauugaaaauuuguuguuuagugcagccaccuucgucagugaucuuagcuagauauucuggauaacuugcuacagcuucuacauaagcacuugcagcuucacuuagcacuuuuuuuuuuuuuuuuuuuuuuuggagauggagucucccuuugucacccaggcuggagugcaguggcacgaucucagcucacugcaaccugcgucucccagguucaagugauucuccugccucagccucccgaguagcugaggcuacaggugugcgccaccgugccuggcuaauuuuuguauuuuuaguagaggcaagguuucaccaugcuuggccaggcuggucucaaacuccugaccucaugauccgcccaccuuggccacccaaagugcuaagauuacaggugugagccaccgugcccggcugcacuuuuuuguuauagagauggugucuuuccuuaaauucaugaaacaaccucuguuagcuuccaacauuuuuuucuucagcuuccucaccucucucagccuuuauagaguuuaagaguuagggucuuguucuggauuaggcuuuggcuuaagggaguguugugggugguuuguucuauccagaccacuacagcuuucuccauaucagcaacagggcuguuuuguuuucuuaucauuugugcauucacugaaguagcacuuuuaauuuucuucaagaacuuuucuuuugcacuuacaaguugacuaacuguuuggcacaagaggccuagcuuccagccugucuuggcuuuugacaugccuuccucacuacgcuuaauuauuucuaguuuuugauuucaaaugagaggugcgaaucuuccuuucgcuugaacacugagaggccacuguagaguuaccaacuggccuaauuucaauuuuguuuugucugagggaauagggaggccugaggaggagagagauggaggaacagccuaucaguagagcagucagaacacacacaacauuuauugauaacuuucgcucuuauaugggugugguucagggcacccugaaacaauuacuguaauaguaacauuuaagaucucccaucacaggucaccauuaacagauacaguaauaacuaaaaaguuuggaaauuuuaugagaauuacugaaaugugacccugaaacacaaagugagcacauauuguuggaaaaauggcaucgauagacuugcucaacacagaguugccacaaaucuucaauuuguaaaaaaugcaguauccacaaauugcaguaaaacaagguaugccuuuacauaucagugaaaugaaccacaggguuuuuugaaagagacagcaugugugugugugcacacacauggacuuacacacacacgcacauacuuaccugggaauucaaaauauacuaaauuccuuuauauagauaggcccuuucaaaacagugaagaaagauagguacuuuaguaaauguuuuugggaaaauuguucauuuuauagaaaaaucauuaagacgaaaaaaguccauauagguuuaauauuaaaagauuuaaaaagaauucuagcaggaaacauaagaaaguacuuuuauaauucuuaaauauaaaggcuuuaaacuuuuuuguuuuuuauuuuuucacuuugaaauaauuugaaaauuauuacaaaaaauuuccaucacuuguauggaagauuguaaaucgucacucagauuuacaaauauuaauauuuugcagaagcacaguacaauuauuaaaaugaggaaacugacauggauacaguauucauauuuacuccauggccuuuacucacauuucuccaguugucucaucaaugcccuuuuucuggcucaggauccaacccgggauccuggauaucgagguuagcugucaugucuccuuagucucuuuucauucggaauaguuccucagucuuugucuuuaaugauguugacauuuuaaaagaauaaacuggccaauuauuuaguaaaacaucuuucaauauggacuuuucuaauguuucuucaugauuaaauucagauuaugacucuauggcaaaaauaccuuagaaaugauaucauuagguacaugaugucaguuucaaaggccuuuuaacuauggcauaaaaucagaaaucagaagaaauugauugagcugaccaaauaaacauucaucauuuuaucuuggcaaaaugcaccauaauaaaaaauaaaugacccaggggaaaugacagcaggggaugcuuguaggcaucugaauugacucucuaaacccuuacauuuuuuguaaacuggaaguuaggucuauaggcuugcuagauucagauuaaaaauauuuggcuagacuggaucacaaguguaguugcacauuuuauaauugcaucacaccaagugauucaugauaucucauuauuccuuauuauuaaaaauauauuugccaauuuaauaagcaauucccagguauuaucaauuuuuauauuuuugucauuguuuuaauuuguauuucuuugguuaaauauuugccuuuugaagaugaugugaacaggcaagagagaaauacauagaaaguaaagugagaaguuggaaagauuuucauggcuggagcaggaagaaagcagaggacagauggggccauugugauggccuuugcuuucuuguuucagucuguccuggucccaagcccuaauuuauuuggucuguuugagacgauggcagucacacugaaauucagaucuucuugccaguagcauuucauuuccucagguugcugcagugugugcagugguggaggagcugagcgcuugcagggaguccgcugugauaugcugccggaagcugugggauggcagccugugguccugcggcuccuggcuggugcuugccaauggaugaacccucucuuuaagcccagaaacacugguccugcuagacacuguaaaaaugagcaucuccuuuuucuuugaugauuauuaccuaguauccuuaagaguaaacucagcacagcaucauccuuuaaaauuuugaugguauuuuaauuaaugacauuuauuuuauagcacauaaguguaaaauuugauuuaauauuuauuuucagagucauggucaacuuaugcugucacuuuuuuucuucaacccagagaaugucuuucuauccugcaugaaauucagaagaacaaacuucagcaggaauucuucuaugaguuugaagggggugucaagcuuggcaguggggccuuuaauuugguaaggaaaucacuguauagaaaccagaacuuuuguagaagaaccuaagguuuucugugccuucuccacugcauuugaaccucauccugaaccuuuccuuggguugguugacaaacagcuagagugggaucaguuuucuggcauugugacccaguguguuauaaaguuccacacaugcucagaguagcuuuggauuguaaaauguaagggaagcgugugguacucugaauagacuaguaagguuuuugguaacaaggaacaguggaauccauuuccauuuccacagcagaaauauuguugcaaugacaaugacggcucuggaauugaaaaugugugagggaccaguauaacuugaggaaugauuuuugaugauuccugaggagauggaagucugaguaguaaucugucaaauuccaauaugugauuaagagauuuuuaaauuuuauugaugguucacuggaauuagugagaaaauaaagugaucaagagaaguauacacaugagugaaugugccacuauggccacuuugcuuauagccuguggggugauaaaugggaaagaggcugacugguacccacagaauggaccaucuuauccaauugguuguuaaaauccucuucugcuaaggucauccuuugguguguauccacaugggacacaaauaucuuuacauuuucugcccauucagaaagaucugaccacguacuucuuccccagaccucuuugucaccaauuuuccaaucaugauccuucuaagccccugcccuuccaaccaaaccauugucuacauccccugaaucagcauauaauugcacaucuggccauuucuccuuucaagcauagugcauaaccaggugcacugcccaggguucugcccacuggaaggauauucccucaccacuguccuucaggaauaucccagagagaagugguagugcugcagcuguccacuucuggguggugucuacacaucacacagacuaugacugauuuuugcuucugggaaaggaaacuaagaaaccuugccuggaugugggcuuugagggguuaccuucuugucacuucaucacaccacaucaaaggucccaguauucuauagagaacccuggaaagaccaggcuuaaaaaaaacuuuuuaaagguuccuugucuuagcuaaaugaaauuaauucauaaaugauuguuacaguaugugguaacagaaauaucuggugguuaaaacuuguucccaauuucucauguuauugaagcauuaaaacuguaaguuguuaguuuagauuuguuugcaguuagaaacacuaacacauaaguacacuguauauuuuuuucuuacagaugcugucccuuuuaccagcaaggauuaucagacuacuagaauuuauuggauuuucugggaauaggguacaaauuuaauuuuauguuaauuuugacagggaagauaagacaguauuuauugaacaugagggcaaugcaacaugucugcauaacuaccuugauaauuauuggcaauuuguuuguaggacagaaaauaagccuuugauucuugaucauguuuuucaggacuuagacauaguuuuucugaugaaaguuaaaaauguucacccuuguuauccaaauucuuggaugaaaaauuauguguugcuaauauugcuucuugcuagaucuuauuacucucacgugguuuccuaugcuuucuuaauaguugaccaaagaugggaggggugggggaagagaggguugaaaaacuaccuguugaguaugauguucacucuugcggugauagggacacuaaaagcccagacuucaccacagcguaauauaugaaaucuguacuuguaaccccccuaauauauaaaaauguuuaaaaaguuucugaauaugauuuuccagucuuguucucuuucuaaaaaugcauuuaauucccauaggaguugggccuccugcaguuacgugaaggugcuucaggaaggagcaugaggucugcacugugcugcuuaaccaucuuagcuuuucauacuuacaucucccuaauacuugguaagaucuggauuagauuguuucauugaacauugauugucuuggccagacaugguguguuacaccuguaaucccaacuacuugggaggcugaggugggaggaucaguugaacccaggaguuugaggcugcggugagcuaugaucacgucacugcacuggauccagccugggccacagagcgagauccugucucuaaauuaaaaaaaacaaaacaagacaaaacauaaaguugauuauuuuuaaucugaguaaguaaaaauuuagaaagaucagcaagagcuaguaguucauaucuguuuacuuuuuuuuuugaauaaagguagaaaauaguguccuuugucauagugacauuuagcagaaggaguaggguaguuucuuucauuaaauaauuuucaucuguucucagcuaaaauuucuauauuaaggugaucuauuuuaucauauaugagauuuuuuucuuugcagaaaaugaaauuuugggcuaaauaaguuaauauugcuguuaaaaccagaaauuccaauuaggaaucugagacagccaccugcauucuuaagaauuaguguguccuagagcuuucuuaaacuaaaguuauaggugagacuggucuuuauuuuauuccccagauauaaaaaugaugaaauaauaguuuucaucuuuuccaugaguaggucuuuacuguauguuaaugaaauuuggagagcugguuauaaauauccccaugucuuaugaagacugagucuuuuccuguuaaauuucuagguacaggagaagugaauguugcggaagcagagcgucuccuggcacccuuccuccagcaguuuccaaauguacgcucaguauuucaaaguguauguuucaaccauaauuaaucagccaguguugacuguugaacaguguguuuucuuccuugcucugcagggcucacucguguuguuuuaucaugcccgaauagaguugcugaaagggaaucuugaagagguaauuuauuaggugggaauuauuugggggaguugucuguauggcgacuccuacaugagucgcugugaccuacuuauucaacaaaaguaaacuuggcuauauggacuagacaaaaauaaagaaaaaaauauauaaguaaaaagccaaaacuuuuaacuuguauauacauucuauuauauaaaaucuaugcaguggauuacugaauauagucuacauuuauacauagaguacauuaagcacuuuaggguaauauauaccaaauaacaagcucagggauuuucaagaaacugugacuguuaccaauuucugcauuacacacugacuuuggaaucuagccccugugugacaugcaggucuacuacgugugggcuccguaucaaaggaccccucaaaaaacgaauucccucaaaaacgaagcgucgaggucagaaguagaaaaguaaggagccauuuauguauauacauucacaaaccauuuuuuccacacaaaugggaucaaaauguauuuuucugugauuuuuuuuucacuguuuacaauaugucuuggaucucuuuccagaucaguaugccuaaaugucuccuauucuuuuugauggcuggguuucauuucaugggauggauauacuauaccuauuaaagugguccauagacauuuggccacuacaaacuguugugaacaucauuguauguauauuucugugcacagguacauuuauagaagacagauuaugauuaguagaauuccugggccaaaaggugguugcauuuuuauaaauccagccaaauuguccuccucacuuaagauuguuccaguguaaacuccaguaaacauauaaaaauauuuuuuuccaaugcucuuugcuggcucaggacauuacgugauggcuaaaaaugagaaucuaauuuuuaaguuuauauugccuaguuuacaaauuuauccacauguauaucugucaucuauauauuuuuuucugauuugccuauuuacaucuuugccuguuuccuguugaguuuucuuuuucuuacagaauuuuauuaaauugaugaaugauaaaagaguuaaccuuuugccaguuacguagauagugacaucuucuuccugucuguugccuguaacucugccuacaguguuuuguccuauggaaguucuaacuuuauugucagucuuuucuuaaaugauuucugcauuugauaucuuccuuggaauggaaccuccccacucccacauuacaaagugucaaggcccucucacaaaauuaaagaaagaggcagaacuuaacuguaucauugccuguaaggaaaagaacauaucaucauauugagagguuuaaugagugauaauuuuguccuuuuuguacuaaguguuuuauguauuuuuccauuagguuauuaucuccuugucuaauaucuggacgaucaacuuuguguacuugauuuacaggcacaagaaguauuucaaaaaugcauuucaguucaagaagaauggaaacaguuucaccaucucugcuacugggagcuaauguggauuaauguuuuccaacaaaacuggaugcaggcauauuacuauucagaucugcuuugcaaagagaguaaaugguccaagguaaagugcaauacuuucauuaaugucaucuguuugcuaauacauggccaggaugauuuucauuuaggacuguuugcucaguaguaugauaccacaguguuuucucaacuuagagauccacaaaaggaggaaaugugccuuaaguacccacuauuuauagguacuguccucagcauugcaugcuuuaaaagccaucuacuguucuuuucagggccaaaugcgauggcccaugccuguaaucccagcccuuugggaggcuaaggcaggaagauggcuugaggucaggaguuugauacuagccagggcaacauggugugauuuuaucucugcaaaaaauaaaaacauuagcuaggcauggugguacaugucuauagucccuucuacgugggaggcugaggcaggaggauagcuugaguccaagaguucgaggcuacagugagcuaugaucacaccacugcacuccagccuggugacagagugagacccugucucaaacaacaacaaagaguuauuuuaaacaugagguuuuaucucugaaaaugaguuguacuuauaaaguuaugaaaucuuaaucauguugauaauuuuguguagacuuuccagugcccugaugcccaggcuuuucaugauaaugaaaauuaauucugauccacuuaugagaaguuggagggcaaugagauaauuuuuucuuguucauucuguccacuuucucaccuaugaaugcuguaguuguauaauaggaaaaugguuuaaauuauggguaauugaaaagaguuguugucauuuugaacagggaauauaagauuucauuuccucugauuucuuuaaugccucuaauuuuauaucuggaagacuuguuggucauuccugauuugaaagguagaaaugucauuuaccuagggauguucuguaauaagcuccuucuuuuucucaaggcaacuuauguguucuugaaagcagcaauuuugaguaugcuuccagaggaggauguaguagcaacgaaugagaaugugguaacuuuauucagguaugugagacacuauuccuauaacaaaggcucugaggguauaaaggggcaaaaucucaucucuacugaaaauacaaaaaauuagcugggccugguggcaugugcuuguagucccagcuacuugggaagcuuaggugggaggauugcuuaagccugggagguggagguugcaagugagcugaaauaaugccauugcacugcagccugggugacagacagagugagacucugucuccaaaaaaaaaccauguauauuaacuguagcaucaacaucaacauuaguaaaagccauggcaugauaaaugucacuuuuuacuguaaaguucauuuccuuauuuuacggaaacaacaauuaauggaagggaguauuaagauacauuaaaaucuuuuaaaucuccuucucuuucuuccacugcagauuaaguuuucuccauaucaaaacaguuuaugugaaagaugugaucauuuuuauuuucaggagaaagcuuugaggucuugcucugucauagcuucuagguuguugggauaaugagaguucuaacaaugaauggucucuucauaaagaugcuguuaccuuuaaacuacaaggguuccugucugagacaugcuucugaccccuuccucugacccccaccucacauuuccacugccuuuuccacugacgguaaugaacaaaaaugaugagacacuguaguuuaaaauccauagcuccauauuuugcccggaauuaaccuaacauaagcuugacucauauuggaggcauauuauuucauguuauuuuuucuuucagugauguaauugaguauugccuugaauucuuucucagcaacuuguuugaugcauccauaaaauuaugcauaagaaagugcucccaggaacauguagucuccccauccuacugucauuuuuaccugcuuaugaauuucauaauuggaauucuguagaauuuuaaaaggaaguuucuaaacaugguacacauccuaagcugauuauuucccaaacaaccugugcuugggaaacauuuucuuaaauuauacguuaauuguuggcugucuuuugagccauauuauuuuauagaucuguguaauacuugcaaauaggaauaggccauauaccaguguacccucuucucucucccugaguauccacaacguaaguaaauacuuuggacucuuuccugcuuacucguagaaaucgccaguuguauaccuagauuuccuggacuguguuugauagauuuaagacauuagcuaaguugacuggaaagaaauaugugucagucagugguucucaaucuugagugugccucagaaucaccuggagggcuuaucaaaaucuagauugcucggccccggcccuggaguugcugauucaguaggucuagaguagggccugaaaauuggcauuucaaauagguucccaggugaugcugcugcugcugcugguggucugugaaguucacugugaaaaccacagguacaaauaauguauguguugccaugaccuuucucuggggcugggcugggguucuucacagacagguggacagcuugaagcagagaauugccgggaaaucuaucccuacugagaaguuugcugugaggaaggcucggcguuacuccgccuccuuaccugcaccugugaagcucaucuuaccugcccugguaucugcuuuuauuuucuuuucauguacuagaaauaaauuaccuacucacagcagcagggagcauaucuaaauuugguuaugaaguuuagcucauuuaaaaaccauuguagguuuuguuguaaguugaacauuucuaaauaaauaauuaauaaauaaaaacuguagcuaaugguuuuugacuaguuaguaugauccaggcauuacgauaaaggcuacuaaaaacguaucauuuuauucuuauaacuuuuugaguauaguuaacucuuagccccauuuuuuagugaagaaauuuagacagaaagaaguugauuccauugaaguugaguugaauucuaaugcaagccacauuauguaauuuuaccuuuucuaauagccacauuaaaaaaguaagaggaaauagaaaugaauuucaagaauauauuuuaacccaguauaugcaaaauuuugucauuucaacauguaauuaauagaagcuuauccaugagauauauacauucuuucauauugaaccaagucuuagaaauuuagugugucuuuuacacuuagaggacaucuuaguuuggucuagcuguauuuccagugcucaagagccauaacuggcugcuggcuguuguauucuagcuccagcucacauucuuaaacuuuaugccauuuaggcaaggcuucugugaaaaacacaauuucaacuugaauuuucuuaaugaaguguucuucaaaaaauacugaauauaucaaguuacuaugacucuucuggugcuuuaguuuuuauauagauagucagcacaggaaagcuguucaguguaaccgaugucugcaguccuccacucugggguuuccugaguuuuuuuuuuuuuuuuaaauucagaguuuauuucaucauuccucuuugacaguuauuuagauuuuuccaguuuuuacaauuauacacugcaaugaauauccucuuuuuguacaugugcauauaauucucugugaaagguuuuuuaaaaauggaauuccugguucaagggaauauauacauuuaauauuuugguagauauuguuaaauuccccucaaaaaaagcucuaccaauuuaaauaaguacugauaguauuuuaccauuuuaauuugcauuuccuuguggaugugguggagcaucuuuucauguguuucuucauuuuuauuuuuucuuuuguaaauuguuguucauauucuuuccuaauuuuucauuggguuguugauuguuuucuuagugacuuaugggagccuuuuauacauucuaugagaaagaacaaugcagccccucccugacaggggucagacaggaguuagccugcgccuagcaccuagguccagguguuuccuaccuaacacaaacucagagaacuucagcaucagacaggcccauucugugacugugacggagcaagacaaaaauaugaccacucuguaaucgugucugagcacaaauaaaaacaagaacacuguguaaaucacacaaauaaccaaacaucucccucucccagcucacaugagagccuucuguugcuuaaccaauuagagccuuagcuccaugccugauucauuuuuauuaagugauuugcacugggaagguuuuucugucucacagaacucuacagaaaauuuucuagacuaucaucuuucuuugccuuaauacuuagauaccaguguauacguaaguguauccugcuuugacuguuaagaaccauagggaagguuaacucccugcacuucuuucuccaggucuauggaaguagaauguacaggaaauuggcuugaaauguuaguacugggauuuuuuuuuuuuuuuuuguaccuaggaauuuuaccaaaagccuguuuuucauaaagucucagauaugagcuugcccucuucugauaaaaagauuuuaucaauaaaaggaauuuuuaaaagaucaucaucaauuuaaaaaagauucuguuauugaauugaacucuugcucuauuagcagcaauaaauuguuacauguaaaauugaagguagagugucaugaucuuaguuuucggugccauaagauaaagauaccuuugcugccauucuacuugagugugucguccucauuuccacuaccuccugcuaagaggcuuuucaagcuauauuuuuaucauaucuuaaaauuuauuuccaagaagauacuaauuacccugcuuacuucauacccuucaaaauacgaacugcacuaucaggaacauuagaaaaauauuuucaagcaaaagcacauuugcuuuugauccaaaaaaauucucaucugguagcccauuaaauauaaucuguaaugagaaaucauuaguuuacauuuuaggagcugucauucagccauauggcuuuuaaaugaauacguuuucugcauauuggauuacauuacuggaccgucacauguuucuaauuguaugaaagauccuaagcccagugaaauauuccaguguuuauauccagugauauucuuggaaacauuuuauguaaacaacuggcagacauuuaaaaauauuuuucuuuacuuaaaaguaacaacaaaaguuuacauuaaacagaauuauuauucauaguaucgguuuaaaauauuuauuucuguaucuguauucuauuaccuuccaaaagaauuaaaugcuuguagauauuuaauaaauauuuguuauaugaaugaguuuaaauuuuugguaaaaauauauauacugaauugcuucacaguauaaaaggcaaaagcaaaggaaaaugaucuguaaauauuguccugagguuccuagaaaccgaagcaaaacacaugaacauuguuuggggaucauaaaggacauugaauaaccucauauaacugcaaaugguuuucauuuuuccucauuaggaaaugauguaugucuggaaugguuuuucaauagugagcaaaagaaaagaccuuucugaaaaucuguuaguaacuguugaaaaagcugaggcagcuuuacaaagucaaaguaaguauacacaguaagcaccgaggagccuuugucucugcuccaugacugcucuccugucuuuucccugugcacaucugccaacauuaauuuguguacaucccaaggacaaagagcuugagcugcaggggucugggugauugcagucaaaugcagggaggaaugauacacacugcaacugcaugaaccuuggaaacagcuuacuaagggaaaaaggccaggccagccauaaaagaccacauauuauaugauucccuuuacacgauacucagaauagggaaaucuauaaagacagacagcagaugagugguugccuagggauggaguauggaaguuaggaguuaugauagcuuucuggggagggaggugaugacaguguucuacaguugacuguggugauggcuguacaacucugugaauauccuaaaaaccauugaaugguuacucucagugggugaauuguauggcaugugaacuguaucuuaaaacuaugacaaaaaagaugaagagaggaagcccagcauuggaauuuuagcgcagcacaaggaaacgugcacuucccucuggguugaguuugcugugacucuuucuaugccuccuuauugcugucuaaccauuaguguguuucugcagacacagggaauaguuuucaaggugaaauguuaucacgauuuauucuacccauuacauuugguugugcuagaggccacauuucaguuuaccggaagcagcugaugugguaaaaggaguaucagaaucaggcagucugggcuuauagucccagcucugccaucagacucuggguaacaccucuguuuucucgugaagugggaggaguguuggaccagaugcuauccaaaguuguuuccuugcccugacauuuuuugauucuguauuuuuaagagggguaaaccaugccauaagugauagccuuuguuguauuucuuuucaaugccaagucacuuagguauuaccccaagagaaauggucuuuuguaauauucuaaccacauaaguaaaaugaaaacuucugugaugcuaaacaugguaaagggcauagaaauucaggaaugguggggaaacauuuuaacaguuaacucauuuuuguuaacuguaaaaagaugggcacuccaggagcccagccuacugucuauuugagcaagcucuucaccacccccagccccccauugguugggggcaaaauucgaggggaaauauauuuuaucagacuaugcuaguaaaaugcaguggaaauuuggaaaaccaagucacucuccuccacccauuccuuuuucucuuaaugacaugcugagaugauaggcuuuagagauauuuaagcagggcgggggauacugagacagacagacagacagacaugccauacuuaccuacaguuuuggcuuuguguguccucucucugggugaaauaauuaguuuauuuucugaagaucaccuuugccagauauuucaugugaaacuuaugaugaccucuucuaggacuucuuuuaugcaagauuaucuccuguucuccuucccaccuugaacuguuaggacgguuuaguaauuaagcuccuauccuucagagcagggaagaaaaaguccauaauuggaaaauggagagaaguuggaaaauggagagaaguuggaaaauggggagaaguuguaaaccugagguuacaucaucuuccaccccaucccccacccccauuauuggaaacuggauguguauuggcuucuccuagcuuugcaagugugucuaaaguaaaagaugguagaggauacaacugaucuacucugcaauacucuggccauaguuauuaaaugcuggccauugauacaaaagauagaacuuugaagacagaacagaauuuggugacaucccuggagucagcauuugguauuaauuccaauaguguuucauuugaaaucuaacuaaauucaacauguaaccagaaguuccacuuugacuaauuugcuuaaugaaauuauauagcaaacauuaugagaguuauguaaaagggaaagugauacugacuuuaugacuuuuuacuuucuaaaucuauuuucagauuuuucucuuggggccauuucagcuagcuucuaaaaauuucagcauagauacuuuuuguaguuugggcuucaaacuucccuguuucucagccuauccaccauaaaaguucagcggaucuuuugucguaaaauuguacucuaguagcuuuaucauguaauuuucuuugaauguuaaauggaaacauauuacauguguguugugugucgaaauguucaucuaugaacacuuucaugagguugaaaaucaugacaaagcauuuauacuucaagggaaaauaaucaucugcuagauaauggucuguagucggaggaaauaaugauuuugccaucuaagguuuuuggaggaauauaguauuuuugaacccagucgccguaugccuaacucaaguucgucauagaaguuacaugcggcuuuacuaguauuuuaacuucccaugauguuacgucuguuccucaacaaaaucaucauucacagagcaccagaauguugucauaauacaaacugucgauacaaugcuacaggaaacucaguagaaugcacaaaaaugauacuacaagcuagcauccaauauggacccuuugguuuugguucuagguccuaaaagauauuacuucuugaaugucuguuuuaacauccgugauuaaaagcaauggauagaauuuuauuuugguagaaaaaugauucuaaauaaauaauagaaaagguaauguguuauugauacccgugguuuucugggugaaugaccuaucagagcuugaaaguuagaggugaauauucaguuuucagcaccuaagaaguaaccccuuucugguugguuaaguagcauuguuaaucuccauagucaagugguuuaccaucuuaacugccagcauguguuaaugaugauuucugagguuugugcugaaagcaggaggauuucaauaggagggacucccagggccucguauguucccuuuacugccguccucucuacugucacagccugaaauguguaaauugucguucugucuuggaauaacguuguacuugccuguaacuugcaaaaaaauuucaaaaguguaaauguggaauggcuaccuuugucagauagaugucacacguaauaugguuccuucuguuuaacacacauuugucuugggcuguagaaggcagagagcauuuucaaaagggaaaaaguggugaaaaaauccuugacauuuuccucaagcaguuagaaguuuguggagauuuuaggugccuuucauguacuucagaaccguuuuguuaaaucuuauggcauaguuuuccccaaaaagaacacaaccugggagaauugauaaguuguaaacauaaugaucuggagaggguauucuacuuccugaauuuuuaauggggauaaggccaucugcuucuccauauggaaguguuauccucuccuguauugaagccaacacagaagccaaacaacaggaggaggcagccuucuuguuccucauggcuuuaccuuuuauagaauuaauaaagcucuuuauuuagagcucagauuuucgguuguuguaucuaaggucacaaagcucagagcgugaccaccugaagaauauuuuaaagugaauagagugaacuccuuaauaaaaugauguucugauauaguaaauucagcacuguaggaauguauguguauaucagauggggucuugcucuuucacccaggcugcagugcaguggcgccaucauagcucacugcagccuccaacugcugggcucaaaugaucuuccugccucuaucucugaguagcugggacuacaggcaugugccaucaugcccaguaauuaaaaaaauuuuuuuuuguagagacggggucucauuguauugcccaggcugguccugaacuccugggcucaagugagcuucccaccuuggccucccaaagcauugggauuacagaugugagccacugugcccaguucuuuucauuuaaaauaauuucauuguauuuuauuuagugaggcauaacaaaugcuaaaaaguuuuccuuauuuguaaaugaucccucugaaacuuuguucuuucucuuaauuaagaucuuaaggccgggcacgguggcucacgccuguaaucccagcacucugggaggccgagguggguggaucaugaggucaggagaucgagaccauccuggcuaacacggugaaaccccaucucuacuaaaaauacaaaaaauuagccgggcgugguggugggcaccuguagucccagcuacucgggaggcugaggcaggagaauggcgugaacccgggagacggagcuugcagugagccgagauugcgccacugcacuccagccugggugagagagcgagaguccgucucaaaaaaaaaaaaaaaaaagaucuuaaaaaguauuuuucuuuguguguuuucuuuguauguuuuuuguuuuaagauuuuaacagcuucucuguggaugaugagugcuuagugaaguuacuuaaaggauguugccucaagaacuuacagcggcccuugcaagcugaacuauguuacaaucauguuguggaaagguaagaccaaacaauaaaaccagcccaagugcaaauugugguuucuggggaauugcugugagaaagugaugcaaaaugcuuuuaucucuuacugcuaaacucuuacuugguguuaccagaaagaaaauccaguaguguguuguuguuguucuuccucgugaacaaaauuauggucuggguggaacaugacuuuauguauuucuacuugauguuuaaagaugacuuacaaaaacuguauuuauagcucaacuaacaggugucuagccaaacucuggcagcaucauacugaaucucugcuacucauuaauuuuuuuguuuuuuacauauuucuuuaguuuuucuuuucuuuucuuuuuuuuuaagagaugggagacuuuccuuguuguccagacuggagugcaaguaguacaaucauggcucacugcagccuggaacuccugagcuuaagagauacucccagcuuagccucuugaguagcugggacuacaagugugcacuacuaugccuggcuucugauacuaauuuaauucauacauuuauuuguccauucauuuauuccauggauauuugagcacccacuauaugccagagacugugcuggauucuaaggauucagagcugaguaaacagacuugccaucaccgugauaauaauuuggcaguaaagagaggcaugugaugagcacucugucucucuuuuggcaaagggcaguucuucuguauauaauugaguuuuguucugguuuuauucccccucaguagcauugaugaugauguccugcuccauuacuaaccauagaguugaaucaggguacugaugccuggcccuuuucucuguaucacaaaugcaguauuuacaggggccagauauguaaccuuacuuaauaaggccggcugagugguggcaggaauaggauugguaggcucuauaggucaggguguuuucucugaagaguguagccacacuccucagcucuauuugauuauugcuuugcacagugugggcccaauagcaauaaucccuaccauuuuucacgagaagccuggaaucuggauauuauguaaaaucaccugauuuuaaaauauuggcucaaauuuuuugaaaauauucugcaagccaaaacaaucacagcuauagacugcugguggacauccugugcucugugucaugugccuuuccauccguggccaccugauccccuucuuccugacaguauugaugggaauauaggaggacuugugccccuguaagaauaaagagaaaauaucuacuucccaaauguacugucuuuaguaauauucuguaauuaguaaacauguuaaagaaauaucuauugaauucuauuuuauuaguguuucuauaaggauuaaaaggaugaucaaaaggaugaccuauugugcuguuuuuuuguaugugaaucucauagugaauuguuugcucaugugcuuuauaauuguggauugugaacucaccuucauuggaguuuuuucuugagauucccaugaggcuauacugaagaagaguugcucuacagugauuuugcauuuuauuucugucagguacccuaaagguuuuuucugcccagggccucuuucauguuaauuucauugcuuacuucuuggaucauuuagacaauguaaauuugaauugcacauucaaugugggcaggccuauugguuauugauuuccuaaggaauucuuuuuucuucucauugaaagugcuggccaaggagacaacugucuuugucuuccuccuuugccagugaguggguuuguucuaaccugccuuugucuuaaggaguaguccuguaaggaucccagcuuuaaauagaggucucaguuucagcucccugcuuucugugggcccaaggccucaucuccugcauggauauuaggauacaaagcccuugacucaguuggagguagaccacagggcucauucagcaucaucccacauauguagagucucacuuuuucaauucuagcuguuuuuggcacuugaggguuuuuucuuauguucuggugagcuaagcuaugcauuugaaaugguguuaguuguauuuuuuuucauugcuuuuacauguuuuauaaccagagaguucuccuaauagugcugaaaacagaaguguugaccauuucuuuauuggccuuuuaaaguauuauaagacuuuaaaauacaaagggaguugaaccuuaguuuaaaaauaauacaacuuucuuauuucuaaauggagucauuuucugaacacauuuguguucagaaagaugaucuugccauuucuaggguuaaucuuuaaagauccguaugcgcugauuuacuuaagagacagcgaucaaccaucagugcuggguuuacauuaaggaauaaaagauuaauauaggaaaagaacauuauuuauugccauaguuuaaugaguuccauaacuauacaauggccgccuuucuaugauaauagacuuagugcugcacauguuuucugaagaaugggaauaauauauauuuagaaaaauguguauuucuuguucuguuaagauuuacuugauuuuccucugcucuuucagugaaaagcuacugaaguaugaccacuaccuagugccguucacucuauuugaauuggcaucuuuguauaaaagccagggggaaauugacaaggccauaaaguuccuagaaacugcaagguaaguguugaaggcagcuuuuccuugauuguuauggagucagaaaugucaguacugcucuaacaacagcaguaacauuauauacuuaacaauuaacaaugucaaauuaguaauaaugcuacuuuugcuaacuucugguugauuuaugcucauggcuuuugcuguaauugugcuguuuccaacccucuuacugccucacccugugacuguuuacagauaugauuaugggcaucuauuugaaagauuucuaacuuauuuuauucuauaucagggguuggccagcuuuuuguguaaauggcuagauaguaaauauuuuuagcuuuauagcauaaagucuccauugcaacuacuccauuauaucaaaagaagucauagaagguaauauguaaacagauggguauguuuagauuuggcccuuggguccuaguuugccaaccuucauuguauucagccauaccuauuauuuccuugaagagccauugaucuugugaagcuugcagaucuuacccagacucuguuuuuucuguuuauugcggcaguuucaaaguauuuuuaucaauucugguagacaauagcuuuuagaccuguggucauggaucacuuagguaaggcaaaaacccuguggccuguuugccuugaacacuuucugcaguagagaaagaaugccagacuagcucuaggucauaaacagugauuuguccauuuauucaaauucagcaguuauucacugagcaccuauuaugugucagacacuacuaguaaaggcuuuagagagacaacuauaaacuaagcaggcaauacuucugcucuguuagccagagggagauacuaaauagacaagaaaaauaucagugguauauguuugcugagauuuauaauaugauacauggugccuggguguuacuucaggauagauugauucugaaauauuuccuuggggaaaugauauuguagcugagauuugcauaauuaaagccaaucuugagaucagucaucagaaaucaaccaacuagguagggagcauuccugacagaagucacaguuagugaacaucugcauugaggagguugagccacugggucaaugaugaugcuuucugcugugcuggggaauacuuagaagaauguauuuggggagagaacgaaacauacuucuguucagaccaugauucuuuaagauggcuauuagguacucauauuagguagauggcaaguuggcguucauacuuagcaugaaguucagugauaaggucagggcugaauguagagauugcagucaacagcacagagacaguaauauuuaaagcaauggcgugugaugaagucauuuugugaauguuauauagcuagagaaagaggucuagcacaaugucugggauaugccaucuucuuagacauuaaaugauaagauuaagaagauuaagagaguuaggaagacaucuaggaaagccaaccaaauaguguuucaaaaagaagagcauggucaguuaugagggcagcaacuaagaggucaaacaaguuaagaccagaaaaguggcugcugaauuuggcagcaugaguaucauuggugaccuugacaaaugaggugacaaacaaaauggaguccgcuacuuuaggcaacucuuuuaggauguuugcugugaauagaacaucguaauggggcaaaagcuuuacgggcaugguagagccaagaagggcuuccuuaaaauauuuauauauaggugauaugagagcaaguugcuuuuaaaguuaauuuguugggaguaugaccaauauuucauguguuagauauagauaucuucaaauccagcuauuggaaaauuauggauuauaaaugcugcuguuccaaauauucauuauuugaauauacaauguauaauaaggcaacuuuauaagauaaaaauaaaagacuaguaacucacugcuaaaaagcaaugaaaagccuccacuaacucaagacaauacugacaauucaaacauaaagauacuucccaguaauuccaagacuauuaucugcacuuucccuuuaugcauuaggagcuuugcaaaguugcccacauugguggcauuuaggaaaauacucaauuccaucugucgguaaacuccaguaacauauugauuuuaguuuaugaauaauacauuuuacuaacccacaucaagauuaccagugaguagcccuuauaccuguucaaaaugaagggcuauagaaauaagugccacuguaaagaaagcaguuauagcucacccaugggccaaggcaguauguaaaaguauuccauuuuucugauucuuaacaauucugguaaagggaggucaacauaaaugcucuuaggcagguuuuaaauaaucuuuggauuucuauggcccccuuuaaagacauuggccuaauucuuauguaauuauuggccaaaccauugauauuuacaugugagaauuggaauaaguaauuuugacgucauuaaguaauucugcugccuuuguugcaguuguuucauuugaguuucuugagugaucgaucaugugaucaugcuaaccauguuuauaugcaccuaccuuaaaauuuuccaauuuaaaaaaggaagucuaauuauuuaggacuaguucacaaaauuuguacagcccuucucacaacuucuugcuaugcuugugaaugauuugguaauuaagcagaaccuugcuacucaaaguaugaccuuuagaugaccaccaggaagcuucuagaaaugcagauuauugcaguuccccccaaaaccccccaacagaaccagaaucugcauuuuacuaagaucuacgguuauguauauuagaguuugaaaguaaguaaguagaucagagagaggaaugggagaguggugguaccugguauauaaggaaauuuugacuguacaauuuuauuguuauugucuucaggaacaacuacaaagauuacucccuggaguccagacuacacuucagaauucaggcagcucuucaccucuggagaaaaccuuccucagauugaucagaacuugaaggauggaauuuuuccucaauuagcaucggcaucugcuauagauucaaccuuauauuaaaguggaaaaaugaucuugugaauaagagacaaaaaaacaguuuuuuuggucaauauuuucuaucaucugagagauuuacuguuggucuacauaauuuuuuuuccuauggaauggcauucuauauuaucuagaaaauucuuauauuuugccucccccaaaagaauuucauauuauuugaauuagggggcgaagaagucuuuugaaagacuugcagaugcaauagucuaauuagauuauuuauuuuuuuaaugugaaaauuaauauuguuuagcaaauagcuuacaaguugagccaauuuuggauuuguuggguaguuaaacuucagagauauuuuguugccuguauuuaaauuucagaagauaaauaaauaucauugcauuuaaaauagcuuaacagugaccuucagaagacuucugaaaaagacagucugagaacaugaacacggaucgauauaauguacuucauggguugaagagaccuuucucuauaaaggaugaugcaguauucaguuagugguuuuuuacucuucauuugauuaaagguggugacguuuuggagagacugauuuugaauguacuuaagucuauuauaauaacaaaauucaaaaccccuguguaucuaaagggaaggaagugucauauuuuaggaauuuuucuuaaccuuagcaaugagagccuaaaauacauacauggauuauuuuucuucuaggaaguaaauuuccugcugcuuuaaaugauauguaaaauaucaauaauuuuuacacuuaagauguugguaagaccuaguuuucuaaucucucuagcacugugaugucuccuuguagauaaucuggaccuugcuuaguccuuuaguugggaaacagaaucagggcauagagcagaagagagcuugacacuccauaugguccugguucugcuacccauuagcgauuagugaggagaccuuuagggaguccacugugcccugugugucaccacauuuucuucugugaaaucaagauuaaagaacagaugacuuucaaggucuuuuucaguuuuauaacugugagucuauguauuagguauuuauuuucaacaaaugacuuuaaaaugucgaaugcaaaccauucccacuuggaguguuuuauuuuucaaucaucaucauugcccccaacuccccacauguauguguuguggcauccagagugagaaaagacaauuuaugaguugaugaaucugggccuuauuucuauuuccauuuugaagaauaacuugucauagaagccucugcaguuuaacagaaggagccacauauugggagucacgaguucaucucuguggguuaauaguuccaugacacggaguacguagcucagcuuuucagggguucaguugccccacuauggauagcggugugguauuugguacuugugagggcucaauuagauaaaacauaugauagcuuuuuguaaacuguaaaaggcuauacaaaaguaugaauuauuauaauaauuaugguuuuuuaugucuggauuacaguaucaacacaaaaguauuggcugauacugugguuuguguuguaaaaugaaagaaguguagaaauucaaauaccuuacuguguauucauguguuugauguugacaguaggcuacccagguuauaugaaccugcuccugccguucccugccacauggaccuguaucaagcaguguguggcuuguuuucuucaagguacugauucuugaccaacacugaggauguauauccaaugaaagauagauaucaauggcgguagauaucaauguguuauuaguaauacaacuuuagguacagacaaaauagaaaauaaaauuaacugucauuauaauuaguaguggaaaauacauuaaaaauuauuuguguauagcuuuggaaaaaaguuuuccaaaaaaagcuuuuuggaaaaaagcucuuagaagagcuuugguaacauuauuuuugaaagcgcacacucacauugugacuguggguauacugagcauauauucuuacauuguuacugugagaagcugcaagucagugcugcaagucaguaacaaauucucuuuuggggauaaaaugaaacaguuuuaagcuuagaguggccauuuuuauuuuaacucugcauuacuaaacaaauauaaaagaaauucaucuccauuuaaaaaucuuuuuuguuauuuauauuuuguuuuauuuuuguuuccuauucuuuaugcaguuaccugauacuauggacaguauauccaguggaucuuuuaguacuguaauaucaaaaugcuacaaauauuuauguuuccugcuauguucaagauauuguaguggcaccaacuucuugggcaucagcuaauauugcauuuuggagucauuaggguguucugugaagaaugaauacugaagugacaguuuuaucuaguuuuuugaggggcauuuaugaugggguuggguugccauugugucugacagugcaauucauguaguuccuggcauaauugccuuuuuuuuuuccuuaauggagaggcaggguucugauuggugcuguauaaauuuaaguaacuuugugcuuuguaggaauggugacaaggaaggcaugauuucccccugacaaggaaugaaaggugaacuguaucagcucuuaucuggacauauauguuaauguuuucuaugcucccugauacaagaaguuuccaaguuauauaggaaaauuaaguccauugauccugucuuuauccucagagggcagaaaugagacaaguggauaaaggcuguaggaagcugaauuccagauuaaucagugccgaggaagauuuuucauuaucggaaaacccaacagucuaaaaucaauaaccaguucuucugcaaaggggugaguuuaagcagggcuaaugugacugucauuucugccuguccugcaagcuuagacuaguugaacuuugaggucacucuaugauucuuuuauuagggcuucaaaucagcagggaguguguaaagaaaaaaugcucccccccuaccauuucaaauaaaagugaauguuuucucuuucaaagcuacuauuagagguaguugugauagacacuaacaauccccgguguuaauacuuuccacuccuuuuauuuuauuuuaauuuaauauuauuuuauugagacagagucucgcucugucacccaggcuggagugcaguggcguaaucucugcucacugcaagcuccuccucccagguucacgccauucuccugccucagccucccgaguagcugggacuacaggcgcccgccaccacgccuggcuaauuuuuuguauuuugaguagagacgggguuucaccguguuagccaggauggucucgaucuccugaacucgugauccacuccuuuuuaaagugagucuagucuguugaucuucauaaauaggaggguuuuccuccagcuuggacauuaaaaauaauuuuuaaaaagaucuuuguggcuaacuggaaaaucuucuggaauuaucuaaugcuucauucauuucccuccauuucuguuuuuuuuuuuuguauuuauacucugcauauuuagaaaucuuaaauucaaauacauuuaguuaaaaugaguugacgaagacuccagugauguuuuaauacccuaagauuuugugauuccuugggccuggaauggaucuuagaaaauuaccuugcccucaugagccuguaaaccguguuguuuccccucagucuugcucuguccaguacaguagccccucgccacacauggcugcggagcacccggaauggcuuacagcacaugugggaauggugcugaaugcugaggaagcauucacucauacgugcugcacuucuuaaaggccucccaauagccugcuuugcggaguucuggcuuuuacuugcugucuacuaugaucaccugauuugugcuucacauacauaucugugaaguuugcuuuuucuauuuaaagugcccuuaaacuuucauuugaucguguuuaucugcagauggucagugucauuggcauauuugaacauuauucugcccucccuccgccaaacuccuuauguacuagauuaagaaauuuuauuuuugagaugaugauuuuaauuugauuuuacagacauucuuuuuuacaaaguacaguuguuagaguuauagaagagugauucacaucuuugagaagauagauuucaugauuaauauauauauuuuuugagacagaguuucgcucuuguugcccaggcuggagugcaauugcacgaucuaggcucacugcaaccucugccucccagguucaagcaauucuccugccucagccucccaaguagcugggauuacaggcaugugccaccaugcccagcuaauuuuguauuuuuaguagagaugggguuucuccauguuggucagucuggucucgaacucccaacuucaggugaucuggccgccuuggccucccaaagugcugggauuacaggcgugagccaccaugccuggcccaauauuuucuaagauaaaauuauucugagaaaucuaguggaaucuuuuccauugcuuuguuauuaauguuucaacacugacuuucucaacuaggccaguauuacuauuuaaagguuuuuagaggcuggcaaugguggcucacgccuguaauccuaaaacuuugggaagccaaaguuggggggcgucacuugggaccagggguuugaggccagccugggcaauacagugagaaccugucuuuacaaaaaaaaaaaaaaaaaaaaaaaugagccgugcaugguggagugcacuuguaguccuagcuacuagggagacuuaggugggauaauugcuugaucccaggaguuugaggcuacagugagcuaagaucaugccacugcacuccaccccaggugacagagugagacccugucucaaaaaaaaaaaaaaaaaaaaaaaaaauauauauauauauauauauauauauauauauauauauauauauauaaaauaaagguuuguggacacauguuacccauuuagagaauaauuuauuuuugaauguguaugauaccuaagugauaugcauauauauaauuaagacauuuuaaaucucuucagauauuucuucauaagauacauguaucuauagauagcuauauacaaaacuacuuacaaauaauaaauagacauuguuuuauacaguucuuuccaaagaaaugcaggauuucuuauccuaguccuuccuccccgaguccaguuauuuacauauuuuugucuuuaaguguuagauugcuuguuucugcugccuauuguugguaguuuugucuuuuacacauuugcuguuagauuuaguuauuuugaaauguugaacuugaaauguaaugaaaaggacacaucagaauuuaucaucagggaagauaucuuuuauguugagcagcugcuaucugaucuugacagacuguccucuuagaggacuguugaaguccauucuagucauuuuguaacuucauaacugcagaaagaaaugaugcaaggacuguuuaguggacugagauggcugagcagguucuuggccugaauuauccagaggagauagguggaucuagcuucagaggaagucuacaccccauucccuucugcuuacaauguacccaugauauguguuuagcacaguaauacuguaacaggacaucacauggaaaaaucaaagcagcuggcucacuguauuuaacugaaaagaaugccuacagauuggauauuuaauagggaaaauuaaggcacuuuaauaacaaacuucauuaugugaaacuuguugaauauuaacauacaauauaccuuguauauuaaugccauaguuuuuagaaacacuaauuuaaacaacaaauuuaaggggugcuggcauaucccagugacaccuucaguuuuauugcugcuuaguauuuucuaguaaauuaguuuuaauuauugguagucuguugggcaccauuugggaaagaaauaaauuggucucaguguagcagacuuguagccaaaaacuuugaauaaaaaauaaguauaauaaagaauauuauuucauuuuuaaaggaauuguauuauuuugaagugcugugugguugauaugguuugguugugucucuacccaaaucucuuauugaauuguaguucccauaauccccacaugggagggacccagugggaggugacugaaucaugggggcaguuuuccccaugcuauucucaugauagugauugaguucucacgagauuugaugguuuuauaaggggcuuuucccccuuugcucagcacuucucuuuccugccgcccugugaagaagaaggugccuuucuuucccuuugccuuccgccauuauucuaaguuuccugaggccuucucagccaugcagaauugugagucaauuauaccucuuuuuuaaauaaauuauccagucucagauauuucuucauagcagugugagaauggacuaauacaauggucuuaaucaauuugaagguaugacacucuuugcuuuggaaaucauguagacauuuuaagucauuccuauuuuuaauguagacaaacguccagguagcaauuuuggggauaauaaaugaguucacccuuuuuuuuucuuuuuuucccugagacagaguuugcucuuguugcccaggcuggaguuuaauggcacgaucuuggcuuaccacaaccucugccuccuggguucaagcaauucuccugccucaggcucccaaguagcugggauuacaggcaugugccaucacacccggcuaauuuuuguauuuuuaguagagacaggguaucuccauguuggucaggcuggucucgaacuccugaccucaggugauccgcccacuucagccucccaaagugcugggauuacaggcgugagccaucaugccuggccgaguucagcuuuuauucacauuuuuuccccaaagugauuuauucuucaaaguagacaguuauguucuauagaguguuuuguuuuuucuuuaagaaaauaauuuacauaaacagagauuaugguaaacauuuuaaaucuuaggcuguugguuaaauuuaaugguuuaagcacuguuggguucucuuuaauuaauauuugcagaaggagaacauauguguuucacugauauguaugguccagaaaaauuacuuaauucucaaaaauauguugcauucucauauuguguuagggaaaauuccauaaguagucuauuuuuuuuuuucuuuugcugacuguuaacauccaaacaccugaaugaaaacugacucauuucuguauugguguuuaaaaauauugauuugcagauguucacagaacacuugcauuuuuugauucacauugcuaaaucaaauguaaaggcaaauauguauauuuaauaaaugagaaguauuuuuuuauuacugaaauuuauucucaaagcaaauguauuuuguagauguuucauuugggagauuuugcuuugccuuaaaacauacaaaauaaaccugucuuguggucugcccaccucaaaaccucuguuaacuugacauguagaaggaguucagaauucuuugauaaugugugguuuucacuuuuguuuggauuaaacaaaaauaaaauuagaguccauagcacuuuguaaacuaaugugaaguuucuuguugaaucauaaaagcuaccuguauguacuuuauaauuuaauguucuguuaguaaaaauugucagcauuuuaucuuuuucucuucucauuacauuuuagucuccaaucuuucccacucucagcagucacaguuuugcagagcaaaacauuuuuagaaacugaauaugugugaguucuauauaaaaugaauguguuaguaacauccaucugcugaucaaggaggcauuggaucugguacuagaaggugaaauugauuguagcuaucaaagcauuuuaucaauguaagucaagaaaaaagaagaaaacugugaaccucugauauuuuuaacauaaaaacuguucccaaugaguguucucuugcugauuuuguguuaauguuauugucuaugauuuuuaagcuaaugcuaauauaaaaucuaaaauuucaacaugaugacaacaauuccuguagccuguuuuuaccauuaggauguuuuugaaaacagaugucaucuuagaaauuauauuuuuaagugcaaauaaaucauccugacuugaaagucaacacauuuuauuuuucauuccguaguaucacagaauaugcugcauuuagauacagguuuaauuugccagauuuucucaaaauucuguauuuuuauauugcuacaacugguuuacuuaacaugcaauugaauuguuauuuaaauaaauuacauuugauggaau

SEQ ID NO: 14011 - RNA, 1496 nt, Homo sapiens
aaagaccauauaauuccguuuauauuaaauguccagauuaguuaaaucuagagagacaaaguagguucuugguuggcuagggcuggaggaguugggaggaucaggggugauagcuaaaaaguacaaguuucuucuuucgagugguaaaaaugcucucaaauaguggugaugguugcccaagccugugaauauaccaaaaaucacugaacacuucaaaugggugaauuauauggcaugugauuacagucuaauaaauaaauaguauguccugcuguauccuucagggccucugagaaauggagagagcuccaucugaagccagacugaguuccgauccugcuucuauuuuccccgcagguaaauccuuccucaacagcaacacggggugauacgcccuauccggaaagguuguuguaauuuuuaaaaacauuaaaaacauacauuaggguuaaucauguagcgugugauacacagacgcucugaaacacuacugcacacgcacaccaacauggggccucugcggagcuugugaaagaaccagaucuggagggcuggucgugucccuggucucggcccucgcccuccuuguuucuuaggcucuaaagcaaucaggcagcagagcaguccuugaaccccagucaagaaaaagcccugcaccccuuaguccgaaagccgcaaggaacggggccuaagcgccuggcgaggccgcccuaccgggcagagacaguugcuacguaacucggggaccagaaacccagccccacccgcugcgguuaaccgacagccgcaacgguucccgcaccgcccgggucggagaacaaugcugcgcccugcacguagagccucgcggugccgcgcccuggggcgggccugcccauggccugccgggaaauguaguuucugaugcccugcccgcgccgccucgccgcucgccggccgggcgccccaagcaacuacaacuuccaucacgcucugcgaggccuugaucugcaggcuuuugcaggggaaggaguggggcgaacauggcugaaggaagccgagguggcccuacguguagcgggguggguggcaggcaggacccagucuccggcaguggcggcugcaacuuuccagaguaugagcuucccgagcuaaauacgcgcgcuuuccaugugggcgccuuuggggagcuguggcggggccgucugcgcggggccggggacuugucgcugagggagccgccggcauccgcucugccugggagccaggcagcugacuccgaccgggaggaugccgcgguggccagggaucuggacugcagccuggaggcggcggcugagcugagggcggugugcgggugagugcggagcaaaggggcucuugcagcuuggggucaaacagggugcagccuugcucgugcgcuccucugggacucaucccugagaagggccugugguuuagaccugggcuaggaguauuacccuuuaaagcuuucaacccgcuggagccuuccuggg

SEQ ID NO: 14012 - RNA, 1284 nt, Homo sapiens
uuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagc

SEQ ID NO: 14013 - RNA, 2622 nt, Homo sapiens
aaaugcaccauauacuagaaaucuuagauagucuuaucagguuaagauauaauacuagaacaucucauucacuuaauucacguuaugcaaacccuggacaggguagaacacguuuccaaagcaauuaaaaccaagaugagggagggcguguucuaccuucuugcucaaacaugauuuauuuuuuaagggggguuggugagauccgaagagcaaagggugggauugagaaagacaauggaaaagucagaggagauuaagauacacaaugagaggaauggauuacucuguacaaaaacaugcaaaaauacuccaaauuggggacuagauuuaaaaaaagaaacagccuugguguauacaucucaagugaaccuauuaacucagcacauugucugggagcucaagagcaucauaccucaugaaucaugcuucucgcaguggccacagcaccgauucacagaugggguagaggaugcuuugucuccuagcauggaaaaggcaggcagugaggcucccacugaaacagugccaggucaguucaccuugcagggacuggcgcuuucucccucucuuuugaaaaacauauccagggccagaugaauggagcucucucacacacccagggucuccccagagucaccucucaauccuugcauuccaugacagaagugggcagagccaguuaauaauugauggauuugccaucuuagcugugcauuaucucaacaucacauuuggcaacaggaagcccuauaaaaucuugguauagcacuuagauacucucucuucaagaaauauacuuucaauacuaucuacuucucuccauuuuucuuaaaauacuucuuucugcucuuccuucccuucaaagauucuuuuuuaaaaaagugaaacaaagcauuaaaaaaacuauuacaaacguccuuaagcaucccugguauuuuagaguuaaggggagaaagcuaguaucagcgagcagaacuugugcaauuuuggcaacugguuuuucaauuaggauucuauuaagaugucugauaaacgauuguaacauauacauacugaggaacuuaagaaguaucaugucaacuaauugccuuugcucgaacccaagaguccuugcucaaagugcuuuucuucccaguccccacacugguucaugaaauuauuuagcacagauuugucaacauagaccuguuacauugucuaucccuaaaucugcugcuguucucuccuugcuaaaguucauauggaagaugauaccgauaccugcacgugucuuaccuggcugacuaauaucuuacugaaaugugacuguuuguaauggggccaacuaucuucucugagaugcgcugcgggaagguuggaaggaagcauggcauccccuagucccagaaagaagacgcuugauagaucuugcacuucauuuagucacuaacuagucacuuuccaaccaucauuugaguauuucaauauacaaaaauagcagccaaucuuugggcucagggcauuuuggaauauaacauuuucauguauucuuccuuuguaccuuugguccccaucacucgauuuucuaaagcucccuguacuuguacuuaccaaaguucuucaaaguggagaauuuaccuuuuacucauagggugguccuuguuuuaacgauuaaagucaaaagccugacgccaucuuuuuuagauugucaguccaguuugacaaaaguuaaucuaucauguuacacuauggauuuggaggggucauugaaagaugcauuuguacaccuacguccaugguuugaugccaaggauaagaaaaaaaaaugaccacugugcguaaccaguuuacaacaugugcacuuuuugaaggggaagaaaaauauuuuaaucuuuucccuacagauuagggggcaauauaaucuuacuuaugccacugacuugcaggaaaauuugcucuaauuauagggccacacccauuacucucaagauggaauuguuaacacuuaaguuuucaaagaagcaaaggaugccgucacagacagcaucucucuacugacccuuuauuuaagaagucaucuuguuacuguccacuuaauagcuggagagggcaucgagaggcagccuugggcuucccacagauacaguagguguguguaugugcuuguauguuaggaggggagaauaagagggaaggagagagagaggggagagagagagagagagagagagagagagagagagagagagagagacugacugauuguggauguguguguacaucagggaacucgaugggaaagccuagcccuuguagucaauuucuccuucacaaggggauaaacaggcaauuacgcauccuuuuauauuugauggccaagugcugaacuggaaagcacacuauuaguuugugucccuucagggccagggcaauaaguagccaggagagcugggcugaagcagagaggguguugucugcuguuagugugacagucuugucagcagcguucacauuacuggaagguaauaaagugacaaguauguuauuagaaagauacgaggugaaauugaacugaagcuucuugcugcucagcccuggcuuuuuucuuuccucuuuuguaaugguccacuauuuguuacagac

SEQ ID NO: 14014 - RNA, 452675 nt, Homo sapiens
ggagggagagaaaggccgagacggagggagccagcggcggccgaggggcugguccaggcgcggccgcuaagaggagaccaagaggcgggggcugcacuugacaaccagcaugccgagaugguaagaaguuuccacccuccuuccucuuuuauucuagacuuccucagaaaugacccccgcgcccgagcgccaccggggccgcccgggggccguguccgcccuccggcccgcggcgugaggggcaaggggcgcugaggagggcgggccggggaccagaaccccgguccgaccugauccccgcugcgcucccaguggccuccccuaaacuuggccccaaguuucugaggcgagcucuaggugggagggugcacgugagagggggcuucucaaggucggccccgcucgcggcuuccgcgcgaaggugagcggcuggcuaggggaggcuccagggcguuggggacgggcuggggggacgagguggaggggagugggggaugaauggagcgcuggcaggagcucggggaagagaggaaggcggcugggaccuacgggaacuuuuacaacuugccgccgagugagggaccggcggcugggcgugggugccgggugcgcuggggcgcagccgcccgggcccggcacguugacucuuccucuccccuugucuucacauucggaaucuucccgugguaaauggagaugggaggaaaugcucccgcaggcuuuacggagaaggugcagaacgcagggcaggaaaaucaaccuugcagagacggcucuuuucgaagugcaauucuauaggagccgauuuguuuuacuugcacguugacuggagggugggauuuggggccuggggagggagcagaauaaaaaauuauauaugcugaaaaacccuaggugaaaucuccugugaagugaguuuaagguugaaaaaaaguuccaagugcaagugguggaggagaugggcuggcuuugccaagcgagacuccagcacagccccucuacgagaagcgacuucuuugcagcgaggaagcgugcaauuaguucgccuggugaugagccgcucuguccgcuuucggggaagugauuuguuagaaauggggcuugaccacucccuucuuuuuaguuugcuuccucccagcgucgcuauuguuacccccacuuggggaucugacaugguguauuccguauauagagggaacauaugagaauacaggugagauagcggguuggcauuuuuuccucuucccugcucccuaaugugacaucucuuguuucagugaucaaagucacaacuggaguguaggagaugggacugucaaaugcaggggcgcguacacacacacacacacacaaaagcaagagcccaggacugugguuacaguaacgcugacagaaauuaaagugguuuugaaagcagcgugcgauuuaugaugguucccauuuacccuagagucaagcuguuguaaaacugacguacaaaagacaucauaaaauaauccuguguacccaggauuaaaguggcaaaaaguggccuguuuuauuuuuauauacuucguggacacuuggaauuguugaaagccguguuuaagugagacaucacaacaauauuaaauauaucuguuuagagcuugagaguuuuucuucuaacgggcguuuuacacaagaacacuguaaaagccgguggcagguauuauuuuucuucccuuuacccuagccuauguuaacuauuugucuacacauguauuccuauauccuaaugacuuugaacuguggcuaagccugucugccuuccacugcuuuguauucugcaauuucacguguuacuguccacacgcauacaugcuuuaaaugggaggaauuuauuucuggcacguuacuuagugugucugaucugaagauguacccuaguagugagaccuuguacaaguuaacagaacauuuacuuuuuggacaaacacacacacacacacaaucccuugugagccuuuagagaguaucuguguuuuauauuuguagccguuucauguaaacuguucagucuuaaugaaguucuuaguucccagagugcgcuguauuaaaaguccagauugcuaaucacuuuaccaaaguacaggaguaucuuuaccugagggaaguaauaacgagcuugaaccugaacuuuguuuugaguaucuuuugagaaaggucugaaacuuuuuuuccucuugagaauauuaaguugggugguguuugcauguaagacuuugaauaagaauaaacugugcauuauauuuuacaauuaauauuaggaaaauguuaauagcaguacauuccuacuaccugauuuuuucuucuauuugagauguaagauaucugucagauagagauaugugauuacaaaaagaagcagacaaaagcagagcugacuauugcuauauuaaaauguaaguguuacaguuugaauuuucaagugagaguucuugaguucagugcuuuacauaacauuuuguccuaaucuugcuugcugucagggauguuucaugguugugcaauugcugcagucaagaaugccaauuugcauuccaggagugucauuugauuacuuuuaucugcacagcuccaagaccggcccagaccucucguuucaucuugccaugucacgagucaaugcugugucgucuuuucaaaaaucugccugauuuagacaagaaagaaaaguacuuucauguugcagccgcaguccccugcuaacuugucagcagcaggauaugauucacuugggcccagaagaauggaacagagaggcggguuaggcgguucaauaaagcccacggacagguagugugugacauccccagagagccgcaguuaaugaagaacaggucugcuuaguucuccacacgcugaccuggugcuguccccacaguuuucucauuugaucuuucccagcaaauugaucuuuucuuguauuuuuuugccuuccaaguuaguccuugugggacugaaauuagcagagcaacuuaaguuggauaauacagcuguucagaaaagaagaaauuggacacuggcucaaaaagggguggggguggggggguagagggagcuauucuuuuuguuguuguuccugggaauauuucuuauauuaagggaguccaaaauagaugaugacuugaaguuagugguuuccuuuacuuuuaauuuuacaguuaaggguucagcacgguuuuaaauauuccuuaaguauuugaaagauggccuuagugaauaugaggaguucaauuuaguacuguucacauucacuuguuugagaugauuugccaguugacaauguggcuuuuaugguuauuguaagauggcauacuucaacuguauuauuuauagucuucuaaacaaccuacgauccccaaauauccaauacuaaauugcagguaagauuaaacaauaaaaaagucauuauacuaguauuguguauaaauacuaugguacaugaaaauguuuucuauacuauuagcaucuuuguuuuauauaaaccccacagauacaguucaugaaguguuuuuuuccugaauuuuugagauucugcauuuaaauguagauuuuuaaaacugagaccagaccacaaguuugaauuucuguggauguucauacauguuguuguuuuuugacauuaaaauuaauuuuagacaggauggguaaauuuaugucguaugguuuaaucugauuaaaguuucacuauagaauucuguacauaaagcuuagguuggaagcaguuuauagauucuuaacuugauaaauauauaaggagcaacgcuuucugauuuacucagcagauggucucauuuaccaucuacauccuuacaagaaacagaguggaaaacauuucuuguggaaggggagguagccuccucaaaucuuuccuguuggaugggaauuauauaguaucauugguuaguaaaauccccucugaagagcuagagggagccucaugauuuuauuagauauacuuaagguuuaaaaaacacucuggccaucagaauguugcacaaaaagaguagguaaugaauacuggcucaguguugaggcugggaggugcuauuaugguuuuuuuuuuuuuuuuuuuuuuaaaagugacagaagcaaaagaacuuucuacaagaacagucaaggcgucagcuaagcuuucuaggcuuuugccuuucaggugauuugaagaucaggcaaaaugcaaccagauacuauauuuuaaauguuuugguuugacuaacuacuguuuguaguuuuugucaacugagggaguuacucucguuuuaggaggccagucuucagaguucuauuaaaaguagcuuccuacgaaaucaccgagaaguggguuaacuucuuuuaguuuaugaaggacaaccccuuuucuguaaaugaugguuuuggaguaguucuacauacaacuucuguauuccagagagaaauuuucuuuaaaauaaaugcuuccuguuauaagcauaaauguuaaacuauuuauaaaccugacuuauuauggaucaaaaaauaaguuaaagaaauaggauuuaaaugauauuacauucaauaauugucauuuaauuucauauuuaccacuuuccauuaacauuugugauacaguuauguuaaagagucauugaucauaauugcacuuuaauauuuauauacuaguuuuuaggagcauuacuuuagacaaacauauuuaucauuuaaguaaauaauauaauccagugagauaaacuacccagauuuguccuucuuaaaaucuuuugcacaguagcucucauuauguugcuagccaauaaaagucuuuauuuguugcuuauuagaacccucaguacacucaagaguucagcuauaauuuaauuuggcuguucaaagagccucccuuguuuugaaauauauucucaguaugcuuuuaccauuuguuacgaacccauauucuaacucaaugcguaagaaccuauauucuaacucaauaugcguaagaaugauauuacagauauaucauucuuuaaguuuuugcuaucgucauaacuuuuuuccuuuaaaaauauccguacauaacaauaucaguuuuguucuuuuugcucuauuuucucuuugacauucuagaguauuuuucucuuggugauuuaaauuguuuugcuguuauaauuuaaaauaaacuuccuaaggaauacaaccuucccuugagguauagugagaagggcaccaaaaaauaauagguucgauaauuaagaauucuagcugaggccauuucacaguugcaaucacuuacaauuacaaaaaguuugccugguacuucacaaauugcuaguaacugcugugaaguuuuucaaugaguagaagguggcuuugagaguuuugguuguauuuguaacaaauuacguucacuaaagacuagaacuugacuauaaaacucuaauaagaugaguaucaggaauucuuccauaaggaaggcagaaugugaaacuccuaaaugacucacuguguauguaucuuaccagugggaauagcaucaagccagccuucuagauacaguauuuaauaguugucaaaauguacaguauugucuuggaacuugugguucaugaguucauagucccugcuuuuuuguguuuauuacaaagauguaacaaccuacacaaaacauuuuucucuuauaaugaccuuacauuugccaaagugccccaugcugaaauuccuuuucagugucuuuuuuuuuuuuuuuuucaguccaaagccagacguguacccagacacaaaagccucuguguauagcaagcuguuuuaaauauugugacucgacgaugugcuguccuuucucugcuugagccaaggaucucugcucagugucuguggauuaccaagcuccuucuuuauuguaccucuugucaacuauuccuauucauuuaaccuuucauuagugucugugcagcuucacugucuggaaaggcaaggaaaaaccgaaaggccccacugucacaguuauuagauuucucgguuacaucccagcaaccguaaagaaguaagcgucgagacuauugucgugcaugcugcuguccuggggugcagcucuucugugcaugucaaggacaugugccacauguugauaugcaucccagggauaaaugcacaacaugggggauaggccgacgcuggcaguaaugagcuuuguaggaguuauugcaaagaccaacaguuugugaaggaauuuugcuuaacaggccaaggagauagacagaguugaggguugccaagauuugccugugcggggcuugucagucacauuguuuucauccaaacuucauuugaggggaaaauugaauacauuugacagcaauggaaagucuuauuuucuuuuuucaaaucuuucagaggacaaaagcaguauuucuggugacuaacauaacuauuuuuaguacugacuaaaucauauauaugaauggaucuauuagcaguuuaucuuuuuccauaucuagagaauaauuaaaagauauuucauagaugucauauauauguuuuaaaaucuauguaaaaauaauguagccuauuaauuuuccuuugcucuuuuccuccuuugauuuuccucuagcauagccugguucuuuagaaauacauuugcuuaauuggcuagaugcagaggagaaaaaggaugauaauguggucauuuucaaaucauaaauaaaauaaguauuuguaaauuuuguauuggaaaauauuauuuuaaaaucuuagagaugaagagaauuaccuuuuuaagaauucugaaaacacuugaauagaaaaugguacauuauaauacauuugucccucuuuacccaaaaguuugucuuuuuuucuuuuuuaaacuaggagaaccguuuuuacugaggguaaauaaaauauuuuugucuccugauuucaacagauuuugucaguuuuccaaacucuuuugggguucuccaauaacuuuucaaauauguuaaugacuuauugccaaaucccuguaaaguuauuuuuaauuuuucuugaccuuaccucuuuuaggcaaggcuuuuuaacaguuguacuuucucuguuaagguuuuuuuugaaacggaaucucgcucugucgcccaaacuagagugcaguggcgugauuuuggcucacugcaaccuccaucuccuggguucaagagauucuccugccucagccucccgauuagcugggacuacaagcgugcgccacugcgcuuggcuaauuuuuguauuuuuaguagggacaagguuucaccauguuguccaggcuggucccgaacuccugaccucaggugauccacuggccucggccucccaaagugcugggauuacagugugaucccacagugagccacugugcccagccaccucuauuaagcuuuucuuagugucuugugaaaguaugggcuaaguuauccuuguuuuagggagagagaguuauuuuucauagucuuucccccaggugggaugcuaaaugcccagcuauccuauccuagggcuaugccccagccuuuuggccagcgggcggaaguacuguguagaauauauugagauggggcagggcgugguggcucaugccuguaaucccagcacuuugggaggcucagguggguggaucacaaggucaggaguucaagaccagccuggccaauauggugaaaccccgucuuuacuaaaaauacaaaaauuagcugggcgugguggcgggcaccuauaaucccagcuacucgggaggcugaggcaggagaaucacuugaaccugggaggcggagguugcagugagccaagaucucgccacugcacucuagccugagcgacagagcaagacuuugucucaaaaaaaaaaaaaaaaaucuaucuauauauagcuauauauagaugaaucugccguggucaucuaaggcuggugaccuucccacagaaaaagcaugagugucuuaacauuccuuuuucuaacaguuucauuuccauuuauuaugguuuguguugggaguaguagaagagaaaagagggacuugugaagaugaaggccauaauuuuaacucuuccccuggcaaugaaaacccccaaauuagaacaaaauagguuagugcugugugguaauuaaagagagaggaauacauggcaguagcuacucucugcagguauccugcacuuguucuuuauccagucaguaucucuacgcaggugacuggcuguuucuuggaaggcaguuguacuguugccuguuagagacucagaacagcgcugggacgggguaucuauagaggcccuguucuauuccaccuacuuuugauagccuguguucucucauuuguaagucaagugaguuugguaauuucuaagugccuuuccaaaugguacauuucauauuuuauauaacacuauauaaucauagcaguuugcuguuauuagcuuuauugagauauaacucacccacuuaaaauguacauuaauauuccauuuuauggauguacuaccucuuauauauccauucaaugaaagcacauuuggguuguuuacacuuuuugaguaauguggcccugaacauucauguacaaguuuuuguggacauaauguuuucauuucucuuggguauaugcucaagaguagaauuguuggauaguauggccuaucuacuuauaacuuuuugaggaacuuccaaauuguuuuccaacgcaacugcagcauuuuacuuuucaaccaauaguguauaauucuuccagucucucuacacccuccucaacacuuguuaugugucuuuuuuuuuuuugucuuuugagauggagucucgcucugucgcccaggcuggaguccaguggugcaaucucggcucacugcaagcuccaccucccagguucacgccauucuccugccucagccuucugaguagcugggacuacaggcgcccgccaccaugacuggcuaauuuuuuguauuuuuaguagagacguuguuucacuguguuagccaggauggucucgaucuccugaccucgucauccucccgccucggccucccaaaguguugggauuucaggcgugagccaccgcgccuggcccuuguuauugucuuuuuauuuuuacagaucuuagugggugugaaguaguaucuuuuuauuugaaucauacuagugacuaugaagugauaucucugugguuuugauuugcauuugccugauggcuagugauguugagcaucuuaugcacuuuauuggccauuuguguaucuuuucuggaaaacagagacaugucuccauuggccauuuuucacuuggguuauuugucuuuuuauuaugcaguuuuaagugcuguuuauauauucugaguacaagcccucugcuagguacaagguuugcaaauacuuuauccuauucuguggguugucuuuauuuauuuauuuauuuuuaaagagacagggucuuucuaguucuguugugcagguuggagugcagugguaugauuauggcucacugcagccuugaacuccugggcucaagaaauccuccugcuucagccuccguaguaauugggacuacaagugcaagccacgaugccugguuaauuuauauauauauauauauauauuuuguagagauaggguauuaccauguugcccagccugguuucaaacuccuggccucaagcgauccuguuuccuugaccccccaaaauucugggauuacaggcauaagccacugugacugugcgcagcugucuuuuuuuuuuuuugagacagagucuugcucuggcgcucaggcaguggcgugaucucagcucacugcaaccuccaccucuuggguuuaagccauuguccugccucagcgucccgaguagcuggcauuacaggcaugugccaacaugcccggcuaauuuuuguauuuuuaguggagauaggguuucucuauguuggccaggcuggucucuuuaaacuccuggccucaggugaucugcuggucuuggccucccaaagugcugggauuacuggcaugagccaccacgcccagccccggcugucuuuugacuuuuugauggugccuuuucaagcacagaaauuuuugaugaagucuaauuuaucaauuuuuguuguuguugauguuucuguccuugguaugcuaucuaagaaacuauugucuaacccaagaucaugaagauuuaccucuguguuuuuuuugauaagugucuuacaguuugagcucccacaggguggauucauagaucuuuaauccauuuggauuaacuucuguaaauaguaugagguagggguacaacuuuauucuuuugaauguggaugucuguuguucccagcacuauuuguugaaaagacaguuuuucuccauugaggugucuggguacccuugucaaaaauuaauugaccaugauauauaaggguuuauuucuggaauuucuguucuauuccauugaucuuucugucuguccuugugccaguaccacacugucuugacuacuguagcuuuguauuaaguuuugcaauugagaagugugaguccuacaacuucguucuguucuucuuuuucaagauuguuuuagccauucuuaguuccuuagaaguugacuuuuuaaaaagcaauuuggauugugguagaaaacaacguaaaauguaucuuguuaauccuuuuuuuuuuuugagauggagucucacucugucguccaugcuggagugcaguggugugaucucggcucacugcagccuccaccucccugguucaagcaauuccccugccugagucucccaaguagcugggauuacaggcacauggcaccaugacuggcuaauuuuuuuguauuuuuaguagagaugggguuucaccauguuggccagacuguucuccaacucuugaccucagcauucugcccgccuuggccucccaaagugcugggauaacaggcgugagccgccgugccuggcccauguuaaccauuuuuaaguguacaguucaguaguguuuucuguaacuuaacguacagcagaucucuagaacauuuucauucugcaaagcugaaauuuuuuaaccuuugaauaacaacucccguuuaccuuuuccucccagcccugggaaaccacuauucuagcuucuauuucuaagaguuugccuacuuuagaugccucauagaaguggaaucaugcaguacauauuugucuuuuuguuccggcuuauuucacuuagcuagaaacuuaauguucuuaagguucauuuauguuguagcauacaacagaauugucuucauuuuuaaggcuaaauaauauuucaucauauguauauaccacauuuucuuuauccauucaucuguagauagacauuuaguuugcuuuccaccucuuggcucuugugaauuaugcuguugugaauauaaguaugcaaauagcuguaaaagauacugcuuucaaucuuuggacauauauguagaagugggauagcuggaucauacaguaguucuuaauuuuuugaggaaccuccauacuguuuucuauaagggcagcaucguuuacauuccugccaacagugcacaaggguuccaauuucucuacaaccucacagcuuauuauuuccuguuuuuuuuuuuugaugguaaccauucaaaaaugguugaggugauaucucagugugguuuugauuugccuuuccuugauuccugauguuaagcauauuuucacgugcuuuuugggcauuuguauauguccucuuuguggacauaucuauucaaguccuucaccuauuuuuaaaucaggcuuuuuuuguuguuguugaguuuuaagaguugucuauaugucuauaccccuuaucagaaauaugauuuacacauuuuuucucacuuucuauaguuuaucucuucacucugcugauuguuuccuuugcuuuugcagcacagaaguuucuuuuuucuuuuuuucuuuuuuuuuugagauggagucucccucuuucgcccaggcuggagugcaguggugcaaucuuggcucacugcaaacuccgccucccggguucacgccauucuccugccucagccucccgaguagcugggacuacaggcacccgccaccaugccuggcuaauuuuuuuguauuuuucauagagacgggguuuuaccauguuagccaggauggucuugauccuccugaccucgugauccacccgccucggccucccaaagugcugggauuacaggcgugagccaccgcgccuggccagaaguuucuaaguuugauucaguuccauuugucuauucuugcuuuuguugccuuuagcaguuuacuuuuaaagcucagauaugucugauccucagaagaguaaaggcuacauuaaaaaaguacauucuauuguuuagguaaaaaagucuugguaguacuccaggggacaagaaauaugucauuugguagccaaaaaaugauagcuccugguucccugugaaacacccugguuuuacuuugauguuucuuaauuaucauugaguuuaaaagcauucuagguguuccguaugauaagagacacacuucaugcccugaaggguggaauuaaguacccagaaauaauuguuuuugguuuuauaaauaccucaaaaggaaagggggaagaaaaccauuauugagaaaauuugucuuccuagacaucccgucaugacuagaaaaacaccaacagagauaaaacuaaaaauuauuguaugaucuccaaacccaaaauaacugguccagugaaguuuuauauaaauaaccauguucaaaucugguauagcauauuuggaaacaugagcuugcuuuacaguuuaccuggcaaauuuuguaauuaaaauaccucaucguugaauuagagaaacuugagagcaaaugaaagguaacuuaauuuagaggcagcuauauugcuucauuguugaauuaaaagaaauauucauucccuuacaguucuaauuuucucuuuauucaugcuaauaaaggcugauauuuauuuucaucuaaguaauugcuuuucuaguauucugauggaccauucuucacugcauugucuguuucuggccuuuugccaguuauuuuagacaaaaguuucauuauuuagucagcaucaacuauuaauuagauauguaacuguucaaauuuauacaaagcgagugugcauuuuuucaucauaaguguuuacguacauaaagaguaauuauccaauuuaaaaugauaugauguauuuuaaggauaauuuuuuuuuucccuaggggaaacaauucugugaaaauucuguagaggauuuaaaaucacuucuuuuuuuuuuuuuuuuuuuuuuuuuauuugagacagagucucacucuguugcccaggcuggugugcaguggcacaaugucggcucacugcaaccuccgccggccgauuucaagugauucuccugccuuagccucccgaguagcugggauuacaggugccugccaacccgcccggcuaauuuuguuuuguauguuuagacgggguuucaccacgcuggacaggcugaucucgaacuccugaccucuggugaucugcccaccucaaccucccaaagugcugggauuacaugcgugagccacugugccuggccugaaaucacuucuaaaaauuguuacaguaaaaauuuuauguuuaccagacguaaauuuugguuacauauacauuuaucccaauugacacauuuuauucauacugaauaaaacauuaauguuacuuuucuauuuuuuaugauguauuuugacauguguuuagauguauguuuuauauguauggacugacaaaaucauauaugcuauuauuuggcaucuuaugugguuggaggucauaaagaauguaaguaacugaaacaauacauuugcucaaagaaaggccacucaauucucugcccugugguaucuaaucucccuguaauacacauuucaccaucuaggauuggagaaguucauucuaucaacacgaaugcuaacagguaggcuucuggaaguacaaugugauaguucagaucuuucucugauucaaaauggugauuuaaaagaaaacauacuuggcugaauuggcuuuugauagacuaaaacauuaauuugccuuaaugugcauuaacgcuaaaggauacuaaaaaacaaaaauuuuuuuaaacccagaaauucuaccaggucuggagccauauuuuucacccaguaaaugucccuuguaagaaauauauuuacacgaagggcugggugcaguggugcaugccuguagucccaacuauuugggaggcugaggcaggagaaucauuuugagucuagaaguacaaguccagccugggcaagauagugagauccugucucuaaaaaaauaaauaagaaauauuuucgcuucaagaauuuauuuauaucugugcauuggucuuugaagcuucccuuuugucuguaaacagcaaccagucgcugacaugacauauuuguguacaaaggacagugauaauuagauaugcuggaauuugugugugugugugugugugugugugagagagagagagagugugugugaagaaauauggaugagaaacugguaguuugcugcuuccuuaugggggaggguagaaggcagaauagaagguagaauaguauaguugacugaaauuuuuuuggaggggaagggcaggguuuaccauuaauguacuuucauuuugcaauagauaauacuugauacauuguuuuuugugguuuuuaacauauauuuauggauggcauggaugaauguugagugucuuacuuacuguuuuacuaguaugacugucaaauugcauuccugaaguacggauaugcuaagguaauaaaucugcuagcagccagcaaguaaauguuuacuuacuauauauggaauaacuugcugcagauuuccaugaaacaacauuagacaauuguguacugauuugguaaaaauaaaaaagauguggccgggugugguggcucacgccuguaaucccagcacuuugggaggccgaggcaggcagaucauggggucaggagaucgagaccauccuggcuaacauggugaaaccccgucucuacuuaaaaaaaaaaaaaaauacaagaaaucagccgggcguggucgcgggcgccuguagucccagcuacgugggaggcugaggcaggagaauggcgugaacccgggagguggagguugcagugagccgagauugcgccgcugcacuccagccugggcgacagagcgagacuccgucucaaaaaacaaaaaaaagaugcuuuuaaaaauuguuagauuuugauguucaagcuguacauuuggcguaggcaugggacuucuaauugccuucauuugccaaaguauaacaaccuuuuuuuauuuuagaauacaacaauuuaacaagcguuugaauuucuaugauguaugugauacucuauuaggugccauagguauuacagaugaaguagaagcugucauccuaagagagagcacaaaauucacugguaaagggauauucauuaucuuaaaagaauuaaccauaguccauggucuuccucuggcauaugaagccuuaggaaccuaauuuuguuaacauaccauugagaaagaucaccuuuucauggaugcauucaguuuguucaccagcugaggaguggagaucacacacacacacacacacgccaugugaacauguauguaucuguauaccauaugagguggaauacucauguacucauauugaaaugauuaguacgucuucuccuuggcaggcaaauuuaaauggggagucagauuauaauccaaauguuguucaucucuuuaugggguuggaauuucagcagagaauauuaagggugggaugggggccugagggucuucuccuccuauagagaaauucuuuccagugaccugugauguucacggugcacacuuuggacuccuuuccugggcugugcuuguaagaguauugacaguguuuaccccucuugcuuuuuuucugcuaccauugcccuugugauagacaaauuucucuuucuuuagauacguuaauauucucaagcagauauuaggcaacuguccugggagcuaguuguuaaggugacuuugccucucuuugguuuuuuauggaucuaaugcagauggcagucucauuucacucguuucaaauuuucuugggggauaccucaugcuacugccuuacacauaacauguuuuguauacggauaaguggaaaugguggaaaaaaagauauauauugcaagaaaaaaaagacuuagaaacuaguuauuaaauaccugguagagaaaguuucuuuuguuaaaugccuuauagagaaauaucuugaucugaaauugacuuuauauacagguggaauaaacugcucuagaaaucaagagggaguauguguauuuaaucucuguaucuguuuucugugucucuuuuccauccuaaaauaaggguuaagauuagguuuuaaagauucuuaauaauucuguacauugugugaugcccaccaucuauuugugguauuauuuuauggaccagaaaguuaaagcuguaccuuuaauuucacauugguuaauucuagcagcuucccaauuagugucauuuuuuuaccuuucaaucuuuccuuccuuuuaaaacacuugaacaucaagaauaaucugcuaugggaagagaaaguagaaaggaaagacacugaacaaacauccacuugauguuaggcagcaggacagaaguuggugguccagggagcagccugccggccugguguccuuaggcuccagucugacuuuagaagucccaugucuaugaacuuacauccauaaguucaggcgacauguaaguuuccgagcagucauaguacaagcauguaaugugagaauuuuauuauuuaaacccgcagagcuuaaugaacuccaaauuuuauuuuauuuuauuuuuuugagacagagucucccucuauugcucaggcuagagugcaguggcucagucuuggcucacugcaaccucugucucccagguucaagcaguucuccugccucacccucccgaguagcugggauuacagauaugcacuaccacguccagcuaauuuuuuguaguuuuaguacagacaggguuucaccauguuggccaggcuggucuugaacuccugaccucaagagauugacccaucucagccuccuaaaguggugggauugcaggcgcgagccacagcgcccagcugcaaauuuuaaauuugaaaaugugucugaaaugaaaauaaagugaggggagguguuggagagaauggagaaauugcacaggaauuguagaacauggauuaaaauguaauuagaaaguuacguugaaaaucaaagaacuaguuaaaaugagugucauuaugcuuuuuuuuuuuuuuuuugagacaaggucucacucucaucacucaggcuggagugcaguggcaugaucauggcucacugcagccucgaccucccugggcucaggugauccuccaccuuagccuccuaacugggccuacagcugcaugccaccacggccagcuaguuuuuuguagagauggaguuuugccaugcuggccaggcuggucaugaacuccugaccuuaagugauccgccugccugggccucccaaagugcugggauuacaggcgugagccacuguauccugcccagaauacuauuguaucuucuaaguggccuaguacuucuaugcuugccucucuccucccacuacuccuagaagacuauccacagguugaucacuucuuaucucacaaccuuccagugacuucuuaucauaccugcagugaaaucccaacuccuuaccaucacugaaaaggauauguaauguuugugacccagcccaacucugacgccguuuccugccacugcucccucuaauccagccuugcugauuuuccacaggccauagaacuuugcuaagcugguaccuaccucagcccuuugcaugggguuuuucucugccugugagguucuuuuuuuucacacuuuugcagggcuuccucccucauuucacuagagucuccucuggaaugucaguccuuuaaagagaccuuccugccaaccuucccuccugugucccuaucaguguauguuucuuuggucucuuacccugauuuuuuucuucacagcacacugccgcuugaaaguauauuuaauuuuuuuauuuacauguaguuuaucuucccaccaccaugaagccccauaagaacaggguccuuugucuuacuaauucugcauuuccauuaccuguagcaacacucaacaaauauuuauugaaugaaugaauggaugaauaucucacauaugauuguccuugugaauaugaacggauucuuuaucaauaguuaucaaaacuuauuuauuauaaccauugagaguucuuuggcaucugcugcugaacuuuucugaacugcuuaugcuuagcucaguuggaauagugguuuccaggauagauguaaacacuucaagggguaugcagaaaucauccuuuacgauuugggggaaaauauauuagaaauuugauuuaucuuguucaccuauuuuuguguuuuauagugugcaugauauauauauaaggggaacauugugcugucaaaaaaacugagacuggauagagcaugaucuggacaggaugguuaacuuuguuuaaagcaaaauguaucucuguagucaggcuauuuuacagauuuugugcuuuuguauaauaaggcggugugacugcgggugagaguguaaaaucuguucccacucuucaaaagaucacacaucucauguugaguugaaagugaaauauuauauaugagauucagcaugaauguguauaucuauauguuuuauuuaauauucauccucugguggaauuuacaagucucuucaguucaggguauaccuguuuugggguccuuuguaccugugcuaacauaugugugagaaguaugugagcucuuucagugacugaaaaaauuauuacuugauuggucuguuuuggcgugaucugggcuuuugauuaaucuuugaauaacuuuuuccuucauuuuuaauaguucaggcuuguuaaugaugcuucacuggcuucuuuggguaucugugacuuaaguuuuuaaaaacaguuuuauugagaaauaauuugcauaccauagaauucauugcuaugaaaaguuuuacaguaccauuuuauaauuacaugugauuuucaagacacaggaaaauaaagaaaugguaugcuuagaauuuggaagaaagucuaguuauguuuucauuuuauuuuuauuuuuuugagacagggucucacccugucacccaggcuggaguguaguggcaugaucauggcucacugcagccuugaccugcugggcuccagcaauccuacugccucagccuccugaguagcugggacuacacgcaugagccaucaugccuggguaaguuuuuuuuuuuguagagacaaggucucacuaugcugcccaggcuggucucaaacuccugggaucaagcaauccuccugccuuggccucccaaagugcugggauuauaggcaugagccacugcacccagccgcuguacugauuuuaaauacuuuuuaagugaaaugagauuuuauaacauuugaagaacuuaaaauguuugacaggauuaauaaauuugaaugaagcauugaaauaauuacuauacuaaugaauacacuaaggaaauuugaaaaccacaaauaagcaguuacaaauaaguauuauuauuuauaaaauagucacccuagaagaugaugcagugauggugucauagcuuaaaaugcucuuggaggucuucauuuuacauugauuucagacagccugugucuaguucuucuaagcgucuuuggugcuagcaaaucuuccaugacauaagcuuugauuuucugaaucuucaaaagucuuuugguguuaacuuacuugguggguguuaaaacaagauaauucuauuuuugauuuuuuuuuuuauuuacuuuuuagaagcagagucucccucugucacccugaccggagugcagugaugcaauaauaacucacugcagccuugaacucuuggacuuaagcgaucccccuaccucagcuuccugagguauuguucaggcuagucuccaacuccuggacucaagugauccuuccaccuucaccuuccacagugguggaauuacaggcaugggcuaccacccccagccuauuuuugauuuagaaaaaagacaacauugauuuuucacauauaguuuacaaguuggcccuagaaguauuuacagaugaugaguucuagaaauauuuugagcaaugguagcauuguuggaagaaguacagugucuuaagcugacaauuuugacauugauucuuuccucccacuaguuauggagcuucuuuaaaucuauaaaaagccauuucacuauauaagaauugguaucauauuuugugcacuuauagauucaugcguaccauacaugcaugcuuauaaauaucauuccacugaccaaaguguguuauuauuuuguagcccuuuguagccagcucuauguuuuaagugccugauaaauucuacuguagagugaauuuuuucuauucuaaguaaaauuuuggagccugagaaggcuucuaaaggcaaaggauaucaagaaaaguuuuaacuaagaugugagacugcaugagugcuucaugauacgaaaugguuuuauauauaggucuuagauaagaaauuagagagguugacagauaaccuaccuagucuguuuuuuuaguugagcaaaucuguguguggggggcauaaacaaauacuagugacauuagaaaucagaaagcuagugaaguacaaauuugugcacauaacacuguuugugggacagccuuauucauacuggucuuugacaaaagucaaaggaaaaaguaguugccaaagaggaauaugacuuuuuuuuuuguacuuuaggguuuguuuuugaauuucagcaaguuaugguuugagguaauacuaaucaguuuuuuuauguugacuuuuugguuaucaauuaagaaaagcauuagugcuuuggaaaaaucuguguuguugaacuucuuccaauuuguauacaaccucuucuccacagcguaaaaugcaaauuuugcauggggucaggugcgguggcucacgccuauagucccagcacuuugggaggcagaggcgaguaggucacuugaagucaggaguucgggaccagccuggccaacauggugaaaccccaucucuacuaaaaauacaaaaauuagucgggcgugguggcaugcgccuguaaucucagcuacuuugggggcugaggcaggagacuugcuugaacuugggagguggagguugcagcgagccgagauugcgccacuguacuccagccugggcgacagagggagacuccaucucaaaaaaaaaaaaaaaaaaaaaaaaucuuuugcauggaaucugcagaucuaggaaucauuuuauuguuaaaaauauaacuagcaauuuugaaaauucagucugcuuugugaagucagacucuagaaaauuuauagauuuuuuugguggggggaaugagaguucgggaaauaaaaagaaaugaaauaaauuugacuccaggaaagcuaauuuuacauuuguuucuucauuccucccuggggcucucugaaacucuggaauuuucucauuuaaaagaaagcuagaacaaccuguguuggacauacagguugagccucugguauuugaaaugcuugggaccaaaauucagauuuauucagauuuuggaauauuuacauuuacauaaugggguaucucagggacaggaccuaagucuaaacaugaaauucauuaauuuuucuuauauauuuuauacacauagccuggaaguaauuuuguauauuuuuacauuuuaugccugaauuaaaguuuguguacguggacaucagaaagcaauggugucagguguggaauuuuccacuuaggacauguugguacucaaaaagugugggauuuuagagcauuuuaugauuuuuggauuuaggaugcucagccuguaaacuugagggucaaacuuuucuuguguuaguugaaaucuccugggugcuuucuuuuaaccaaaucccaaagucuuuuuuauaacuaauaugcuagauuuccuacauuguuuuaugaagguagagaggguccuuagcaggccuuguuuucagguguaaaguucugcuggaccaaaaccugagggcguaauuaacagugucuuuggagggacuguuugugcugucuucauggaccauuuggcucauaagaugggauuugguucauaauucauugucauguacuguaacuccugugggaguauaacgucuagcuguuuugcauuggauagguucugaaugcuuuaucuuguuccaggguggauuauuauacucaagaaugcacuuaauuacaagcuuuauguuuccagcacccauucacaauaccuccucuucacuacaccugacuucaucgauggaauuucauuuguagauugacuugggagauggaagcugucagacuugaagucugccuccuuuuuuuggugccuucucuuuacuuugauauuuugaaccuuucuaacuuaaaauuuguuuuuagguuaauuuucucagcaaaagaaauuuauguuugauaagauacuaagggaaaaggcagcauuuauuaauauuggauguuuccuaauuagaauaucuuaagaguuugaauuuuguuguguuuucauaagcuacugcaucauagguuucauugucuuugaacagagacuuagaaaagggaugcuuuggaauauuucuuguuucagucuuuugagauugaacacacagguuucuuacaggauuuguuuuuuauguauuuauguaaccugucucuccaguuuccugaauucaugcuucauaugagcuuaaucauacuuuauuuuaaauaaucaacuguuuacacaucuaccgcacaugcugcuccguagauucucagguguaucuuuauggucuuuucauuuuucugucuuuaucaaggaauaaaugauccuaacuggaucaugauuuacuuguggauuuauucaauaguuuuguguuuuaguuuuuaaagccuugcucaaugguuaugguuuggggauaucuugauauaucucggacaagcuuuuaauugucaaaauuaaguuauacuaccuuguauauuuuagucuuagaauuuaauguucuauuccugauugaaaaaccugugacuagcacuucaaaauuuccuaaacguguuuggucaauucuuuuuuccuuuuuaaccaaaugaauuuuauaaagucaacuuccuuaauuuguaauguaggcucagugaaagcuucaggguuguugcccgccgcccccccccccccgccccgagaaaucuucagagagauguuuaaacaaaucaaaauauacuuaaaguguaaaaaagguaauuugauguggcaaguuuuaaauaaauaaaaaaaauaaacgcacacacuccauaaccuuucuuugagucuugguuuaaguucucugucauauagugccaaaaacuuuguuuugagcugcguguguguugaaacauguaugccuguccuagugucauaacuaauuauaucucuuauaugcuuacuucuaguaauuggaaaguagaccuaccgcagcauacaucuucacauuuaguuuuaucuugaggaccugcuacagagaucauuuucuaccaugcagcaacuugacauugugaacagauauuacuauuuuaaauauauuaucuacuuuguguuuugcagaaauaguguacuuucagggaaguuaaguuucggguguuuccaaagcacaucugucuuuaccaguaauuauacacuaauacugccuuugcaguuuugacugagauauuucaucugugaauuggaaauugauggccuagugcugugauagcaaaauuuuauaggauuucuuuuuacucaaaguuuucaaaagauuguggcugauggaaaaccugcuggugcuuuggucacuuacucuucauggauuggucuaaaauaauuuggggcuucuuuuguaaaaguguauuguagaauuuucacaaacuuagaaauccugucuuagauaugcuuaugacuggggccgcaaacuguuucucauaugcaccagcuuguaugaaaauaugugguccuuguccaugccugcugaaagagaaacccuaccagucuucaguuucugagcugcagccuugucgaaauuaaagucuuaggacugggagcaguuaaugcuggugauagauugugguauuuagcgcugugcuguguugcgugguggacuuacacgauucuagucagaacuugggaaagaauauaccacagaauuggugacaaauauuuuucaaagagaaauacgaugacuuuucuuauuaaugagcagaccuuuugggcuuugcuuaaggaaauagugaaaagauuguacaguucuguuauugauaaugguuuagaauuuaacacugaaaaugcuggauuuucuuuccucuuauuaaguuaauguauuacuuugaagcaucuuuucuuuuuuuacaguuagaaauucaccaaaacuauauuucaaacguagcucuuuuuaauuuuauacuaaauuaauuuuuuuuuuuuuuuuugagacggugucucgcucugucucccacguuggagugcaguggcgcgaucuggggucagugcaagcuccgucuccuggguucacgccauucuccugcgucagccuccggacugcaggugcccgccaccgcggccagcuaauuuuuuuguauuuuuaguagagacgggguuucaccguguuagccaggauggucucaaucuccugaccuccugauccgcccgucucggccucccaaagugcugggauuacaggcgugagccaccgcgcccgggccacuaaauuaguuuuuauaaauucugcauuguuucugucauaugguaacuuaaguaugcagaggcauugaacuugaacauuuuguguucuggaacgugggguuuggauucuugguauaauuuuccuauuuuauuuuuauuuuauuuugagacggagucuugcuuugucgcccaggcuggagugcagaggugcgaucucggcucacugcaagcuccgccucucaaguucacgccauucuccugccucggccucccaaguagcugggacuacaggcccacgccgcuacacccggcuaauuuuuuguauuuuuaguagagaugggguuucacuguguuagccaggauggucucgaucuccugaccuugugauccgcccgccuuggccucccaaauugcugggauuacaggugugagccaccgcgcccggccaauuuuccuauuuugaaaacccaacuaccgugguuucuuucuaaugcguauauuaugacuuguagcauuugaaaagcuccauggucuaggccaugugacuucugaggacuguaacuguaaaaaagcugguguugaauaauuaaaaacucccuccauuuuaaaaaaaugcccauuucucuuagaauuuuuauggugucagucaaauuaaugcagguauguuugguuuuaagaauaacaugauagaaauccgaauuuacacugauaggcugccuaagagaaaguuauuucaaaacauggggcauccuggcagugccugggaagguuggcccccagcccgacugauaggaacuuccuacucaucaguucgcugugaaguacugacagguggaggggguuuaggcuucuuuggguucugaaccuggugaugcuacuaccuacacaguguuuggaaaucuugggcgauguuuuguuugucacaaaugacucaacuggggggcugccuccugcuauuuagugggucagggacacugcagcaucaggauugcagaacaauuuacauacagugaugaguuguucugccccaaauaccaauaauaccuuucccagaaaugacuggauaguuauugauauaaaaaaaugaaaaauggcugggugcgguggcgcaugccuguaaucccagcacuuuggccaaggcagguggaucaccugagguaaggaguccgagaccagccuggccaacauggugaaaacccgucucuacuaaaaauacaaaaauuagccgggcgugguggcgggugccuguagucccagcuacucgggaggcugaggcaggaagaaucgcuugaaccugguaggcggagguugcagugagccgagaucucgccacugcacuccagccugggugacagagcgagacuccgucucaaaaaaaaaaaaaaaaaaaaaagaaaagaaaaauauucguaaaaauacuacucuugcuccccaucccuagaauuaccaccugacaucuuuuuuuuuuaaaggaauguugauuuuuuuuaagguguguacuugauugaacacugaauucuacuucuuaacguuuuuaaguaaacaugauuuguaaaggcauauggauauuuuaugcaguugguauauuaauaguauuuagucguaagcccccaacucaaacccagauauacccguuuuugcaaacacccaucagauuuugugucaguguuugguaaacuagcacuuaaaauguguguugaaacuccugucuguaauuuuuuuuuguaacguaaaaaaaaaaacuuaugagaaauugcuaaacucuuauaagauuuauuauuauuauuuuuguagagauggugacucacuauguugcccaggcuggucuugaacuccuagccuugagcuauccucgugcuucguaggugugagcaaccgugucuggccaaaagauuuuuaaaugaacaacaacaacaacaaaaaaccuaagaguaaaaaccagaauuugauaaaaacagauauuucacauacucguugcauccucauggcauuaucaguucuggcauuuugacuuggaagaaaaauucuaacaugaauuucugcuugaauucuaacaugaauucugcuuguuuucaaauacuauucaauugggaguaacuguuugaugaaaagcguaguaccuaaaccucuucuccuuccacacacauuuguagucuuacaugguaaaccuaaaguagcucagaaacauuuacuaaaacccauuuacuugguaauagauuuuucauuuauaaaaaaggagcuuaagaauauguaggcugggcaugguggcucacgccuguaaucccaguacuucaggaggccaaggcggguggaucacuugaggucaggaguuggagaccagccuggccaacauggcaaaacccugucucuacuaaaaauacagaaauuagcugggugugguagugugcaccuguaaucccagcuacucugaggcugaggcaguggaggcugaggcuugagcccgggaggcggagcuugcaguaagcugagauuuuugccacugcacuccagccuaggcgacagagcaagacuccgucucacacacaaaaaaggaauguaucuuaguguacaccuuucgaacgaccauaaaugacaucucaguacuaucuaguacaaacagaauuauaacccugcccuuuuuaaagaguauuggcuuuggaguuguaaagaccugaauuugaauacugauucugcuacugaauaugguagaaucuugggcaaauucaucuaucucuccaucagucaauuaucuaucuaucaaaucuauuuuuaauuauaguaaaaaacagauaagauuuacccucaacuuuuuaaaguguacaguucaguaauguuaaauauauucauauuguuguuucauuaaaaaacuuugaauuuugaaauaaguucaggccuucacuugagguuaugaguuugacuccagccuggccaacauggcgaaacugcgucucuacuaaaaauacaaaaauuaguugggugugguggugcacaccuguaaucccagcuacuugggaggcugaugcaggagaauugcuugaacccaagagacagagauugcagugagccgagauggcacugcagcaagacugcacagagugaaggagacuccaaaaaacaaaguaaaacaaaacaaaaauaaaauaaguucaggcuuacacaagagucagaaaaaaaaaauacaaugaauuccuauauauccuuuaaccagauuucccaaauguuaauguuugccaugauuguucaguuuuuaaaauggagauaaaauucaccauuuucaaguguauagucacugguuuuuaguauacucacaaggcuguggaaccaucaacacuauuuaguucuagaacgcuuucgucacuccacagagaaacucuauccucaacaguaaauccuccauucucccuccccagcccuuagcaucuuuuacuuuuugacccacuguuuucuauaaaauagguauaauaauauuuaugcuggaguguuucugagaugacauaugugaaaauuccuagcaugguaucuguguaaugcaagugccaaacacccauucguuucuuuuuccuaucacagaaacagaaaguaucauacuuauaucuacaugaacuauuuuggaaauucuaaugccagcaucuuuucuaagugaauuucucuuacuaguuugguaggucaacaguuugcaagauacuaaaaaucauaguggagguucauauguuaaaauaacauaaggcaaagcagcuucaaaacuccaaaaaauaugugcauuaaauaaugucuugcaggccggguguguggcucacgccuguaauaccagcacuuugggaggccgaggcagguggaucaucugaggucaggaguucgagaccagccugaccaaaaguggugaaacccugucucuacuaaaaauagaaaauuagauggacgugguagugcaugccuguaaucccagcuacuugggaggcugaggcaggagaaucacuugaacucgggagguggagguugcaguaagcugagauugugccauugcacuccagccugggcaacaagagugaaacucugucucaaaaaaaaaaaacaaauuugauaauaaugucuugcagacauaggcuucggaaauacaucuuuugcaaugggcagucaucaugcaugcagcucuuuucauggauuaaucuuuuauuuugaaguauuuuaucuuuuuuuucacguuuuaaguguuuaaacauuuucaaacuuuguauuuuugauuuuauaagaaggcauggugaauaccacagugcagugaaaccacucaaggaucauaaggguuccauuguuaacuuaaaugacccacacagaccuuaugcccugguuugauuagcuuuugaugauaugaugguuugauuauggacauacaguuuagccaggauaucuacauuuugaggaauaauuaguuacaguucugauggccucacaacauuuuuacaaauguuuucuaaguauuuauaguguaguggaaguagcauaggcaguguagguauagaaagcgucggaguccugaguuugaaucccaacuaugcugugggaaguuugacaagggacagaauuucuuuaagccuggauuuccucauuuuuaaauauggaggguaauaacugucauugcuuaggguuggaaugagaauucaauaagacauaguuuggguaaggaucagcacagugccugacaaacaaaaacucauuaaaacgguggauaucuuucagauuugcuuauguguuguuuaaagaaaggacucuuuugcccauuaauuugugaccuuuuuaucugccuagaacauugcccaugaggucauuucugcccgugaaguagagaacuacaguguucaaauguggaaucggaagaacaacgaaaauacuaauuacccuagcugagagguuauagugguggaacuggugggauuucagucaaaaaagcugauuuuguuagauacaauauuaucuacaguuaggccuguuuauuguggaguggccaaaauauguuaugguauuuaaagaguagugaagauauuuuccaaucugagugcauacaugugguaacccuucucugaugagcaguuguaggcucauuugacauuagaacugcugaaauaacuaugauugaaauguuuauuuggugucagguuuauaaacauuguacuugguuucuguggcagguaacaagcauaggaauaccaauuuuacccagucccuugaccugguaauucuuuuuugcuuuugguauaucuuaccaucuaaguucuugagucuuagugacaaaacuguauaguguuugucacagaugugcguauuuggaaaggcauacaaccacugcaguauuuuugccaucaugacauuaaaggaaaaacacuugugauagggugaauaaauacuucugagcagaagcaaaggucaagcuuuagagugaacuuuugagugacagcuaguggcuuaagggggagacgccauguuaacuaugggcauucauuaacugcguggauaugaaauggcaguaaguucucuccccuuuuaugccaggggcauuggauucuguaaaagcaaaagggagaggagcguauguggcugccaaaaugagaugguaagaaguuaaaugaucaggacacagagaaauuaaggaauaguaagguuuaguggguaugugauaaacauugcagauaggcucugugguauggaccagaaggcacaaggucuggauuuuuuucuaacccagacucugucacugacugccuguuugaucuuuguaacuucuuugguacuucuuuagaccuccuuaucugaaguuaaagauguaaaacaguaaagauguaaagaguaaguuaaagauggaaaacagguuucaacucuuaucaauauugauagauugguaaaggcuauugagaagagaauccugcagcugugucuugcuugggucauuggaaggaguucugggauuaguuuagcaguuucuggugacugucauggggugguggugggugugugcuugcaggcaugcauguuuguacguagguacaugcaccacaccgcauugguugacuaaucauuuguaaaaauccuuuucaauucagucuauauauuggaaauuacguuuuucuuggcuguaagguugagaggaucuucuaaucagccuuuaauuuuucugacugaaagccaguguacuucuaguuuugggagagaauuacgugcuauagagcuggaugccuaauaggcauauagugauggcgccuaagaaggaaugaaaucguugguccgagagcuagagagugcgcagcgugcuuuagacuugcaugggguucucuucuaaccugcauaucugugugagucaaacauaguagguccuuucagauagguaaucaucuaaugagccacaguuaauuaaauguuuaucauugcuuaauauuugguauagggcauuuuauuucuauucuaggauagcuuucaaaacuaguaauuugggcaguauuuuaguacuacauagaaggaagacugguacaaaaugggugauggcguguaacuuuuaccguauugauacauagcauaauauaaacauggcauuaaaagaugcauagccuuagcaacgagugcuaguuaugauugguugagcaguauugaaagcaacuaagauuacuuucagauauguauauuauauacaaacuguugcagaauuauugcuucacuuuuaaggaaaagaauccuuaaguuucuagugucuuuuaucugagaaaauuauccagaauuguuaacaguuuaauccacuauguuggaaacucuguuagaaacuuuuauguaucagcucuuucugcaaggaggaauuauuaagagcuaacuucuguuagcucaccucuacugacuagugaaauuaguaguuuucuuucacguguguuccuuaagaaacuguauguagcaaccacauuuguggcacacauagaccaauacaauagccuuuuuguauuucuuuguaucuuucucaaguacuauuaauguuguccuuacugugggucaggagucauguuuuacucauguuggaaucacccaaccuagcauaagccacgcauacaauaaguacacuauaaauaauguugaauccauaguugaaauacaauuuuaccuaagagcaacugugagcuaccaggugaagaucaugucuacuuugaagucuaaguuggggaaucugaaaacacuggauuuaccauuaugcaguucauaugugguagugugaugugauucuguggugaucaguuuuuacagugacauccacagaacuaaaacauuugagguaacaacucgcauuucuuuuuuuuaacacggaguuucgcucuuguuguccaggcuggagugcaauggagugcucuuggcucacugcaaccuccgcuucugggguucaagcgauucuccugccucagccucccgaguagcuggaauuauaggcaugcgccaccacacccagcugauuuuguauuuuuucuuuuuaguagagaugggguuucuccauguuggccaggcugaucuugaacuccugaccucaggugauccgcccgccuuggccucccaaagugcugggauugcaggugugagccaccaugccuggccugcuuuguuuuuccuguaaaagucuaucuagaauuaaacugucaguauguauuuguacauggaaaaaaauuccaaagaaacauuuuugguuaaaaauaugugguagguugaaacuuguguacaguguaaauaucgcauuauguaugccuuauuuaaguagaccuaaauaccugguagccugagccaucagacuugcauagcuccaaagggcaguagugaucuuguuaggguuuggcaucugaaugaucugguugccuuuuccuuuuggcguuuuuauaccagguaucauaaaauacagaaagcagagcaaaagugaaagaguagaaacccuuuguuuuuuuuuuuagacagaguuucacucuuguugcccaagcuggagugcaaugguaugaucucggcucacugcaaccuccaccuccuggaaacccugagcuuuuuaaauguugaggcagaguugauaguaauagaaaagcaguagcuuaggagcccuaagaccaggcuaauuugauagcucugaaguuagggcuccucaucuuugaaaugguucaagaauaccugucuuauauaccuucagaggaucacagugugauaacauguuugaaaguacuucagauaauucugagguuuuauuuaucucauucuacaaauauaauuugagaaccuccucuucaccagacaucgacuucgaggcuggagauggaagaacuuggcagucuaccaaggacuucccagucugguagaauuaugguuuucuuucuuuuuucuuuucgggauggagucucgcacugucgcccaggcuggagugcaguggcgcgaccucagcucucugcaaccucugccugcaagguucaagugauucuccugccucagcguccugaguagcugggauuacaggcgccugccaccacgcucggcuaauuuuuguauuuuuaguagagacgggauuucacuauguuggccaggcuggucucgaaugccugaccuggugauccaccugccuuggccucccaaagugcugggauuacaggcaugagccaccaagccuggccagaauuaugguuuucuaagauuauguuucauaguguuucagguuuauauuacugagaucuuuguuguggguccauuuuuuggguucaaaaacaugaaaagauagcauuuugaaaguguuuuguuacuucucuaugcuuauaaaaauuugacucuuagaacuuaccuauguagucccccaccugagauaccaggacaguggggagagaauuuaugaugugguaaauuuuuuuuuuggcagagccaaaauauuguaacauauguugaaccagguguguaaguugaauaccuuuuagacauguaguugucacuguuaauauaaguggccugcuaucacucaaugcuguggacagcccaagggccuuuucugaaucuuuuauaagcaggaaguuuaauuugccuauauauuuuucuuucuuuuuuauuuuuuugagguugguucuucuaccaaaaacugaaaaaaaaaguauuauuagauaauuuuuacuuuaugggauuuguuagucccagucuuuguagcaauuucacuuuaaaauucgugauuagcagaauguccucuucauuucugaugacuuucuguggugaggaggguucacuuagaaccugggacaaaugagaguugguugaguaggaucaaacuuaauaagaaucaaggagacauuaaauauauucuugaacugguuuucuaggauucuuuuuuuuuuuuuucuccugaaaggaagagcugggccaaaguuuuaaaaaucaagacaaacuagagguuucuucacauucauggccauauuauuguuugggauucuauuuaauuuucauauaccccuuuauguuucuaagaauauguuucugauggucuacuuuauauaugcauucguuugacuccagcuauaguaauaauugauuauacccuaaaaaaacgaccucugauucuucauuuaaaucagaacaaauuguuuuugaaagcagcgccaugagaauuaccuugaaugaccauagacuuggcccacaaaggaaaggaaauuaugaagaggaggaagccaugccguuggucuucccaaauccuaaucugggaaccauuagcaggaccgucuugcugugaggcacauucauagcgugagaggcaauuucuaaaacugcuaaaaucaaucccuguaggccuuuagagauuaaacucacuaccucguguuauaaccagaugaaaauaauuauguacugcagccugcugaguggggugaaauagauuucuagugccaggauucuuaacuaggugggaugggugcuguguuuuacugaagacucccugcaguugaaagauuuauccuauuagagcaagucucaaacugguaagucugggaaaaaacaauucaacuuuagacgccaauucuucuaaaaccucuuuaacuuaaaucuguuuuucuuggcaagagaguuaaaccucauauuuaaaauaggauaccagaacugugccuugcacacaauaguuuucugcuagauagauauuaaguacacgauuuuuuauuuuuucugaaaugggagucuugcucuguugcccaggcuggagugcaguggcgcuaucucugcucacugcaaccuccgccucccagguucaagugauucuccuugccucagucucccaaguagcugggacuaaaggcaugugccaccaugccuggcuaauuuuuuuguauuuuuaguagggacaggguuucaccauguuggucaggcuggccucgaacuccugaccucaaaugaucugccugccucggccucccaaagugcugggauuacaggcaugagccaccaugccuggccaaguacacaauuuuuauaaccacaaaugcagugagguuuccuucucuaucaaauaaggauaauaaugguaccuaacucaugggguuguaguggugagaauuagaugaguuuacuacauguaaaaugauuauaaacauacuuaacaaagaaaaaucaaugcuauugauugaagaucaaucaguuguuaaaguauuaaacuauuuugacaugcagaaaagacgaauaauguuugcuauuauaugaaguugcuguucuuaacaucucaucuguaugaauuguuucucuauuuguguggaaggacaguguugauauuugcacaacacucuguaacucaguucuucuuuugaacaauuugugauacuagaggaaugaagccacuauaagugaaugaaacucgcugacuagacuuuucuuaaguacccguggauauccaugaccgacuggaucccagugaacacugaauucuaugaaagaauaguaacuagucauacacaggggagacugcugaagauguauuacccuuuguagaauuauuaacaucucacuuaaaaaaaaaagcaaaacuaauaugcggagaugggggaaucuguuuucauacugcacuaucucuuaauccauuuauuuaaaaacucuuuguugagugcuuacuauauauaggacagacauuauacuagacucuggggauucagugauagagaaaaaagacuaaaaaucacuuacuuguagggaguucacaaaugggugaggagaccgguauuauuagauaaucaggcaaaaauguaaaaugcuaauuguggaaggcaaacauuggcuucaagaugcaugucuccugaguacucuaaggaaguagcauuguuuucuucuuucuacagaagagugacugggcauagagaagguaguggauuuagcuauggucaggcagcugguaauagcaaggucugacuuauagucugacucuaagccuggugcauuuuuugcuuuucugcaacugucugucauugcuaccaacacagggaaaggaggaguauuaaguggcuacaguuuucaaaaguauugaucuguuuuuggaguguuugaaauaaaugaacauugaccccaacaaguggauuugggguuugcuuccaaaaaucuguaacacugaauuuuuuauuaguauaguuaagaguagaaauuaaauacuacaaauaucagaauuauuuugcuuaagggauuuuuuuuuugacuggccagugauggucaaaguuuuuuugagcuuugagaccacucuucauuuuucagauagaauauuacucagaauccaaaaauacaaagcagugaccaccaacuggaguuuguggggucagagaagauuucucugaaggguuguuugagcugagaucugaaggaugcagagaaauuaacuagguugucugagggcaagguagagggugcugaguauugcaaaaggacugaaggccugagauuagagagagcuugcuugggacauuggagguguggacaggccauuguaauugguuccgagagaaccuaguagaguaaugcuggugagcugguaucagacugaagggaaggaaggggcuaggaggccauguuaaggaccaagaguuacuacucuaaaugaaaugaggagguuuuaagcaggguuugaguucacaugauuuucuugaagggcuugcuuagccacccgucauucccuuuggaguggucuuccuucuggagucagggacaccauuugucuuaagugcaguaguaauaauuccuuauggcaaguggccaaauaaccagcaauucccagcaugugaggcccccauaaugggccugcaaggacaguaacacuugaaaaacaucagagagaaaaaaaaauugcucuuugcccuuagugaaguaaggcuaaaggaaccauaaaggaauauagucaaccauuacugcucugaggcuaaugaccucgaagcucuuggcuucccaagcuaguuuuuuuucucuuccuucuuggcauuucauugcuugagaaaacuguuccaggaaauggaaaaagaauggaguucagacucaaagugggucuuuacuuuuugacgauccugguaaaaugcuuacagggacagaagguugaaauugucaagaagaguguuuuuggauuuguuaaucuugguccucuuugaaggcagagugcuucuaagagaagaucuuauucaucgucugaugaauaggucaguugucacuugggaggagggagcgaaauuggugguggcaagagaaggguggauuuguaggaagcauaucacuuuccugaggguuuuguucuaauucuucuccagauacaaauaaacgcaacauugggugaauugauuuacuucuguaagacugauuccuggacuguaauaagaaggaauuuggguagggcgggggggcuuacaccuguaaucccagcacuuugggaggucaaggcaggcggaucaccaggucaagagauugagacuauccuggccaacauggugaaaccucgucucuacuaaaaauagaaaaauuagcugguuaugguggugcgugccuguagucccagcuacucggcaggcugaggcaggagaaucgcuugaacccagugggcggggguugcaguaagccgagaucgcgccacugcacuccggccuggugacagagcgagacuccaucucaaaaaaagaaaaaaaaaaggaauuuggauucagggacuuuucucagguuuuguucagcucuuaccacuuuguucuccuucuaccucuaaaugcuauauggaaaaauauguauuuugggaauuaacgugcuguauguuuugucuugaggauuucacagacccuugagagaauauucuguguuuauuauagaacuuggguucggauucguugauucacuuguuuuacagucaggacacgagugggguggaggucuucagaaauuaaugucaucuauugccuacacugaugacaugauaguaagcagaucaagucuuguagcuauguucuugaaaggaacucuucuaggccucuaaaacugggcaaaacauauuguguucucuguucuguuucacagauugccugguuuucucuggaauucugugcuucauggcuucuuuucccuugauaacaugacacaugacugaugacgucaaagaaccuucuagauuuucucuucuacugguauuuaacuacauguaauaguuucauauuuuuccuuugaagacuaccuuguaguuuuaauaagggcgcaugaaugaaaccuacuaaauggaccguugaaauauccuacauccaggaagcugcauugcaguauuuuacucauagccagcuggaauucuaauagauuggcuugcugauuguccuauuaguuuuuguuuuguuuugcuugaggauucaacuuuucuggcuuucuuuaacuucauaguuauggcuggucuguaaaccuguagauaaggucaaaaaauuauggguaaacucuucaaaguuuccuagaucuugguugauaggagugcaaaucuaauagccugugcauguuauaaccauugccauuauuugcucaguggaguaaaacagaaaagcauuagggagagucucuauggagcuugaugcaauuggugugacauugucuaagaaaaguugguggcuugaggaaccauaacccaggagcacuugauugaguuuuuaaaacacacaguagauuaaggacagaagugugucgaguucaaccaccaaaucuguucauauggguaucuuauaacucuuggaacuugaauacuuccuaugcugacuccagguuuaauuucauucuaaccuugugaugcuguuaauaaccaacauugcaccacccccaaaaagcccaaaaaacaaacaagaaaaccucucacugaaaaaccauuauuuugaauuugacaugagagucaacgcauuauuugccauuuuucucauaaaaguuagcugcaaguucuguuuaagaaauuuuaaauaaguaaaugucacacaagugaauacagauauauuccaguucuuugaauauacgugaacucuuuacuuauugguugaaugccaagaucaaggugaaugaaaauggucauugaagcucauccaucuuuuagacauuuggcacuucauugugcaaaugugcacauugauaauuuuggcuuaaauguuuggcauuuuauuuggaaaucuguuagccccuuugaagucuuuuaauuugggaguggagguagauuagacuggaauaauaauaaaguaggcucugcaaauaauugcaaauacacagauuauuucuuuuuuguagguugccaacagauuuuauauauuggaccuugacacugauuguuuuagguugucuaacuugucaggaaguacaguuucuguuacgaggaaauaaugacguuuucguugagaggaugaaacauuuuccacgaccaugaaucuguuacuggcuucauucagccagcugccaguggaauccaauuucuagaaggcagaagcagugccauucacccuugcuauucuuucauuccucaaauuuuaagucuuucagccuccaagaauccuuaggguauuccucugccagguuaaaugugugaauuacagaguaaagaguaaguugaagauuucuuccauuuccugcucucaaauaauaauuuuucauguuuuucuuuuuucuguuucccuuuggugaucuacuuucagaaucugagucacuaaaugaguuuuaucaaaggagaaaaauguacuuagauacuuagaaauggaaacaagauuuguaaguuggcaaucaccuugaaugaaaauacaguuggccuucuguauccaugguuucugcgcccgcagauucaaccaaccguggaucaaaaauaaugcgaaaaaauccagaaaauguuacaucguugcugauguuucaguauagaauauuuucuugucauuacugccuacacaguauaguauaucaaauauuuacguagcauuuacauuguauuaguaaucuagggaugauuucaaguauaagaggauguguguagguuauaugcaaaugcuacaccaauuuuuaagggauuugagcguucgaagauuuugcuauccucagagggaccugcaaccauuccguaccacccugauacugagggacagcuauacuaggugaauacugccuugccuuagccaagcugauaacuguguauguuauagagauaauugcccuccaaugcaguuuuguuuuuuguuuauaccauguuggaaaaccguuagauauuuuauugaaauauaauuguguggaguuuuugaaagaaaauauggaauauguuguuucaaaagcuuuucacauagauuguaaauuucuuuacagaccuucuaggcuuuucacagauauaagcauuuauagcagaaauguagugaauauuuuuauacauagucucuaaaacuuaaguaaggcccauucuacaaaugauuggaguagaaauaggcauuaaaaugugguggauucaugcacaaguaggugguuuguguccuauagugugaauauaguguuuucuauuuucuuuaggggggcauuucuguuccccuggggaaauaaacuuccuauuuauuuuucuuaaguauuuuuaagcuugguuacuuauuuuuuuaaguaaucccugccacuguuuauauguagaacccaaguagcauuuguaguugaauuuuguacauuaaaaauauuuugaucagcaaauauuuaacaagugccuacugugcguuaagauguuuguagaauugccguuuuguuugugaauguuagcacugggcauagaucuaaauccuccucuuugcaaacaccccugagaauaggaacuaaggugagaauguguuuuggccuauaucguguuuucuagucauuucuauguauuuuauuagaaaaauauuuuuaaaaaauguuuuggguuagggaaccaacccacuuguccaacuugugaaagucugcggaacaccaccaccaucaaaaaagacaacauauucggaucaggaauguaaucacccagucaccuaauaaaaagagugcuugaguaugcauauggaacaaaaaagcaaaaccauucauuugguaaagggugaguaggggccaggagacagcccuacccugaagauagaaugcuuuaaaaacauguugccauuaauauuuaagacagaaagcguuuugagcccgcuccucucuucuacccuuccucagcauucauguuguaguuugcucccuaaugcucacaaguccgugccagacggaaauucgcagaggccgcugcagucccgcagaggccacucaggggagggacgcgggcggaacagucgcgcucaguccucccaggccgccccaggccccagguccccuggugccucgugccggcuccuggcucgccucccuucugcucugcccagcccaccccgccgccccccugcucacacaugcggccucucccccgcgccccagccucuggagucgcuucggggccaucuagucauacgcuguccaucagauguguuuacuuuuuuccugacagccgacacaucuggagcacauauucagguuauuccagugccacuagacacauuccacaagaucauuucagcgguuguuauggcgaucuuccucccuccagugauuuucaaguugcaugacagaaauagcuggagcuaaccagggggacaaaagucaacgggaucaggaagggcuucuuucacagaaugaacuaauuagugacccugcuuucuucacagggcaaugagcauaugguuuaauaaagugagucugugacacuuuuuuuuucucuguaggcaaagcugucacuggcugaaaacuuuccuguuuuuacuggugggaccguagucugcugucuuucaacagaguuuacuucacaaguagaaaauguuugcuccugagaguuaagcuucagaacguauucuuggcuucauacuaccuaacuauagcagguccuguaacuuaaagagacaguauuaauuuuauauucauuucaugggaaggguuuaugcuuacucaagacuaagcauuuucaguuaggguuuuguaaguauuaugaauugauaccuggaaguucagguaaauauaauguguuguuugcugugguuuuucuauaaaauauaaucaguauuucucacuggauuaguuacaaauuuauuugaaccugugauuuuuuuuugggcacaguuauagaauauuuugguauuaaaagauuugauuaagcuacuccauuuuuaucacauuuuaaguagcaugcagaugucugguuaugucugucaauuuuuuuccugagguacuuuuuacauuuuguguaggauuuuggaugacuuuauagugugaacauaucauugcagacauggaaauuuagaccugagaucauuuaguguuaguaguagaaauacugcuuucaguuuauaauggauauauaagguaauucuauaaagcacugccaucuuugaucacuuuaugaagaauacagacaugccucaauaaauguuuuuuggaugaaugggcauaucauauggauucaaacaaaauacauguugccauuaaucaugagucugagauuuauaaauuauaggggcccauuuucuuuuuuguuuuuguauuccuguacuguaauucagucuugaaaaauguagccagcuauacauguuucacacuucuucccauauguaccaugauacucuuuuacacacgugugcacauagaaucucuuaaucuccuuuucuuguucuuucaccaguacucacaaauuccacuccuuugcacgcaccccauuuuuagguugagacccaaugcacuuaagucaccaugaacaacaaaguuuauaguuuuccuuuuugaucgaauuacucauguguugacugaguucuccggauucuaggaauaugacaaugagugacaaguaggagaaucagagcuggacucacccaagcaauugucuucaucuuucuccaucaguacaauaccucuuuccuccacucucagucaaauuccuguucagugggucccacugaggcuggucgcagcugcucuggaguaccugcucucaggaagacuagaagaacacugaaaggucacauaauuacaugugaauuuaauucacagagaccugcuugucgcuuuuccauguguuucuccuaguuacacauuauuaacuguggugccuuguagggcuucaauuacuugggcaaauauguaucgugcagagacugagcacaaguuagaaugcugagagugguuauaaaauuauguuuuccucuccagauguaacuuuacaguaauuaaaccuaaugcaauguaagcauuauagucagugcugugguagcuaucuccaagucuaauugguaacaucgcuuaaaucauagcacuuauugcugguuaucugggaacuggaauaaaccaaaaaaguuacauacauuaaccuuugguuuuucugcaucaggugaaguggauagcuugucccuucaucaaaaucugucaucuguauuauauggaauuuugauagcauuuagaaaauuuuuuucuuauuuagauagcucuguguauucauccauccaucgaucauccauccauccaucuauccauccaucauuucaucugucuuuaggcuauuuuccauaguuuguugcccuggauuuggagacuugauccagcacagagcuauuguccacuuggguuauugggguuucccuuucuaaguagaugaucaaaauccauggugaaaacaugcuugccuuccauaaagggcuacuuguuuacuauauuucagucauuuuucugccaaaaguaaaaaguaaaagaguccaaaagauagaaaagaaucucaaguuuaaaauuuucuuuugcauuuauuauacccaagaauauggcaagcagcuuaauuuaaucaagcagcaagagugccagacaguuuuccugcaugugagagcuaaauaaauaguggaccuccguauggcagugauaaucgcaacuuagaggguuuucucaguugugaaauguuuguguuaaggaugacuuuuuuguuguuuuuguuacagucugacagcugaagaugcuuuuaaaaccuucuaguuacuuagagcagagcuauauggcacaggcuuggugguucuaaaaggcagguccuauccaucacagaaacagcaagucucuggguuaugggggaagauugagcgggggggagugaaguaaggagaaaggggggcuguuguguccaguuuacauuugucaccagugacuagcuuuuaaaaaauguguuagcugugcauggugguaaguaagauccagcugcaggggauuauggcuuugagugggucggggagcuuggaaugcauucaguuccaucaggggauuugugucccucgucaucagccuuaacauugcuaacacaguaaagauuaggaacagaccagugucaccugcccugaacuuugaaaaacccuggaaccauuaaacaaagggguuugcuaguuuagaaagugucccuucucucuguccaaaguguuuuucaaaugacacaugcaaaaaaaaaauacaguuaugcucaggugaaagacugucugugguugaacuauuuucacaauuuaaugaacaugucacaaucauaauuucuaaugaaaaacaccuuccacaaauaacguucaguuaaugaacauuuuugugaagugauuuccaaaucaaaaugaagagccaguaguuaggagggaauguuucugagcuuuagucucacuccauaggagaaaaagauuuugcuugguuugggugacccuccccuccuccuccuccccaggaagaaaguuaagagaacaccacaaagguuuacuuuuuucagggauuuugaaauucagcauacaugccagcaagcaguuuagaggcaggaagucuuuucuaguagugcagucaugaacugguaaacuagaagcaucuguaaaaauuuagagggaauaucagcuuucucaaagcuccagcccaaguguaaugaggugcaaaugauagcacugcauaacccuuccccaccccaauuguggaaugagauauugagacaaaaauaaagaggagaauagggauuucagaacucuacuguacugaaauaaauuuugauuuucagaugaaauggcuuuugggugacuaaggauagccccaacuuugacgguugaugaguagaaaauaaaugauuuucagcucagcaucucuagguaccaucuuugaaaagugguugcauuugggcugugagugcauaaaugacauaccuccucauucggcugaguaaauuaacgagaauuuuuaguauaaaguaaacuuccacugauucguaucuuuggcaggcaccucucucuuuacagaaagaaaaaaaaaagagggguaagaaaaaagaugugauuuguuugaaggaacacaucuggggugugaucugcuauaucuuaacaccagauggcagguuuaggcugacaacuaaacccaguuuagccuggucaaaccguaucuucguauguccuuuucccccuccccucccaaacaaucuaugcacaggaaguagaacaauuauuugcacuccaggcuaacaguccucuuguaucuguggcuuuggguucucuuucacugugccucugcuguuuauagacaaguuuggcuucccuuggcaaccccugaaacagguucccucuguggcucauacuuuuuucagagguauguuuugucgaggcagagguguggugccuuuagguggcuggugcuugucaugacaggcauggcauuagcugggccuagcagugacuagaagugacagcauugguucgaggugccugggggccucucagucaucacuccugcuggagcauugagaauaugaaagcaccugagagcaccacugcuuaucaaggagauaacaguuugggagaacagggccaggaggugacugaggacaggcaagugccuuucccucccuuuauuuucuuguaguagauuuuacuugaaagagugucauauauguggccuuuagaaagaaggcauacaaacaagcuuuguccagggccacaaaagaagggaccuuugaauuuccagaaguuucaagucuuuuaauuucugucauuagacuuacaguuucuuuguguguuguaucauaaaaugaccaaacauuaaaaaaccaaccaaaaaaaacccuuuaacacuucagggaaaagagucaauaaauaguauauuauccuccucacugucguuagacacauuaccuccuuagugauaaugguagcggucacagccuauuuuuaugacugauuaucaaaggaccaugucagaaguuucuuaucacuccuaaccauuggguuccuuuguagauuuuccaggaauuaguuuuagauucucacuacugauuaauggacauauguguaaucuaugcaaagagcuacaaaauguauucauuaauccauucuacaaacuaagauuaauuauaauugucuguaggcaucuuauaaggucacaauucuaauauaauuugauaggagcuguuagggauuugaaugaaauuucaaaaucaccuccacagagaaggaaaaagaccuuuagagaaagucagugaauguuuuuauugggcagagcuugaaguuacuuccugagauuucucuucuuucauaguucugcuuucuggguagucaaagaucaccuguuuaaaaaagaaauaauuccuggauaccaaauguuacuauaguuaucaacaugaaggcaaucaaaauuuuucugaguagauuuuaaauuguuuuuguuaaguuacacauuucaguuguaauucuuuuuuuuuuuuuugaaacaggaucucacucuguugcccaggcuagagugcaguggugugaucucagcucacugcaaccucugccucccaggcucaagcgauccuccuaucucagccucucagguagcugggaacacagggacaugccaccacaccuggcuaauuuuuuaauuuuuuuuuuuuuuuuuuguagagacaggaucucacuauguuacucaggcuggucuugaacuccugagcucaagugauccucccaccuuggccucccaaaguacaugagccacugugcuuggccuggcagguguaauucuuacaugucacuauagaacuauuuuauauauaauguuugaccuauaaacuuuucuacuugcuauuuuagaaaaagaauuuguugguuagaaagucacugaagagaguuuaauaagaguacuguuuguuuuuuaauaaacuauuuacugugguucuuguaaauaaaacaaagcaacuuaguuaauucuauucaggaaacuuagcucaauuuccuaguaugaagaagacugauuugauagcuuggaguaguagagaccuaauaugguuucaaucauuguguggaggaggacauuacauugaugagacaaaaccauuuucuagguucuugaaacuacuugaccaauuacaguaauuugaagggggcacuuccuaaauaauauuaaguucaauucauaguaugaacuuuugaguucaaggcuucuguaauuuuucuuggcuuaaaaaaauauucaaauuuauagaauaguaaugauguuggaacguuugauuagauuuuaguguuccacauaguugacuauaauaauuucugaacuacaauaguuucagcuagaauauuuccauuuauucaacaccacauuaaucuuuacuuacuugucacacagcuuuuaaaaaaaucugaugugaauuugcuuuauugcauuugacacguuugggcaaaugacaacaacuuugguguuuuuaaaauguuccaguuccagaaaucagccuucaauaagcuucaggcaguuucccaguaaguuguuaauggauugccaucuuucugccucucuuuuaaauuuuuuccuuaaaggccauacugggggaaacuaacuaguucacucuagauggcuguacuaacccuacuuuaaauaccacugagaguuuaaaaggcugcguuuuugcaucuagacucacuuggauuugaauaacugaucucugaccgugggcaagucucuuaacuucugugucuugauuucuucuauuuaaaaagaaaggccuauuuuagguauguauuaggguaauaggagguaauguuagaaaacagagucuaguaugaagccuaauauauaguagaggaggguacaauacuuaauaauuacuguuguuauaaccucuuccuccccgcagccugcgccucccaggcucaaacaauucuccugccucagcuuccugaguagcugggauuacgggcaugucacuacuaccccagcuuuuuuuuuuuuuuuuuuuuuuuuugagauggagucuggcucugucgcccaggguggagugcaguggcgcgaucucggcucacugcaggcuccgcuuuccggguucaugccauucuccugcuucagccucccgaguagcugggacuccaggcgcccgccaccgcaccuggcuaacuuuuuguauuuuuaguagagacaggguuucaccguguuagccaggauggucucgaucuccugaccucgugauccguccgccuuggccuuccagaaugcugggauuacaggcauuacccaccgugcccagccccaccuggcuaauuuuuguauuuuuaguagagaugagguuucaccauguuggcccagcuggucuugaacuccugaccucaaaugauccaucugccucagccuccccaaagugcugggauuacaggcaugagccaccacgcccugcuggguucuucuuaauuauaauacucuuucccaagcuccuugcaacuucuacaguuuagccugauauguuguaaccucuugcuguuuacacuguccacucuuguggagguagcuaagacacugacugccagggcauguuuuauagucauauaaaaucuguacaaaagaaaguuaauuuucauucaagaagccaauagcuucuggaucauugccuugcauuggaaauaauuuuuuuuucucuguagauaaaagguaagcauuauuaaguuauuaaagcaaacaaauaacuguagucauccugccacuccaagaacaacaggaucuagaguauaaaaguaauaucaaaauuucagaggccugcagacccuguugcuguuuaucacuuuaucauucuauuuccuccuugaauccuuuuuuuuucuuuuuuuuuuuuugagacggaguuuuguucuuguugcccaggccguauugcaauggcgugaucuuggcucacugcaaccuccgccuccuggguugaagugauucuccugccucagccucccgaguagcugggauuacaggugcgugccaccacaccuggcuaauuuuuguauuuuuaguagagaugggguuucaccauguuggccaggcuggucucgaauuccuggccucaagugauccacccgccucggccucccaacguucugggauuacagugcuccugccucggccucccaaaguucugggauuacacugcgccuggccuacuugaauccuuuuaagccaucauugcccugguuagggguuuucccauugcuguuugauuuucagauucauuaauugaauacuaauccacuuuaaacuuuuaguguuuuuuuuuuuucccuuuauacacuuggccuguuucauuuuaauguugaacaguuguuugucaacuucaaaaaagaccacuuguuuauauaacaugaucucuauuugugagaaauauuuuuccucuaggaccguaguaaccuuacugagucuuaauauucagauaucaucaguauggaauaaaauaugacaugcucugagaguaacaagcuucccacuugggaaguaccuuuuccugguggcuuuuaaugagaggaaaggcauaguuauuuaagccugguuguggagcugaauaaaccuaucauuugaaucuugguucuucugcuuccuagcaauauaaccuuuggcaaaaccuuuuacuucucugggccuuauuauugcuuuuuuuuuuuggaacgaaauuuugcucuuguugcccaggcuggagcgcaauggugcgaucucggcucacugcaaccucugccuccuugguucaagagauucuucugccucagccuccugaguagcugggauuacaggcaccugccaccacgcccagcuaauuuuuguauauuugguagagacgggguuucaccauguugaccaggguggucuugaacuucugaccuuaggugauccaccugccucggccucccaaagugcugagauuacagaugugagcgaccacgcccagcccuuuuuuuuuuuuuuuuuuuugagacagucucacucuguugcccaggcuagagugcaguggcaugaucucggcucacugcagccucugccuccugggcacaagcgauucuccugccucagccuccugaguagcugggauuacaggcacccaccaucacgccuagcuaauuuuuguauuuuuaguagagcugggguuucaccauguuggccaggcuggacuugaacuccugaccugaagugauccuccugccuugcccucccagaguacuggaauuguaggcaugagccacuacaccuggccuauugccauuuuuagagauaaaaaaaaaauacauaucucacagaguuguggaaauuaaaugagaugauauuuucagagugcuugguauggguaccuacuggcaugaaacauaaagguagucuuaauaguauaugaucuuuugaauuucuguggauauugguuuggacugcauauuucuuuuuuuuugagaaggaaucuugcucugucacccagucuggagugcaguggcaugaucucagcucacugcaaccuccaccuccuggguugaagugauucugcugccuccugaguagcuggaauuacaggcacacaccaccacaccuggcuaauuuuuguauuuuuaguagagacgugguuucaccauguuggccaggcuggucucgaacuccagaccucaggugauccacccagcuuggccuuccagugugcugggauuacaggcaugagccauugugcccagccuggacugcauauuucuuauuaaugauuccuuuuaugcuugcugacauuagggcaucauuucugcugcuaugguagacuuuauuaaaaacgaugacacauuuccaacuaguauuuuuuaaauagaaauggauacaccauaaucuuauaccugaauuaauaaaaucugucaaauaccaucucuacuauuugcuuuuuucuuugaccguuuguuguacagacagcuuauagguuuuguuuguuuguuuaaauacagaugcagaggguugacuucaccucacuucuuaauucaugacucaguuuugucauugguucaugcaaugucccucuuuuguucacuaauuuuuguuagauuacuuguuugauuuucugauggggauaagagaugaagggacuuuuuuuuauugccaagguucugagguccagugaagccagaguauauuguuaagauaggauguaagaaauggaagagaucugcaguauucucuagcuaaaguacuucuuaaccgcuuuaaaaaaugccucacuccuuuaaaugaauuuuuuuuaaaaauucauuccaggcacuguggcacgugccuguaaccucagcuacuugggugguugaggugggaggcucacuugauuccaggaguuugagaccagccugggcaacuuagugagaccucaucucaaaacaacaacaguaaaaacuaguucagacucuucuccauuaaaauucauagaucuagucugaacuuuuuugaugcuugagaaaacugagacucagauaaaagacacaguaauaaucaccauaauaauggccaucacuuuuugaccauuuauuaugaaucaugagcuccuugccugugaucgaaaugucaucucuagagacacuuaagcucaugcagcucauuguggacuuccauuuugguauucucuuuaaacuuccaaaccgguucucucucccuucccuucguuuuuggguuuaauuuuuuuuugagacggagucucgcuuuguugcccaggcuggagugcaguggcgccaugucggcucacuacaagcuccgccuccaagguucacgccauucuccugccucagccucccaaguagcugggacuacaggcgcccgccaacucgcccggcuaauuuuuuguauuuuuaguagagacgggguuucaccguguuacccaggauggucuugauuuccugaccucgugaucugcccaccuccgccucccaaagugcugggauuacaggcgugagccaccgugcccggccuaaauuuuuuuuaauuuuuauuuuauaguugcaguugcaggcuugccauuuuugcuugcaauuucacauuguauuaauuuugguccaucuccagccucuuccccaguccugccuuuucuaugacauuuuagcuuggcauuagacuaacaacacaaacaaugcuuaugaaccaugcuugcaucaaaugaaugagaugaguacauugucauauugcuuccuuuuugagaaaauuugcuuucaaucccugacccuaaaacauaaaaguaaaucaaauuucaagacggcagacauuaaagaaaauauaugccaagugucccaagcagugccuggcacacacugaaaacucaguaaaugcuuauugagugacuaaaagucuccaguaugagcaaaagcuguaaauccuggaucuacuucuguugcuggccuaguucuuucugauuuguuuaaggcacguuaaaccauacucuggcaagggagaggaaugaaggaguauuugagaaacaccuucagugugccagaugcuuucaucaauacugcucaguuuaucuccacaucagccuuguggguuuaugccucuucaccuuuuuuauuuuuugaaugaagaaaugggaacucaguuuaaacagauuguccaagauguuugaauuugaauugggaucuuucugacucuagacccuuauauuuuccagacauccauagcaguauaagaaaugauuaauugcuguuacuauuuuuaauugccaucaugaucaucaucauuaucaccuuuagauuuuacaaaguuguccucaaauggcagccuguugccucuaaaaagggugggacauuacuuugcgaggagaggagaacauuaaugguucaggcagcaguguuucuagauccucuuauuccuuacagcacaaaucuacaccagucucuuguguguguaugcaaauggcuaccugaguaaggguguuuguuaccugagaucccuuccagcuacucaagucaaagagauuuuuaaguuggaaucagaguguucugccuauguaauuuugauauuuuagauggaaaagugagcuggaaugcaggaagguuuuccuaaauggaaaggcggcugccucuucacccucuccacuuucuuuuucuuugucaguugcuggagagagauggccagugacacaaaaguccuucuaaacuuuggggaguccuagauggcuggcagaugagaucacuugauuccagugaaaccuaccagcugccuuaaauucacucuuccagagcaccauacuuuuuauuacuagauugaauuauaggauaagaaaagugcuuugagcaucuuuagaccgcacauguaagacuacauacuugggccugagccucccaguuuggaguagggccucuuaaggaaaaaagaaaaagcacacguuauccauguuuguguguguguauuguguccuguuugcccuugagauuaauuuuuuaacaagugccgugauuucccaguuuuucuuagauuauauuucuaauugcuuuaauauuagauuugccauuuauuucaccuauccuuguuuucccuugacuuuuuaaaaucugcugucauuguuauacuuuguauaucuuuuuuauggaaggcagcagaaaaauuuggagguuugucuagaacaaacucaguucagucaagggaaggcugcccagcuugguauuuaacagcgcagaacuggccuguguuuguauucucuacugaagagagcgugcacaccuacaugccccugcauugagcuucguuuccuucaucuugaagugguggugugaagaacacucagauuucccacauaaaucaggaaagaggguucaucagaaucaacacugguuaaaaagaggucuuaauggaagugccuaaguauuguccaaacacgggggauaaauguguucugcuuuacuuggccagaacaaugucucaagcuagugauuaggcuuuacuccagcuuuaaccucaggcaaaauuuaugcagcucugcuaccguuugucagguaauuaaagggaaaaaagggaaauguuugcuuaaaguagaaguguuuuuuaauuaaacaugaaaaauaauaaauaaacacaaggggcaaauaggcaguugggaaauuguuuuuaacuuuccaguuaaaacaugaagaacuucaagcaaaagaccaauauuuuaggcauggcugguaguuuauuccuuacagagcauuauucagcugugcuagaaauccaaauuugagauuguuccaucuuugugucgaagaauguaaggcauaguuacucugucuuacuugaaagauaaugccccuuaccaguuuuugcuaaccacuaacuauuuacuugguaggagaagaguucuucaaagucagaaccugauagaaagccaauaaauaguaguacaaaucuugaugugggaagcacagauauagcaggaaguuuaggcuaaaaagaaagggggaaauaaccucuucccuauuaugguuaaccagaguauuaguuggauuguguuauguccaaaauuuauguuaauggauccgccacucaucaccaaaggcugaacucuaucaucauugacuuaucuuuagaucccagaucuuagggauucugcaucuauauacccucauucuuaccugcuauauuaaaguugacugugaccauugcaguugccugccucaacucuuugaauaguaguauccuuacaaacauuccauaucuaaucucuccuacugcuguccauccuuccuguugcugccagggagauuuuaccuaaagcucaguuuugaucaugcuacuaaucuuuucaaacuuugcacagcguuugaguuuuccaugccaugguccuuagacagcuuaccauaucugaucuauguuuacccuacacuccagcuguacuuaaucuaguuuagcuguucuuucaacacaaugcagggcucuuuuccucuaucuccuugacuuugcuuuuggagugcuuuauucuacacuucuuaauuaaguccuuuaauuugggcagcugcuuuucaaaggcuggucaaacgaguguaagucuugcugauuauauaucauuauuauauaauuuccuagggucuuccuuauaauuucuuuucaugguagcuuauuccuuacacugaauauuuauacuuugaggguuuggggguggcaaguuagagauaaucaucugaaguguuuguuuccuuggagaucauaagguaaagugaauaacauuaucucucuugagugucuuagaacuaauagggaagaaaaaagcacuugucaaucccaauggacagaugugauuuaucuugguaugucuuugagagguagaaucaccauaauguauaggagccccccuagauauuugguggguguggcauuuggcacauuauguugaauuucccugcuucucuucccaacaguaauccuugagccauuuuuuguuguuugaacaguaucuagcugauaucuguuaucucaaacauugccauuuagugguggucaucuguuuacccauaaggugaaauguuacugaggacacuuccaaagguaguuuaacugugaucucuuuguuuggguuugcaugcauuucugaauauauaaauacaaacuuggauaauuuagggguaauuaccuauauuagcaaauagugguuuaugaaaggaguaaaauuucuuuuaaauaguaaggcuucucuaggcccuuugaauauuugaguugcaaaauacugaucacaaccugaaggaaaacgucuguuguauaaagcuaaacauaucuauauaucuaugccaauaaagacauauugagugccuagauauaugaaagggagaguguguguguaugugugugucccugugugcacucacgugcuggcccaccaacuauauaaauauguacccuccuguauucuuuaccuuauagacaaggcaaaaacauuuaucauugcucuugccuggaguuauguccaccuucaucuuacugcaagugucagagcaaccuacaaaauaguagaugaggagaugaaacaaguagggccagaaaacauuguccacagcccagugguccgugucaccauucuucugcuucuagcauauauugcauaaucaggacagacgagacaagccaaauccuuuuaguacaccgugucuggggagguuauggagucucagagauuaguugucauuuuaacagucucgauugugacaagaucuuggaagucaucugagaaugucaugaaaaccauauucccauugcuuuuauuucugcuggacacuuacuggguggggaacauguuugauauauauaaaacaaaaacaaaaaaacaaaaaaccaaccaagugaaaaaccuauguucuuugcauugaggucacauuaagaauaccuccucuucuacaauucaaccaaagcucuugcaagaaaaugaguuugcuuuauuuguauuuauaaugaaucauuguaauugcagcuagaagcuuuguaguuaugauuauucauccccucuuuccauucucacagaaaugucagguucaggauagauuuuuaagacucuaaaaauaaugguuuuuuggcugggcgcgguggcucacgccuguaaucccggcacuuugggaggcugaggugggcggaucaugaggucaggcgaucgaguccauccuggcuaacacggugaaaccccgucucuacuaaaaauacaaaaaauuagccgggcguaguggcgggcgccuguagucccagcuacucgggaggcugaggcaggagaauggcgugaacccgggagguggagcuugcagugagccgagaucgcaccacugcacuccagccugggcgacagagccagacuccgucucaaaacaaaaaaaaaaaaugguuuuucugcuugcuuccguuaugguaauguuguggguauauagaccuuuaggaguuuuucuucuuuuugagacggagucucgcucuguccgaggcuggagugcaguggcgccaucucagcucacugcaaccucggccuacaggguuccagugauucuccugccucagccuuccaaguagcuggggcgucaccacgcccggcuaauuuuuguauuuuuaguagagacaggguuucaccauguuggccaggcuggucuccaacucuugaccucagguaauccgcccaccucggccuccuaaagugcugggauuacagacgugagccaccgcgcccggccaggaauuuuucuauuuugaaaauuuauauuguuuuucuugagguaaccagagacacuaaaauauacuacuaaguguguguuuuguuaguauuguuuuuguccuguuaauuagcaguuuuauuuuuauuuuauuuuuguugcuuaacauuuuucagaaguuauagcuaaacguauuuugaaugaauccaacuggaauguuaguuuuuaaaaauaaauuuuguuucaaccugugcagcuguaguuuacuuuccaggcaugagaaauaucuauuuuauuaaguccuaugaggaauaugugucacacacauuuaagaaaaaacuguuuaagaugaaacacuccaaaaaugacuucccccuggugugaaguaaaacaaaagccucaauugcaucucugccugugguaaugacacgaggugacaaacugcaggcaggugagguuuguggggaugaucucacaccugcaccucgagcuuggggaacagauggguuuggagcuggcgucuggccuugcuuucuuuuugauacgagaccagcucucaggcugggagcccccacauuugcacagaagacucccaaguguuuuaacauaggcagaugggacugcugguggauaauauucccugguuuugugaaucuuuuucuugggauggagaggugaagaagccccagcgcaagcaccaccaaccuccaagcccagagcccuuacaucaagccagagcuuugccugccaggcagguuucacuucagaaacccagagacugaggaucugugcccucuucagucuuaguucuguagccaggcagguagcaaaaggugaacccaguugaaggguuccuucccugccagucccugcuucauuccccugcagcugaucagcagaacucuggaagcaguuaaggcuggaaaaccuugugggcaggcagagcucuuucugcaguagcacucagagaugacuucugauuaauucuuuuucacaccucccuaaagaaaucagguauguauaccucugaagggaaggucaagguagauuucuguuugagaccuccgcugcaucaucuaacccaacucaagacagcuuuguagaaaccaucaggcccaccaauguuuuacugcuuugcccccuucacuaaggccauucacuaggggcucuucuuuuccuuucaacacuaguguugucuuggcaaaugcguuuuuggagugccuccacaugcauagcuucccagggacauuuugcagaaagguuugcacuccuuucuuaagagcaguucugcugccucauuucuguuuacauauguacugaauagucaguccaugucuagccuucacauggguuugauuuucccuguacacuguuuuuuuuuuuuuuuuuuuuuuugagauggaguuucacucuuguugcccaggcuggagugcaauggcucgaucucggcucaccgcaaccuccgucucccugguucaagugauucuccugccucagccuccugaguagcuggcauuacaggugcccgccacuaugccuggccaauuuuugguauuuuuaguagagaugggguuucaccauguuggccaggcuugucuugaacuccugaccucacaugauccacccgcguuggccucccaaaguucugggauuacaggcgugagccaccgugccuggcccccuauacacugugguuuuuuugguuuuuuuuuuuuuuggucuuuugagacgaagucucgcucuguugcccaggcuggagugcaguggcacgaucuuggcucacugcaagcuccgccucccggguucaugccauucuccugccucagccucagucccagaguagcugggacuacaggcgcccgccaccaugccuggcuaauuuuuuguauuuuuaguagagacgggguuucacuguguuagccaggauggucuugaucuccugaccuugagaucugcccgccucagccucccaaauugcugggauuacaggcgugagccacugcgcuggccccuguacacuguuuuaaaagaguucgagccccuuuuaaaaaaaauuuggggagauuucauaugacagcucagaguucugguuucucuugaaaaagagaaggaugaucuagcaacuggagggucuagcaacaccuugucuacauucccauggaacucugagguaggguaucuggcuagcggcuuuucucuuuggaucacuggcuuuaagcauuuuugacauagacaugugcaugaacuuauccuuacuaugugugaugcauuuuguucaguuucauuuaagcacaaaugguuaagagccacuaaaaugauuuucaccauccaccaaugccugugaccugcaguuugagaagcagugcuugggauuuggcugcagggucugcuugccagggccuuccccaugaaugugcaucacugcuuaacuccuggccugcagcggcagcaucugguuucacagacucauugucauugucauucacaugagguaaacaaacagcucugugggacgccuagccuguagccccuauuuaggcuguggguauccaggugaggacuggucuuuucacgacuccuugguuuugcaaggcugaagacaaaggcagagugaaugccugucuugugucucaccucagcuucuagccccaccccugccaagguaaaugaacggggagaaaauaugcugucuuguggaagacuacacuaagccuguccuauggauugcauaacagugggcccuaguagacaggucagggacaauucauauuauaaugauauucuuuuuauaaagcaaagcaaguuuuuaaccauaaguuaccuuaguggcuuuacauuugcauuacagauuuuuaaguacugucauuaauugagaugggucaguaggcagggggcagaaaaagacuaaagagcuucuuuaaucauaccuuugcauuuuaucauccuagaggggaggcagagaagccucuuacucaucaggaccaucaauggaccauggccaucaaagcauugauuaggaaagaugaagcaucuuuuuauacaauuuaaauaauacauucuuauucagccauucaaauuuuauuccuuuaucauauagaaagaacucagaauuuugagucagaagauguggcuucuuguucugggcacacuguuuucuuuuuuuguguuuuugagacagagucuugcacugucgccaggcuggagugcaguggugugcucucagcucacugcauccucugcuugcagaguucaagcaauccugcugccucagccucccgaguagcugggacuacaggcacgcgccaccacacccagcuaauacucaguacauuacaacgcauucggucuugguucaggagacuccugaauugcugugcauugaguuuuuaggaagggaauucagcagguacacccucguuugaccuauugaaagcugguguggaaauaaaaguaucacauauuuauuugcauaagucugugacagaagcaaaaacuggaccgagagaguucuugcuccucaucccagggcucuuauccuaacacugaaguuauuggauuucugcaaucgaaggcauuuuuuuuuccauaaaaaaaaauugagcuuucugauguuuucaaaucucuccuagcccuaauguguugagugauaacacacuguagaccacugaaaaggucaucagagagugauccaggagggggcuuguuuuuggcucuuaucucauugucaacaguucuuccucuagcggcagcucccaucacaugcagcgcugagacaaggcccuuguucugacaaagggcacuuagacccaggccauuuaagccucagccgaaacaacugaucuacuuuagaauuugauaugaaacaauucugguaucuaagaaguugccugggaaccaguguugugccugguuccaagucugugaaugagcuguugucagauggcagagaugagccucucuucucaguauggcuggugaaagaggagguggagcucucuucuuuaggggacagccaaguacauuaguaccucuguuuuuuggucugggaaguaggagauuuauguucuuuuccugucccagucaccagcuugcuugccuugggcuaguugcuuucagagucucugggccucaaagcaauucacagaccuuacaguguuuauuuugcuacccagguuuuagaucuuuauuguagcuacucuuauuuuuuucuauuuuauaaauaggaaaauugaaguugaaauaaaaaaaaaagcuugggcaacauagcaaaaccccaucucuacaaaaaaacauuggucaguuguggucacauacgccuguagucccaguuacucaggaggccgaggugggaggaucacuugagccugggaaguugaggcuccagugagccguggucacaccacugcaguacagccauggugacagaaugagacucugucucaaaaaaaaaaaaaaaaaaaaaaaaaaaguugcccaagaucacacaacuaggauauugauagauucaggccuggggcucagguuggugugauuccagggccugacagcuguuagccucuaccucuaacuuuuaauuugagggauccuucuaaugggaauagcacaggauucuaggcucugcuguuugucaaauaaauuuuaaugaaauaaaccgagagaauaauaaugaaaaugguggguaauuagccuaacaaaagauaauuugcugucaguauucuauuaguguguauuucuuauuguucauuuauucuuccuguguuuaaaaaauuuuaagguugaauauugaaauacgucuaacacuuguagcuaucagaaacauacucugaaauuuuguuauucuuuaaauaggugaguuacacauuuuuaauacucauauaauuaacauauauggcccaccuccuuuuugccagguucugugccauguauuauuauucuuauuuuacagacaaggaaacuuaagcucagaaaguuaauuaucuugucugacugccacauagguagccaugcuaggauuugccuauguucuuuuauucuacaaaguauauuuauaaaauucuauuuuuggauauuaugaguuuaucuguuaggaaauuuuuaaguucauuucucacuccagagugagaaaaaaggcauucuagacagaaagauaauuuucaggugucagaaaucacuuucuaacuggaauuuuuuauauuuuagauaacaauagcuuuauguuaaucaaugaauuaguuacaggucuuuauccucaauggguucaauuaaacaauuuaguaauguaagcaggaauuaagugucuucugucacucuuuuacuuccuucccacagauaguguuuagaacguuuuaggucccucucuucauggagcauuucccuguugaccuccccucccuccaccuccuucucauuuucuuucuucauuuugcuguaaccuucuccccaguaaaacuuccaucuuuuuuaauugcaugaagagacaauuggugcauauugcaaaacaggauauauuuuguagacugauguaauaauaugguaucuuauuucuuuuugugaucaugggaagauuuagaagaagauuuggguuaauaaaaugauaguuucuguccuauaaaccuuguuuucauggaaauugauacuauguuguguucugauacuuaaaaauaacuuucuguagauaacauuuaaugcauuugccauuauucuuauucauucuagucauaaagagaucugugguguugacacugacuuuuuauugucccagaaugguaaguugucaggugguuucaaacaagaaggauacuaaaacuuaaaaacacuugcauaggaaagagaaauauaacuuugccuaauggaaauuguuagucauagauaauaaucaugauauuagucaagaaaguauaaucugcuuaacauuacauugggucuaaccugaaaaaaagagaagaaaguagacuauuucuuaucaaaguuaaauuuauagcacaccucuacuauaaagccuagugagugcugcacugacaaagacagauucuggauggucucuuucuggucagcaugcagagcuggcaaucuggggagagaguuucuauucucaguuuaauucaaggauaguuucugacaccuguuaacuuccuccaccuaugccaaaccagguuuucagucugauuaggggacaauuuagaaucuuaaaacauguuuugaacccauagggagacuguaguuucuuguugagaacuguaagauaggaagaacuaauaugaagaaguuacauuaaggcuguuacuuaagcagagauguuauaaacuguccuuauuuuucugggucuuucucugauuucuccaacaccccuucagacaaacauauacaacuuugccuggguaauuagaaaauaaaaagcaacacuuuacuuauggcguaauuucccaggauuauuggguauugacaacaaguuuuaaucaagcuaaacuuugcuuaaauuccuucuuaucauuauguuccaagugaaccuucaaaauagcacuccguuccucugcauuauuuccuuccuucuuucuuuucuuuucuuuuuucuuuuuuagaaagaaacuaagccucacucugucacccaggcaggggugcaguggcacuaucacugcucacugcagugaucccaccauguugcccaggcuggucuugaacccuugggcucaagugauccuccugcuuuugccucccagaacgcugggauuauaggcaugagcuacugugccuggccuauuuucuuuaaauauuugaguauuuuuauaucacccccuguuaaagcuuuagccaaggucauuuacaaaaaacugauuuaauaucuguuuaaucuucaguauucuccccuuuuaaaucauuuugggacugguuugagacuuucccucaguuuggucacaccuuuccuucuuuaagggcauugcuucucucugcuucauuggggaagcaaaucauuuguacuguuugcuucacaaacuauuucacauuagaaucaaaauauacuguuacacuaaaaauuuguaaucaguuaccaauauagguaaaauauaucuuaauguaucaguauuuaaugccugagcaucaaacuuuucacauucccaucuguguuuuacauuuaagugaauuuuauuuuuaagccauuagguuuuuuugccccucccuacuaaagcagaauucagaagggacacuguguuugcgugugugugugugugugugugugcauguaugcaaauuauacauguaaguacuuuaauuuguucauugcaguuucucaugcaguuuccauguaguuuaaaaugaauuuccugccaggcacaguggcucacgccuguaaucccagcacugugggaggcugaggcaggcggaucaccugaggucaggaguucgagaccagccugaccaauaugaugaaaccccgucuguacuaaaaauacaaaaauuagccaggcugugguggcacgcgccuguaaucccagcuacucgggaggcuaagacaggagaaucacuugaaccgaggaggcggagguugcggugagcugagaucgugccauuguacuccagccuggggaacaagagcuaaacccugucucaaaaaaaaaccaacaaaaaaauaaugaauuuccuuugaaugaaacaauagccagggaauucauguguuuggcuacauucacauagaaauuugacugugcuuauguagccuugcagaccuuugcauaaagucuuccagauucuaaagauggcauguguucucugacaaacccuacuauguccauggauuauuuauaaugcucauuugaagauucgagauaguuuuauauugauccagugguguuaccuaccaaacagauccccacaccacuuuuuuuucuuuugagacggaaucucagucugucacccaggcuggagugcaauggcguggucucggcucacugcaaccuccaccucccgaguucaagagauucucccaccucagccucccgaguagcugggacuacaggcgcaugccaccacacccggcuaauuuuuguauuuuuaguagagacgggguuucacuguauuggccaggcuggucucaaacuccugaccuugugauccgccugccucggccucccaaagugcugggauuacaggcgugagccacugcacccggccucuccacaccacuuuuaaaccacaccaggaucucccccaagcagugaaaauacauuuucugacaugugaaauaaaugcaccauuugcuugcaaauacuaauauuugaguggcuguucauucugugcguaucauacuccacuucguguuccaguugguuuuuaaggaauuggagagauccucuaaaaacaaccuaucuccaggacaugcaguuuuauuuugaaaaauugaaagggaaauaaccucuguuuucaugagcggucaugugcugaggcauauaucucauguccagcauaugugcuugugagcaucugcauguauaugcaugcauagaguauagcauacuaagacaguggagucuagauuuggacuugauacugcagcuuucuagcugugaccacgaggaagucaguuaacuuccauguguuucaaugcccucaucuguaauuuggagacaaugauaguacuuacaucaaaacguucuggggauuguguauuugcaugugaaauauuuagaacaguuagccgauaaugaguguuuaaucauugugcauuacuuuuagaauaaaauuauuuuaugaugcuuuauugacaagaauaauaacucauaugcaaaucuuuccucaaagaguuaaauuuuauagcuagcggcaaacuacugugacauuucauuuuguaaguauaguucuguacaucauuuucuuuagcguggagcaggcagaagccugaaagaguuaaaaguauuuccuuguuuuucaggcuuuaauuuaggcucauuguuauacaaaaacuguuagccuggguaaagcugcaccuugagcacugauguaaacugaguuuuucaaaguacauuaaaauuugccauagucuucccuugacgauugagagauuugcaucugguagcgauucacucagccgaaugcaagaucgcacuccuuagagugcugauaagcggacacaugacauuugcaaagagcaguuugcccacucgagugccagggcaaacuggagaaaauucugugcuuccaauuucaucagaaacguagggaauauugcaaaugacacuaccaaaucaacuguaaauagaugauaauuugauugacaucuggaaagcugucaccggcugaguagcccauaacaggaacauuuacugagugcaaaggcagcuuucaaguaaaucacuuuuuguccaguggggcccagccagauuauaauugcauguccuucccuucauugcaaauuccccauuaccguuaccagcagugucucauuuaaaggaagguugucuuccaaauauucacaaugucucauguuaacucgucacuucccuccuugaaggcuugcuaugugcuggauaauccagcccuugccucccuucguuguaauaaaacucauuaacuuugcucuuuuuggggcagagguacguauuauaaauuagcuguuaggugaaauauagcaugacuaaaguugagggcuaaaacauuuccagcaggauuucagcacuguccucagaauugucuccacugucacuuuugaauaaauguuuuggcacugaugauuuuugaaauggcagcauuucacaauugagccaaggaguggugccuuccugcuuuguuggaaacacacaggauacaucuagagcugguguucauucuggguccuucugcaaguccaaauguuuaggaauauaggaaaacuacaaucacuaaaacagauggccauuuagagguucacuuguagauagauuaugaagugagagacacuuggggagaauauuaagucaaugucugugugauggucuacucuauuuuaccaaccaaauauuugcuaccugguuuuaaaaaugcaauagcuuaugaauaaguuugccaaguaguacaaaguugcgugucuuuauuccccaaaguuagugacccuccauuuggucaagaaaaugaagggaaaacaucauacuugcuuugccuauuuccaaauccagagaacauucucuggucccagcagaaucucuaggucugaaaaugcuucacauguggagcacauagaacccaccaugaucucagucuuggaauuucaaauaguguguucuuacaaaaacccuucgguccuugucuaugggcuugaaaagugucuugcuagagauggacaaagaaugggagagaugaguaaugugaagcaaguugucucuacucuaggaguugucucucuuguauaaacauaagaccugaagcuucuguugcugaagcaagaccaaugcacauuugccuugcaggaagggcuuuagaucucugugucacaaacaaucaagaaaucauuucuugcuguacaaauguagcagcuuauuguagcaccagugaaugggcacgggagugaaggauauugcuaauuguacugagccuggcugcauugcaagugucagaugauuugauaggacugacaugcagcuaaauggaauaggaaaagacacugcaguggacuguugguccauuaguuugcucgggcaucuuguuuuacuaaggagcccucuaaugguuucucggcaauaauuacuaucucucuucuucaugcuauucaacaugacaggcacuugcugaagucgcagcuaauauauuugcacucuuaacuggccccaaugccgcguauccuugagcauguuuggcuaagaaaugaaugauagcuauguuuuuuucuuugagaaaauguuucuaauguggaagacagucguuuuauuuuggauacgaagcaggcguguggcauaacaugagugcuugugaaaaaaauugaugcauuagcuguggacugccccauugcaugucuccuguauacuaguugaugauacugaaacgggaaaaacuuuuaugggcuguuuuacuuauauaaugauaacuucagacuugagccagaaccacagagaaggagaaguuuacauagaaaugaaccuucacacagcuguuuugaagcuauacaguaagggauuaucccuuuguuucaauuaauuaacuuacaguugagaggcaguuuuauuuuuucuguguguguguguuuuuuuuuuuuuaauuuaagggggugucuuagaauaaaauauuucagcuucuuuuggcauggcuuucucacuccuuuguaaaguauggucaguuuugcuuauagcuguauugcuuuuuaaaaguaacuugaaacuucuagguuaaguacuugagguuuaguugaaugagcuuguuugcuaaaguacagcauuuaaaggugaggaauggggcuggccacgguggcucacgccuguaaucccagcacuuugggaggcugagguggguagaucacgaggucacgaguucaagaccagccuggccaagauggugaaaccccaucucuacuaagaaaaaaaaaaauagaaaaauuaaccgggcacgucccagcuacucggcaggcugaaacaggagaaucacuugaacccagggggcagagguugcagugagcaauaucacgccacuguacuccagccugggugacagagugagacucugucucaaaauaaauaaaaauaaaggugaugaauguauuaucaauaguacuaucauuauuauuuuugcuaaagucuuugggagauuugaaggucacaaaaagacuuacaugugaaaaaggaggaagaaaucagaaauacggagaauuguguaggggauauacuuuggauuuugaagucuuguuuagaaguguauauacuuguggggcaauaauuacaaucauuuuggguucuuuuuucaucuagucagguugaagaugucuauuuuguguaaucuuucuuuugggaggaaugaaaaaacauuagcaacaacuuaauuuuugguuauuauuuuucccuuuugcuucuaaaacacguaguugccugauagaauagcuucccuuuuuuuucuacaucagaaaggagagaaagacaacuaucuuagaaacauauuuaaagcacaugaugaaaaagaagagguuuuuaaaaacuguugaaaauacauuuucuuuguaccagguaccagauguugauguuggcagugccucagagggucacagggcauuuaaaaucacuaggcuguagggaguaaaauuccagaucucuugcacugaaaauuauuuaaaaauuaucuuuacuuagcgauaaguaguacaagaguacuuuuucuaugaauuccucuuaaauagguaccuuagaaauacaugaucaaugaaauugccagaaaaaaaaaagaguuccagugccucuucgcauuacaaaaguagugcuuuuacugguuaaguaacugguugcauuuaagucucuauuuuuuuugauaugaaaagaauauccccucaacuuuauuagacaggauuugccuuacuuuugagcuauccauuucaaauuagagaggacagacgcugugcuccuugguuauauacuaugcaaaaagacauguauaugguacuuagauaguauuucguuucuucuagaaguguaauuuugagaaggaaauaagacuguuuuuccauccaccugccaucccaugccaccccuuucuacauaguuucuuuucuuuuuuuuuuuugagauggagucuugcuuugucacccaggcuggcgugcaguggugcaaucucggcucacugcaaugucugccucccaagcucaagugauucuccugccuuagccucccgaguagcugggacuacaggcgccugcuaccaugccuggcuaauuuuuguauuuuuaguagagaugggguuuccccauguuguccaggcuggucucgaacuccugaucucaggugaucugcccaccugugccugucaaagugcugggauuacaggcaugagccaccgcgcccggccucuacauaguuucuucucugugugagccaaaguuccuuuugucacugauaagauaauuaggguuaauaguuucagugcaaaaauaggauuuuggaagguaaaaaaguucugaaaaaacaaaaucugacaagguuaccgcuuauauucacuauagauuauuguuucuucugguuuuguggguguuccaguagaaggacuugggugauuaccuuacugggcuuuuccagaggauuuucaugcauuuuuuauguaguuagcaucaagauuuuacuggggaaauuugaguuaguucuguaaauacaaugggauuaauuuuuuuuugggcuauuuugcccuucuuguuauugccugaagaaaguaaaugcuuucugaugccaaggugggcagauuacuugaggucaggaguucgagaccagccuggccaacauagugaaacccugucucuacuaaaaauacaaaaauuagccagguguuguggcaggugcugguaaucccagcuacuugggaggcugaggcaggagaauggcuugaaucugggagguggagguugcagugagcugagguccugccacugcacuccaguuugggugagagagugagacuccauaucaaaaauaaauaaauaaauaaaauagaaaguaaauacuuucugcagaaaaggaaacaauguuuuucaggaaaaaaaaugacuggaaggaaauaggucaauauuaucaguuguugccucuggaguuaugacuaauuucugcuucuuuauacuuuguuacauuuuuuauauuuucuacagcuagaguguauuacuuguagaaucggaaaaaaaaaggaaaauaaugugcauuauaacugauuuugacaugccuaaggagacaagcacuggccauucaaauugcagaucccagaaccuugguucugagccauaaaaacuacaggcuuguugauguuuguaugacucucagagcccccugacauuuggauagauagaaagugguguauuuagcugugggccaccuucccaugggguuugcuggugaccaaagucagcaauuguguuuacagcuuaaguggcagaaagggcucaccauuguugccauuacuugugcgugauuguuuaccuucugcucucugugggcauauguuuauuauauuuauauugcccauucaguguaguugugcaauggaaauggacuuacagggugguggggagcauaggggaauaauuucaguauuuccucuauaauuucuacguaguuuaguggagaaugaaaaauuuaccugccugcugucugaauggcacuugguaaaguccuuaauguaguuuugaauguuaauucugguuggaggaacuccuuuaaaucauaagauacuaccauacuugaaaaaauuacuuagaagucuaguguuuggagucaagagacugcuuugucacuuugaucuuaggguuaguacuuuuaaccucugaacuuugucauacuugucugcaaaauggggauacaaauaauauuuuccuuuaggguaguuguggggauaugugaaaaucuuuuguaaauccauauauauuuaauuuauugacuaagcuaaucuugccaaauuaccuaaauuagaaugguggugauuuggauaaagucccugaguucacagccuagagccaaauugcauuuguccauucuacuuggaaggugggacaucaaagauauaugguuuuaaucuuauuuuugugagaggcugugccuauucgaaucugcauagcuuccauuaaaaaacuugaaaauaguucauuuucucuuccuaauuacuuggcagaaauuuagaauagaaagacagaagcuaguaacaaccaacuuuuccuucacacuuccagaucaacaaaagggauucuuggguccuagagaccaaagaaagaaucagcaggaaugcccagggugaacugauggauugcagagccuagcugguaauuacuuucacugagcuaaaacauuaacuuaauacaugggaucagagccagaugaaaaucagaauuuggaucucuuccuuuccuguggauaucccauacuuuccuucugaaggcagucuucucuuggugggauaggccugcuuccuuuccuaggacauggcauaaauuuucaugccacacugguagacuggaguuguaucauuuguugcccugggcaacuuuugguggggauaugugacuacuuaggucugcugguuucuaggguggcaagaaaccccaguuucuuuuaagacuuuucagcuggauaccagauauugacagacucaaucucaucuugguguucaaauuuuaaguugccaaacuuuagcuuuuggacuugugugacacucuuacuagaugcauaccuagccuccagcuaggugauauugugucauccuuaagaggccaacgagguuucauuuuaaaagcuagcucauguugauuguuaguaacuuccuaguguguugugcugugaaagauggugaagucauaaugagauucacuggcaugauuguuuagugauguguguuugccauggauugggaggggcauauauguauuuucagagggaugucaaaucuauaguacagaggagcucauuuaaucuacagugcccccaaccucauccuuuccauuguauaguggagaaguuggguaucuagaaagaugaagcuauuuccagcuuauuagagccaaguguggacuugaacucaaguuuucugaguucaacuugcuuguuacuuuuuggggauaauaguaguagcuaccuuaugggauuuagagaagguuaaguaaaaaaaaaucuauauuaagcuuuaggaauagugacagacacugagaaagauauaguaaaugaaagcugccauuauugucaucaucaucauuuuuacuuuuaucauuccuguugcacuuuauuacuaccaacaccauauuuugugagguagucagguagcuaccuuaacaaaagcuaccucuuguuuugugccauaucguagaagccccacuuuugcuaacagacugaagcaaguguucaacuugcgacaauuuaaggaaaauuugacaguauuugaccuuguacagagacccacaaaaggcauuaguugaagauaaauaaaugguaguuagcaauccuaauuugaauuuuuguacacuuguguguguguuuauagauaauguuucccauuuauaaagauuugucaaauacgauucuacucaaguacauucucuugaaacagcaggaauucuauggaauaaggauuucuuucuuucuuucuuuucucuucuuuucuuucuuuuuuuuucucuuuccuuuccuuucccuuucccuucccuuucccuuucccuucccuucccuuccuuuccuuuucuuucuuuuuuuuuugagacggagucucacucugucacccaggcuggagugcauugacgugaucucggcuuacugcaagcuccgccuccuggguucacaccauucuccugccuuucaugauuucuuauuaagcagucuccuauacuuccuugcuuccugagacuucuucauuaaauauguacuauuucaaauguuuuaaauuuccuaguccugucagcacagggcuuuaaguuagaagacaucaguuaugaaaucuaucaggguguaguuauuuaaaggacuagacuuuugugaaauuuuuaauuauaugggauuauacuuaugcuauauuaauugaaaagaaauggauguaaaacuauauaaaguacuuacgaaagaagccaaguuaauugugccuugguuagauagugaaugguuaaugccauuuugugucauacuggcuuugucucuguuuuauguaccugcugucucacuaacaguguugcuuaguagaaggagugugggcuuugaagugagauggguuuggggcuucacuccauugucuucauuuaagagcuuugagacugcguaaauugucucucugagccuuaguucugguuagacuuggaugcucucuccuuugcaagguuucuuuauccugaaaguggcuugcucuuggaggugcuuaguaaauguuagcucuuuuucucuuccuaaccaugaccuuuaccucccauccucuuucccuggcauucugcaaggauuaguucagggauuaaagcaacuuggaaacguuuuaguuucauacugucauuuuuagugguuugccuuuuaaaucaucucuuuacuguaaaagucuugguuccuauaaaucucacacccuugggaaccaaacucaugacaaucaugaagugucuuacuucaaaggauaagaaaaccaagcaaaccaaaaucaugauauccucucuggagcagugugugugagccugggaucagccugggaauguugguuaauggugucaccauccuccucucgcuggcagugauguggaggguguggagaggacaugggcugagcuaggguuuauaauugcauggccgucuggccuuccuugagcauucuuucccuuccaggauuccuguaauugucaucagauggcucagucucccaauguuuccgguauugcaaugacuucuggaguguguuuaaaaaaaaaaaaaaaagccagaauuagcaguuagcagucaucauuuguuugugucaguucuguuguguguagaggcgugcagauugggcgucucuggacuguagaaagaccggucacauguggaguucgccuuacuaucuuguguugaaccuuccuacuuccuuugcuuauucuuuuccgccuacacugcuuuaaaggacucccugaaaaaaaaagugagaaaagaugcaggcaguguuccuguuuucaacucuagucagccuucuuuuuauucucauuguucuggaaacuugagaggauugcaucuuucuuggaucugcuaaaggccuagggagguugagaguuggacuggauagugagugaacccugugaagaaugauuccaagucuugggcuguucgugggcauggaggaggagagaguauuuguauuuuccuuuaucaugaacuuaucacuaaaggcccaaauauaggaauauaucuugcauggguuuuuuuuuucccccaucagauaagcuguuguaauuugagccugacacuucuucuugaggaaggggaaaauuguguaaaugaaaaaggacagcuaauuuuuugaaaaacaaaucuggagugauugagaggucuaaacccccaaaaguguaaaauugaagagaacuaauaugguuaauuuugcuucaugguguuagcugaggaauuguguuuuuuaaaagcccuuugauuuacuggcucuuacucaccuaauggguaaaguauuauaguucauugcauucuggugccuuuguuugucuaaugguggaguguuuuucuuaaguuacagggacccaggccuagaugaugauaaugacuauagugcaucuuuacaaaaaacagcccuuuuacaguugucauacggaucuuuuagaauaauugaggugaauuuuaaugccaacccuguuaaugaugucuaucccaccucucucuucccagguggcuggggguggcgguuggaaacaggagagccuuggucuuaaugaacagacaggagauaucucaagauuaaugugaaaaaagcucagucaugauaauugcauuccccucggcagugauugguuuacgagcagucaugugauuaaguucugaccaauacuuuguaagaggaagucugcugggggacgguagugagaguuucccaucuggaauaaaaaacacaucacugcuugaaauguggcugagaugcuuacagaggagauggaccuucuuggccagccugaggacaauaccuugcagugagaaaggcagagccaugucacugauacccagcacugggugcuaccucucacuuguuuuauaaccuauaacuaagucacacaauccaauguauaucauuuaaauaauuuucuguuucaagaugugaaaggcaaggcccggcgcgguggcucacgccuguaaucccagcacuuugggaggccgagaugggaggaucacgaggucaggagaucgagaccauccuggcuaacacggugaaacuccgucucuacuaaaaaaaaaaaaaaacaaaaaaacaaaaaccacaaaaaacaaaaacuagcugggcaugguggcgggcaccugcagucccagucccagcuacucgggaggcugaggcaggagaauggcgugaacccgggaggcggagcuugcaaugagcccagaucacgccacugcacucaagccugggggacagagugagacucccucucaaaaaaaaaaaaaaaaaaaaaaaaaaaaaaaaaaagauguggaaggcaaguaccccuuugggugggaucgaaaucuagaauuggccaggcauaguggcacccaccuguaaucccagccacuugggaggcugcagcaggagaaucccuugaggccagccuggguaaugauguagugagacccugucaaaaaaaauaaaaaggacaaaagaaaacuagaauugauccuucccaaagaaaauguucacuggcuuguuaagucauauccuaaccaugucauuuucaccacuggcagaaccuugaugaaaggugugaugggguaaauacauucguguuugguuuguaugguuuauauuaauuuaauuuguuucugcuguuuauaguuggauuuucuuugcuuagguaacugauuucggcuuuggauuguuaugauugauaauaagagaaaaaagaauguaaaguguugagaaauagucuaaaaaaacauuguauuguuggagcaguuauucaguuuucacaguauuccuuugggcaauuggauuuguuuuggugucugacuuuguugacaauccuguuguuauauuaaagcuguuucuugcaguauguuuucccuuuuaguuaagaaaacucacuuuauuuccuaagaugaauuauaauuaggacuauuugguauugagaaucuuuucucacuuaauaccccuaaugagauacaaauguucuaaauguauccuuaugaguagauuauauuuagagaggaauccacuuauuuuaguuaacuaaucccuuugcuuuuguaucauacauccuuauuaggcucccacguuccuauuccauauggaauuccuugugaaaucagaccucagcaaacaauguuauuaacuuucagggucaguguuacugaaaaugucaaugaaguuuguugguuuuacauaccuuguuuuuauagcacucuagcuuuuuuauacgcuuaugauaaauacgaauucuuucccucuucuugcaaaguaaacuuuauuucuuaguugguuccccccgcugguauuuaugcuucuacucacuagaauugaaggaauugaauguauuugaacuauucuuuuggccccuucugcagacugggaauggucuuucuagcuucucagaucucugcauauugugcauccuuguucuuuugccagaaaccugaaaauuucccagcagaacuaacuggcaaugaucuuugaauuauaugaaucagguuugccuggcuucuaggagucaauauuauacccuucucaaugacuguauccuucuuucugaggaaagcagauaaguuagugaugaaguuuugaagaacuucacuuacggaguuacacuuccugaguucaaauccugacuucacugcuuacagguugcaugcuuuuggacaaguuauuugacuucuuuaugcuuugguauucugaauggggguuauaaugcaacugaucacguagguugucaugaggauuguaagugaaaauuuguaaaauguucuuaaaauaguuccuggugcauacugaguguauaguugguaugaugguaucuaguugauuuuuuuuuuuuuuuuggagggucaaggucuuguucuaucacccaggcuggaguacaguggcaugaucuuggcuccuugcaacuuccgucuccugggcuaaagggaucccuccaccuucaccucccaaguaguugggaccacaggcacgagcaaccacaccuggcuaauuuuuguauuuugauagagauggaguuuugccaugcugcccaggcuggucucuaacuucugggcuuaagugauccaccugccuuggcuucccaaagugaugggguuacaggugugagccgccgugccuggccucuaguugaauuuuuaaaaguacuuuuuaaucuauuuucucuuuugguccucacgccacccugugaagagguaguaguauuacuuauuuuauagggcaagucauagaaacacagugucaguaugugacuuuguuacuaguaacaguguucgaauuauaaucuagauuucuccucucaucuguuauaguugacugugaauggggucuuuaggaaguugcugugauucugugauguuaucagucagaagguguaaugggaagggcaucaaucucuguuucuuaaauuuggcccaguggugagccaguucauucuaaaauaauuuguauuugcuaaaugcagauauuucucacuuugcaugauuuuaauauacacaauuuucaguugccaugguuaacuaaauaauacuagucccucaacacaguccaaguuucaguuaucauguuacauuaacuauaauuguggccgggcgcgguggcucaugccuguaauccuagcacuuugggaggccgaggcaggcggaucacgaugucaggagaucgagaccauccuggcuaacauggugaaaccccgucucuacuaaaaauacaaaaaauuagccaggcaugguggcgggugccuguagucccagcuacucgggaggcugaggcaggagaauggugugaacccgggaggcggagcuuacagugagccgagaucaugccacugcacucuagccugggcgacagugugagacuccaucucaaaagaaaaaaaaaaaucuauaauuguauaaaaucccauacacuagcacuuccuguuauuuuguucaucagcggacagcaaagcauguagucguguugccuucuugucucccagugauagacccauguagcauuucauaaaaauggauaauuaaaggggagaauugucaaagaucaaagugcaucaaauaaaugaaguguuaaaauuggauuaaaauuuuagcuaauuguaaacagcauucuuaaaaaaaaaaaaaaaaaaagcuuaccaagggaaugucaacucagccaguguucuagaggcucuauauauuuagcuaggagcacuuagugaaagauaacuaacuuaucaaagucaguuaugaagugguugugaugaaaaggaugaagauguaacagaggaaagaugcuggcaaaaaaaaucauaugagaggaacucucacagauauuguauaacugugaaaacacaaaggauaaaauguuggaagcaagucugaacuuagaaggaaguauaccuaucuaccaaggcauggaaaagaugcuuguuuagaauuguaaauuagcaacgagaauaaggcauucccauugaaacuacuauugacacaguuuuuuauaaauaaauaaaacaauucucagaguuucugauguuuuagaguacuaaauaaauauacuuuucauuuuccuacacauuuauagcugauagacaguuuuuacuguuuugacaaaaaaauuaaaggucauagaacaaucauaauauuucuguugauuauuaaaaucauuucauggccaggcacuguggcucacgccuauaaucccagcacuuugggaggccgaggcgggcggaucacgaggucaguagauccagaccauccuggcuaacauggugaaacccugucucuacuaaaaauaaaaaaaaauuagccaggcaugguggcgggcaccuguagucccagcuacuugggaggcugagguagaauugcauaaaccugggaggcggagcuugcagugagccgagaucgcgccacugcacuccagccuaggcgacagagcgagacuccaucucaaaaaaaaaucauuucacaugauuucagcgcgcaugaucacuuuugugguauugcauuaucaugcaaaaugaggacuaccuguauuuauugagccaaguaggcacucuuguaagugaugaggguauaccaacaaaguggacaggccaaaccugccuuuaagaaacauuuauuccaauaaaggcuuauugagugucugcagugugccaggcagcauguacacaugugaaugaauaguaguucguuucucagagaauuuggaucuuaguugacuggugagagacaagaccauuauacuauaacauaugccuauaacauguauaauacauuucugugaaugaaauaauaaugaaacaccaggcauuguaagagccaagaggacaccuaucaaacacauagccugaguguaugagaggugggagaagcagggagacaugccuggaggacuuaggaauuaaucuggaaaagcugcguugaagaaggguacaguggugagaugcuucugcauggaaagcacaggacauuuuaaaaaguugaguguuguugaaguguguaggguaagauaugggccagaucaggaacgccauggaacuuguaggcaauggggagggucuauaggguuuuccccuaguuucuuuuaaauuaagguauaauuuauacacaguaaaauggacccauuuuauuguauuguuugguguguuugauauaagugccauggccaccgugacaaucaagacgaagaacauuuauauuacucccuaaaaucccccagugcuccugagugacuaacuccucccacccccagucccuagcaaccacugauguuuucugccccuauaguuuuguguuucucaaaauaucauguaaauggacucaugcaguauguagugcuuuaauucugucucuuuccuuuagcauaauacuucugagauugauccauguuguugcauguaagaaccuuuggguuuuaagcagaauuaucugugagauuugguuggaggauggauuugagaggagcaagacuagagacuuugauuguauuacaauuuaaccaggugcuaauggaguagagggaauagagaugccaaggaggagcuugguuugagguaggagguggaauucguuucaacuaagguggggaaucuagaaggaaaaacaggugggaaagaggaggcccugcauauuggacauguugaggcugaggagugugggauuguccugcaagucaaccuuggcagggugugaggcauaugaaggaguugauuucucuccuuccuuauccucugaucuuugccaggaucaaauuugcuaggcacugaucuuguuaauuaaagggcucccuuuucucuuuauccuaccauaucaccaccaagaauuugcucccaaggccuugccuuggacuguagacugucauugaaucaacuugucauguuuaaaaggaaugaccucuuuuuuuuuuuuuuuuuugagaaggaguguugcucugucgcccaggguggagugcaguggcgucaucucggcucacugcaagcuccgccuccuggguucacgccauucuccugccuuagccucccgaguagcuggaauuacaggagccuaccaccacgcccggcuaauuuuuuguauuuuugguagagacgggguuucaccauguuagccaggauggucucgaucuccugacuucaugaucugcccaccuuggccucccagagugcugggauuacaggcgugagccaccgcgccuggcccaggaaugaccucuuuauggagugucaucagccaagucaguucaucugugguuacccauuguuuuucacugguaacguaaaaauaucugcggagauagcuaugguuugcuugguccguggaacuggaagucagagaguucaguugucacaaauccaggcuggagauucucuucuguaaagauccuggacauccuuuccaccagaaggaguuuucuggaacuguauguuugaggguacuacauuugaaccaguuugaaccaaaugugauggaauuagugaugaagggacacaauauuacccauauuuaggauguggcugacucaucuugugugcuaugauucagugauucuaauucaguaacgguucugaagcugcauccuggcuaaggaaauaauucugugcuugauuaauauugucuaagggcagggcgcguuggcucaugcuucuaauccuagcacuuugggacgcugaaccaggaggaucaccugaagcaagaaguucaagaccagcccgggcaacaaagugagacccucgucucuacaaagaagaaagaaaauauuaucuaccuuuugccuaggaggggaagcacuguaggaagcgguggccagaguaguuacccucuuuaggugauucaccacaaaaauacacucaaaagguaccggauauagaauaagcccacuaccguaacuucagcuaacagaucauuucaucaucaggauagcuccaugauguaaagcaugucauucuugucucuuacaagugaggaaauugaggcacaaagaggucaaguaacuugcccagugacagacagcuaauucuggcagagcugggauuuaaacucaggcagcguggcuccagaguccauacucuuucaugcacaucaugcuguuuucagaauucuagaaugcuagcaccaggccgacuuaggaaaauuauuuuguuuccccguucuucauuuuacagcuaauaggaguaaagucuagagagggcucugagaugacugacucaagaucacaggugaugguggauggagggagaacuaguuucccccugcccagggcuucugacacucuuggaaguuuuguaccuuugucuugguugcuugucaguuucacaucagugaagagagauguugcugaaguaggcagacuggcaaaauugguguuuaauuccauucuuuacuuuggccucagcucucucuugccugggaauguacuaauuggcucucuuccuguccccucugccauuuauuauuuucaagggagccuggaaucacuguuacucgucucuagccuguccuguuuaaucacugauugucagaucuuuugcucuuuccagucccuucccacuaagaaguaggagaggggagaaccugcccaaccacguggguuuggggugaguuuugggaugggggaagggaauuagacuguugcagggugggaguuauugugccgcagaucaaugaccuucccuugaggaugccacucuuugugguuuugcucuuucugccccaccuguaucacagucauccuguggguucccagcaggacucugccccccacauuuggggcagggccucucccccuuucugcaguugggguucagagcuagagagggaguucugacgaaauuugcuugccccaugcaugcauucucauggaacccugauuauaugguauccgggacagaaaaggguuuacauuucauaucuguuguaacuuuauuuugaagagccacaguuugggggauaaaguaauuuucuuuaauauuuguugaucuuucucuuaaagucucguguguaagcuuauucagguagagacugacuuuuuuuuucccuccguuucuucuguacugggucuuuguauguaaaauucuaaguccuguucuagucuucuuccaccuacccaggaaugaaguugaauauuaaugcaccauggucaccauucuccaauggcucagucuuucuccacauuuucuauaauuaagacuguccuucccaauuucaacucaaaauaccugaaaagacuccuuguuuaguuaagagaaagcaaauuuccccagguaaguucccauauguuuucuguaaaaacuagcgcacacuuucuuuguauuuuaccucugucaaaugagauucuuagaagaguaaucagccauucuaagccacuccacucuuuugacuuauauuuucauggguaauuuuaacucuuugggugcuguccagaaaguuuacugcugcuucucacaagggaaggugucugugguucccgagacuacccucuuccugccuuccuuucagcuuccucagaggaccagcaagcuccaguucuucuaaauaggugcacaggcccagagguggauuuuccuucaaggcccugggaaaaggccccagcaauguguucacauugccauuuguuucugucaaguuuuuguguauuuuuauuuuugcauacuuuuuuuuuuuuuuggagacagcaucuggcucuguugcccaggcuggagugcaauggugcaagcuugguucacugauuuacucaagaauggaugcgcccagccugcauccauucuuucguaaauaaauacauaggcugggcgugguggcucaucccagcacuuugggaggccgaggcgggccgaucaccugaggucaggaguuugagaccagccuggccaacauggugaaaccucaccucuacuaaaaaaaaaaaaaaaaaaagccggguguagugguacaggacuguagucccagcaacucaggaggcugaggcaggagaauugcuugaaccugggagguggagguugcaguuaggcaauaacgagccacugcacuccgaccuggguggcagagcaaaacucugucuuaacuaaaaaaaagaaauacauagcaagaauuuccaucaccuuaaguagucaccugauccccuuacuuuccccguggccucaguuuuugcaguggugauaucugugaaauggagaacaacuguucauccacacuauuaaacaggaggugaaggcccucgcacaaaccugcccagugggauacuuuaaggcuugggcagucuugucuugcacugcaaugagagcauaaauguggacacauauuaaccucgccuaguggguaguuggguucagcacagguggguuuaaaguucccguucuuuucuacaaagugcaaacacauucccuuuccaaaagguacacuggaagcugucuuuauaaaaugcuuuguagcauaagcacauacagagaauacuguauucauacuguauuaaucagccucuguaaguguccauucucugggucucacgggcuuaaaaacuugaaugaucgucaucuuauuucuucuuccacucuugucauuuaccaaguccuggaaguagauuguuuuaguuugcauugccuucuggaacaguccucuccuuaaaagaaaaagucucauuauuauugcuccgcaguuggagggcaggggagugguuuauacugugaguucacaucacucuuuuaacuccuuuucauucccacugaccuacuauaggcuuguugcaguaccugcccacuuuaacuuuagacuuucucuaggauacucuagugauugagauuggaggcuuuuaaaaacaccucugacuuugccagugcucagccccaaaacuucauuuauugcagacucucuguauucagaguaagcccuuaccucugugcucaguaucccuccuugaguguaggcuugcuuaccuuucuaccuccaucucuuucugacacucuuuugauauuguguccuauccauauuguuucccaggaauaccucuuauuuugcagucuuuuucuuaaggcacuuauuacuuugucccuugugggacaauuauuuguacauuuguauagcgcuccaaacuagauuuagaaauucuugaaaauacuuuauuuacuuuuaguagugguaguauaguaguaguagugguaaauaguuaaaaaaguagcaccagacuacugcaaagaccuuagggcaacauccccugaauacucugaacccuaauuaucuguuugcacagcugucuucccugcuacauugugagcaacuccagggcugggacugugcucccagaaucuccagugcuacagcaguguggcaggaaagucuuuuugacuaagaagauagucauguuuguuucuuauucaugugaugcuuuccuccauuccuugaauaggaauuuuuuuucuuguuuuaagcagaaauuuugccuuuuucccaaauucacuggaaaaaucggaugcuauuccacuguuaauugaggugucacuaauuacuuugcuugaaauuucaauuauucuaaaaucuuccaacauuuucauauauguaucgauauuuuaaaaauauaaaagaauuuuaaaacuuacauuuggaaaauuuaccaauacaguuuuggcuaauuggguugucaguuagccaaagguuagggaugauugaucuaguuuaaauauagcuuugcgauuucauugaaauuacuuaagaaaaaauauuucuagacagcauggaagaaaggugaauauaauagugguuuaaaugaaguagagguuuaauuugugaauuaauuuuugagauuguuauagagauacugugaucaagugcuaagucaauaauguaaagcagugcauaucauuugaagcuguucccaaauauaucuuaaagcuaaaucaauauuaaaacuguccuaaauaguaaaauuguuuaaucauuagacaaccugagcuuuauguaaauuuguagacucuugaaacuugucguaugcagaagcguaagcguagcuauaacauaagcauaaaccauugugauuugcauaauuuaucucuucagcauaaauauuguacuuguagaguaacauuuuuguccuggaaaucagauuuugguugucugaguauuugugggacuggaggagguuuuagguuuauguuuguguuuagauuaaauuugaauggugaguuaagauuuauggugagcagugugcagaauguuuuauuuacuuuuucaaagcuuaugaauaaaagcaacaucugaaucugaucuuugggaaccaaguucaggaaaugugguauaaucuauuuuaauugucucccuuaauuucaacuuacuucuguuuauuugcaaauuguguauuuaagacauuaacauauuuaauacccuguuauuggauauauuuaacuuucuacuagcuucaugcuuucagaguuuugaacucugaaaacacaagcagcauuaagaccugucuuuugcuuaaaguacugagugauuacacuccgauguuuucauuauaugaaacaccccugcuuuacuucagaguaaaugcuucuaagaauuaggcaugccuagcuucuaagguagacuauucacuuacucacucauucauuaauacauucacuuuuuccaaaaaugaauauuccauguucauacuaugugcuaggaaugauaguggauauaguagugaacaaaagguagacguuucuggccuucagaguaucuuagagucugguaggggaggagaauaugaaaccaggcaaccacaguaccacguacuaugauaaaugguguggaaccccuaagcccagaguuccaucggcacauaugugaguggugcccaaagucuuccuggaggaagugacaccucugccucuuuauucuucagagucagccaguggaaggggucuaggaaggguugcuacaaaugcuucugguacaaagaacaacauugguaaaaguccagagaaaauagagaagucagcacauuagacuaguauguaaaaacuuuaggcaacuagaacucaaauaacuagaacucucauuuuggcucagaaaaauuuuccucugcauuuuacuugaugaggagaugaaaaaugacuacaaacuuauugauuucuuaccccgauagaaauacucauuuauucuaaaaaaauuuaauuauacaaaauuauuauuauuauuaucauuauuauuauuuuuuugagacagagucuugcucugucaccaggcuggagugcaguggcacaaucucggcugacugaaaccucugccuccugggucccagcaauucuucugccucagccucccgaguagcugggacuacaggugcacgccaccacguccagauaauuuuuguauuuuuaguagagaugggguuuccucauguuggccaggcuggucucgauauccugagcucgugauccgccccccucggccucccaaaguguugagauuacaggcaugagccaccacgcccagccuauacaaaauuauuaaaaauugaaagucauaauaauauuauauagauaaucuuacuugucauuuuguaaauauccuuaccaguuuucuccuuuccaucuuugguuuuauaaaauugagaugauaucaaauaugcuauuuuguaacugauauuuuacaguuaacauaaaaagcacauuguguucauaucauuggaaguauuuguaaaauaucaauuuuaauggcuguauaauauucuaucaucaacuauuauucauuuauacaucauuuauuauauauuuuccaauauacuuguauuggaaaaguagauuguuucuaacuucuuguuguuuuaaaaauucugccacgaauguguuuauauugaaacauuuaauuaaaucuuucauauuuccuuucagcacuuugggaggccagggcgggcagauugccugagcuuaggaguucgcgaccagcaugggcaacacaacgaaaccccgucucuacuaaaauacaaaaaacuagcugugccuggcggcuugcgccuguagucccagcugcucggguggcugaggcaggagaauugcuugaaccugguagguggagguugcagugagccacgauugcgccacugcacuccagccugggcaacagagcgagacuccaucuuaaaaaaauauacauaauaauaauaauaaaguuauagccuuucuucugugccccugcuuuuuuuuguagguaugcauugucugccaccugccuccaauaucaguccagcccugaucuucagaccuuuggugcaaauuugaaaaugaaucuuuuuuguaucuguucaaguaaaagcguaucagcugaacaaaauguuacguggcuggacacaaaacugaaggguaaugucguuuugcauuaauaaaaacaugaaacaauuagaucccauuuuuuuagagugcccacucuaaaaaaaagaagucccuggauaaagcguuuuaucuggagauagcuucucucucucuuuuuuuuucaaacaaaggaauuauaucuuauagagaauuuucuuuaagugcaugauuaaguacucuuuuugguuagugaauuggaauagaucuguuauuaaauaaauaccucuguagaguuaagaauuaaaagaaaacuggacuuguuucuuagguaaaguaaacauuuuuuuucuuaaagaugucaaggauguuucccacauagcaagguauucuaucuuaauacuagaagccacuugguuuacagggguuuuauuuuuugcagauuuuuugcucuucuggggcugaaguccuguuguuuucaucuguuuauccuguguuugccuuacuguccaguacaucauagauaaccaauaaguguuaaaaaagcccaauacuuuuuaaaaagcuuuauugaaauguaauucccauaauauacaauucaccuacuuaagauuuuuuuuuuuuaaggcggagucuugcccugucgccaggcuggaguguaguggugugaucucggcucacugcagccuccgccuccuggguucaggcgauucccuugccucagucucccgaguagcugggacuacaggcgcccgccacuacgcccagauaauuuuuguauuuuuaguagagacgggguuuccccauguuggccaggauggucuugagcuccugaccucaugaucugccagccucggccucccacagugcugggauuacaggcgugagccaccgagcccagccaagauguuuuuauuaguuucaguaguuuuuuuuuguuuuuuuuuuuuuuuuuuuuugaaacgaagucuugcucugucacccaggcuggagugcaguggcgcgaucucggcucacugcaagcuccgccucccagguucgcgccauucuccuaccucagccucccuaguagcugggacuacaggcacccgccaccgcgcccggcuaauuuuuuguauuuuuaguagagaugggguuucaccauguuagccaggauggucucgaucugcugaccuugugauccgcccgccucggccucccaaagugcugggaucacaggcgugagccaccacgcccggccaguuucaguaguuuuuaguauauugucuaacuaucacuacauucaauuuuaaaccguuuuuauuaccucagaaaagaaacccguacccuuuagcuuucaccuuccuggcccccccacaacacugccauuccuccagccauaggcagccaccauaaucuacuuuuucucuauggauugccucuucuggacauuucauacaaauggaauuauacuauaugugguacuuuguaacuggcuucuuuuuauauuuucaagguucauccauguugugccauauaucaauauuuuauuauuuucuuugccucuuaauauuucauuguauggauaggucacaguuuuauuuauccaucaguuggucaaucaaauacuuuuaaauauguaaaucagcuugggugguugugccuuauaaaggcaaaaaugaagguagaacugaaguugugauauccuaaauuggaaaugccuucagagcuuguuagucguuaagguauauauaaguauguuuagaauuaagcuuauauguuguuggguuuaagauaauagcacaucaaucaguaggaucuugucaguuuuaccucuuggauacuucuuaaaucugcuuucuucuacuuaccucugguaacuaucuaaucaaaaucuuuuuuuuuuuuuuuuuugagagagggucucucugucacgcaggcuggagugcaguagugugauacuggcucacugcagccuccaccuucugggcucaagcuguccuccuaccucagccuccuuaguagcuggaauuacaggugcacgccaccaugcuuggcugguuuuuuuuucuuuucuuuucuuuuuuuuuuuuuuuuuuuuacaauuuuuguagagauggaguaaccuagguuggucuugaacuccugaccgcaagcaaucaaccauccuuggccucccaaaguacugggauuacaggcaggagucugacaucuaauuaacaucuuuuguuugaacauugcauuaccacugccauccccaaaagaaggcaaaaggagcauuucuaaaaauaucguuuuauguuaggggucagaagucuuuaacauaaccugcuuggcugccuucacaucagacccuugcugccuuuccccuuccucugcccuccuauucuuuaauacuuguuuuguauuuaacagaggauaauggaguccuuucugaaguuguuugggcaucugagauuucagcuuauaccacuuugagaacuaugcauuaaggaucucguuugaagccuugugcaguggaaagagcucaggcuuggaagucugguaaacuagguauaggcucugcgguccaaugugcacuagaagugugcuuguuccuuuugagccuuuuaucugcaaaauacagaugcuaccuugcaaguuguugugaaagagaaauaaugugaaaguaucugacacauaauaugugcuuaauagauuguccuuucuguuucuuuuuuggauuauuguuuugaaugaaguggcuuaggucaucauguuuuuuuggcugaaaagaaggauuuauauauauuaugaucauuguugguaguuuggggguuuuuucuuccaaaguuugugucuuuguuucagaauccuguuuucaugaagacucuggaauuuugucacugcucuaauaccucugccaggcagcagcacuccuuugggucucugccaauagagaacaucauuuauugccuuaaaaagaaaguauuuguguguauguaucuuuacaauauccucauuaugagaguaauuguaguauuuguguguauguaucuuuacaguuuccucauuaugagagucauuguuuuucauuuauaaaauaggaaaaugcagaaaauagagaaaaggggaggagaaaauaaaauucauuugccauuuagucaccuacuguggccauucuaguuuauacuuuucuagucuuuauucuauacacaucuacauacauauauguuaguguggcuuuggaaguagaaguuagauaauaguauguguuuuguuuaauugcuguuuucucauugccaguauagauauuuucaguguuuaguaacauggaauguauauaauuuuuuuccggucucagagaauuccauuguaugggaguaccauacuuauugucaccacuucucuuugggaggacauuuagguuguauccaauuuuuuguuauuauaaacagugcuugcuuugauuuuacagucaugcgugauucugacaugcuuuuuacauccuaacaguucuuuuuuuuuuuuuuuuugagauggagucuugcccugucgccaaggcuggaaugcaguggugcaaucuccgcucacugcaagcuccgccucccggguucacgucauucucuugccucagccucccgaguagcugggacuacaggcacccgccaccaugccugguuaauuuuuuuguauuuuuaguggagacgggguuucacuguguaagccaggauggucucgaucuccugaccucgugaucugccugccucggccuccuaaagugcugggauuacaggcgugagccaccguguccagccccuaacaguucuuaugaaauaauuucccugagguuugaugauaaauucaauucaaauuugcuccucauguuuuucacaggucuuuugaauauuacaacucauguggcagaaugucccuguucuccuuuuugcucuucaucugguacuaguuuucuaauguguucauacccccacauccauuuaccuuggcuaagacucuucuugccuuugucugccccaaaccacuguccuaucguuuauuuauuuauuuauuuacuuuuauuuuuuaauuuauuaauuaauuauuuuuuuugagacaggagucucacucugucgcccaggcuggaguguaguggcgccaucucggcucacugcaaccuccgccuccuagguucaagugauucucuugccucaaccuacugaguagcugggauuacaggcgugugccaccaugcccagcuaauuuuuguuuuuuuaguagagaugggguuuugccauguugaccaggcuggucucgaacuccugaccucaggugauccgcccaccuuggacucccaaagugcugggauuacagaugugagccaccacgccuggcugccacuguccuaucuuuuaaagaaugauuccuucauauucguuucuuucaauugacccuuauuauuaacuucauuaauuuguuuccuucguguugcccaucauaucaccucaaauuuggaauuacuuaaguguuuaauuuuuuaaauuauucugaaagagagugcuugcuuucuuucacauaacagaauuaguggagugguuuguauuaugcauuacaauuaaaauuacgucuuuacaauuaauuggcuguugcucuaaauugggauauuucugaaguuauuuuaaauccaggacuguuuuucuuuccuuugugucuguuucuugccuacagcuaguugauuauauccuuaaggaguacuagccauuuuaaauaauuuuaaucugaauuuaaauaaaucaagguggcugggcgcugugggucaccccuguaauccuagcacuuuuggaggcugaggugggcagcuugccugagcucagagguucgagaccagccugggcaacauggugaaaccccgucucuacuaaaaauacaaaaauagcagggcgugguggugggcuccuguaaucccagcuacuugggagacugagagaggagaaucgcuugaacccaggaggcgaagguugcagugagcccgagaugguuccauugcacuccagccugggcgacaagagcgaaacucccucuuaaaaaaauaugaauaaguaaaucaugguguguauucuaaagccauaguuauaaacuugagggguagguaauacggaggaguuuccugcagguccccguggcugaaagucagcguagaagugccugaccuggucgggguuccacuucuggucucaguccugcugaggcagcagcugcguuggucagguagguuuugguuuuggacacaguggcccaccgccgcuguacauugcaggauuauuucaguucaaaaugaacugauugcugagcuccucugcagccuucguguugcaaggacuacaguuuguggaggcccggcaccaccagccucauugaggacauugacaaaaaauacuugguccugcuucaagauggaaggacacuuaauagacuuaagaaguauugaucaauuuggacuuggaaaaugagaaugacacaccccuccagcaaguauccauugaagaaauccuagaagaccaaagcguggaccagcagaccaggcuggaaguagaggaacugaaaguucaggcccacugggaucaaggucuuuccauuccuugagcagauacucuugaugaguauuaaguccucugcucagaagcuauugcucuugaagaguaagggcugucacugaaugaaacugauacccugguuaccucacacauuugaccagggacuguaguguuucugaaaaaucauuuuuaguuuuaauucuagcacacauacaacaugaagaaaucaugggaguuuuuuuuuuuuuaauaacgaaaucaguguuuaaggaaacagugguauggacuccuucacuguggagccagcagcuacuucuguauauugcucuucuuaucccaaauuagaguuuauaggggacauucuucauuuacuuauaaauaaaauauaaaucucaaaagaugccaugaaucucaaaaagcgauuaaacuugagcaugcaucaguaucacuugcuugucuuguguaaucacagauugcugggccccuacccccaggucuuuugauucuguaguggucagggucugauaauuugcauuccuggcaaguuccuggaugaugcuguugcugcuacuugugagacacuacuuugaaaacaacuguucuaaaggaaccuagaaauaauguuugcauuaucuguauuccuuguaauuacauguauuuuuucucuuuacuguuguacaugacagauauaacugagcauauuuuaguaaaagcaaaaacaaauaaaaaacgcuucauuggcaaaauacaagagggucacuggauaacagauauacagucuuuugugggauaggccagcagauaaggcauccagaggcuuaaagcacucaggguccuggguuguucagcccaaaacagguuuccuuaaauauuuuguagccuuaguuuuuuuguagaaaaauggcgacugcuaccagaucucucuggacccuuuaacuccuaaaucuguagucagauauucaguauguuuaaacaggcuuacaauacugcaaauaucuugauuaagaaaugcuuguauguuuuuaguaaauguucagaguaauuuaauaaaagccuuauuuguaaguuuuaucacaauggagauuuaaaaguuggaugaggaaauaaacauugaaaucauagauauuccaaaugucuuucgaagccugagcuacagcacaagcuauggucuguaugucaggccugauagaauguaagguugagcccagaaaaaaggaggugguuacagaaauuuuuaaauggaaucgaaacugucauuggaugcauuugguucaucagauccagauucaguucgaugugcaguucugguuccuuaucagauguaacgaauaguaguuguacuuauuaguauacuggcaauuuaggccggacacgguggcucacgacuguaaucccagcacuuugggaggcugagguggggccgaucacucgaggucaggcguucgagaccagccuggccaauauggugaaacccugucucuacuaaaaauaaaaaaauuagcugggugugguggcggguaccuguaaucucaccuacuugggaggauaaggcaugagacucccuugagccugggagacaaagguugcagugaucugagauugugacgcuguacuccagccugggcaauagagugagacugugucuuuaaaaacaaaacaaaacaaaacaaaacaaaaaaacauacugucaauuuggaccuuugggcuugaaguuuuuucuauaugacagcugagauugggggcgugggauaauaccaucugcaacuuguuggcaagcacauuauuuguauucaaauagaaaggacguacuguuagaaaaugcgcaaagggaaaaaggcuuuuguagaggucauuuggcauguagguguaugaaaggugaggcuacagcaacacccagcagcugauaagaccauacacaguguaagaugaacggaaaguuuccuccaagcaccuugggcucucauguuaagacuugguaaaaagguugcugaugcuucauuuacuguagcgacaagccccuuuaucucagcggcugucaaugugaguuggaauuucacaucuuuuuaggaagucuuuuggaccauuuuaaaauuauuauuauugcacugucccucaccuuuuuuuuuuuuuuuucugauugcaugacguguaguccucuuuucuugucagcaauuaggagaaaaaucucaacagaacgagaaaaccuugugacgcugaaaagauuugccugaaguguuccauguaagcagugggaauggacauacacugaaagagagaggggaaaaaaggcuuuuuguugagagugacaggcaggcaggaugagcaaaguuuaaccuaaauccuuucauugauauugcaaagucauaagccuucauaugacacugccacauucaacucacuguaugaucuggaguucaguagcuuguaccauagugcauguguguguacagugcaaacauuuuaugaacugcagugucugauccauccgucugucugggcaagagugucccuugauaguaaaaagaacagcaaucaggacagaauuggucaaugcggcaugucuaauagugggaagauauuugaaggacucacuauagacacaguagucucucuaaauagccucuuugcacccggagucuuauugcaaacagguucauuaaggagagacauucugacacacagcaucacaguaaugaaaguagcucuguuuuucuaauauuguaucuugccacuucaguuaggcugcuaguacaagauuucccuuguguuguuguauguuucuccagaaaaagaaucagucuucauagaauauacaauuauuuuguacgggaauguauaacuccuaccuaagauccagucuucccuguuuaugugcacuagugcaaaaauaauuggcaaacacauccuccagaccaaaagauuccagcaccuucaauuuguugggcuugaagacguugaaccaguuauaauaaacuuuaaaaaaauguguaauguucaaaauggauuugugaucaaucauaaaagacaaaaaaaaauuaguacaguuucccaugaggugugagguuuuuuuucccuagguuuuagccaacuucauauaguaucaguucaaagagggggaaaaugcaaaagguuuucaucuacuaagcuuuacauauaacuacuauaugaugacuuaagcuauuggauuuucugccuguuaauguacagcgugaacauuaugaacaaggaaaaaaauguuauauugguuuaaaaguggauauggaaaauuuaaugugcucaagugggaacaauggcauauuaaaaaaaaacacucaugacacagaucuaauaauucacuugccccuguaggagaaggguaucaacucugauacuggcucacaguuuauuuuuauauacaccccuggucccugcaguauaccccguguguggguuccagagaaaagaaagaaaauaaccuguagggaaaucagccuggaaaccuuucauuaaauacauuguacuuuguauugugucuuucacagacucuucaagaaauaaaggaaaaaccuguuaucagucugcauguguaaaauauuguauuugaauacuaucauuuguuuuaagauuaaggcugaggcugcagacauauuaguuauuauucacuuacaucugguagauaaugcaacagggauuuaaaaauucuuuuuccauuuauagucccugccauccuccccccaccaugaacuguaaagauacuacuuuaacuuaaaacugugcuugcuaaaauauuucaauguuggaaauguugccucuuuauagaggauuaggguugugaggguaauaaaaucagucuugaauuucuuggcggaguuuaucugucauuuagcaaaagaugccuuucuagggaaaauugaagaaaguguuaaauacauucuuuuaugagaaaaaauauaaaugguaagaguguaacugugaauagugacaccuuuaucaaguugaauguccuuuggagugaggcuuugucuugucauuauaguucauguauugcuguuggugggcuuuuaaaaucuauaaacgucuuaucuuuuuugcugacuauucaugcaggauaugcuaggcaagccaacugugacacauacucugccuauacuuguagcugccucuuggaugaaaaugaacacauaucuuaaaaccaaaccuugggugccauauagcaguauuuaaugaacuucugggauugcagacaguaagagccaaguuuugaucucacauaccugggaacacauuguccuacacaaucuguugaaagauuuauuauuucugaaguagcuuguguuaaaaaccuuguuuuaaguauagaggguuguaagccuaucagucucagcaaauugauaccuuuuuucacgucuguuagacucagugccaccucuuguccugaggacagauauagcacauuccacuccauauuagguauccuugcuaagaauucuuuuuuugggggacagagucucgcucugucacccaggcuggagagcaguagugugaucuuggcucgcugcaaccucugucuccuggguucaagcgauucuugugccuuagccuccugaguagcugggauuacaggcaugcggcaccaugcucagcuaauuuuguauuuuuaguagagagggguuucgccauguuggccaggcuggucaugaacgccuggccucaaguaauccaccugccucggacucccaaacugcugggauuauaggcgugagccaccgagcccagcccuuuucuuuucuuuuugugacagggucuugcuuugucgcugaggcuggagugcaguggcaugaucucgcuaucuuggcucacugcagccuucaccuccugggguucaagcgauucucccaccucagccccugaguagcuggcucuacaggcgugcacuaccaugccuggcuaauuuuuguauuuuuuguagaggugggguuuuaccauguugcccaugcuggaaaaaaaaaaaaaauucuugaaugacuugaggguaggguuuuugaaaaauagaggugugcuguuagauguagaacuucucaggugaaacagccccugggugauugguuaccauggucauuguggguaaacuccugauuuggaaguaguugcuccaguauucauaugggucauuuugguuccuuucuggcuucagaagccugucaauugaguucuuaagccaaagaccaaguuaauuuagagaugucgaugucaguaauuuaccuucugauugucagugaauuauuuaagaaguaucuuacuauuuuucuaaggugaaugagcuuuggggagagguuuuucauaaccaccaucucuguuuuaccugaauagaaagagcacaaucagcccauaucugugacuacacaggguuggcccugaucuuaggguggcaguggaugagcauccacugucaacucuccuguaucucuggguguucagugccucgcauucugagauuuggcccauaccuuccagguuagcauugagccaugggacuauguuaguuuccucugcuguugaacugcuuuaggaagaaaagaccuccuuguuucuggcggugacugcugggccuuacauucauuuugggucaaguaauucauugagcaaaaccguaggcuguagguuagguauacagcuucuccuccccauaggguuuguguaaauuucccaaggccugggaaauuucucuguaauuccggagggcuccacuuauccuggagcacccacuuagagccugaaaaugccacagguuggucuauacuucacagcaucaggguuuucucacguuugcaagcuucaaugacaagcuccacccacaugaaucuuguaagugguggcagagcuugcuguuauccagugcuuauugugugccaggcauucugcuagaugcuuuacauccaucaucauuugcucuuuacauuaagcuggcgacuuggagacuacuuaccucauuuuguagaugaggaagcggugugacuaguaaggggcaggcagcacugggauuuuuagauccaagccuggucucauucccagguccguggccuuugacaucacauccuuuaagcugcauggccucccugagcucuccuuuccguuggcucucaugccugugcaaugauuccgucccugauuugggguccugucacgugacccccaucacuuauuaaccaggugacacuguuagucuuuucacugacugaguggcauuuucccugucaguaaaaugggagagaaugauccuucuucuuuaaccuguuguugugaggaguaaaugagauaaugucucuguuauuuauuagacaccuauuuuaugcuaggcacugugcuagaacuuccaguacagcagugacacgaacagacguggucccugcucaugaagccugcagaccuguaggcauggcaagacacuuaaacaaaaagcgcacuuaguuuugugcuauaugucugaaucauauauaguuguuaaggcccaggaacuuugacuucaaguuuaagcugcagccucagcaggcacuaugcuuuuccaggguccuauuuguaauucuuacagaagacccguugcuuucuuuuauguugccuaauccucuuccauuguuccccauuucaggucucuggaagucagaaaccuggaaguuccgcccccuaccuacuucucagcuucuucuuccccucuucuauucuccugccacugucugcgccauuugucuguuucuuaagguuuccugcucugcuuucugucuuucucucguuucugaacccuguuuaaauucaacgcuugauuuaauaagaucuuagucuagucuccauuauuucaagucauauaucgcuuuugauaaauugucuuuuuaagcacuuauccuaauuuugcauuuguuuauguaggcaguuuuucuguuucuccaauuagacuaaaaguucuuugaggguagggaccacuucucugucucucugguaccuaucccagcugcuugucuguuuucaaauacuuacugaguuagguuggauuccaccccccucauucucuucucuggaucagcucuuucucuuucaucucuuugccuagcauuuucauuuauucuacuaacaugugcauuuggucuaucaaauugaacauaucccaaacuaaacacaucuccccaacucugcauuuuuuccuuauuuccaauucuuguuaaaugucucuguugccauuauccaaaucccuuuugccucaguuucuuguaacacucccguuuucucaccaucuucugaauaggaagauugauuuaaggaaagauuccuuggcaucucucauaacuucccuaccuucacugccacuacuugguggcucuuacugacuucugugucugaauugcauacacuggccugucauggugguucacgccuguaauccuagcacuuugggacgcugagguggguggaucacgugaggucaggaguuuaagaccagccuagccaacauugugaaaccccgacuuuacuaaaaauacaaaaauuagccaggcgugguggugggugccuauaaucccagcuacucgagagacugaggcagaagaaucgcuugaacccaggagguggagguugcagugagccaagauugugccacuucacuccagccugggugaaagaacaaaacuucaucuaaaaaaaaaaaaaaaaaaauugcauaaccugccucuucacuucuugcccugauagauuugagcaugucggaucuuaaaagucuuugauagcuacugaaguauucacuagugaaauaaugucauguuuuggauuuucuuuaaaauuauccaguggaggagagagcuaaaggggauuuugggagaggugaaacaagacugaccaugugcugauaauuguugaaguuagguagugagacucacagaggggcuauuauacuguuuacguuuguauaauacauguuugaaaacuucaauaauaaaaauuugaaauaaaacacagcaaauuuuggcuuuacacugucuauagauaauauaugaaccucuuggcagagcauacaacccucucauacuuuuuccccagugccucauuuggcuucuaaucucccucaacucuguauacaggcugacucuacucugaagccauuucuguccucagcauugaucuccggaaaggcucagcucuacaaaaaaaauccucccuggccuaauuuacuagccugauuugaguuuucucucccauaucccuuagcauguaccgcccuuaggggccuuucacauuguauguaauuguuuccuugugucucucugagcacugacccccagccaguuuuaucccaguacugaggacugcccaaacugagaagguucuccccagccugccaguauuucaguuuaauacucauugcaugccuacugaguguugggcacuugaugaauacuugagauuuaauugacugguugcuucuggucuauaauauggagagagucuaccaucuggcuuucugggcugacguuggcuguacauuucaucccucucccucacucuuacgaucuuccuagauucuccuuugggaaugaaguauauaauguucagagaugcuuagguagacuaugccauguaagguagccagauagugauuggcaugucaaaacccuuuguccagucucuucuuaauggugacuuuaaaaauuguuaggcucuguauuuacacuuguuaagucccucuuuccucucuuugguucaucuuuacuccauaaaacuggguaggggaguuguuuuuuuguguggggagggcaaccuccagccagcuuuuugugagagcccacucuaaagccccuacacuagacucuucaggaaaagcaaaguaaccuucccaaaccauuuaauucauuucacuuauuucuggccauuugaugauuccaaacuccaacaggaccuguagcccagagguaaaaguagaagauguuuaaaagauuugagaaaugaacuaauuuuuguggucuggagaaguaaagaccaagguaugaguuaaucacuguuuucaaacacaugaaauuauuuugcauggaagguaguaccagcuguuagccauuugagugaaaauaaacaaaaggacuuagauugcagcuggagggauuuuaguuagauagaaauuuuucauuaagugguucugggugggaacuggguucccaucccaguagauuguugauuuagguccagauuggagggcaguggggcagauuugaggaauuuaagcauccugaaaaucaguccucaugauuaaaaaaucagcagcugcgaaugcucuucguguucagagcugcagaaugaggauuccccucaucccucccaccuucccccaaguugaaagaaauuaaccucaauuaaaggaaacagugauggaugguugcagagauaaguaugauauaucacacaggaaaaacuacauuaaaagcacauuaaaguugagacagaaagcacuaaaagugaagaaauucacaguuaagguugaaaagugauaucguuuacaucucugcuaauauggagaccuaacaggguacacuuaagaaauuaugagugccgggcgcgguggcucacgccuguaaucccagcacuuugggaggccaaggcgggcggaucacgaggucaggagaucgagaacauccuggcuaacacggugaaaucccgucucuacuaaaaauacaaaaaaauuagccaggcgugguggcgagcgccuguagucccagcuacuccggaggcugaggcaggagaauggcgugaacccgggaggcagagcuugcagugagccgagaucgugccacugcacuccagccugggcgacagagcuagacuccgucucagaaaaaaaaaaaaaaaaaaaauuacgagagugcccuguugugcuaagaaguaaguuuuuugacuucacauacuaagcuuaauacacaguuucauugcccagcuuuaauuaaggcaucauucaugacugauuauagcccauggaaaaaaaccuguuacuuuuaccaaaagaguuugggguugguuuuaaaauuuagcuuuggaggggaccagguggugauucugugacucugugcauuucauuaccuaacauauuucagcuuuucuaaagucaaauuauuucugcuuuucuaaagucaaauauuucuauuuaaaaggcacuaguuuugacuaaaauguuaauaauaacagauuuaauaauauugaguaauauuguuuccaucuguuuagaaaccaaaauuuagcuuuuaucccuucauuucagggguggauuuuugcuucuccaaaauagaucuuaaaucuuauguguauauuuuaagcaaauuauuauugcauuuuaggagucuuagccagaauaaaaucugauuacauuuucaauucauaaaauuacauugugaccccagaaaacauccucuaauugcuuuaguuuuuaccuaauaagacugucucuuuguguauguuuaccauauuagagacaaaaaucccucaaaugggucuagaauacuaaauauuuguguacgauagaguguggauaguacaaacguccguccuuagcugcuucaucccuugucugacucuaaagaguuguuacuucuuccuaaaccaagagccaagauggaagauauaaccuuccaaaaaaucagaguauaugccacagcggguuucguauccuuacagaagauguucucucucuccuucuuuuuucuuccuucccuucuuccccaucccuccucccuccuucccuccuucuuucccucccucucauuuauuuuugggauaauuuugaguucuuucauugaccauaagcuuauugugaagaacaaauucaguuuaucaaauuuagcuaccaaaucuuaaaauuugauuuuuaaaguagaaagauaauugcuucuuauuaaaaaaaaaacagacaaauaaguaaaguuaugucaauuuguauaauuccacauuaaugagcuaguacauggguuaaaauguuauauuaguaguuucaagaaaggaaaugugagcuauaauuauuauauguuuucuauuuuuguuacauuuaaggugagucuuguaaaagggccaaugaaauugccuuaaguaaaaugauuauuaaccaauacaauuuauggcauauugacuuggguaauauuaauuuggguacaugacaggauauauacucauggucucuugucacagauuuuuagguuggguuacuuaccagaugaaugaguuuguguuuccacuuaauuuuuuuaaaguucaggaggccaacaauuugacagauuugaaaauaaaaaugaaauugaggucacuuuuuuucuaguggcuacuuugguaugccgugcauagacucuguuucuuaaugcagaaaauacaaucuuuaugccuguuuggaguuucaaauguaauauaaaugucauguaucaucauaaguaugcaaacauguuuuaaaacacagaauuguauggaagcaauuacuggcagugagugagcuacacaccccaaggguggguuggggccaaaaaaauuaaaguuccuaaacagaauuacuuuugugugggugggaaagagagagcaauguuaacuuuuauuaggaaccaaucccagcucuuauuuuaauucucgucacauacuugguaacucaaauaaauagguaguaaagggacauuaagggacuuuguguuaggauuaguuuuccccccacuugcuauagucuuccgguagggagugauuaguguucagcaggagggccugguggacaccagugcauauauagcucuguaguuuucaaacacuagguguugguuaaagaugauguugccacccuuugugacaugguacuugagcauucuuuugcgggguguguuguguucauuuuuagcagaaugaaugggauguaggaagguuagauuuuaucauuggaaaguaacaugcuauguaguuuucugccacucaccacuagccuggagaagaccugaaugauggguucucccucuugaccccuucaugcuguauguuuuauuuguuuccuaacuucauauaaaaucacuaucaucugaaggugaugaugguuuuuuuuuguuuuuuugagacagggucuugcucugucacucaggcuggagugcaguggugugaacacagcucacugcagccucaaccuccugggcucaagugauccuucugccucagcuucccauguagcugggaccacaggugcaugucacuauggccggcuaaguuuuugauuuuuuguagagaugggguuuugucauguuucccaggcuggucaugaacucuugggcucaggcgauacuccugucuuggccuccaaaaaugcugggaauauacgugugagccaccaugccugacccugaaggugauuuugcauuguacuauuuuguggggguauggaccacaaaaauggaggggaacggaauuacucucuauaaaaauaaauuuaucuucugacauucucuggagcccuuugcuaacaagguuuaaauggaucuuuuuucuaaagcccuuaucaccauaaccucucagcuagagagccguuuuggguucaacugcagguugagcugagugaccaucuaagcagcacagggacuagcagccccuuaacugugaucagaacaucacuguauugauaagugagucuuggucaagucacuuaaccuuucuuccuugauuuucuauuauguacacuggaaaugauaguaucuaucugccuuugaucucauagggaugcuucaauccauuaaagucauuaaagcacuuuaaguaagguauaaggcacuagaugcaaggccucuucauuguuguuaucauuacuguuauuuuauuacagugcuguauacaaagggggcacuuuuuaaugcuaaacagucaucucagaauauguucuguggaauccagaaguugacagaggaccuuaagcggucagguuaucuuucucuuucuucuugaagccaggcucuguuccucguugucucugucuguuacuuuggagaacaaauagcaaaaccaggaacacaaaaaugaaaauagaaaauugagacaaaugggguagcuguagucuacuucguguuauuuccugggaacugcuguugguguugggucuccuaaagugggaaguucauugugccucucuggauacugaucuccccuuucuguaaugugcacauccagggguuuugaaguggauugugggcuuugauucauucccacuugcaacuuucauuuucuuuguuuuuucgaaauacuguuuuacuaggaaagagaaaaacauuuggggguaggguggguaaagaucucuggaugucuuuggauaguguucaaaggcauuuuguacgagaugauuguauuuccuacaucagccccuucuggcauuucaucucaaauacuuccucccuugcaccucauaaaaaauuccagaaggugagguacuuccauauggccuuggauggcaccaacuugaugauguccaugaaaaaauagaggaucaacgcucaccuuccagagugaagaguuugcuuccuggagcauggguucuuuugaucucacaaauaucacuauucuaaaguaaccuacccuguccuuuaucuuaacauucugaagcugauguuggugacucuauugguucuucuuggcuaaaaaguuuugcuacuuuccauguucauucuuuuuaauuuuugguacuuugaguaucaugauaaauuuuacuucuguuaccuuauuuguggacugauuacucugcuccaccauuuacauguaacuugguagcauuuucaauuucaucagcuacagagcacuaauuccucaaacaugggccuuuguaguuagguggaacuuaagacaguugagugucauggucugaaauguaaguuauuucuguucaucaaaaauauuauuuaagggagcccuggaauaauuaugaguacugaauaauuaagccauaaauaaauauaaauugguaaagacauccaucauuuauuauuugguuuuccagcuuccauaacuagaauccugaacuuacgaguauguugcuuuauaaauuaaauagaaugguuugcuuuucugacucccucuccccgcaaaagcauaagagucuaacaauggauuuucugguauugauuuguuuguuugaaaaaucuuagauuauaucauaguuuuguauuuuagaaucaguuucuugaagaggaagaauacaauuauaugaaauugggauuguuguggaaaaucagagacguauguuugcuauagguauaauauuaguuuuucagcaucaagaguaaaacaaguggaauuaccucugaaauugcagcuaacuauugcuaccucuauaccagaaauauuuuuucaucuuuucauaccacaugugaaaacuuuguuguuguuguuguuuuuuguuuugagacggucuuacucugucugccaggcuggagugcaguggcacaaucauggcucacugcaaccuuaaccucccaggcucaagugagcuuccugccuuagccucccaaguagcugggaccacaggcaugugccaccacucccagcuaauuuuuguauuuuuuuuuuuguagagacggggccgcucuguguuuuacaggcuggucuugaacucuugggcucaaacaauccuccugccuuagccucccaaagagcugggauuacaggugugagccauugcaccuggcccugaaaauucuuaaguggggauaagggauaacagaacuucuugguucauuguuaccuacuuuucuuuuuucuuucuuuuuuuaaagaaaugcugcagcacucauuauuuuuuccccuguuucccucuccuccccaaauuuccugucagcaacuuuguuuucuguucauuagaauucaaacacaauuuaaauuaauuucccuugccaccuucucugugguuagauacaccuuuggugaguucacaaaugacucauuggacuaugaugauuuuuguugauuucuuacaugguccaacuggguuauccuuagagaugccuuagaaccaguggagguguuggcuguaggauuagauggacuuaacgcagauuacuggggaucuccugguauucauaucccuguaguugcuaaccaggcuuggauuuauccuggauuggaccuuuuuuucacuaucagggccuaaggagccuuuuuaggcauuuuauccaaccuccucccagccaggcccucauuacauccuaagaauaagauuuugucuggcaggguugaacuuuaaaggaccauaaaccguuguaauaucuaaauuuuuucaccccuauugaaaaugcaugauuuagacccaauauguggaugcacaaauuauuaaaugacuuagcuauuuauauuccacccaauaguguggguacauuuuucugagaguugcugaacagcagugguauuuugaaaaauacuacucaccuugaggagguuacauugaauuugucuuuuuuggcuuaguuuuaaaaugaagcugauuacuuggugguauacuuagauggucuuugauaggacccucuccuguccugccuucccccauggaaguaucauuauagcuauuuccuauacauucucacugcaaauaaaauucagaaaauacuuagcucguaagaguuucugucucuggccccgcgcgguggcucacgccuguaaucccagcacuuugggaggccgaggugggcggaucacgaggucaggaaauccagaccguccuggcuaaugcggugaaaccccgucucuacugaaaauacaaaaaauuagccgggcgugguggcaggugccuguagucccagcuacucgggaggcugaggcaagagaauggugugaacccgggaggcggagcaggcagugagccgggauggugccacuacacucuagucagggcgacagagcgagacucugugucaaaaaaaaaaaaaaaauaguuuaugucuccaaaaauugagguauucuaugauauuuaugugacuucuaccuucaguugugauuguagaaugccuucacagauuuaaaauagauaccaauaaaauggaauuauauauaaauggcaugguuaagaaugauuguucucuugauuuguuuucaagcuauguuuaguauuccuuuuuucuuccuauguauuuugagggauuuaacacugagucauauagauaguguuaauuuucauuucaguuuauaaacuucuaucaagacaauaagauuucaguguaaaaaaaaauuaaggaaaauauauuuggugguuuuccuccuccugaaaucuuaaaaguuaccauacuuuccauuaaaguccucucuaauaucuauacagaaaacauacuguucuugaauaaaacaaaauuaauuugugguccuugacuucuguggaaaaagacccuuaucauaacaaaguacaaaaauaguaaaagcaauuagugaauuaagccucaauuccaauugccucgauuuuuuguaugaaaucauaucuuucuuauuauagaagugugagauuauagccagcuguuggaguaguaacuuguaauccauuucuguacguugguuuuuggugugaacugaaaaugauuaccaugaaguuaaguguuauaaccuacuuuaaaugaauuaguuuccuggaauuuauuacugcuaaaaaucagaacaaauuuccuuaggaaucuguguuuauaacaaaaacaugaacuuugaccguagaauacuuuucccauucaaaugaaagauaauuuaaacaauauuuuuaaaagguugauuuaauuuuacaucugugaguauaaauacaaccaguugauucuucaaagauuuuugauugugauaauaagauugauggauauauugugccuuagccuuauauuaaauuggcagauuuuuaaauaccagauaauuagaaaugcuauuaauucucaguguagaaugcuaaccuaacauuuuuguaugucuugugcggucaauagaauaauggccacccaagcaugaccaacuuuuaagaacuugugaauauauaucuuacauaagaaaugggacuuugggcugggcgcuguggcucaugcccguaaucucagcaccuugggaggccgagguggacagaucaugaggucaagaguuugagagcugccuggccaauacggugaaacccugucucuacuacaaauacaaaaaggagccgggugugguggugugcaccuguagucccagcuacuugggaagcugaggcaggagaaucuuggaggcagagguugcagugagucaagauggcaccacugcacuccagccugggcgacagagugaaacuccaucuaaaaaaaaaggaaagacaagggacuuugcaaacgcggcuaauguuaaggaccuugagaugagggagauauuccuggauuuucuagguggacccagucuaaucacaugaaucauuaaaagcugagaacuuuucccagcuguggucagagagagaugaccauggaagaauaguaagagagcucuaacauugcuggcuuugaagauggagcaucugggcccuaagcuaaggaaugcugguggcggauagaagcugagaaauacaaggaagcagauucugcuuuugagucucuuaaauggauggcagcccugcugauaucuugacuuuagcccagugagaccugucaggcuucugaccaauauaacuguaagauaagaacuguguguuuuaagccacuaaauuagugguaauuuuuuaggguagacauagaaaacuaauauaccuugcuuuguguuuguaauuucuugaauaaaauuaucaccaaacucucuaaauacuguaaaggaacaaaaagcuauuugcuugcauauaaaauuguaauuuauaagacuuuauuauaauggauuguuacaauuaauuuugcuuuuaaauaacagaacgaacuugaugcgaccuugcaaguaugcuuuuuuuuuuucuuuuuaaaaucaaggguugcuuugcuaccauuguaccaggaauauaguaggcagucaauaauuguuggaaacaguaaaauuacauagucaacauuuucauuagcuauuguuaauguuguuguuaacaauggaguuuugagaaaggggcuuaaggaaauguaggaauguaaguguguuaggucuuaagaaguaucuccaaacuuuugacagauauuucucacauuucgauuucugucauguucgacaguugucaagaaauugcucaaggguuuauuggacucaagcgccagggcaugagugaguuuaucucugucuugauaagcuggacacugaugguagccagaaaguaguggugauggggaguucugauucuucagauaaucguuuccuauuuaguuagaaaaugacaggauucaagauguuguaccauauagcaagagauuuaagaucacuguaaauacguauaauaaauuagguaaaucuacaugcuuuuaaauagcuuuuaagcugcuugucuacuuucauggcuaguauguuggaacauucaaucagaaguauuuauugagucugucuguacuaggcacuggggauauagguucaaagagcccugccaucauggugcuuauugacccauaagaaagaaauuaaguaauuacuaguguuggaaaguaguacagggcacuuuaggaauagguaguuaccuucuugggucuauuuuuuuuuuuuuuuuuuugagacagagucucgcuguguugcccaggcuggagugcauuggugugaucuuggcucacugcaagcuccaccucccggguucaggccauucuccugccucagccucccgaguagcugggacuacaggcaccugccaccaugcccgguuaauuuuuuuuguauuuuuaguagagacagaguuucacuguguuagccaggauauuuuugaucuccugaccuugugauuuccccgccucagccucccaaagugcugggauuauaggcgugagccccugugcccagccuaggucuaguuuaagaaaccauuucugaaggcaaggggagagguucaggaaugaggaaagaaaaaagcuuuaaagcaaagaaagaaugucuggagcagagaaaaucugagaucacugugagaaggugauaagaugguuagguuggcagagaucaaaucuuacaggguccucuuaaaugauuuuggaaccucagcugcaauuugaagaauguauuggaagggagaaaaaggugacuccaagaagcugagguaggaggcuauuucagcugucaaaauaugagagucuguaccagaguaauagagagaggaauggaggauagauccagagacaguuaggagauaaacuagaaagauuuggagguugacugcauguggggugucagagaggcagggagagguaguuggggaaauaaaauaaucaugccaacaaaaaagacauauuauccacagcgaagagagagagaauauaauuuauuauugaguaggcauaaaaagauuuugcagguauguaagauaucucaaaaguggcuaugaaguuggggacaaaaucacaguuaauacagaacagcagaagaaaguauauucuuaauaacuucucaucccuuugagagacaaagaaaggguugucccuuuugauagucuucuguacaucucaugagagacaccugaguuaaucccagaggguuguuuuucacauaucuagcguugguuuggcacaugacuuagacguaucucuacauuguaaaaacuggagacugaacuuaauccuuagagagauuuaucucuguuccaaagguuagaguaaggacucagauucacaaugucuccaaggaaacacuccuaagaaaagcggagaaggauaaaauggucuuuuauaaauggagaaaaucauuuuccaagcccucaauagcagauggugccauuuacugagguaggcagcgcuggaggaggagcagauuugaggaguaauaagacagacacuugggaagaugucaaguuugaaguuucuauuagacacugccccggaaaugacaggagugcauucauaguggagaagggagaucuaggcuaaauauagacauuuacuagccgucaacagguaguacugaacccugggaauguacuggguagcuuagggacauggaacggugggauggggaagaaaggaugggggggucaucucuuuugucauauaauugcauaguuagcauagugauauuacccuaaugguuaagcgcagcaguggucgacacuuucaucuuuugacuacuuuuccuggauaauguagcuaaaaguuuacaucaccuacucuuguaaucuagacuccugcccuuuucuguuaauaggguauguucugaggugguguccccccacagccuccuuuccuuuuguucacugauuaugcauucucuucaguccccugggucuccuguggacuguuuuccugcacccagugugcuucugccucccuccauuugaggccaugugucuucucaugcucucuugcucucucuuuuugaacuguugcuuauuuggaaauauuuucaguuauuuccacacauaacuucuagauguuuauaccuuuuuacagagucagguauccuuuuucugguguauuuauuuggucuggaaugugucagguuuugaggccacagcacagaugcuuugcucucccauaagugugggcaauauguggagaauggcuuuguguggauuggaaguggaggugaagggggaaguaucuuguugggaagaaauagcugacuguggcccucaagugcuucuuggguggaugcauuuaauaaugaucuuagugaaucaguugcugcauauugaaaacaagauggcuggggccgggcgcgguggcucacaccucuaaucccagcacuuugggaggcugaggcaggcagaucaccugaggugaggaguucgagagcagccuggccaagauggugaaaccccaucucuacugaaauuacaaauauuagcugggcauggugguggguggcuauaaucccagcuacucaggaggcugaggcaggagaaucgcuugaaccugggagguggagcuuguagugagucgagauugugccacugcacuacagccugagcaacagagcgagacucugucucaagaaaaaagaaaaaaaaaugacuauuugaaucuauaacugaaccuauaauuggaaaaugaaauauggggugggggaaagacccucccauuuguauuuacaagaacauuuagaucuggauuaaaauagcagugaccuuugcucuuuauuauaucggacaggucaguuugcaaguuuguuggguuggggcaacuuuucugaaucagacucauguacugauaaauucugcacuugguggaggaggcaaagguucuuauccagagacacuuuagggaacucugggguuuggcaaguaggaaaauagguagaaauggcgcucagggacauuucauuuugugaugacugacugugagcugaagauaaauacauaaaaagguaggcagugaugccuuggacaaagauuuuaccaacuggcagugugaaauauucuguagaccaccaguucuaaugaguuuaucuuagacaguucugagagugucgguuaauaauuuacccuuucugagagacagaggcagcaauuacaggcuauaagcgagcacucugaggcuucuugcuuugcuggagcccaucugggcuggagccauggaccccauugguugugacacaaguaccaagugucugcacuuuggcauauggaggcuucacagcgcucaguaaggcauagacauucagugugauucacuucaagugauaucuaaaguauggauuacuguaacuacccaucugcuccacaucaaaaagaauagaacucuguauagauauuuuuaaaguuuauuuugaaguaggaugguguucuauauggaagagaggguggugguggaaaaauagauuauuuugaagaaauauuuaugaagcuucagagaagggacauacugggcuugcugauugauaccuggaauaugcuuuuauugucuaacaaaauauuggauccagcuguacauguaagacuuacccguuggcagugugauugauacuguuaaaaacuugagucuguuuaccccuugccauacaauuuguuuugaugcaauagugaacacaacuccacuguagauuuaagcacuauuuaugugaauuuuauuucccuguuuagucacugaaucacauuguaguguuggcaugauaaguuuuguaauuugcuuucccgugugaagagugcuuuucuugaaccaaauguugacuucugcauacuuuuaaaaguuaggcuuuaugucauuacaaagauuuacaguuauuuaauaaugauuuauugcaguaauuuauucugccagcuguggcacauuuucacuggaauuuguaaaucaaauuuauauagaaauuuaccaggacaugcauuucaggauuuaauaaaauauacucuaaaaucuuuuugaagaauguaguuuuaugcuuacacauuugggauuaagcuuuaccuuaacagccauuguuacuauucaaacugcuguguuugucccacagucauugaaaagaagagucaaugagaucuguuaaaauacacaguuucaggucaucuacuuugcuuccagaccuuuagugucauguuauauuugaccugggauauucauaugauguugagggacauggaaacauccugacauuaggcucugugcaguucuguaaguuuuaaucauauuaaacugugcauccagaaucauaacugagagugaauguagugcacuguauucauuuagaaacccuaagugucagauuuucucucccuuuuucaaaacuuacuggcuaauaaccauguggaauacauuuagcauuggcugugccagcucacacuccuguaguuucuuuggaaugcacaaauacggcaaguuauuguauuuucuuucuuauuuuaaaaaagauuguugcgauuuuguuuacuugaugauauauauguuucuagagagagaaucuagaauaaaaagaaaacuauacagauuauuuuguaacuugugugucauuaaaaaaaucuagcaauuugagaggcuguauuuaaaaugugugauugccaaguaauuuguaagaaugacuuguucucuaagacugcguaagaauuuuacuucuaagauuaaacuacuaauucacagcuucagucagcugguuauuuuguguacaacagcaugaaacgucucauuugacuuaacuacugccgcccaaacacauugacuucauugaucaguuguuuuaauauugugaagauacagucugaaugugcccugaagcuaaacuuucagguuauaguuaauuguauuuaaagcaguaggcuuuggacuaucuaaaaaggaagugaaagcauuugcaaauauuguagccuuuaauuuuucauaguaguuuguuuauuauguucaagcacugguaaaacauaacuuaacaaaacaaaauuuugagccaaaacagcuuaucaucugaaauguaaacccaguuuaucuucggaucucuuauuuuuuaaaagacguaauuucuuaaaagaaauuauuagaacagucuucagcuaggaguucaaguuaccguacauaaaaaacuggaucuuuauguuauuaagaugaaaauauuuuuguuuuuagagucuugcucuguuguccaggcuggagugcaguggcgugaucugggcucacugcaaccucugccucccggauucaagcaauucuuuugccucagccucccgaguagcugagauuacaggcgcccgccaccaugcccaacuaauuuuuguauuuuaguagagaugggguuucaccauguuggccaggcuggucuugaacuccugaccucaagugauaaaacugccucggccuccaaagugcugagauuacaggcgugagccacugcgccuggcugaaaauaauuguuaaaaaucuuuaauuuuauauauacauacauauauauauauauacacacauacauauauauauacacauacauacauauauauauacacacauacauauauacauacauauauauauacacauauauauauuugugcuggggacagcagcuuuauauuucuagaacaauaauaacuuuuuauaugauuuaugacucuucacaguguuugauauuuacuuuuauuuugagaaaaauuaaucugcaaugcaagggaagucgagagauagggagauuucuugaaagggagcaaagauaagacuuuuucuugagagaguucauugcugaucucuuagaugugauacuguguuuuccuugaaagcauguaacauuugugugcugaauggaucauggagaacgcaugagcuccuuaguuuacauuuacucauccaguacuccagugcucacaauauacuaggguuuuuuuuuuuuuaaaccauuuucaaugcaauuuaagagaauauuuuagaauuaaguuuucacaguuuuguaguuuuuuuuauuucacaguuuuguaguuuuuuuuuagacuucagugauguuuuaaauguuuuccuugugcuuaccuggaaaagcuuuuuaaaugauaccaauuuggaauguuaaaaaagguauaauucugggaugacagauauauuuaaucuugugggugaauuuagacugaugguuggugaaugcuuugagagucugaggugggccagagaaaaaagacacaacucuguacuugguuagcaaugccugccauugccgcugaaguaccagucaguggaagcaucuccugaauucaucucccuagcccagaaacuucuguguuacuguaaucauucauuuauucaucuuguguucauucauucacccaaauuuuucaacauuucugaauauguggcagcaugccaagcaugguaggaauauaguggugaagcagacaugaauuugcuuucaagccuugaugagugggaggcuuaaucguucauuaacaaagaguugaaaacaggguggcagcgguuuuggcaagaauguguuacggucuaauucagagauacugaacuugggaccuaaguaagaaggauauucuguuguagaaaucuggcagauucuagaguuuguuugagagaucucuugcauuugcucauuggguaugccaggcauucuggagggaugcccauucgcaucugacaggauagaugaucuacuggucaaauguauagaugaugucuaacaucuccguaaugcaaggcaaaaguagguucuguaaggggaaugauaugacauuaguuuagagaugagugguaaagccauaugcuguugggugugaugccagucaguaguagaugguagagaauugaagauagagcauaauuuuaguguucagccauuuuuaauuucagaaaauauuuuuagguagaaauauuuuaacuguauaguacauguauugguacaaauauaaguaucaaauuauauuucuaccuucaccauuuuuuccaacuagaaauccuauaauuaucuuuugcuucuuuucccuuagagcuaaaauuauuuuagguaucaguucucguagauucuuuaaaacagaaaacaaaacucuaaauuguuaauuuauuucucacaauuaccuaguuuagguccucaugcucugugaugggcuguccauuuccuauuagugucuacuauaguuucaaguguaaaugcaugcaguguaaaugaauauaaaacugauaaaauuccucguucuuagagcuuauguucuaggggaauauuugaauacaaacaaauccccuaauuuaauacuucuguuuucugcugcauucaccauuccuagaugaaacauaacuucuguuacuuaacuacuguguucagaaauuugaaguccaaauuucaaggccucuacaguuugccuguauauacgcuuucuaaucucaugucuuauuaaauaauaucuuucaucuauccaaggaacagugcaucuuuacauccuuacacuauuuuuuuuuuuuuuuuaaagcacaggaucucucucucuugccuaggcuggagagcaguggcacaaucauggcucacugcagccucagccuuccaggcucaagcaaucuucccaccucagccuccugaguaguagggaccacaggcaugugccaccacaccuggguaauuuuuaauuuuuuuguagcgaugggaucucacucuguuacccaggcugaucucaaacaaccgggcucaagcuguugacuuucccgcccuggucucccagggugcugggauuauuauacuuuuauucgugcuucccccacccauuuggaauguucucuucucuuugccuuuugauauucuccuuagucuaagaaucuuggcucaaauugcucuuuuaaccaaauaacguauguuccuggauauauuauaacuaacaacacguguacugauuuguagacuucuacuuuuguaagagagugcuuauuuacaucuuuuauuuaacuuguacauuuacauauagucucuccagcuauacuguaaaugaugugaaaucagaggacuuuguuuuaaauauucauacugggcuaauaugagcacaguugaaaagcaggcaggaacugugcuuugagcauccuggagaaugaaacaaagcuuacaagcuuacauacugaauuucuaagauagucauucccccauauauugcuuagaaccugaaaauuccaaaacucucuuugguuuucagggccaucauuauauauuaauuuuuuuauuuuguuaauuucauauauauauauauauauauauauauaguauaaaaagugaaaaaaaguacagaagcuuacacagagaaaacaaaugguccauugcuuuuuuuuuuuuuuuuuuuuuuuugagacgguuucgcucuguugcccaggcuggagugcaguggccugaucuuggcucacugcaaucuccaucuccuggguccuagcaauucucuugccucagccuccugaguagcugggacuacaggcggcugccaccaugccuggcuaauuuuuguauuuuuaguggagaugggguuucaccguguuggccagucugaucucgaacucuugaccucaagugguccacccaccuuggccucccacagugcugggauacaggcaugagccacugcacccgggcaaauucuccuuuuuuucuguuuacuggauuccuucuuuuuaaauguuuaagacaaugucucacucugucucccaggcuggagugcaguggcacgcucaggacucacuguagccucgaccaccccgggcucaggugacccucccaccucagccucuggaguagcugggaccauuggcacguaccaccaugcccaacuaauuuuuguauuuuuuguagagauggguuuugccauauugcccaggcuggucuugaacuccuaggcucaaacagucuuccugccucggccucccaaagugcugggauuacaagcgugagccaucacacccagacuuauuugccagauccugaaagguauuucuagcaauagcuuagccccauuuuagaaguauuuguuaccuccucaguuuuucuuuucuacucucucuuucuccuguuuuucucuuucuccauaaaugauaguacacaguauuuacuguucugcaucuugccuuuuacucauguuuuguuuggagauguuguuuaucuguauuuacaguuuuuuuuuccauucuucuuaaugacuacuuaauauuccauuggaaagauucauaguaaaauaaaauagcaaauucuagaacugggaagaaggcaaauguuaggcaaacaauuaauaauuauaacuaacuaugaaaggauaaaaugguagauaguugaauuuaagaaaacagagccuucccagagcuccucuuucccaugccaagucaaguaggaagcccuaagcacuuagaagccuaaagauauuaccagauauuaauugauguuuaauuaucaagaaagauauguccugcuuaaaacaggguaauaggcagcaccuuuucagaaaauucuugucuaaaaugguagaaaccuggagaggcaaugcuggauauuuggaugagcacauauuuugaaaucagaccaacuuggucuugaauucccaguuugacccuuaauauaagacuucggccaagugacuaaacucucuuagcuucgauuuccuuauugguaaaaugagaauaauaauaccuaucucagaggacuugugaagaaugaaugaaaaaaucuuuuauguuuugcauaguaccuggcacacaacaggugcucaauaaauauaaaguuccaucuccuugacucugugcccuuccagaaugauuaauuuccuaagagcucuggaugcugagauuuuacuguuaauuguaucuuuuauaaaacuugcaaugucuuguacauaguaagaaguccacauuuauguguagauuuauucuguaauucuuaagagucuggcuugguuuucuugaaacuuuucaugaaauuucucaaaucucuagaagcggguacaaggacaauuaauuauuuauguacccugugaagaugccuaacuuggccaaaugucaacaucucaagcagugguugugcuuguaaaauuuuaauaaucuguacuuucguaguauacuuuguauuucuuugcguggugugauauuuuguauauuuuaaaaaugggaagaauuucagauguuuuaauaucuguuagguggaaaguauaauucuuuuucaauuacauggauuaauuuuuuuuuuuuuugagauggagucuugcucugucacccaggcuggagugcaguggugcaaucucugcucacugcaagcucugccuccagaguuuacuucauucuccugccucagccucccaaguagcugggauuacaggcacccgccaccacgcccggcuaauuuuuuguauuuuuaguagagacagguuucaucauguuaauccaggauggucucgaucuccugaccucaugauccgccugccucggccuccaaaagugcugggauugcaggccugagccacacugccccuggccgaauuuuaaguuuaggccaggcgcgguuguucacgccugcaaucccagcacuuugggaggcugaggagggcagaucauuugaggccaagaguucgagaccagucugccaacauggugugaaacccugucucuacuaaaaauacaaaaauuagccgggcgugguggcacauggguguaaucccagcaacucuggaggcugaggcucgagaaucccuugaacccaggaggcagagguugcaguuagcagagauuggaccauggcacuccagccuuggugacagagcaagacccugucucaaaaagcaaacaaacaaaaaacaaaaacgaguuuaauaagauucauaggguuaaauguggggggcucugacacugauugcagucagguucaacauggccaauaugaagucaacuggcuuguaaguuuccuaaaaauuuaauagucaguucucacaagucgcaaagaguaaaucugguauacuacuagauuaucaaccuccugggugacugcuuugagcuccgguguaaacauaguuaggagaaccaauucgugaaaaaugguccaggcuuugcuaccaguuuauucuuugacuuugccucaguuuccuugauuguauaguaaagcaaugggauuagaucuguuuccuaagauuuuuugguaugaccuuacaauucuguguguguaaggcugcagaagccaaggagcccaggcuuuauacgacuugucucauauucacaauaucaauauuuuuuucuuuucaaaaaaggucuccccuaguuaaagcaaauauauuugagaaccacuguuacugaaaaaauagcugucucaaagcccaugucuguacuuccagcagggccccugauacagucacauguaauggguuuacuuauuccuuauauauauacuacaguaaacaaucuaggguuuaggaaaacggaaaaguaauggaaugcaauucaguguuauuuuuaucagagacaggcauaauagaaaacauuuugguacuugauacuuuauuuaaauaugacuuucauuuaugugugaaugaacucuccauauaugcuaauggaugcuuguaggccaggcaucaugaacuuagauggcaauaguggccaggcaaguaaaggaauugcgagaaccugguaggguauaaaaugaaaguacgugcugcagagaguaguuucuacuccucccuugcugauuguugucaggaaggaacauacguuucuguuaccauaucuuuaauucuuuaacgccucaccuuuugccucucccugcccauucccucagcagcugaauauccauauuuuaauuuaaaauuucuuguguuuuacauguuggucauuaauuaaacauaugcacacucauacacacucacuuaggaggagccaagcaaaacacaucugaagccaaacuuggccuguggucuucuacuuugaaaugucuuuucacacacguaccuacgcagcaacugauacuuuaguacuuguaugcuaggcgcuuggcuacaccuuuugcacuaauaaaaauguuuaaccuucacaacaauucugugaacagguacuuuuauuuccacuucagagaugaacuuuggauaaguaacuugccaagaucacacaauuaguaaaagguucugcaguuauucaaacccaagaaauugcgcugcagaacucugacacuuaagcacuuggcaaaauugauuuccuggauauguuucuucuauauaugcucuaagcacacacacaaaauguaaauaacacuauaaaggaugaagagaaauuguuuacuauuaguucauucauguacauauguuugcauaugugggcaugaugugauaaagcacugaaaugcuauaagcuuucacauuuuacacaguuuuucugauaaagcucagugagaccaguguaaaaauuucacagggaguuuauauuucuccuugccacaaacuagacauccugagcuuuggggccaacguugucuguguccaagggcaaaaguucucuuucuucucauugucauauuuaaaccccacccauggaaaugcuccaaguccugagugaugaucccuuccucugggcaaggguaugaagaauaaaaguaaaucuagcaggaggaguaaaucccagaagacagagauaaguacuugaggucagagacugcgucuuuuauaguuugucuacauaccaaacucauuaauaugaauaaucaucuuagcaguacugguuguaguagcaaaaguaauacaagaaaccagucuucuccuauauuuuuacauuagcauucauuauuuguaggauuugggaggucuuuuugagaaagugaugugaaacuaagucucucccacguuuuuccuuuaguuccacuuuuucauaccagcauaaaauauuuuucaaccuuaaaaacugcagucuaggccaggcgugguggcuuacgccuguaaucccagcacuuugggaggcugaggcagguggaucacaaggucaggagauugagaccauccuggcuaacauggugaaaacccgucucuacuaaaaauacaaaaaaaaauuagccgggcgugguggcaggcgccuguaguccuagcuacucgggaggcugagguaggagaauggcgugaacccgggaggcggagcuugcagugagcagagaucgcgccacugcacuccagccugggugacagagcgagacuccgucuccaaacaaacaaacaaacaaacaaacaaacugcagucuguaggaauaaaaguauaagaugguaggggaaaaaaaccgagaauagugugaacaaaaucuauguauuuauccauuuagguuuuuccccugggguauuuuggaauacccuuugacaccauaagccucuuuaugguuuacucacuugguauggaaugggggagaaaaaaggagccaguccaucuggcaguauuccucucaacacccuauacccaucaugugaauggaaagaaccccaaaccuucauuuucagaacuguaucucagccucuggcuccugaagaaaaccagugugguucagaugugggaugggaagagugguuugcauuggcaucagcccugcgggugcuuuggggcuggagcacacacagcuguggguuacagaugcuugcucuccgguauuaauguggccaacaugugaaaccaugacacccacaauacuacacaaagguccacgccucugauaguuugagaaauaacuccgucugaagaaauuccuuuuugaaggccuagaauacauucuagaauggaagguccucuuucagagggguagaaccaggaaagagaugccuuauaauguuggacagagcacagggugucuguaggcuuaggagcuuuaaccaaacauggggaaaaaaaaaaguaaaaagucuccucuaaaccuuagauuaauaaauucgaaauucugugcuaugcauguagcagaaagcuuguacacucaagucaucguguaguuucuuuggagaugucaaaugcaagccaucguuggugguugucaucuggccugacucaggguguguuagaaauguuuccaccgauuuuuauuucccugagcugucuccaaggaugguagaaccagaggaaucuauacacaagagaaaagaaaugagcauggguucuugguaauuuaauaacuaggacucuuuucaggguguggggauuuuguccuuucucacucaugagguccaugcuuccuucugacaguacacuugagagagcugagauguuuccaucccccauucaguuagugagacaguuuucucauucagguacaauuuccagugaaauaguagcuuauaaguauccagaaguuaguuuauugacucuuauugcacuucugagcaccuaauaaauaauuuauuagucugauggauauguggcuaccuaacuauggggcaugaaauaugcacuguuuuucuaauauacuguagggagaccuguuuauaaaguauuuaguauugguuuuauaaugcacuguugacaacaggagaccacgaagcucaaagaucaaucucauuuuggcccacaguauuaaugcugcuuuauaaagcucuaugacaggucacuuagacaguggucuucacagaaaggacucuguuaggaaagcaggcuguaggggcugcuaguauaguagaugaaugucuuugucugugucccuaaggugacucuggcgguugcugauguuggccaggugauggaacccaucauuucccugcucuccagagggauucuggacuagaagugcugaguucugcuaaugcagaccuugcuaauugggcagaaagcuggugugacuuuggaccacaauugcaguucuggagacagaaaucaggcaauaaggaguggaacuuggcucucuucagcuuugucuuauguuuauuaaugaagugaaauuauuccacaucuuuuaugccuuuguucaaaucacauaggugacauagcauaaaguauuuugauuuuuguuggcuuuggggaauuuccuagccagaaauaaauucauagacauuagaccacuacauacuaaacacuucgaauuugggaaaaccuaaacaaagacuaaguaauuucauccaaaaucaauucucaguguuuuacuuuauuuucuucauaagaacuauacacuaugagaaugcugcauaaugacaaugauuuauaucauacuauugcccaucaagguauacguguuguugucuuuuuuuuuuuuuuuuuuuuuugagauggagccucacuuugucacccaggcugcagugcaguggcgugaucucagcucacugcaaccuccaccuccugaguucaagcgauucucgugccucagccucccaaguagcuggaacuacaggcguguaccaccacaccuggcugauuuuuguauuuucaguagagacgggguuucaccacguuggccaggcuggucuugaacuccugaccucaggugauccaccugccuuguccucccaaaguguugggauuacaggcgugagccaccgcaccugucauggugcauguuuuagagcaagguauuuuucucuuuguguccagaacuccuugcugguucuaaguauuucacuucccaaacugggaacucugagcuauacuuucuuggacccagucagcuuguuuauuauuucucacgcuuuugugggaaccaggcugaguucuacuauuugccauuucuguuacucauuucuuacugauucagaguuucauuuuuuuuuuuugaaauggaguuucgcuguuguugcccaggcuggagugcaguggcgugaucucggcucaccgcaaccuccaccucccagguucaagugauucuccugccucagccuccugaguaguugguauuacaggcaugcaccaccauaccuggcuaauuuuguauuuuuaguagaaacgggguuucuccauguuggucaggcuggucucgaacuccugaccucaggugauccgcccaccucggcuucccaaagugcugggauuauagcagaguuucauuuuacccuuuccaguuggacccaauguuuucuuccuucuaguacuccucgauuccuuccuaucaugucucccuuagcagauagccccaucuuuaacuuuccucagaugauuauuuuguucauguagcuguuauuuauugagcacccuguuagacccugaauuaggaaagauaaauucugucucuuuuaagaaguguacaguuuaguggaaaaaauugguaauaaauugguuuucuaacaugagcaguuuuaauauauguauuucuuaaccacagauuuuuuuucuguaucucuuaccuuugguuucugagggaaaaaaaggguuucuuuuuucucccuccaggggcacccuuuucauuugugcucuugaucauauucucuccucggacccuuucauaccauuuucccucuggcuuagaucuucaauaucguuuucucucuuggcuucauccccuuugccugugauagucucuuuuuucccuguagugaaaaacaaacugccaacuuaugaacacaaccugucugagcuccucuaacuuuucagaccacguuucucuuacuuguuuucuuugcagaauuucuccaaagaauguuuuaucuuuucugcuucuuugucuucacaauuugcuuacuucuuaacuccucugcaauauggauucuguauaccuaucagucuacaaagacauucacucuuaugacacaaagccuaauaaaauauuuuagccacaaauauacaugaauguuauguugaacacucauugacccgaguuuaggaacuaauaauguacaaacacaucugaagacuagaguuaccauuuaaauuauacugugucagucacugucaaucucccuaucugccuuuccccauuuuccauccuuaagcacuauucugauuuugguauuuauuauucccaugccuuuugguuugcucuuacuguauuugcuucuacuuacuauuucacuugguuuuaaccauacccuaaauauaagucuuguuguucuagaucauuuaaaacucucaagcauccuaucuucugucaacuguuuucccuuaucagguggaacguuggacaaucacgaugcuccuguuaacgcuguuccuucugucuuuuccccuaauaaccauggauauccccugagauacuaaccuuggccacuuguuuuaucucuuguuucaggucuguguagauggcugcuggaugugauaacuucaguaucagucuguuuucuaacauuuccaguugccugguuaucugcaugaucugcuguuccccccauacuaaacuugcuauauauucucacaaacuaguucaucccccuuucuguugauaaugcuaccauuuuccugugcucagacuauuagaacuuuagugucauuguugacacuucucauuuguuacagucauucugguccccuugauuuuaucuucacaguaucuucuguaucuuguccuuuuuuuuuucuccagccguauugccaguaauuuacccagauuauugacugauugauugagauggaguuuugcucuuguugcccaggguggagugcaauggcacaaucuccgcucacugcaaccucugccucuuggguucaagugauuccucugccucagcuucccaaguagcugggacuacaggcaugcaccacuacaccuggcuaacuucuuuuguauuuuuaguagagacgggguuucaccauuuuggccaggauggucucgaacuccugacuuuagguuaucugcccgccucggcuuuccacaguuuugggauuagaggcgugagccaccaugcccggccuauuuuaaugucuuccuaauuggacccugcuuuugucuuuucacacuucaguccaucugucauacuguugccagauaaaucuucuuggagcaaaauaaugaucagacguuacugcuguugagaagcuuuugguaguuuggacuguugguagauaacaggcuaaauagcaacucuuuguaguggaguauagggcccuuacuuuuauaauaguuccuaucaaccacugcauccauuucauugaugguucuucuauguacaucuucccuuauguuccagucaaacuguauuacuucucuaggaauauaaucuacgcucagugugagagugccucgguguagaagcuuuuuuuuuuuucuaaaccauacuggcuggaagggaucucuaaguuguauggaauucugcucuuguuucuuuuccuauucuguuuuuguuaagguuguuuuguucauagcuuaucuccuguacuagauuguaaacuugugagcaaggaguaugucuuaacuuuuguguucuccacagcuucuuauacuuggcaagggagcggggcggggggcuggggcgggaggaugggggugggggugauuaguauucccuaacagcaguuaaaagugucauauuaaguggaagaaaagggaguaagaaauugagcuaggcagggcaaaaguguauccauuaucaaucagcaaauuauucaguuauucccacuuuguuacuuuaguucucaccaaaguuuauuuagcuguuggcuacuaucagccuuagaaacuauuaacucuuaaaaaauguguuuaguuggucauugguguguuauauuugcaauuucuuaaaguuuugauguacucaaugcuuuuaaguaauacugucugggcauauguaauuuccuuucccaaucucucaauaggcacaccuugggcccaccccaccuccacauagccuuaauuacaaaucagaggacaggcuuagugagcaagacuggccagcauauuucaaggucccauguugugggguugauacaucucaaauugagguauguugguuuuuuuuuucccccuuuaaguuacuuggacacacuugcauucuuugauuaccuaguuaagauauaucucucaccucuucuuucugccacucuuuuacugucuuucauacuuauccucauucuaugaaacucagguauuuauuugcuuccuaacacuucuugccucugaagaaauaauugaaaguagauuuaaugaugguuauuugaaugauuuugaacgugauaaaguaucugccuucuauuguuucucucccugcacuuacuucucuuuuccuuuuucuauucuuucuuuccuauuguucuagggcuaguuuauuguuaucacuauuuuuaauaauaauacuauauuaauaguguuaguaguaaacuuuuaaaacugaaguuuaacauacuuacagaaaagugcacaaauaaaaguguauagccugauaaauuuuacacacugaauauacccaggaccaccaacuagauggagauacauaacacuaccugaaccccaaaagugucccuuagcccagccacuauucuccaucaaagccaaucacuaugcagaucuucuaagggaccuguuaagucuucguauuuuuaacuugccauuaauagguuucuggcaucuuuuggguuucuucauuuggaaaacaaucucuaaguucaugaacauuugcucuguuucaacauuuuucgauuuaaauauguauguauauaaauagucucuaucaaggccaguagauugcuugagaguaggaguucccagacuugccugggcaacauagcgagaccccaucuuuaaaaaaaaaaaaaagccaggcacgguggcucacgccuguaaucccagcacuuugggaggcugagguggguggaucacgaggucaggaaaucgagaucauucuggcuaacauggugaaaccucgucucuacuaaaaauacaaaaaauuagccgggcgugguggcgggcgccuguagucccagcuacucgggaggcugaggcaggagaauggugugagcuugggaggcggagcuugcaguaagccaagauugcgccacugcacuccagccugggcaacagagcgagacugucucaaaaaaagaaaaaaaaaaaaaaaaaaaaaaaaggccaggugugguggcugaggugggaggguugcuugaggccaggaguuugagguuccagugagcuaugauugugcacugcacucuagccugggcgauagagcaagauccuagcucuuaaaaaauaauaggccgagcugggcaugguggcucucgccuguaaucccagcacuuugggaggcugaggcagguggaucuccugagguugggaguucgagaccagucugaccaacauggagaaacccugucucuacuaaaaauacaaaauuagccgggcauggaggugcaugccuguaaucccagcuacucgggaggcuggggcaguagaauugcuugaaucugggaggcggagauugcggugagccgagauggugccguugcacuccagccugcacaacaagagugaaagagcuaggcaggccaaaaguguauccauuauccaucucagaaagaaaaaaaaaacaauaggucgggcccaguggcucauaccuguaaucccagcacuuugggaggccgagagaggcggaucacaaggucaggaguucgagaccagccugaccaacauguugaaaccccgucucuacuaaaaauaaaaaaauuacccaggcaugguggugugcaccuguaaucucagcuacugaggaggcugagguagaagaaucgcuugaaccugggaggcggagauugcagugagccaagauugcaccacugcacuccagccugggugacagagcaagacucugucucaaaaaaaaaaaaaagaaauaaucauaauaauaaacaauaauaauaauaaauagucucuguuucuauaaaaauuuuugaaacuuuaaguauacugggauuuuauuuuuuaaguuuauuuguuagguuuguaaauugcauaugaaggaguaucauuuuuaguguugcuuuuuccugugauaauucuaaaggcaguguugaguuucucaauaauuuuguaagguacugaacucugccuugcaauaugguuuucuuuuuucuuucuuuccuuuuuuuuuuuuuggaaacagaguggagugcaguggcgcgaucuugggucacugcaaccucugccucccagguucaagugauucuccugccucagcuucccgaguagcugggauuacaggcaugcgccaccaugcccggcuaaguuuuguauuuuuaguagagaugggauuuugccauguuggccauacuggucuuaaacuccuguccucaagugauccacccgccuuggccucccaaagugcugggauuacaggugugagccaccgcaccuggccugcaacaugauuuucuuggauguuggugaaucucaaucuucuuuucugacaguaauuuaaaccauuauuaugacaccuuuacugaggcugcaagcuucuugguccacagacuuuagaaggaaguaaauaaagaaauuaacauuaucuuggcugggcaugguggcucaccccuguaaucccagcacuuugggaggcaaggcgggcagaucaauugaggccaggaguucaagaccagccuggccuggucaggguuuggugaaacccccucucuaccaaaaaauacaaaaauuagccgggggugauggcacacgccuguaaucccagcuacucgguaggcugaggcaggagaauugcuugaacccaggagguggagcuugcaguaacccgagaucacggcacugcacuccagccuagaagacagagugagauccugucucaaaacaaaaacaaaaaacaaagaaauuaacauuaccuuuauaauucuugcaacuuucauguucauguuaauuucccguugugugcgcccccagccuguuuuuuuuuuuuuuuuuuuuuaaauucauuuaaguaaagccaucacugguucuuuccuucuagauuuucucauaaaacauugaauauagguuugguauaaagaagccacuguuacuguuuggacuugagagaagauuaauaaagucacuuuucuuuuuuuaaaccaaaacaagguagguaaaauguuugaccuuuuguaggcacaagauucaugcugaccucagcugcuuuuauuaucugcaaauaucuugagucuaaggauucaucauuucccuaacauuuuguaaacuaccucaucuaccauacccuacucaaauccuuuuauuuuaaaauuuuuguagugcaucaagggauuauggcuuuuggauauuuccuugauguguuucuaugaaacugagccccugauuaggcugucagcagauacuguauuacauugauuguuuuaguugguacagacacacgugucagcuagagcaguuucucccuuuugcugagaagggugaagcuuuuagauaauauuuaguuauggaggauguuugugccacuguuuaaagugauuugacccuguguccuccuccaaccuuaaguuagaaggccuauuuuccucuauuggucuaagggcauguaaugaagucuucagcacacaagcuuucucccucccuguaggugagugguuauuauuuuuucuuuugucacgggcuuggauaucauguucuuauguguaaacacuggaccauauaguacucacaauacuuuggcaaaaaccaaacuaacugaaaacugaaggcaugccuuuaugucuuauuuccaacuuggaccaugaucuugccccuugaaaucuucaggcuguuuugaugaagccuucuguauguugaaaugcccagucaagguggccagaaccaucuggagaagguagaguuguaaauaugaagugacauguauaauucuaauggacucuuauaaugagaggggccagugauugaggcuggcaaucagagaugacacaagcuuuuuccuuccuauuugaaucuguaaagacccuuaagagcacuuugaauuuguucaucuauaagcuguuaacccaaauucaugucccagguuuuuaagagaauaagcaauagaauauaggcguuuccaaagaggaagacguacagaagcagauagguguauaguucauucauucacagauaggcacuagguuagauccaguaguuggcgugcaugcaucaacauguuaaucggaauuaaaggcugcuacauuuaggcuuggcuagaucaucuauaaauugaaacccaaaagagaauuguuaacuaggaaaguagcuguccagguuccuuaaaguuuaaauacagggauccaacuaguauucuccaaaauuuuucaggaauaucagacuuuacugcuguggaacacuuggcuguuguaagaggaguguuucaucucucauaaggauguaaugaaaggaaauuaggagccagugggagagugcagggacuuagguguaaaucauaggugaaucuuuuuuuuuuuuucagauggaguuucccucuuuuugcccaggcuggagugcaguggcgugaucucggcucacugcaacuuccaccucccaaguucaagcgauucuuuugccucagccuccugaguagcugggauuaccagugccugccaccaugccuggcuaaugauaggugaaucuuaauugugaagaugaguaccuuuaugaguagagauggcuucauaucagaacuuuaucuuacaagcuacucuuuacucuuccucuuucuccccgcuccaugccaacagaguuaauguaagcauaguagaguaauauuucaucuuuguguguguaguuuucuuuuuuuuuugggcgggaggaggugaacuuuuuacugucuuuccaucuauuuacauaugugaguccagggaaaacaggcagcuuaaauuaugauauaauuuuuuacaaagggaaaaccugaauugaaauuauuguuuuacuucuuuucuauucauuucuuuacagugagucaaaaauuuuuuccccuuaacuucacauagaaaaugaaacuuuacacaauaaaguaaggauggcagguuucacaagggaaaaagcuugcugucaacuucuuuccucaggaauauggaaauuuggguggauuaucuuuucagaagagguuuccuuuauuacuucuuuuuucacuuaagacaucuguuaacauuucacacagcccaacagauguuggagagcaagucccauacuuuguucucaagaaaaaugacauuuccuuaguugguucccccacuucugugacugaguccagccugcugcauaauuugcauauauuaaguuauauaccuuaaugccauaugaauuuguaucuucagcauuauuuuuacaugguaaagucugguuugauuagaaacuaguuuacauguugcuguagaauuaagagagggcaaaacauuuuaaaacucuacuucgagaauggcaaccugaguccacauauaagauuggauagccaguuuuuaacauuuuuuucuauaaaauaaaugaauuacaaaagcuugaguuguuucgccauaaggaagugcugauugucaugcgauguggagcgucauuuuuauuauuuuggcaagaacagggacaguuuugucuugacaagccauuagaugaauaccagcgugugucacaugaaaaaccacugaucuuuaacccagcucuguacuuaaccaagccuugaaaaugaauagugaauaaaagaagagcaaaggcagagcacauuacagauuauagaaucuguuaacaguugcugaacucaacccagggaauuacagguauuguucugugaaccagcagaaguucuagagaugcuuguuaaauuguauacaaaaacuacacauuuauuuuauauuugugcaggauuuacauuguuggagacagaaaaaauaaaaauccuagaguacuuucucagugcaguaaauguaugcuuucaucauaaaaucauauauauuuacauagaacucaaugagguuuuuuugccugcaguuacauaacuuauuuuaugaaagcaaugugcuuuuaaagaaauuaaguagaaagaagaaaacauagguuauauccccuuccccucaaagaaaacacccuacaaacauacaugcaaaacaaaauucuuugcucacuugcguuuucauguauucauuguggcugauuuuuuacaccaacauagguuuuuucuuuuuuguuucuuuuucuuuuuuuuuugcaggaaauggagggaaaaacccaaaacccaccguaauacucaaguacugaaaagaucaguaacauuuuaaacgguugugggaauuauugcuuacagagcuaacaagaaagaacacacuuuuuuacucugcugguggaauugcauugugccucccuauagucuuguuaucccacacuaacugaaaugcaaauuuuuuguaacuaauuggaucucauugaggguacaugcacaguguguaguuauaugcaaaaagguuuuaaaaaguaaaauuuuccugcaauuacaacuuuuaauuacuauccaaaacaugguaccuauagcacagguuuagaauauauaugucugacuuuuuuacagauuacucaaaaacaugagcuaugaaaugcuuaauaaggugucagcucgaaaguuacagggaaaauguuuaauuacagcagucuauaaauugaauuuuacuauaguuaugugaaaauaaagauuucuuuuuaaguucaggauuuaguguauuagagccaguauaugaaaggcauguuauagugcauuccuuuucuuggaagauuuuaaacguuaaaacaucaucaacaucagaagucacuuucagagccauugccuuuuuuuccccuucaguucuccaaucuauuuuaccauuguaaaaugcuuuugaguuucuuacuuuguguaaguauauuucuacuuaugugguguggugugggggaaguauucacauucacacaaugucuuuaacuuggaugcagugaaaccuaguuugguggacuucauaauuuccaugguccaucucucacuaucaguaaaugugggaaagccaacagauggccuuuaaguacuucugauucuuuaaccugaaauacucagaaucagcagcaaaaagcaauuauuguggaagugauacuugucuucuuccuucuaguuuuaaauaauuuucauauaaaugauuccagagaguuauuccauaauugucagacuauguagccagugaaaaaaacucagaagacauauuugugccuuguagguguauuuuuuuguaccugugucuguaaaacgauacagaugucccacuugcuagauagaaauuauccuaaugucaaauguucuacacaguauguuauauguggaaguucagaucauguaucuuggggauuuauagagggauuaaauguucuuuucaaauauuuauuuuaaaaugaguguuagagaaacuuaaaaucuuauuuauuauugagucuggauuaauuguugucucuuuuuguaacagagcuuguccucuuuguaaauuuguguuacaaaguaguuaagauuuuguuugagcaaauccauuuagcaggugcaguacuguauauuuaugaaaaaauauuuuuuaaaacuuagaaagauauccugcugcuuuuaaggcucguguuguggcaguaacauguuauauugcagacguguuucagccagggccaccucaguccaugauaucugaaggagcucaguuugccuauacuggguagcauuuugucagaagacugcuggcugggcagacuagauuuggauguauuagcuagucagccuaauaacccuguacagacuguauugauuuucuaggagagaguuuaugaacuaaauaaacuugggguuggugucuuaauaaacugcuucucucagucugucacauuuaguuacggagcugugcaguuuagggggaaaaaaggcuaauucuguuacagauuguucacagcagggucuccaaauuagcccuuuguuuuguaaugccaccuugcuugggcuugcuuugagcacauuucucaguuuugcccuaaugaguugcaacacugauaauguggcugaugaucuuucauugauuucacuaucacuugcuugucugguaauugauccguugcugagccucuaguuaauuauaucggcuuugacauggcccgguccacggggaauuucaagucuugcagaauaacaguuuuaauaaaagagucuauuacugcaggugcuugcugcugcaugccaguugauuuuuguguuguuagugugugugugggguguuggguaggauaccugggaaagaagaggacugcaggacugagaaaaaacggggugggggcuagaaaaagaggaagagggagugaaggagggggagaaagagacaaggagagggcgagugagaggcgagagagaacacaggcaaaaacacacaggcaaagcgauacaacagagccugaguggaaggaggaggaagcuugcuauugacaguguccuuaagccucccacaaauaacagccauuagugggaaggucaggagcugagcaggcagcuugacugaggcacugagugccacuucagaaaucaagaggcuagcaaauuuuagagggaguuuaaguggguaauagcuagcacuaaagguacagucacuguugacaauugacucguaggggauuuuccugcccucccccccagcaagaauauuuuuauugaccacagguggacuuaauauauuuuaaggcaacaauucuuuggguucuuguuuguuuccucucagauauugaauuugcuucuuuugagacuuuuuugugcuuaaugguggggaacuggagggaaguuuaacagaaaagcuuucaggagaugucgguucuagaggggaaggcacauuugugucaacauaguguacguuuucucaucuuuucucauuguccacuaaugacacagagcugccauugaagcucuuuucuguuucuuuuguuguuucagagaguaagguuuauuguuauucuugaguuaagaaggaacaaggagagugguacauuuguccucgauauuuguaggugguugaagauuaauguuccuuacauguuaaguuuaggaaggauggcuuuuuccugcugacuacuuuuaugagauggcaugaauuuagcuuuccauuuugaacuuacuguuuauguacagugcauuuuguucagugcugcuuuuccauaaauaaggcagacaaauacuaucuaauaaauaggugaauaguuuuaagacuuguuuaauuaaaaauacgacauguuaucaaggguguauuucaucaggcaggaaaacguuauagaauuuuccacagagaucuugaauaaaaaauggaguuuuuauauucauuacuuuuugccugaaaugggacaggcuuuuuuuguuuaucuuuuucuuuucuuaacgauuugaaaggauauugcagaugcuucaucuaggaacuuuaacaaaggauuuuuuucuacuucugagcuuuaagaaaagguauacuuuuuuccuuugccauucaguuucucauuagcuaacauccaguuuaguaauuaauagccugagguacuagauauuaaauaguauauauuuauauuuggcaaauguuuauugugcaucuucuauguuauaaaaacugcuaggcuuauuugcuuacucuuuagaguauaaggucacaucucuauguacguuauuuaggaguuucuaugugguuauaaauagcccagcacauacgagaugacuuucaggagcuaacauuuagaccauaacugagccaacuuuacauucucuuacagcugaauauuuuacuuucuucaguguaauuaaaaaaaaauuuaaguaucacaguuuuacaaauguuaaagccaaagacuggugucagauauuauguguuauaucagaaagcauuguugagaaaaauucccggggaagggcccuagcuuccccuugcccugugcaccgugauuguggugcugccuggagugugcauaaguguguaucuaucuguauaucuggagagggguuagugcagggugucauuuggugccugacaguggaacagugcaguugacucuuagcucugcuauccaaugacaugcaguggcugagaguuugaagcugaugguugggucuccagugccgccugcacaccugacaggcagcuguuaaacugagcaaaggcaagcuuggggagucacaaucuaugcauaaaugauagggauaucugugcagaaggugcgaaagaagcucugacccccucccucccccaaaucucccccuucccaaaugaaaugcacaguucagccagcuucuuaacuacacuacacuccugcuacuggcugccaagaggcucaaaaaauccaccuucacuuuucagucagaagaggcagaaguggaugugagagaaagagagacacagagagacagagagccaaagagggcaagagacuugacuuuaagagacuccuguacugacaacuccaugcaguucggaaccagaacgacuacggcugaaccaggguucauggggacauggcaaaacgcugauacuaaccucuuauucagaaugucccaacagguaaguuacuuucuuucuugauuuuuuuuuucuuuuuuuuaagaaaccuugaauuguuaugggcacuuuuguuucugguguuuuucuuucuaaauacuuuuuaaaauguggucacuuccuaguuaggcucuuguuuugucauaacuguguuacuggaaugugcaggguuacuucaugguuucccuaagggcgucuuaaaagaaaaaggggaaaggauaccgaaguaaaagaaagcagagacauuguugaaaaguuucacaguacaaucugggucaggggaagacuuaauuuauuucuuuguuuucuguugagaaugaaaaaagccaccucccaacaaauguaucuaucaauaugaaucacuucguccaaaguguuugcucucucggaguagguuccgcaaccuaaaaaacagucaucaaaucucggggccccucagaacagcccuacugacuucauguggcuggaggcagcuucguucagaccugagaagagagacgaggcugugcaggcuuggcugccagcgccgaggguugcuggaggagucggcgugcguggcgggcugugcugcucgguccucgcuccuccgcuccgcuccuccuugccagccagcccucugcgcccgccccugcauucccuucgccggcuccggcccgcucucccgcccgcccgccggcccgccggcgcacucacucgggcgcagccucggcgucuuccccagagccgcuccuccgucccggccgcgcuggaggcguucggcuugcuggcucugcugggaaagccgacgugguagcgcgaggccaucgguuacugauaauuaaucaccggagccggcggcucguaccaugcgcuccgugauacgcgcccugugcgccggucuccucuugcacaauugcuggcuccuuggcuccgcgggggagcgagggugagaggaagcgaaggggacacaacccagaaacuuucaucuuggauugugcucaagugagggagggaaguucccuggugccucccuccuagacacgucuugcuuuuccaaagccuacaccaaacccacacaaagcaaguuaguuugauauuaucauccacacacaaagcaaguuaguuugauauuaucauccacacagcacgaaaguacuauugacaaauauacuuggauuuuaaguugacggcgguuauuaagaaauguugugccacucaagaggaaaaaaauacugcaacugcuuuuuuuuuuuuuuuuuuuaaaaagcuuuuguuuguaagaguucacgaaaauuaaauacuuugaguuagauauuuaaaguuguugauaauaaaaaaaaaacaauuugccaggcuauaaacuacuacaaguuuagaaauacauuugcaagcgauaauaccuacaaccaggguuuuguagcauuuagcuagagaacaguuuuagcacacaauucuaaauaggauaaaugcauuugaauaagguauauuuugacauauccuguagagggacccugauuacugcugauacaguaagcugggauuuaaaugcaaucaacaucaacccaauaaguaacucuucaugugcaauuucccauucuuucaagugaaaaguucauuuccacacagagaugcuccuugucacugcagagcgcugugagagguguuuuccgcgacgcaucccugccuggguggcucucgcguguuggaaugcaguguuuucgcuaaccuuaguaccaaauaacuugugcuucacuuuuaaaacuagaugucaccuucaggguuuuccuugaguuaguggaggucgugugugugugugugcguguguguguguguguuagaagggaagauuggcuuacgucucccucuagcuagaaaagaguuaauaaaaccagauagagauaaugaucaauugauaaauggcuauugaaccacauagaugguguuagauugcuuauuuggcacuagcccauuuccaaguagauuugaaucuaaggagauuuugucauggaaaacauuuuaacuaaaaaacaaauaaaguaauauaaaugaugggucagaauuaggacaauuuaugaugucuuugauccagcugucugacuguguggauauuuuguguguaccugugugugcauauauguguaauggugagcaucagugauuauauggagagaauagaaauauagggaacuaauuuaugcuuaauggaugcuauuaaaacuguauaauauuaugcuauuuaugaaauagaguaguacaacaaaaggagagaaaucacaguuuuaaauauguuuucuuuuuuuuuugguuuugauguaguuagcaaucacuccuauccccccaacccaccuuuuucugucauggucacugaauguuuaccucuugugcauuuuuggaaagcauguaaaagaggauaugagcuugcauuuuuuuucucuucaagaugacauuuuaguuuguauaaauauuacauaacuuaaguucaaacuaugugagugaaaguaugugugcuguucauauuuaauauguuuguuuuucuuaccuguaguucaucagcaaugcugauucagcacgugugugugugugugugugugugugugugugugagagagagagacuuauugaaauuauaucucugauaucucuugaagccagccauuuaaacgaguauuacuuucaauauauacaguuacgcuaguuuuuguuacagguaaaaguuuguccaguuuaaucaaauauguagaauucuguacaucucauugcugaggcauaaagagguuucucuagauuaugauuauuuuauuucuaaguaaaauuuacuuagcuuaugaaaugaauaaaauuuauuggguuauuuuuuuuaaaguuuucuuuaauaguauaaaaacuaauauuuuccugauuauuuauuuagacguuugaaaacucugacuaguagggcugcuauaaaagguuucaaaacugaguuacagauaauuuaccaucaguauuuaacuauagagaaaauugugggaaauguccaugaauacugaaauuuaauaaucuaguuuuauguguucuauuaguaaacuaggaaguagggauacaaaaaucuuugucuuuuguuucauaugagcaaaguuggaucugcuuaaauguacaucuuucauucugucuaauaguaacaaauaaucacaaucugaagccaauuuagauuuagugggaugaaguaugugccccuaaaguucaagugaagucuauuugacuacauuuuccugugccuguacauuuuuucuucuauacucaaguaugauuuucucaaauuauuucuauguauauagcugaguauuugagaacauuaaaggguaugacacuuguguaaagggaguucuucuuuggaucaguuugaucagugacagguggagaaagaaccuuauuuugccuauuuuaguuucacaagguacuguuaaaagcaaaaaaugaggcuugcuuuucaaaguuuuuuuuuuaaucacacuugaggaggcaauucuucuauuuguauaaauauuuugugcauuugagagaauaguaaauaaaauucuuguagcuaucucaagggauguaauaguccagucuauuuaaaaaucuuuuuagaaaggaaaccauaaagguauauagcuauagcccacauuuaauguguuacuagagacauuuaccuuuuauuauuggugagguauauuuaaccuguuucaaauaaaauguagaucccuuaauaaggucuuuuuucauacuugagugaaauacuaaguuaggauuauaaaugacucucugcaucauuauguaguaauuuaggauucacccgaugauguaacaaaauuaacaacauaauuucauugugaaacugugucuuauuaaagaacaacugucugacauucucuuacaguugcuuuauuuaacuucaugcaaauauuauuaguagugacauuuuucuauugugcauuagauucucucauuagcaugauguguuaguuaucaccagagaaaucauuuuuuagauaggugaggggcaaaccaagaaagcuaaaaauuaaaucaacgauuuacauuaauaccagagcgucugcucaccagagauaugacagaguaaaagcaaacuuucuuacuaauauaaaaaucuagcaccuuucagagaaaugauaaauaaaauauaagaaauguauaauaacauugcuagaauccauuuaaaacagugcucaauaugaauuuuccucaagaaaucuuuuuuuucuauucauauaggccaacaaucucaguuucuggaaucuauauuuuuaaaugaaaauguuuuuguccccccccccaauuuuuuugaguauuuauucacuagucauuuaaaaggcauauauauauauaguauuacaagucagacgccuaguuguacauugugguuugggucuucuuuauaguucauacaacgcauuuuuauucuaaacucugucccacucaaauagacaucccuuuuuacauaggauguauauucuuauuuaaucaaagcccugaguaaagcagcugauaguuaauggucuuugaaaacgacuuucauugccaggcaucauccaucccuagcuugcuuucugcaguuuucuccauuuuuuacucccuuccuuacaguuaguauguuuggaugaucuugucuuacuaaaaaaggauuaaauugacuaaacuuguggucuuaaugcuaaaauaaauauuuauauuaagaggcaugcaguuuuagccuguugaauuacuaggcuacgaccuccaauuuaggccccucuuaauuugagugguaauauguuuuauuuuuaacaauagacauauauucaaauauaauucucaguauauugucugauaauguaacacuaaaguaggaauauuuggguauuuguauuuguuaagauacaaauuguagcauagagacaggugcuugguuuguccuaaacuuugaaggucuauggauaacaugcagacuucacauaagagauaccgucucauuuguaaugcagugggaaaguaacaguuuauauauaugguauucuauguacauguaaacguuaacgcaaguaaagcaugcacaaacauauucucagguguguauuuuguauauguuaaaaaucugugcacaaauuuggaguuuauuuucaacaugauucauuuaaaugaauuugaacacaguaggugaucguuuugaaauuauuuaauuuucucaccuuucugucaucugcaaacaggucuauuauguuuguguaauuuguaaagccuuuugcuaaggugagccaaguaacugcaguugaaaaauaaaucccucuaaggugcagauaucuuaucuauaauuguagguauuuuuuauaauuauauuuaugaguguauauucacauucacugauaaauccaauuauucaugcauagcuuuauggaaaucugauuaaugcagugacaggacagauuugggcugccacagcagcacauccucccacucccaugucaggguuaagagccacggcaaauccucccugacuaauuagaugcugaguaaggcaucucugagaaguuggggcagaagugaaugggucacaaccaaggcaggauugcaaggacuccagugauagugaaagcauucaaguuugccaggucguugugacacagggagcugauuccaaaggaacaguccguuacagauagugagcuggcgucauccacuugaaugaaaaacacaaauucuggugccucccucucucuaccuuguaugcauuacacacacucacuuaaaaaaaguugcauugggcaucugccgucaucugucugcaaagcuuuugagaggauuuuccuuguaaacgugaauagcuaaugauucuguauagcccaagagguauuuucugaacuuggcacucuagauuagcacauauaucaaaaggaaagaggaaaagaaauuggaauuuguuuuuagcuugugucuauaauuugaaccuuaguguuugaaucgaucuaggaauuaacuccuuuuuccccccagagugcugucagagaacuuugugguuguagagaaaacagagugaaucggguagguugacuuuuucagugagagaaauuuucugugggauucccugcuuguuauuguccaaagaacauggaauauaauguuccaagauuuccuuucacgguagguuuggagccugguuuguuaugcguguagaaauaauucgccauuugaaaauccucuuguaccuuuggugguacgcuuuuguggucuguuuauggugcugcucagugaccacccuucuccagaccuuggucagaagauuguuuggggguccuaggaagugauggaucucacuacugucugccaaagcugaugccauuuuuuauuuccagaaaagcagcuggcuucuacauuuugcugggcgaucuucaucuacuguaaggacccuggagacaggagaaagggagucaaagacccuuucaagaaacugacaucuauuuuuaagcuuuagagaaacaaaggaaaagagacauaauucaggaacaacagccuuuauauccucacauagaaacaaaacauuggguaauagagggaauguuuuccuauaagaaaaacugguaaagaugcaggaaaaauaagaugaaaaaaaucugcuaagcagcucaaggucuaagaaguuuuaaaaugugcagauggcaucccagaaaugaugucuggggccaugacauccaggguccccacauuuccuccucauugagccugaccuguacugccaucuuucuccccagguuuaaagaaaguuuaacgaauaggaaaaauaaaaguauugauuauuuuuuaauuugugcguucccuguaggaagccucgcagauuucacaguguacauucaaacccucaggugaaaaauuuaugacuggaguucauuuggguggagacagugugcagugucauucuguucaaaugcuguauguagcauuucaugccacgaagugcagagaucaggagaagagaggaaucgcuguauguuuucuucauucauagagcuuucuuuaauggaaaugcuuguggaaaaacaacacauuacucaaauuggcuaguuuaggaaccaaauucucaacuuauuaaucaucauuccgauuaaaaaaaagaauugauccuuuaacaacaaaauaauauccuuuuguuuuucuuuaauuaagcccaucaguuuuucauuucucucuguaaagaaaaugaaaauaaucuugaacaguaggaaguuacucauugaaacaacugauucucuugagcauaucugacgucuuauuuacucaaugcuuuugaacuguaauguuauuucgcuacugucuuuaggguuuaugugucauugagugguguugauuuauaaaucucauucauauuugguuggcagaaauuuacuuaaugaccuaaauacaagguuauucuguuccuauuuccuuucucauagagguaauuucuuucucacuuuauucucuuuucuucucaucucucucauucugaauuccuccuuacuuucacuggcccuuuuugccuuaauagaagagaauugaaaugcaccugaaacguagcaguaauugaauaaauacccuuuugccaauacaucauucuggcagaggcaugagagagaggugccacccucaggugugguccucugugagugcugacaggacugucucgaguguugcuguagaaggguucuuugaguaagggcaugauaaaaacguguaaccaggggcccuggcuuaucauucagaggugcugaaaggcagcucaauuugauccuuagccuguauaagaaaguacuuaguugaagagagauuuugcuuuccuuuuuucuucuuuuaaaaaccuaauucuuggacuuauuauuuugugcaguuagacuucuacacgagcuuauuucccuacaagaaggaaaagauaccaagggcagugcaguagguugaagggaugauucuuucagacaaacugcagcuaguaagaguuaacagaaacauuuaaaaaaggacuugaaaugaugguaggaccaguauuaauggaugguauuaugaaauuaaaauuuaaagcaugcaguauacauaacacaugaggaggauucacucuuguuuuguauuuaauaaauuuuaacccauugucucacaaggcauacagauuguuaaaauugacaagacugaaacauauucuguaugggaaagacauagcuuucaauauuguuaccugcugugcuuuuuugagacugucaugaauuuuucaacuuuauuaaggugucuuuuaguggcuauugguucucuagacaguucuucagaacucacauuuuaugaucggaguaccugaacugggugucugaaaaggaagauaacagguuagugaacguuuuacaugacaacaaguaauugcuuucagcuggcuuaaaauaauaacaaaacuaauauuaaaaugagaaucuccauuagaggauuuuaauaauuuuuuucccuuuccauuaacauuuaaaucaagaagaauuucauugauuuaaaucauuaggguggcuauuugggacaccugaucaggcauagauuaagaaagcugcccacuacugcgcccucugccagugcuggaggucaguggacauggcugggaugucaccggcaagauauggggaguaauuauacacugagcauauucaugagagugucccugagugagaaugccugcaaacauucucauuguugaccucaugccagaaccuaacuuggagucagcgaguuagcugcuguuuaauauugcuuuucuuuuauucuuucuuuuuuagguauaaauauuagaguaccagaaagaaccaaaaccaaagucuggcuguaaacuuuguggaaggacuuacugucuugaaaguacuaaaaaucccauauugccacauuaugguagugcauuuauauguaaugcguagacaugcagaaaguguaugccugcuccauugguuggcuggugacaauuaggugacuuaauucuauguauguugaggauuugcuaaugacuuccucagaggcagugagccuguggguggcuuuccccaaagaggcauucuccauccuaagaaucuuguuguaauuauuccuuauacuaugcuaucuauauagccuuuuuccuuucuugacuauagcuuuuuggugaaacucagugucauucauuggaaaauagcaugaugguuucuuauuuugugaacugccauuuucagcaagugggagacuacagcuuacuucagauaaauuagaauugcgcuaggauagagacaccaggaugagucucucugacucaaauuucagaugucucauuauuucccuuucuagcaacuuuuguuuguucucuuggacaacuuuggaaaguaaucaugggacugaauggagcuuaaaauauguuaccaguccuaucaugacuaaauacucuucauuguggagaggaguuuuuucauuuuuacuuuauuuuugucaucuauuauaauguaaguaggaagggauaagaagaauucaaacuccaacaucugggagagcuuguuucaguagccagccgggcagccggaaagcuggccucauacaggugagauguguuaugggaauaagggccuugugcacuuaaugaacccugccugccugucagccugguuuuucauguaccauuguuguucaaauaagaaaaagagaguguucacagccuguggugagauuagaguaaugaaaaugaaguguuaaucuguugauaggaagcacaucccauauccugcaucccgggccacauucaugcguguauaauauauuccagguuuucucaugaccagaaaagcuuggguguucauuauauugaaaacauccuuuuaguaaaagugagaaguugguuguuuuaacuuguguaaacaguuauuuuaaauaauuucuuaauaaaccaacugcugcuuaccuucugaguauucugauaaucacuguuccuguaugugccagcaguccuguacuuuugaucuuuuaaauuuuuuuuacaacugcagaaugccgaaaaugagcuucaauauaagccuacuuugagauacucuuuucucaaaguaggcuuaauagagugauuaauagaaggaguuaagugacaguaauacuuuucucuccauaaaacacagauuaacuaaaacauccauuaucucacacuuuauuuuucaucuuaaaacaauuaaguagaaacaaaaauuugugaauugugagucuuccagaacugcuuuacauauuugcagucagcugccaugaugugaaccugaggagaccagcuuaaagcuuuggucaucacaucaugguagggaauuguguauuucauaaaauucucuuucuaagaugguauaaaaggcaaauuaacaugaauguaaugaaguauauacuuuccuuagaauguuuguuuuaauuuuuguuuuuuaaaugauuuuacucaguaauuaguugagaaauuuccauuuuuuuucccuaaagcuauauacuuaaaaaagaaagaaaguaaguuuagucuuggauuacaacaaggcauuuuaaagaaaguaaugugaacacugguucagugcccuuuauaugcaggucauccuauaagaucauaucuuucagaugcaucguaagaaaugguuugaagaaaagugugaaaggggugcggagagauaaauuaacaacugaguuccaggugucuauuucuaauugcucacauuucaaucauaauggaaauuaaggaaaaauguuucccauaagaaauacacugucauucaggccuaccuaagacugccuuuauggaguucauguuuacgguauuuucuuuuuuucuauucaccuaggaguuaaggaaugcuacaguaugaucauuaugauuuugugaacuguuuacuuaaaguugugcaaguugcuaagaaucaagagaauuuggggauuaaaguccgauugugaaguaaauuuggcauauguucagggauuacauucuuuagguaaaaauggaagaaaaaugcuuccuuucggaaggaaacaccuuaaaaacuaaucuuucaagcauguggugcaaugaugaaacauaauguaaaaacacuauaguauaguugauccaaauuaguuggcauaugacuggucauagccuacguacuacaguuugcaugauacguaagcauuucuguacuguaguaauacgucagagauagccuguuuuuaauauaguuggaugaaaugagaaggccguugcuucccucugcuaaauaggguauuuuuaauugguuuuuaaaauccauuaauagguagaaaugcugugucguugugauugauugggaauaaugaaauguaaaagauauucuccuugcaauugcuuucauguaaaaaaaaaguagauauaaagaagugcauggugacugugucauagacaucugcuuuuagguaauaaucauuuguaaagaaauaugccaugacuuuuugggucauuugaacccauaauaaugucuauuuaauguaaguauaaaugucagaugguggcauacauguggagucaguaaagaugaauauuugcugugauaauagucaugcaucuuaaauguugacuuuuaaaauauaccuugaagacauauccuauuuucauauuacaguacauuuucacuuaaguacaugauagcucuagaaaggaaguguggaaguguuaacaugugaaggaacaaaaucugaguaaugcuuugacaugagcaucuauuuugggcuucagagaaauagguggcugauugaaaaccaauguaaagauuguugaaccacucuguaaggcugggucaucaguucuggauuuacuauuuuaaaaaacauuuaauuaugaaaaugaguuuccuuugguuugcacgaauguuucauugaaaugaaacuugcuucccauugucuuauauucuguaaacuugugaaauauguauuuuuaaaucucuguucugagaacacccucuucuuuuuuucccagaaacucuagaguaguaugacauuuuaaggaguaguaguugucuaaaagggccauguggagguaacaaaaauuaaaacaaguagagugagucuagugggaacugugguggaccagaaagcucaugucucaaccacagugagguagcugcuccuugguuccagccgauuguuaccaggugggaaugcacgcccaguuugccagauccacugcugcugcuuuauaaugaugagccaaaaauccagauuuuuaugugaaaucuccugauuuugaaaucuuggcaaccuauucaaauauuuuaaaaacuguguggucuaaacaaaacucaucugcaggcuacauucagcccucuggcugccagauagaaaccucuguuuuagauaauauuuuaauggaugaagauaauaguuucauugcaugugaucauucaucuugggaauuccccacugggaucaaccaaauucuucauuuuuuccccugugauuagaaaaaaaguuuaguaaauauauuucuggugcugauaguuuugauguauagcuuuucuccuuaugacccacauuuaaagaaaaaucaccugugugggcaaaacaaaaaaauagucaaauaauuuaaauaaagguagaagcauaaggauuuuaaaauaauaaaagauuucugaauucugaaaauaaucccaugauuuguguaaguaauugauguagaugaaaagccgaauucaacuauaaaaagcuuuucgucucaccuuaaagcgguagauucuuggcccugaaucuuugugggauugcuauaauuuaccaagcaauugauuaugaugucacaaggaggagauggaccacaagggggaaaacuucccccuacuaauucaugcaaggccaauauuuuauaccugcuucaagaaaacauuauuuauauuguauaagaugagguuuaaaaugccugucuauauuuuuugaagggucucuuuaaaagaaauuaucuauucauaauugaaauucuccaggcaaaucaguuaucagcauuuucaacagaacagguaauuaauugguuugaauuucaaauugaaggucauccuguuauugauuuucgugggaaaaggaaacaagaacauccuguuaaaaugaucugcaaauggggccuagguauaucuaggcucuuucuagggucuuguuuaacagcaucacugaacagugucagaaaccaaucagaagggagccauuuguguuuuaaacauaacaaguuguugguuugcuuccaaaacuucagagaagaacucaacuggagaaaagaccagagauuaacaguuuguguuagaguaagucagauauuucaaaucaagugcuggugcagcuuguaaggaaacaucuauaaaugugucagaaugaugcugguaugccauguucaagaaguucagcaucaacacagcugugacuuaacgcuuucagaaaccuuucaacugggaauuagauaaaguaucuuuaauauaaggggagggaagcacugaaguaaaagagguagcgaauaauggaggauaaaagaauauaccccuuuagaugcuguuaauuuuuauaaaauaacauuugugcuuuguguuugcuagauaguuuuauuguuacauaugcuaggcuauuucaaagcauucauuucucuccucugccguguuuaaacuuuuugagaaugguguaauguaaagguaacacagacgaaguggguggcagacauuuugccuuucuacaguaaaccgaaauuaguaucauuuuggugguugaggggagacaaggugugguucuguggcccaggcuggagcacaguggugagaucugggcucauggccagcauccaccucucccgcccaggcgcaagcaguccucuuaccucagucucuggaguaccuggaauauagauacacgccaccaugccuaggugauuuuuguauuuuuuguagagauaggguuuugccauauugcccaggcugggcuugaacuccugagcucaagcgaucugcccaccucagccucccaaagugcugggauuagaagcaugagggcaccacgcccagccaaaauugaguaaguauuuuaauuuuagcugcacuaacuagguuggaaacuuaaugcagcuucuuaugguucaaaguaaaauucuuaauaaaaaaaaagggcgggggaaagccuuccauucuaaauacccuggagcuguuagugcaguuauuucuaaguugacauacuuuuguauaggcaugacaguggcaccaaccaucuacauuaagccuuaacauuccacagagccauuucaaguuuauuaugagcuucaaagccugcacaucccuaagagaauaucaaguuuaagcaugucacuuugccauagucacaguuaacuuucuuaaaaaaaaaaaaaaaaaaaaaaagugccuuuuccuaggcugguuuucuacagguuauccuugaaaaauuucccaguucaguacagucauuuuucuuacccguuguuucugcccccuugaguucuguagauuuauccuguuggugaugguuggaaacuaccuccaaauaaaaguaguauuggucacaauuuguugaaaggucuaugacuauguaaguaucccuuugcagcuuuauuccuagggcucaagacauugaucccauuuuacccauuuccauuuggguuuccauugcaguccuuaaaaaaaaguguagcuggggagaaaaggaacauguaaaacuguaaaauugcuaaugcuguccuaguacaugacaauuucccaccauggaaugcuccauggggaggacgaugggccugcucagccugaucuuacgguacacugcuucucuucuuagggaaaggaauuccccauuuccugaaugugaaacgccuacccuuuuggagccuccuagucuuuaguuccuaccucaguuaauaaaccaucccugucuaugccuugcaucucagagauggaauuugacggacuagucagcauugcaaaggucacccuaaagcuauuggcagaauacacugcccuuuguugcucagugaugauaaugcuacuguagcaguuaacuggauguauuagacugagcuacuuuuccagaauaccaaauuaucuauuuauuucuuuuaaacaccugauaaaaugcccauuuacaagcugucucaaguguauuuucaaaagggaucuuaaugauagugaaauaucagugcuuuggccucagaagagauaaucugugcaguguguguguccguuguguuguuuugcuuccacgaaaauacuucuaaaauuauacucaucuuuuaguguuucaguugucugaaacuaaucauguuccaacaaguuugaaaauucaagguguuaaaaaacaguuuuauuuacauuuugucuucuguuagugcaauaauacucuaagauguuaugaauugcuuuauuuuggaaaaaaucuuauaaagcuucauuuccauucccauuauuucccacaaauauaaaaauguggaaauagcauuuuuggcuuuagguuauaacuuuacacauaguguaaaaguggaugucaccaucuuuuuauaucuuuaaaucuacucacaauuuacuuacugaaauuauauucaguauuuauuacugcuuaaauuauauucagaauuauagaagaacaauuaaugaucaugcuacuugaagcgggggagcuauacuugacauaguuuuguguuuugcguguguaaacugauuuugugacaccacagugcagucuugauauaauuuuuuguacacagguaacauuuuugucuugguucucaccuaaauaaaacugaguaaugauccaaagugcuaagguauuugugacuuucacuaauuauuuucacuuauccauguauuuuguacuaauuacuuuccuaaaugauuugccacaugcucuucuauccuguaguucuguuuuguccuaaucagauugggugagcgauuagggauuuaaaauuacuacuucuuuggucucaaaacgaguaagugaagacucagagaaauaccuuuaauuugccuuuuaguauuuuugaauaaagcagacucuguccugccuuccuuucaugcauguauucauuguuucuuacugagugagacaagcacauuuaaaguagaauauauuccuucucuccagaauaauagaaugaaaucagugaucaaguaauuuuucauuucaguaauucaacaaucaauggaaacaaaacaaaaugaguuaggaaagaauaguuugcauuaagcucagacauggaauaauauuugaaaacaaaguaucacuauaguuuugugcuguagguucuuccugaccuaagugauuguugaaaggacuuucucuaguuuagagguauguuuaucuucgaacaauaaucacuucaugcuguucuuuuuuuccuaguugacccauucuccagaccuuucaaaaacuuuuuaaguggauguaaacuccguuuuaauuagagcagugcagucuaauacugcaacuagcgaggaauggaagaaacgugcuggaaguuaauacaacccaaaucaaccacagccagauaauuccccugaucuuuguaacaaccgcccccccuuccccaccuccacaauuaagugacccuguuguucuguaguuucaacgagacauuuaagguucauuuaaaaaaaugaucauccuuuacaggauucuuugcucuugcguuucucuuucuuucuuccccuugccacacagcugucacugguauaggagaaagacuggggggaggggaggaggaggaagcccugcucaaaucgugucacguagcacuaauucaucugcucucauuagagggagcgagggacagcagugauggccaagagcugcacucuacacaugacacgcgaacaguuuggggaauagaaaauugcuuucucaggaagcccagccaauuaaggacuugaccauauugaaugucaaguguuaauuuagguuuuucuucauuuucccaguaguaauguggguccugugaugagcaaauacaugucaaguaaaaguugauugcaugaaggaccuggguauuauaugucacugacaagucacaaauguacugaagucuuuuaaccccuuaggugaguugggagggggaggggagaaugggauuaaugguaccauaaugauaagaauagauaguuuauguggggguggcuuggaugggacagacaggaaugguaauucaugcaaaaacuggggauagaacaaauccuacucugagggcauaaauagagacccuugaaaagcauacaugcauauauauaauucccacugcaaacacacugcccagaauauauguucggucuccuaagauuuuaugaaaagggaaaauaguguacucuguggucaugaaccaggaaauuccuuauuaauuaucucauuugaaagaaagaaaacauucauuaaauaauuacacuguuuuggauauuuuagcccuuuggcucaaugccacuguaauauuucuggcuauuuacuuauaauuucaaucucuaauauuuauuuucaauggacucugugugauacaugucauaggaaagaugcaaagcauaagacugaaagaauguuuguuuucugucuugaguaucucuguaagguguuguuuaaccaauagaaacugguggaagguccaucauugucauucauuucuuuuugugcccagguguaggaggggaagagauucaagcuucagcaagugaaguaacuuuuuuuuuuuuuaaauguugaacguugcccaucauguuuagcaucucauuuccauucaucagcauucauuuacauaugaaugucuugaaaauaagagaaugucuguuucuguugcaguuguacauguagcaaauaagaaugccuccaguuuagaauacuguguguagucugggcaaucuuagaaguuauucgugauugggccuuguuuuuccuuuauaccuauaaccacuuuuccccuucauaucuuugaagacauaaucuuaauuaaaacacuuucuugaaaccuacucucuucuauuuauuccaaaauuuuaacacacuugccuuuguauguugacaaugcuuaaacuuugaaaauuuaagucugaucauacuuuaauuuuggcaacaaaacuuacuaacguagucuuucccugucucucccacagguuagaaacugugcaaucauuauauuaaaaguuaacuaaauuuuauuaaggaauaauuaggaaacaauuccaagaauuugauguuuaauaaaauagguuuuucuugagaaagaaauagucccucuaaugaggcuccugaaugcugggcuggcaucugaguucuuuaacaucucuccuccaugucucaaaacuaaccaaacaaaauucgcuuaacucucucuucccuuccuauuuugauaagcucuguggaacugugguggcauugcaaguguacuguuuaauuaaaauccaguugucagcaggcucucuuccacugggugugcugagagacuuaaguaaguuuccauaaaguaaauucugacgauggcagcguggguugcugauucaaguuauuccuucucuucugugucacuuuugacggaugguaccuaaugcaaucaaccacaggccgagaaagccuuuucuuugguugcuuuaguaacuggaccaggaguuccccuccccacuucaucuccccuucaguggcuugcucacuccuugcugccacccccaccaacacuucagcccaaauaggaaagcggaaagaacagcagaacuaccuaggacuggcugacaggcuuucccuaaaccuccauuucccagcggugaagccgaagcugccucccuuugcgugcguuuuugauaaauuuaagaagucaaaucgcugacacagauagauaauccaaguguauagggugaagcguuauaaauuaacacauuauucccucuuaaugugaaauacuugagaaugcauuuucugaguccccugacaucuacccagugagggcucacauugugcuuuucuaguggcauugauuuguuaaagcgcugaaucagcaucucaggccagcugccugauccacuguuuuguuguggggcuccagcuccuccucucugccagcaaucccuuuuuuccuucggucuuccuuuucuuuuucucucccuuucccuacugacuccuucucugcuuuuuuccauuuugcuccuccccaucucauucuuauuucuuuuucucucucaccccgcccuuccuguggcuugcuuuugucucaaucugguuuuccucccacaccaucucuuugcuuuuccuuccuucucucuuuuguccauacacaucuuguccuuucucaucucugagugaguuuucccucacucaggguuggugucuguuaacugccuuugcuugcaugugcauguuguauguguguguugaggaggggguugauuuagccaaucucucgacuccaaaugaaucccugcagagcagaauaaauuaacguaugccuguuugcacaugcauguccuguuuuuaauagaaguucaugagaaaacuuucaccuauuuugcuuucuagaaauuaaaacguagcuuacagaacuuuaaaacucuuauuucuaaaugccauuuaacacaguaaaguuuucuuuuggcucaaggaaaauggaaaucacggcugguuaucacagauuugaucuacucacauuguacccaccaaaauaaauuaacauuucuacaaaacucugggcaccuuuuugaauuucagugaacuuacugauacgacauuuuuucuucagcagguucuguauuguucugauuccacuuauuuguacugguacaauuucauagaaaauaguuuucaucgugguauuuguagcaugcucugauuuccuaauaugugaugcaucgcuauaccauaguagugaauacuuagauuauaaaauuacuuuggcccggcgugguggcucacaccuguaauccuagcacuuugggaggcuaaggugggcagagcaccugaggucagggauuccagacuagccuggccaacauagugaaaccgugucucuccuaaaaauguaaaaauuagccgggugugguagcacaugcuuguagucccagcuacucaggaggcugaggcaggagaauugcuugaaccugggagguggagguugcagugaacugaaaccgugccacugcacuccagcccgggcaacagagugagacuccaucucaaaaauaauaauaauaguaauaauuacuuggcaacuuguuuagaacuaaaaugagauugcuuauccuucuuuuagugauguaucccagaguuccagaggucuucagaggagauauauuaccauggagaggguuacauguacugcaggugcaacuucacagaccucuuuucauaggccccgguucauccuuugaauauugguccaagauacuuuggugucacuguguugauuaacuugauauaagaagaaaaguguaucuguuuggacuaaaauagaaauuaaccucuguaauuuuaaucucacggcaucacuugauucuuccuucaauuuuacuggguuuuacucuaguaacuucacacuaguaacaucaaaauuggaauuugaauaugcacauugauaauaaaucagauuacuugaaaaaaaucaaaugucuauugcuguuguuuuuuuuuggcgggggggcggagucuugcucuguugcccaggcuggagugcaguggcgcgaucucagcucacugcaagcuccgccucccggauucacaccauucuccugccucagccucccgauuagcugggacuacaggcgcccaccaucacgcccggcuaauuuuuuguauuuuuaguagagacgggguuucaccguguuagccaggauggucucgaucuccugaccucgugauccgcccgucucggccucccaaagugcugggauuacaggcgugagccuccgcgcccagccuucuugcuguauuuuauauagauuaaacugacaauuugauuucagcauuugcaauuugaaauggaaguguuucacauagguuuugguaaccuuugcuucugaguuggauugauucuccccuccccccagucaaguauaauuccuuuuuuuuaaaaauuaauugcuguccucucaugaauuagcauggcuuggcuaaggugaagggauuagaaugacuuuucaaggcaugauaaugucuguuuaaaggaaagaaaaagaaaaaagucuuuuaacuagggcuuaagacuaauuccagcuacuaaggagacaaaaauuacucuaaagaagacaauuugguuuuauuuuauaugugcauguuaaccugcuuugagaucaucauuuuguauuuuaggguauucucuuagaugaaguaagauguucuucauuuguuacugaaaggggacauggccucacuccaggagauuaaagcuggaacaccuucugccuucuguagggauaaucacagcucaccuggcuguagcucaaggucagggcaaaaagaggggacuuugugcuuuuuagaauugccuaugacuacaguagagaagaggaauaauaaaacaauuggacaagauugaaagugaaugugcaucauaugaagauaguuaauaagaugaaugaucagaaaaagacaaucuggaagacauccuucagugguaggagaaucagugguagaagaagaaagggguauuuuggggugcaaaacuaugaccucuguuaacuugcaaaaauuaguacuguugugauugguuauaaagggcuacaugagaacaauuuuaaaauuauaaaaacauuuguaaacauuuaguaugauuuuaauuuuucauuugguauacauacuuuuuaaaauaguugcuugucaguuauguugcuuggaaggcagaacucucugcacaagcaauaagucaguaaauccaguuuuuugaucuaauauuguugcuuguuuguuuuguaauaauagcauguaaauaaaaaugguuaaguguagguguuuuaggauucaaucccuuugaauuuuucucucaacuucucuggagaaauaggaauuguuucuggguguuuuguaaaucuaaauugaaugucacuuaaaugugaaagaacuggcaccuuugauaaguaguccccauacugaaucauuuugucauuaauaauaacauaauuaucaaugcaaauguaaaguuuguuuuuuaaaaaguccaaaacaaacaaaggagggaaaaaaaaacccaagccacacuaucauacaacucgaggaaaaagcaucccuacauuuaaacagaagacuuucaauaguagcaguaauaauaagaaagaaccuuuggcgucugcccaagagccuguugagagggagcagcaaauggccugcgcaguguguggcucugcagaaauuccagggugacacaugccucacaagcuggucacaaugcaaggggucaggggucauguucaagagcaggguguugcuggauaaggcugaggaagcagagguggccccucugugcucagugugugggucuguguacuccuuucccgucaaagcuggcccagcgcggccaaaaaagcgguuccuuggcaggguuuaauggcaggaugauguagucuguugugacuagugcauuccuuucagguuaaacuagggaaauggcauuguguuaaaauuccaagucgcaugaauguuuuauugccacagugcauuuagcccuccaggggaguguguguggcggccggugggggugggggugggggugacuuagagacucaggaacuaucagaagaacacuucccuuggaaaauuuuacccacuagcaugaagcugauuugcugugauggucacuuagaaggguuucgcuuuuuccuaaacuguggcuguuuaaagucuuggagucuggacaauuaacagcugaagaaaauaugacaagacacacgcaaagagguugggagauagagaggaggagugcgccagaaaggagcugagcugccuucuuguguaaacugccugagagcgggcccccuccccuggccuccgucccuguccccccuuccccaaggcuguguucugcugucugcccgaaggccaggacugaucuguuaaccuugcaccacuggcugggaggccgcugcagcucaugguacuguauguuaccauuacuacucccucauucuuuuucacuggcuuuuuuuuuuuuuuuuaaaaaaaaaaaccauuucucuguaauaacgguuuauauuagucagagggauacaauuuuggaaugcagaagauccgaguuuaaaacaaaacaaacuuuagaaugguacuuuuuuuuuuuuuuuccuuuuuggcauuuagaagggcuaaauccaaccaugcuaauucaauugcagccaaagguuuucagugugauuuaaaaucaggaguucuggaaauggagcaguugaaagaugcagucauuugggcuguggaucuuauaaagggacuuuguugugaaaccacacgagcaucuucagguuuuuaggauauuuucagucuuugcauuugucucaguuauauccauuuugcagauugcccccaaccccuauccuuccuuagggaaaacucuagccgucucauucacuguuggaguuguuuuaggcuuacaguuacugaggguguguaugauuugacuucaguuguaaucgugugcauuacauauaacauuugaacugacucaaguuaauuuauaacagauuaaaguguggauguguggaacagcuuucugauaaugcagugugccuuuauaaaauauucaugugucugauuuuuucccccaauguauaggagaaauauguauuauccuaagaugaccuaagaaaggauauauuaauaauaguuugaauuuuacuuuuggacugcauuucucuucaauuucaaaccuuaauucuuucuuuguuuucauguuccuguucagauguuauuuuucuuuuccuuaauaauacauauauacuuguaugugugugugagugugugcacauuuuaauaacugccaaauaguuauaagaaaaaacuuggagagcugcuaaguuacuuuuccauugauacauuaucagucagaaagucauguaacaaaaauucaacucaagaauauagcacagaaaaguaaacuaugaguggacccgugugcccuauuuauagaguuuuaaguacauguuauauauaucuuauaaaacaaugauuuugucaagauagaccccugaguuuaaucugacuaaugguguuuguaugauggcuuguucuucuuaaacauauauauugacauuauuuauaggaagucuuacaccaauaagcgaucagcuccauaggaaaaucaagcuguguuuaugggcugggcacuucaaauuuuaggugaauucauuagauauuuuuuucuuauauucuagagaauacccacuucaauaauuauuucuuuuuguucuauuuggucuaguaacaugaugauaguuuuuuuagugauuuguuuuuuaguuguacauuuuaaaaugugauuuuuccggagaauauugcucugugcuggauuuuuauuucuuuuacuuaacagccaauuuuaaaguuaauuauuuuauuuaaauacuagaaaaaguaguuaauguugccaaauuuaggagaaaaaucugucaauuaacauuuagauuaucugaaguuauauuucuuuuccuagugauagaagcacuuuuuuuaaacugugaaaaggauguuguaguuguguucagcccuuuccaauuugauuuauuaaaaguuuccuuucauaauccaagaggggaagaguggaauuacuccaguaucacaucucucuaauaagaaaauuucagcugauuuaggaaucuucuccgcauaaaaguaaaauuuucuuaaaaaauaucaucacuuguucuuuuaguguuuuccuguucccauugugccaggcacacuuguuuggcuuuggaaacuucguggaauagugaaaaaauggguguuguuucagauucuaaugcugcuacauguuagcuuugugacuuuggauaagugacuuuaucccugaccuuuauuuucuuugcuuuuaaaauggggaaaaggacauuuagcuuacagauugucaggaaaaugaaaugagacaacacacuugaaguuccaguacauaguagauacuuaauaaaccuuaggucauccuccuuugaccugcucuguggcuuauucuccaguuuuuaucccuugggaagcuugaauuuuuggaaauaguaguguaggaugguaggggaauaaguuuaaauaaaauguuuuagguucuucauuuaucucuaggaaaggcgauauuaggccaucagcagaugucuuuuuuuuuuuuuuuuuuaaguaaagaaacucuggcguuauuuauuagucuacauuuuuaccacucugcaaaauuuucauuagguugaucuuuguggaugucagagugaugcuaucauuucuguguuaccaguuuugguacagguaguuuacaaguaaaguuggccgauucuguuggauccuguuuacuuuuguauaaucuuuucuaaucauuugcuugaauuaaagcuuccugccuuauagucauuagcauuugauaguggaucuugaaacuugauuuugcaaguuagacuccagcgucugucccugguuuugugaaaaucuacuuauaaucauggaacuaagaccacacuaaagcuucgaguguuuacaccucuguagaauuaaacaaaacagcagcagucaacauacauguaucugggcaauacuuuaucuucauuuagaaucuugcagaaugccuaaaggguaguuaaggacuuaggaacuauuuguugagcaaaauaaugugcuucuuuuuauuguuuuuuagcccaggauuauguuuucauaaaaaauaauuguguucccaugugaaguacauuaauauuauugugguuggucuuuuuuuuuuuuuuuuuuuggagagucucguucugucacccaggcuggagugcaauggcaugaucuuggcucacugcagccuccgccucccggguucaagugauucuccugccucagccugcugaguagcuuggauuacaggugccugccaccacgccuggcuaauuuuuguauuuucaguagagacgggguuucaccuuguuggccaggcuagucuugaacuccuggccuaaaacgaucugccccccucagccuuccaaagugcugggauuacaggugugagccaccacgccugccuguagauggucuuuauuuaguauugcuauuuugcuuaacaucuaacuucuuuuagccugccaaaguuugaacauacugcaucuuaagaucuaaaauaaauauuugacuuaguguuuacuuuggcuuguuaguaagcauaaaaaaaugaaaauuguuaacuaauaacuuuauugcuaccuuuuagcacacauagugugcuagggaugcuagucaugauaucuuauuuaugcuuacaaaagcauucauggaagguacccauauuuucauuuuacagaugaagaaaucaaggccuaacauguguaauccagcaaaguugauuccaaaucccuugcuuucccccuugcugcauucuucauauaucauuuaagcuagcuauuuaaaaagaaaaaagaaaguuaguuguagaaaccacugguuuuauuuccuuucaaauuaaauuuuaugaggaagucaguauguagaacugauaaaaaucagaguuguucuagaugaaaagagauagagccacagucccaucuuuuaagccucuccuagggaucccuggaauacuugaugagaaagccuuagccuaauaccuccacaccccagaaaauggggccuagugcaacucuucaguuuccccaucugggacuugaagguuuuguuuaucuugugcuuggcgauguuauuauguggaauucacaggaaaagcuaaucaguauaauuuuauuuauuauuuauuuauuuauucuugagacagagucuggcuagagugcaggggcccgaucucagguucaagaaagucucaugucucagccucccaaauaaccgcgauuacaggugugugccaccacgcucaguuaauuuuuuucuuuuguauuuuuagcagggaugggguuucaccauguuagccaggcugguuucgaacucuggacuucaggugauccaucugcaucagccucccaaagggcugggauuacaggcaugagccacugcaccugacugcuaaucaguauaauuuuaaaagcuuaugaaagacugugggguaaauaccaccgcaaaaaaaauuacaagccagguugcuggcacgcaccuauagucccagcugcuugggaggcugagucaggaggauugcuugagccgaggaguuuugaguccagcuugcgcagcacagacaggguguugcuuuguugcuugggauggagugcaguggugugaucauagcucacugcagccuccaauuccugggcucacgugauccucagccuccagaauagcugggacuauaguugugcuacaccaagccuggcuaauuuuuuguagauauggggucuugcuaucaagaccucaagcaguccuccucccucggcuucccaaagcgcugggauuauaggcaugagcaaccauguuuggccucauuguaaauguuaauuuucaggguauaaauuuuguuucauccauagcaaugaaguaauuuuacuauggaacgagucugaaaaaacuaagucacaguuuuaugucuaacugaagucugugucuacagacucuacuucauuuugaagguuaaaguuugggugcuguauaucacauuauagcauaucuauuaaagacauauacauaucauacaggcauauauguguaaacauaaggauggagaagauaaaguggaucaacuuaacugggaaaauaaugucaaaaucacuauuuuaaauaaauugcuuguaaaacaaauuaacugccaugauaauucuguaauaucuuuauaaaccagaaauuacagguuuucucaccagauaaauuuacauugggaauuuauguagcucuuuauuagaaauaugucucuuucaugaauauagugagaagaguccagacuuuuuagcuagauuuaccugcauuugaacugaucucuuuccuaugugacuuuguaaaaguuauauaaccucuuugaaucuuaguugcuucauuuauaaaauggggcuuagaaguaaaugaugccugugaauucuggcacagagaggguuaguuagaccaauuucuucuucugucuguuacuauuguagauugcuagucuuaugcaguuugcacuugguaucuguuuaucaacagugccacaguguucuuuauacuugcaucauguacauacuuggccuuuucaauuacuaguuuaaaaaauacuugugucacucuugcagaagucuuacuuuugcagaagaaaaugaggguggagagaaaucucuucuuucuuacucuucacugagaaucagucacugagcagcauaauucuaaaaucuuauguggcuuuuggguacuuuaugaaccuuuuuaugguaacccagaagcaaggcacugauugaauuaauacauuuccaucaagggacuauucuguuggccugucuuccuccuccuaacccaugcaugcuucuauaagggacuuuuuuguugcauuauuuagguugccacauauaguggggaugacaguuuguagaugugcagguuacugguaagccuuauagccuuucuguuuuuaaaacaaagggaaaggacaaaacaaaaacaaaaacaaaaacagaacagcaacaacaaaaucacuacccaaaccaaaaguaacuuaaaaauaccaucuuagcuuucuggaaaacccagugcuuuauaaaauguagaaucuaaaguuugcauacugauauuaauuuuuaauaguuuuaaaacuuuuaaauacaacuucuguacaaaaggauauguguucauagggcagaucugauuaagaaaaccucaaagagagaaaacugccugaagggcuaucaccaaggaacuguuaauguauuuuuagucgucuuucuucauuuacaaguaccuaccaauguaugaauaggugguaguuucauaaagggaugauguuacauguauaugugacuuuuaaaaaaugcauuguuauccuaaguaucuuuccauguccguaaauauagguauucaucauggcuuuuuuuuuugagauggaguuuugcucuuguugcccaggcuggagugcgguggcgccaucuuggcucaccgcaaccucuguuuccccggguucaagcgauucuccugccucagccucccgaguaucugggauuacaggcaugcgccaccacgcccagcuaauuuuuuuguacuuuuaguagagaugggguuucuccauguuggucaggcugaucucuaacuccugaccucaggugauccucccgccucagcuucccaaagugcugggauuacaggcgugagccaccgcgcccggcccucaucaugacuuuuaauggauucuuagcuugccauuguaucauaguuuauuuaaugaguucuugguuuguggauuuuuuuuuuuuaauaaacaguagugcuuaaauaugaacauccuugcuugcccuuguaugcuuauuuccuaaaggugaagacagaugugauacugcuagggaaggcagcauaauuuugcacagcuuaagagagagauuggcaaaucuguucugugcagggcuagaugguaaauagguagauguaugguuucuguagcaauuauugaaguuuuuguaggaccaagccccuguguauguaaaggaauaggcagggcucuauuucaauaaaacuuuauuuacaaaaguaggcagcaggauagcauuuggcccacaggcuuguuugccuacccuggacuugaaacuaaguagaaacuaauuugggaugaaaauuuaucccuaguuugcuguaaacugcuuuuacaguuucuuagaaauguguuccuaucucagggcaauguaaugggcugaugacugacuuucuuuccagguacguggcaaucaauacuuaauuuuaaagaacuuauuaaaggagcuucucauaccagcuccuacuccugaagccuaguaaauuuuaaacuaagagguuauauauaccaguauauauuuuuaucauucuauacuuuuuuuuuuuuuuuggaaaucgagucucacuuguugcuuaggcuggagugcaguggcaaucucggcucacugccaccuccaucucccagguuuaagcaauucuugugccucuuagccucccaacuagcugggauuacaggcaugugccaccauacccagccuuuuaaaauauuuuaguagagaugggguuuugcuauguuggccaggcuggucuugaucuccuggccucaagcaguccaccugccucagccucccaaagugcuagaauuacaggcgugagccaccgugcccugccacaucguauacuuuagauuucagcauauguugacaacuuguugggcaaggaacgaccucuuuaauuaauuaauuaauuuuauuuuuguauauuuugagguggagucucgcucugucaccuagguuggaguucaguggcgcaaucucggcucacuaccugguucaagcgauucuccugccucagccuccugaguagcugggacuacgggcacgugccaccacgcccagcuaauuuuuguaguguaguagagacaggguuucaccauauuagcuaggcuggucucgaaauccugaccucgugauccacccgccucagccucccaaagugcugggauuacaggcaugagccaccgugcacggcacacucuuuaauuuauauugcagggcagauggguauuucccccuuucuagaagguugcuuaguuggagucauguucuagagauauucagaaguaagcugaaaggaaaguccaauaagaggagaagaaucauuucagcagaaauauaccacagaucaacagggugacauugaguuaguuacugaaccuuaauaggcuaaauuauacuugaaaaaaugcucugugcauaaauaauaaccuuuuugcaucuugaguuucuauaaaacaggaauuauuggccucuacuugccuuacggguauuuguugaggaucugcuggaauaaugaaauaguuaaaaucacucuauuuguaacauugugucacuggugcccuuaugaauuuuaagauauuuauuuauuauucaguauguauuuguugacuaucugcuauguguaaagcaguauggcaagugcuauugggaaauacaaagagaaauaaguuaguucuugauccuaaggagagaaaaacauguuuuuaagguucaaggucauguggugcuuagagcccuaaggaacauagagcacuugggacgaugagaucccuuucauccaaagguaucaggaaauuucauggaagaaguggcaucaggaaauagggacauuuucaaagggagaauacaggcgaggguauuccaaaaagagcagcaugagaacuauuucagguuaggaaaguccaaaucaguaugcaagagacauaaaauauucuaauuagagugucuaucaagcauuuuucaugaagaaggaggagaagauaaagcuggaaaggcagguuagagcuagauuguagagggccuggaaagaacuguaauugguaauugguggggagcuauaaacaugaucuaggagaauguguucgacaauuggaggggugguguauagcacuaguuggcaaguauggaaugauaaagucaggauuauugcuaaaggguuauugcagaggucugagcauguacuuguuagaauuauucuggaaagugugugggggacagcugaggggauugaaagggcagaauggacaggcuaucagaacugacuggguucaggaaauaaggagaagccuuuuaauaaugauguaugguucugagucuuuguuaaugggcuuaugguaauaacauugaaaaauauagaaaaauccagggaaagcuguaguaaagaaaggagaccagugaaccuauuugcuuguuuagcucgagauguuaacuggacacuuagaaaaaucuagugagaguuugaaaaugcaggacugaaauucacaugagagguaaggauuagggauuugggagcccuguucacacagagguacgugacagaugagacuugagaagagcuucacgucacuuaacgagaaugcguguaagagagaaaaugcggccacaugauguggcucaugccuguaaucccaguacuuugggaggccgcagcaggaggaucacuugaggccaggaguucaagaccagccuggguaacuuagcaagacccccauuuuuaucaaaaaaaaaaaaaaaaaagaaagaaaaagaaaaaaauuuagcuaaaaagaaucacuucucagcuaaauugcagggcacguggguauuuucccccuucuagaagguugcuuuaguuggagucauguucuagagauauucagaaguaaacugaaaggaaagucuaggaguuuaagguugcagcgagucacaaaugcacaucacugcaucccagucugggugacagagcaagacccugucucaaaaauaaaaauaaagaaaaagaaaaugguauuauuuuaaguauuacuuaccauuggguaagucaauuacguaaguagcucugucuuuuugugaggcaacuaauaccaaaagaaaagcaaaaaagaaacucucauguauuuuaccauuuauaaagcauucuguuguccacuaagcuucucuucuuagcuucuaaagcuacuagguuucagggguaaaguauguucaguuuggggaaaaaauauuuucauaagauucccaaggaaaauauaacucccuuugacuuuaucuucucuccacuuccugagaaccuuaguaacaaagauguuacugguaggacggguuuacauucacuuuuuaccugucugauacagacuacuacagcuuuucaucuccccuaguucucaccccaguugagauccaugcauuugggauggggguggggggguaucccuuagaaaucaacuuuguaugcguuugcacauuuuucucuuuuuagucugggguccucagcaggcuuggaggggggauuguguaguauacaguaugacuuauguuugacuugggaaaauuuuuccuguauggaacagcaggacugaaucugcuuucucauuuccuuucuucuuuuaacauuaccuauguucaagcuuugcaugcaaagaaaaccguguugauucauugaucuucgacaugcuacauuaugagccuuggcagaagguaaaggcuccccuggcuccccuguuuagagcagccggaauuccucuggucuguugguaccaucuguggccuuccuucaggcucagucuucauaguaagucuaacucaugucaaaugggccaaggugcuaguccagaguaauuugcaucucuagccaaccacugugcauuuacucuaguaguaaaugccuguuguauuugucucuuaaacuguguaugcuacugaaacuuuuuuuuaaaaucauaauugguuuaauguaggugguucaaugaguaguuugugaaguugaauuuuugggaacuaauauuugcucuuucccuuucugaugccacaacauauucuucuauccuauuucauucaaauucacuauucugcuuuuuucacauaaguuuuucaaucacccuuuuucccuuugguguuguuuagcaagggaggaaacccuuucaauuuguuccauuuuugugccucugaugaaguaagagcaacucagacggauguauuuucuuccuaaguaaacucuuuucuaaaaaaaugccacacccuccccccaaaauaaagcauucaauagcuugauggugauuacuugaaggcagucucuuuccucauuagagguaaauacaucuucacucuugauugccgcggaaagauagguagagaagcugaguggagcaaacccaauggcugaguucaaguugaccuggaucauuuuaaagugcuuuucauguaaaugcuacaguuaaugucuguccccacauaauuucuuucuaauguuugcagcagauguggaguuggccuuaccacugcucaagcugcuugcucauuuuggcuuuuucucguaagcuuuuccuuuccuggcuuccuuucuuuucuuuacagagugagauguugggagauaagaauuuuaugccuugguguaugcuccuucuucuuucucuccauuguuuuaaguuauaucuuuucuaaaacuaaguuaugaucuguagagcuuuugucuuaugguuccuuuuugguuuucuaguuuacaugggcuagggagccucaaacuuuaaugcucaucagcaucacguggagggcuuguaaacacaggugagggacuccaccuccaguuucugucacagugggucucagguggggcaugcaaaugaguuucagacaugcucucaggugaugaucacaauaaucuuuggccaagaagcaugccuugggcacugaccgagacuauuggucuugucugucagugugcugcccacccccagaggguuggguucuucagauuuuauucaugcacguucucuggaaacucuuuacuuuuuaauaauuuauaggccaggcugcuagcauaagagaacucagaaaauuaccuuauauuuuaauugugaaacgguugguugcaggaggggcagauaugcugcuucuugccacucucacccccucaucccccagugaagucuuuuuuuuuuuuuuuuuuuuuugagacugucuuacuguguugcccaggcuggagugcaguggugagaucucggcucacugcaaccucugccucccagguucaagcgauucuccugccucagccucccaaguagcugggauuacaggugcccgccaccaugcccagcuaauuuuuguauuuuuaguagagacggaguuucuccaugucggccaggcuagugucgaauuccugaccucagguaauccacccaccuuggccccccaaagugcuggaauuacaggcaugagccacgacgcccagcacccagugaagucuuuaacacuaagucccucugagcugacagcgaucuuuucggucauuccaaacacagcaucacucuaggaagccuucuaaaagaugauugaguuggcccuuggucccuaagugagaccaagugacucugucucuuuuuaguuuccccaguugcuuauaauauuccuuugacccuuguggcuugcuuuccuuuccccuaugcggcuuccaucguggucucaaaguucucagccuucauuggauugguaugcuguggugcugcuuuugugggcugggggcagaguaccauuuacagauauacuguguaccuacugaauccuuaggugcuuuacaugugucaucucauucaaccuugccaacccugcacaauaaauauaaguauccucauuuuacaggugcaggaaacaaggcucggagauacguaacugagcaacuuuacaagauauugcgguagagauuuaaacagagaucuaauugcaaagcuagaacucuuucaguauuaccugucuuuaagauagcuggaguugaguguugaggauagaaaguaaguuaaccuggguguggcauacuugaaauugcauuuaaugucaguugucagaguugacaauguauuugcccauaagcaacaaccugugguguucaauuuccaaaauaauguauuacaagaaugauugcaaaccaauagaauaauagaauucuguaccuuuuuuucuuaaauauaagaacccgccgggugcaguggcucacgccuguaaucccagcacuuugggaggccaaggugggcagaucacuuuaggucaggaguucaagaccagccuggccagcauggagaaaccccaucucuacuaaaaguacaaaaauuagccaggcaugguggcaggcaccuguaaucccagcuacucgggagaaugaggcaggagaaucacuugaacccgggaggcagagguugcagugagcugagauugcgccacugcacuccagccugggugacagagugagacuccaucuuuaaaaaaaaaaaaaaaaaauggcugggcacaguggcucaugccuguaaucccagcacugugggaggccgaggcgggcauaucaugaggucaggagaucgagaccauccuggcuaacguggugaaaccccaucucuauuaaaaauacaaaaaauuagcugggcgugguggugggugcuuguagucccagcuacucgggaggcugaggcagaagaaucgcuugaacccaggaggcacagcuuucagugagccaagaucgcaccacugcguuccagccugggugacagaaugagacucuguuucaaaaaaaaaaaaaaaaaaaaaaagaacccauacccauccguggaucugguacaagugacuucauucucauuuucuccaaugcuaaaacccagguaaagcaagaauugcaggaaguacgugaaaucuguccaauaguaggauguuuuucgaguaaagcacuagcgaagucauugagagaacuuugucuuaauuucacuucuauccauuuuuaucaaauguagagggagaccauagugauaggucucaguuuucucauuuagaaguaaaaggaguacaauggaaauuucuccccuuccuuacuugucugaugugggaauuaauaaauauuacguguaaagcccuuugagcacucuggaagaaagauucuauguaauuuuagcauuauucgugguccauuaggcuccucagggugucaccagggaagagagauuuuuaccuuuuaucccauauuucacaguauaaaaacaagguauuucuguuguuguuuguggcugugaaaaaucuccuguaauuguaccugcagagguugcuccuaucacagagcccagggcacuguucuuuggcagcucaccccagaggaucagcuccugagggaagagcaagagugaaccuuagugaaauagcuccugguggcugugaggacauugugccugcuccaccccgcacccuggcauccccccaccuccgucaccuucugugucuuucaaccuguugcauaacagaaucacauacugauugacucuuuuccauuuucuuuuaucuuaugcugauccuauaguucauugcucugagaugacuccagaggagaucugugucuccuucaggcacuggcaucuguccuauccaguucuucuccuauaaaauaucucccauccuuaucauguuccuauugauacaacucugccuuaucugacucuauaacaaugaauguauuucuggucauuccauccuugaaaauggauaaguacuguguuguauuuauuuauuugaaacaggguuucacucugucacucaggcuggauaauaaauacugugucguuaguauguauguauguauguauguauauauuugagacaggguuucacucugucacccagccuggagugcaguggcacacucacggcuccuuuuaacuuugaacucuugggcuuaaguaauccuccuaggauuacaggcacaugucaccacacccagcuaauuuuucuuucauuauuacuuuucucucuguguugcccaggcuggucuagaacuccuggucuccugccuugaccucccuaagugcuaggauuacaugugugauccaccacauccaauuugacucuguuuugauuuaccaguugcuuucugaucagugagcaguggguuccuucuucgcccuuagguucuauauucuugguccuucugagucuuagucuggggucccaugguagagaaaguuuaggcccagaauuuugucuccuaguuaaauuguaggcugaaaaauggagauauaauuuaacugcauacucugccacguagcucaccuuccuguguuucugcuuuuguauucauuuauuuugcagcaguguguuuagcgugcaucuucaucuuuacaguguuggauaauuuguuuauuucuuuaucugcucuuucucacagggacuccuggugagcuuauugucaaaucuauuucacuugauggucuuccugaacucuuuguguuaucugagugauuuuuccucuugccgcuuggcauuguauaaccacugaaauuaggcuggagugcuauugggucuuccuuuuggcuuggaauccggcagugcuuguaccuagccaugucucugaggagcacucugauggggcuuuauuucuguuuaucucucucccucuuuuuuuuuuuuuaaacuuacauuguauaucauucuuuuccaaggucuuugucccuucaacacugccagacugaagccaccaaaacacauacacuucagaacugaucugggcuuggggccagcuugacugaggagacuggagcucacauggaaguuaguuuguuuauuuaggcugugacuuucauagugucuaucaggcagaugccuaccugcguguuuaauauuuaaaaguaaaauggaaauuucaaguggacccuggcucugcagggggcaucccugacuacgagcccuuuucaucguaacaugacucuucucucaaguuaucauuucugugacuuuucucuuuuuuccuuuguccccuuucugccacccauuuuucacagccauucaucuucaaauauuuucaacgguagcucccauuuacaaccuggagcuuuuuaugucuucuuuucagaagucuggucccuaacauuuuuuuuuuuuuuuuuuuuuuuugugaucucaguaaacaaagaguguguguaugugugugugugugugguuauguguguaggaagccugccauauuuccucccugccccacagaaaauauguuuucuggaagcccuuuugacaccgaagugaaugcccacuggcccucccuuguugaauucuccugaggggagagagagaggccuuuauacuugucauaucuuuuguuucugcugauuauacacaaaguaaguuguaaauagcucucucacacaccaugauuccuucaagguauguauauacaggagaguagauauguacucagccuccacuugcccuggggauuucagagggucccuuucaaggccucugaccuccuguuacaguacuaagauaaugaaauuuacaucaguuguaggcaguuauuccauaauuaaaccuguggcauaauguuuagaaauauuagcugaacaguucaccauuuuuuuuuguuuuuaaguuaaaugauuuuauuacuuuuaaagcaacauauacaaucauacaaaaagaauaaaaguuaaguaccuauaaucuuaaucacugugaacauuuuggaaaaucuuuguagaacuuuguacuauauaguaugucaaguaugucauuaaaacaggcacuagguguuagcacagaggaaaaguggauaaaacggaauuccccaaaucaguuuaaaauuuauauuaaauaaugguuaggcacaccccauauuuuauuauccuaauuuacaauagacuaauaauaagggguuagacaauugauaucugauuuuucuucaaucauuuuuugauugcuuguggcuggcuaacuucugaggcuucuaaaucaaaagguggaaugagaugugcuaaauuacaacuaauuagguuaucagcuuuuaucucuuuuguaucuuccuuaguacauuuugaugaauucagaaagagauaugguuugccuuuccguguugaaagauuucccuaacugaugacgcugauugugguggauggggugagagugugguguauuuuuagaccaugaaccguucagugaacuuugugaaccaauuuugauuugaaucucuuaucccucauuuuuuagaauaugggagucaacuuucaaagauucuuauggauauauuuuucugcucagaaauccuagcacucuaaguuugaaaauguacccacuucccuacuaguuccuuuuugugauuaugauuguugaaacauacugguaguuugccaccauuuccucccaacuuacucacagaccuuuauguuuucucuuagaaacaguguauuucuaagugucucaaguuguaauugcauguaauuuuaguuguuuaacuuucuccuucccucuugagaauguuuauaaagugcauucugugacugugaagauaaaaagaacuagaaacuuaguguuugugacguggucaaauaaucuuaagguaaguagcaauuuguuuuguguaugugagaucgggugagguuuacacuuaauuugcaauauauggcuuacugaaucugccuuaguuaagucccauuuauugagguuuuauaauaagguuuuggggggauucauuuugauuuggaauauucucagguuaauuuuuuucuuuucccuucuauugcucccuggggagaauuacuguugcagaacucauuaguggccuuccauaugucagcugagggguagaaugagcauuauuucuaugugugacacaacacaaaugcacagugcccccgcucuucucccugcugcauuucuuucuuauuccucaguuaagaggauaaauucccuuuuuuguuacuuauguuguccuagaccaaggagcagguagcaggucuugauuucgguuagcgccuuuuuccuuuguugucuucuuuguaauuucuuucauaugaaacaucaacaaauaccucuagaauggaugccacuaaauguaguuauuacauuuuuuuuuaaaauuaaauucuuggaaauguauucucaaccuuucuuuucuuucucaugucuuaaguuugaauccagguuuuacaaccuaauaacaugugacucugagcuaguuauuuaccuacucuaagccucaguuuuuucguuuguagacuggagaugcucauacuccguaagaguguugagaggaaaaugaggguuaaucuacacguaagauuccccacauagugacucgcgcauuggccugcacgugugaaacucuuggguaaagagugguuguaaacuucaaagacagaugacacucuguccauuucaccuuaugagccuaguaaagaagaauaaaagacuugaaaagaaugagagaacuggaccuaaaaauguuugaagcguugaccgaguaccuuuuauuuuucuuuucuuuccagugauauucacuagugaacuugcaaaguggaguauacugaacguuguuuaaguuuggacgauuguacugauuuuugggugaaaagaaagagggaagcaccuuuuaagcuagcaugcauggcugaaaacugaugucugaacaaagcaaauugauuagcacagaugaucuuaauuggaguuuuaaaaaagucaaagaaaacaaaacagaggagugcuuugauagggaaagaagacaaaggugagaugaugcuuaguugauguauugaguuuagagacauauagacagauauaugauuagugugaguaguauaaguauggaaauaaugaggaacaauuagaaauuuuuaaaaagcagaaaacauguuuagguggaaucuaaaaccuuguuuaaucuuaaaaaaaucugaaaugaaauaagcaagggacaguaggcaguauuuagggaugauauugacuaauuauaauagcuuaguuuuaaaaagggaucuuaguggcuuucaguuuagaauuuuagauauagagaaacauucauuaaguuuuaaccuuguuuuuuuauuauuaggacagauacauaaaacaagguuuuuaagcuuaaagauaacauguuuaaaugaguaacuauuaauaauaaauauugauaaauagaagucugccugugcuagccuacaccaggaacaggaaaaauaaauuugaacaaauauuuuaagaacguaaaggaacuuaggcauuguugaauguauuuuuuuuuaaauuccuacauaagaaaauuaaaggaaagaggaaaagaaaaaauuuaugucaccaaugugaaacagaaauuaucuauuuuagucuuuucccaucccugcauuuccuuccuucugucucccuccuccuguccguggcuauuuauuaggugccuacugugugcuaccugcugugaauacaaggaggaacaaaauuuauguugcuuuuuucuucuuggaauuuaccuucugguaguuaauaaacuuuguuacaugguauucacuauauauuugacauacuaagugucacauacaugucaagccaugaugaccuguuagagacccgcaguugggauuuccucucucugccugggucaagugugacugugugcaguucucagcagccuccauacacagcaucuaacguggcuguauucccucagguuccauuggcauguacuggcagagugcugggggcagacuucugcccaaaccuggaggagccauaccacaggcuggaaguccagguuagagucuuaacuguuuucucagcuagggguggugugacagaaacagugguccuggaaagccauuuggguauaucagcgucaucaggaaaagacaaccauugaguuagguguaaagaggaaccaguguagcguaugugcagccauagguccuuuucaggaugcguugucuguaacuguagaucauuugucuguucagucaagacauauauacauacuguaguaaguacauggucucugaagguugacuaccuagaguugauacaaguugcugugagaccuuuggcaagucacuuaauuuaagugaaccuuaguuuucucaucuguaagauggagauuuaccacacaaggugaugaugagaauuuaaaggaccugacauauauucagcaguuagugcaggaccuggcacauaacagguacccaguaaauauuagcuuucaucuucuaagacuuuugggauauaugugaguaagucaugcuuccuacaauauggucucccggcucaggagaacagcagccauucaacugagugcuuuauaagaaaagcaggacuuaaugaaauaucuucugucuucaugcguuggaagauaugucuugugguguaauaggaguauauuagcaaaguacauuuuuuuuuuuuuuggugaaacuguuggauugaaauucaguucguuuuguauggucuugaggcauuagaagugauuugguguauugcaaauuaaaaauguaaaugugacauuuuggcuaaaggcaugccuccauuucuauguacauaauaauauuuaaggaaugugugugccaaugcaaagaugcaggcugaaguuucaacauggguagcacucccuagcaugaggaaacucauacuuuuuuuuuuaggaccuccauuuggccuuauuuucuaaauuuucaggcuuauaagaugagcauagugagcucaguuuuaaaacguuuuuacugauuuagaaccacaaaugagaagagagaaccauuuaaaaaauggacuucuaugcagugagaaugaggguagaaguggugguaggaggagguuucaguuuuuaugguaccgaaggguaugccaucucuagcacaccugcucuuggcccagggaagaccaccugagcucugcugugccccaaacugguacugucugggugguguaugucugugauacaacagaaaagcaggugggacacaugagacacgaucauguauuuccuaguucuagaaagcuaacagcuugugugugacaugcaaaugcagagugauggaagacuuuuuguggagaguagucugauccuugaccuuuuuuggguaggacgagugauguucuucaaacacaucaccuggaauggucugucaugggugauuguuggaaaucuguuuuuaaaccuugaauuacagugaaaagaaaauuggguuuugcagaugugaguguguaaaauaaaacuggaaaaaaaaaccuauugaguacauugacauacuaugggagaaaauguagaaaauguuauauuuacagguuaaaguaacauucugguuguagaugaaccagauugugggguugauaguucagaaaggaccuugcaaagaagacuaaguuccuggacaaaguaaugaaagugacauuauuggauauuccucauuguggaucaucauuuugguggacugcguggaaggauugaaucuguuaaaagaugaucagcuauggagaguuagucaaguagcugggacccacuugaagcauuucuuccucucuucuuuuucuucugccuuccuaaaugugcuucuucugcacauuuuagaaauaccuaguacauauacauauuauguccaccauaauaaagaugcuuaauauacuuuucaccagcuaucuauuucaggaguauuuuuuagcuuagacugcuuucauucuugccaugucauguguccuaguccuuuuuaaauuuuuuccuagagaaugagccauuucuuauuguucagcauagcuuuauacucuagggagcucacuauaggacuugccagucaucuccuuuuccugcuuguaucauaggcuuugccccagggcuaggcauuaucaucacuagagguuuugcuguuuggccucuugauucugagaauaaccuuccguacaccucaauuuaggagcagcgguuuguuuauauucuuucuuagaaaggauuuuuguuuagacauacagcccugaaaucugguuuacuuuuauguuuuagcugacguaaguucucaugacugguggagccccuuucugcucuuugccuucuuccuuuuaaaccuuugccuuuuauuccuaaaauuucagauuucuuagcagcuuuauuuuuaauaaucccaagauccccuacuguggucaaugaauguaucuuugguuuugaaugacugucaaccuucaagucugugccugauuugacuuuugcaaggacuucugcugugguuuguguuaauauugcuugauucagaaaaauaacuggaaaucaagauuuugauucuguaacuuuauuuacuuuccccaguggcuuuugaaguggguacuccaguuugggagguuaacugaugaacagcagcaaagaaucccacucuuaugcaaucaucuucuaagaaaugguuauucuaauuuagacucuccuuaauugcugauauuuuacuuuuaucagagaaaaguuacuuuguuaguucaguugugccucaucauguauuaaguuguuacauuuagcucagcacaguucuuuucuugguugggaauucaggaugugagguuugacuugguauuuuucaccacugaagugcuuaaaaaauuagaguaaauaaugaaccaauauuucaguacuagauuagacacaauuugcugugauguuuuauaaaccacaggcuccuuucuuaugugaaugcguggaggaucacuuuuuuuuccagacauacuggggugcaaguguaaauuuccauaaaaguuaaaugaggugcuuccuguaauuaaugaacaacuguggcugcucucuggucugcauuguaauuaaccgugaucaggcuuguuuagugaugacacuguuccuguaauaauuugacaagcuacugugaauuugccagguuauuaaacaaccugcagcauucacuucuggaaucacggagaugagcucggcugcugcugcuaguuaaaugcagcauaagggugaaccaaaagcugcucaucgaagucugucgaucacuaugaacggauuuaaauuccuaugauguuggagaaguuaauuaauuuuguauagggugucuugaaacuuuuuauuacaugauaaaccuacuggggcaaagcuggucauguuuaugaacucacaaugaagccagcaaauucucuauauuuuuuaacaacaguaugaacuaaacaaaaucugaaguucuccuuaccaccuuauuaaauggguauaacuuauuuuuaaaaaaagguuguuuccuucacagauacauccacaacauccccccaaauaaaaguucacucucucuuuuuuuuuucuguuccaaauagaugaccuugugcuaaacaaagugguguugccgguagagcagucuaaguggaccaguagccuuacauccuuggucaccagcgcaccggucccccaacccccucuuucagguuaagaucuguucaaaacguuacugucuaguuacuguggugucuuucauucagauucuguuuauugacuaaaccgcaaggauuccugcccaaaguaccaggcggucuaugcuugacugauuuugauuuucuaacaucagcccugcgguuuauuugaaaaauguacauacacugcagcuuuaacaagucaagugacugcauguuuuugaccauggaguagaguauaucugaagaucauuaaauuuagugggggaagggagggguagagaauaaguguaguagucauuguaccauugcagagugagugagugugugugugaguuugugugugugacacaugguuuuugucuuuucaucuucuccaagagccagaaaguuuccugcaguucucuuuccagcuauugacaaaugauugccagaugugagaucuuugcagugcucuuucccucagcaaaccugcagcgaugggauauuugauucucccuugcccauuucaucuccuuuccacaucugccagggacacacaagcaauacaucccuacaugagaguuuaaaguuuauucagcuccuuuuuccccuccgauaaaauguuuggagacaacagaaugagguccauaugacucucuccugacuucaccguaugaaauuaauuguuuauuuuacuuaucuaccucucaguaauugaaguauuucauuuuaguuucgguccauggaaaauuugacguaacucugggagugcuaagaguuuccuauugucugcuugcugcaaguaugccaccaucucagcuucccuuugagugccucaauucugauaaaaacuagacuguugguuucacaggacuucccaguaaaguaauuuuaaucaacagcugucaaaauauuaaguguggagugucugguaaaauucaguagucauuuagaauuuaaaaagccaucuaagagggagaaaauucaacuuauuugguuugauugguuuacucuguguuuguguccauugucgaaauugauauggaugaggcucuaguuuuaaucacaaguagcuuaaaaaagagaaaguacacugaguuucagaggaaucugaaguuagccuguguaggccacacacguaaucacuaacaugcacagaagccuuuugcaucugcuuggaaucuguauugauacugauuuuuuuuuuuucucaucucaguuugaaaauauuuuccaaaaugcccuuauagcucauguucauaccauagggugggcugacacagguggccugucuguuuuccuuuuacacuuuuuggcaaauggaaaggccccuuauucccugaauaagaucaacguuuuuuuuuuuuuaaacauuuaaaaaauaauccauaaaaugucugccacauguucucuaguuuauggaaauguuugccaaauuagacuuguggaauuggauucuuauuguaaaaguauuaguguguuuacuauuucugcuaccuucuuagcuaccugugauuaugugaauuuauauuuuuauaugaaauuuaaaugaggaguauaauuauuauuucugaauucccguacugaggaaaaauuuuuuguuauuaaaggagguaagugauuauacccacaucagaaucaacauagaaaaagugugaagccuguuuuucaauauuuucuuuaaaaaauuaagaaaacgacaaagcuaacaacaacaacaacaacaaaagccccugaaaagauuaaauccuccuaaaccuaaguaaauggcggaaaaccauuuaccacaaguugccaaaauguuguauguuucuauugaaaguuuucacugaauaggauagaacauaaucacaguugaacaugaggacagugauuucaaacuguuuacccuuaaaaagaagaugaagaucaugauggagggguuaaguuuaaauaacacucccccuaugcgaaacaaaauuacuaagaaccaaacagaucccuguggaaaaguuuguaugauuauuguucugacuuucccugaggacugacgccaugguaggcacucaguggauaccagugguggaagguggaggcaaagagcccuuuuauaaaacaacaagguuaggaacuccucuggcaggagccaaguuccuccgaguuuagaucacuucacauaaugugcccuugcuaaugcauuugcugguuucucacgccuuccugccuuuuccucuccaugguuacucugggaggcagagaggugcuaagcaauggaggugucauccggcccgcgcaucuagggaacguccuucagaggacaacuugucaccagccgucaaagaagagaguggcuuuguggucucugaacaucuggcagcgcugcacaggaagcugagggggugucauuaauugugaugaaauaauuuaaaccaucaggaauaaaugaggcuguuaagcuaaguucagauuccauuugccaugcacaugugucuagcagccugugugcaguuaaaagaaauugaauuauauuagcucaugaguagaagugaaacagauacuguaaaugaaacaaguugcuguauagcgaugacaucguguugaaccauuucacagaguuacaguuuguaggaucacuguaucaaaagugguauauuauuuaaugaauuuuuauauuauaaaacauuccuacgguauggaguauaguaaggaccagugguuuauggguagguagagaggauguguagguggaugggcagaaagaagcaagccaccagguaaaggugcagugaggugggugggagguguuuugccaggcugaauugaggcacaguguagcuuucuauagagucuggcugugauugcaauauuaggugcccucgcucuguguacauagugcagcuuggaggacaguuucucucugaugaccagauacgaauguuccugugagagccucugacacuuugggcccauccauguuguuuucuugcuauuaaaaacaacuaucuugggcgauagaagguuacuccucaagcaagggaacauauuuauaaggcuuugcacaaucagugaacacugauuucgauuguaauuuucaggcacuaccgaaggagacaucuccaguuucuuuacaaaggaaaaacuguuggguuuggaaugucaggacaacucugaguuuuugugcacuaaauggaucaaugguguguagguuccaaaguauauuuguaaaauaaaagccauuccuuuacacacaagugaagcuuucaaaguugaacuuuuauguaaaaacaaucauggaaauuugaaaaaaaaaaaaaagagacuguuacuguuuagguacagaaagaauuuuaaaaaaauuacuggagagguagguaauaccucugucagaaaacagauacauggccaggcgcgguggcucacgccuguaaucccagcacuuugggaggugggcggauugccugagucaggagcucaagagcagccugggcaacauggugaaacccugucucuaauaaaaaaauacagaaaauuagcugggcaugguggcgugugccuguaaucccagcuauuuggaggcugaggcacgagaauugggaggcagaggcugcagugagccgagauugcaccacugcacuccagccugggcgacagagcaagacucugucucaaaaaaaaaaaaaaaaaaaaaaaaaaaaagaaaaagaaagaaaacaguuacaaguuauggucuggaacuucggcaaauuuggacaagaguuguuuugcuaaaaauauuuuaucucccuucaccccuucgucccucccuuaccuuacugccuuucuuauucacugucaccugcugccuuuuuucuuccuccucucucuccauuuucucuuuuccuuuccauuauucucucuuuuuauuuugcauccucucauuuuuguuacaauugauucucauccucuaccgucacagaaagugaacugcaauuccauuuucauuuauaauguugguuuuccugcuacuaguuaaaagauuuauaucuauaauuacuuaguuuguaaaauuauaaaauuuagguuacauuuuuacauaaaguugugugaccauuggcgaauuuuuugaaagaaagcaauugaaccuugauuaagcuuuuuaaaaggaaugcagaauacucauugaguuauccucuucccuggaccagaaugaaauuguuauuagugaaagccagcuagaaguuugcagcucuggguuacccucucccuucuuaacuccggacacaggaggaagacauucagguugaaacacuuguguuuccccuaacuugagacguguuugaaguugaauagaaugaccaguagucaggauauugcuacuguguguguguguguguguguguguguguuuguuugagacaaagucuagcuuugucccccgggcuggagugcaguggcgcgaucuuggcucacugcaaccuccaccuccgagguccaagcaauucuccugccucagccucccgaguagcugggacuacgggcauucaccaccauguccaguuaauuuuuguauguuuaguagagauggaguuucaccauguuggcugggcuggucucgaacucuugaucucaaguaaucugccagccucagccacccaaagugcugggauuacaggugugaggcaccaugccuggccauguguguuuuuaucuuuaaauuuuauuuuaauugauggauaguauagaaagaugaguucuucagccuaucucuugacacugucggacagauugaaggagauugugccuguguauuagcuuuuggcuaauagugaaugcauuguuguuacuguguaaauuacuuuuacuagcuugugguggccaagcacauaaaaauuagacagaauuuuuuucugaaauuuucacauaucuugaaaaauuaaauauuauuuaccuaaaaacaguuuuauaauuuuucccuaaaauaaggaaucuaaagaacacagaaaauuuuggaacaagauaacuauguuuuucuuuuuaucuuucuuaauucgccuucuguaauacaucuguuucucaaaacaaauaagaaaaugauaauaucuucaacagugacuugugcuuucuuucagaaguguguuagugaauauuuacagggaaaaaaacaguucaugaacuugcuuuuuuuuucuccucccuuguucucacuuggguguggugugaacuggaugccccuacauauuuucgagaccuucuuuauuccgcugcugcgguuaacuuagcaucugcuuaggcagcauuaaauuugugaauuccugugucucagguucuauaugucagauacauuguggauuaaguaaacuuugguugaauggccugagaacuuaacuacauuucugcauucucucucaauaccaauauuucugugagagaauguuaccuagauuuuggacaaccaacuuaacauacacuguucauguuggcaacugccaguauuaauguaagaaguauuaaauaagaugcuuauguuuauguauguuccuaagccauagcagcuucauagaagaaggaaaacauagagaaaaacaaaauguuuuaauucuuggcuuaaauagaauuacgcguuuguguuugggugugugccuaugcauggauuuuguauguacauacacacaugucauauauauguauauauccauauuuuuauauaagaauagcuagugauguucuguucaaauauuuuguuggaguuagucauaauuaauaauuuaagagcacacauucccuccuacauguacacaaaagaaaaagaaaaauucuuuuguuugaguagauaauggaaucucaauuuguguuuucaauucuuuaggaucaguauuuuuucauguuuucgaaauuaaaagcuggaauugauugauugauugagacagagucucgcuuugucacccaggcuggagcgcaguggugaaaucuuggcucacugcaaucucugccucccggguucaagagauucuccugccucagccuccugaguagcugggauuacaggcgugcaccaccacacccagcuaauuuuuguauuuuaaaauacaaaauuucacauggguagcugagauucaccauguuggccaggcuggucucaaacuccugaccucaagugaucgaucugccucggcuucccuugugagccaccgagcccggccaaagcuggaaauuacuuaaguuauguaaccuaauaucuuuacagauuuggaaacuaagguagagaacuuuuaagacuuaaccaaaaucacguaguuaguaacacauucuucauugcugaugugucagagucuuuaagauacaauuuacuagguuuuauuccuuuagaguuuaacaaguauuauauagcaguauucuaaauuuuuucuuuucuucgaaaauuaggccaggcacaguggcucaugccuuuaaucccagcauuuuggaaggugggcgaggugggccuaucacuugagcccaggaguucaagaccagugugggcaacauggcaaaaggcugguucuacuaaaaauaaaaauacaaaaauuagcuggguguggugacaugugcuuguagucccagcuauucugaaggcugaggcgggagcaucacuugagcccggaggcagagguuguggugagucgauaucacauuacgacagcaccacugaacuccagccugggugacacagugagacuuaaaaaaaaaaaaauuaacucaauuuaguccuuguuuuguauaauccaaguggacuuaaauaaaggauguaaauaucaguuagaccucaggaaaggugagggaaaggugaagaagaaugcaaggaggcuacauuuuuaggcauuguaguaguugucuuggcagguuucccugugaaaauagcagaucuuccugcacugugugugaaaugugcuagcuugaugcuaagaaauggaauauuugggucuugcuuuuauuuuuucccuucuacuuuucuagugucaguuaguuuagaauuuggguguugcucaaaugccgauucuuaaacuuuaagaaucggaaauauucccaucuaauaaucuguuucaaaacugccauuauagacaacugaacaguggaauugcccaagaacauaaaaguguaaaucucuacuguucauugagugccaguggagagcuucaaggagcauauacgcagaccaaguccccuugaaaucaauguuauauaaaccaucuuuaagugccuucuuggguaugguacuauguuuacaucuuauaagaagugagcugaauagauagggucguugcccucuaggaguuuauaaucaaaaacagaugauauagcugauaucuguuauugucuuaaaguccuacaaauaaacaucgauuagauccauaaauaaaaguuugauaucaaagacaaguaaaaaccuuuuugcuugccugauuaaauaaguaaacacacaucuucuucccuacacugagacuauccaugcgaguuguaaaaugacuaaacuaaaauaaucaugacaccaggauacuccuuuagauuguuauuuuuuuuagggguuuuaaaagagugcugacauuaauaugaugucacugaugguguauuguaagugggucuggauucagggauguuuuugucuuucuggcuaggaaauugggaugagauuaauuuuccuccaucucuggaauuucuuuauuucuaacuauucaaugguaguacuugcuguuguaaaccagcauucuagaggacaguuuaaaaauuuuauccagacccucacugugauuagaaaucauauguuuuuaaaauuagcuguccccuaagccucugggaacugcacuaaaacaaagaugaggauaugaaauugaugcuguaaugagaugaacuuauauaucuaaaaggcuuugaguggaauauuaguccgaaaaggcagguucagaacuuuggaaugaacaguucuaguuguacguuugaguaaagcuauaacaacuaaaauuaaauguaaaauguuggcaagagagauagguauugaguuugauaaaauauuuucuuucugcaugcuucaauuuuagugcaagguauuauaacagucacuucauuuuuuaaguguaggggaacuaaaacagcaacgcuggggagacuaaacaugaacccgucucagaguucaacacauuaaaaaaauggcugucccuacugcaguguaggugucuggcuguguaaauuaaagcauguggaugcagaaauuaauuagaacagucaaagauauaaaucaaacuuauuugguacacugaugaaaugaucauuguuuaugagauuaucuuguuauuuaaucuauucuguauaaaccuggcugguuagccuugugaaguaauaauacaauuaaugugaugugaugaugguauacuuuuucucgguacaggccugauccugcagaucuuucuugacugggacuuguguauauagaagaccauaagaacuggaaauuuuaauuagcaagaaugccuccaccucucaguuguauguguguguguguguguguguuuuuuuuuuuuuuaaaucucagaauguucccugggaguuuauucuuuuugaaucauucaucuacucacccuagaagaaugaagugcuuucagauguuauuuccucaaaacugugcaaaguuuauuauaagagcuaccugcugucuuccagcuauacugugcuaugcuacugggucucaaauaaagagaaaguuuuacuuauaaaugaaaccauuaggaauuucuugaauaaacaaagguuuuucucccuuugauaugcagaggaauuuuguuuguaauuauagucauauaagucuaugucuaauacaugcaagcaucauucauuaucuuuuauaugagaaugcacuccugucaccuaaagagcagaaaacagauacacuaagacaaaacaaaauaaaaaacccccccaaaacuaaacagggauuccagcucguaggaaaauugucagcgucauuauuuacuauuugauucaggauuuuugcuucguguuguuuacccugcuuucuuuccuugucucuauuccuuugacuccgugaaguugguuucuuuauguccccaaaugagaacuuuguuuuuggaaaguuaaagauguagauuuuauuuaccuugcucuuagauugcuucacuacuccaugguguucucuuacucuuuagcagaauuuggcgacaguguccaauaaaguaacuaauaaauuguaggaaaaaaaugucacauguaaucucucuuguaaaaccuuuuaugaauggagccugauggcuggaguuuguuguuccuacuuaaucucauaaagagaauggauuuagaacaauguucuuuuaggauuaugcauagggugauuaugagugugauacgauaaaaucguaauuaugauuucauuuuguccugaacaguuaggauuuuuugcucuggauuggucuauaguugauguuaaacauuuucuuuuuuuuugagauggaucuugcucugucgcccaggcuggagugcaguggcacgaucucugcucacugcaaacucugccucccggguucacgccauucuccugccucagccuccugaguagcuggggcuacaggugcccgccaccaugcccagcuaauuuuuuguauuuuuaguagagacgggguuucaccguguuagccaggaccgucuggaucuccugaccucgugauccgcccgccucggccucccaaagugcugggauuacaggcaugagccaccgcguccggccaauguuaaacauuuucaauuugacaugucagauauuuggauguauuauuuuaaagaucuuuugucucaucuucauaggagugccccagaucucccuguuucaccugugauuaucugugaugccauagcaacaccccuugcuguuagcagaguauguauuauuucugugguuuugugaaucaguaaccacuaaaagauuugugaccaaucacccaugaaugauuuguucagaguuugcuuaaugagagaaacuguggcauaagacaaccuuacaauguauguacagguauauuuucacuguuacacuuggcucuguucuagauuaugcaacuugcauuuucagucauuguugagcuauguagauauauuugguggaguuugggucuguuuucuguaagccuuucagaacaguacuugucaaaccaguguuaaaaccaggaucugcugacuggaguucaggcauauggugaaacaagaugccuucuggguuaaagaggugacuaacggugggccaacugcucuccuuuacuugccaaccagagccugcuucucaaaucucaugggaggcaggcuucaaugagcugaguaaacaguaugagcuguauguccaguuucuauuuuggaagugaugcauaggaccagagcugaugagaaacucugggauauagucuaauuuucugucaaacagaaccccucgugguaaagguaaaggcugauguugggguaaaggcacuguacagagauugucuccugaguuuggcuuuuccaugggcugccuguucuuuuggaugugaaaggcuagauguguucuccagccuuucugcacuucccuagcucuuuucuuuuuaccacuuauccuuuccuuuuuccugugaguuauuucauugcuucaccuuuucguucauuuugaugcaaucacauauuauuuuauccauacauuuuaggaugucuuuuaggaggagccgaugugaugugggcccuuauguaaacaguugagagagugacuugcaugaaggcauuuuguuuagggaggauccuagaguagaaaugaaggaccagggaaaaccaacacaaagaugaauuacugagaugaucagugccacaacugauggguucucauucucucugaggccuucugaggaaauauuuaaccauuggcucucauuucccuugauccguauggccgucugagcaugaacuucccacacuuuuuggcuugugcaugugcgucuucagguugucaggaagcaugacucagguggggcaagcucaggggaaggugcuaauuagcgaucagugggggaaguugguucaugcggcuagaauaagagacgugacagagaggauuuuuaaguaguccaaggaacccauacauuguuuuugguuuuggucuaaaagcauagagagcucuggaguauuugcuguucugaauuucucuuuucuugcauuuauuguaguguacuucucaggugaguucacguauaccuuuaccaucacuuuguuacuugaagggauuguuugcauuuccuucaauaauuuuaucuuaccucuuggaacauuggucauucaccauuaggaccagaaugaucuagaauagguaacgcauuucccuuuuauuaacacaagucuacugcuuuauccacacuaaagcauaaaacaguuauauccuauguccuugauuuuggagugggagaaaguugucagcuauucagccacucuuaauauucuucuuaaauuggcuggauacaguggcucaugcuuguaaucccagcacuuugggaggcagaggugggaagaugacuugagcccagaaguucaagggaacagugaacuaugaucgcgcccugaauuccagccugggugacagagugagaccuugucucuaauauauuuuauuuauguuuauauucuauauguauauucuaaauagagguauuuagcagaauucugccacaggguaauuuggcucuuucagauguucaaaaguagacccaaaucuuuacuggcauuuuccaaugguccuaggaacccgaauagguauaguuaaugcuucuauuaaaccaugacauaugauagaucagugaagauuuagagaagaguguaaggaaaaacuaaaaauaguacccagugggauugaaacauuaugcaugcuuucaguacuuauuugauagaagaaucuguuucagaaaccaacuucuaacaaaagcaguugaauuacacaauuauuauauguuuuuaaauuguaguuacauauuuuuauuggagucaugguccacaaauuauaagguuaacuauuaucauguaucaugcagaggagaugaaaccacaucaaaguuuccuaccguccacucuaagcugcaguucaaguuucuaacacguuuuugcuucuuauaaguggaugagcugaucuucauuucuuuuuccgugguaucugauuucuuucugguuguuucuguuuaaagaaauauguacugcuuauaggaaugauaauuuaagcaguuagagaagaaguaguucucuauuugugcagguagauggaaggaacaccuugccaaugcauaacauaguaucucacauacuuuaauucccucaauaaguuauuguauuuuaaagguaaaagaccaggacagagaaacaacagagggccugauucuacuaagaauuuauaacuguuauaagauccucaaccaauuggaaguugcugucuagugagaugugcaucucauuugcuauuuugcuccaauucacaauagccaguacuguuucaauaaaggaaaaauuuaguuuacucugcuagaacuuucucuugaucugagggaguuggauaguuggauuauuugagguuaacauaccuuagcaccuuuagggcaaaauguaaccugggggugugauagaauauuccaucuagaggauaaggaguuuuagauuauaaggaaaauuacucccuuagugggcucuucaggaacaauuuuuuaucuugugguuggucacuuucaauauauggcaguugcuuuccauuauauucucaggcuccaaucaauacguacaauauuaugcaacuuauaguuacauuauaaccaaaauaugucaaaugugguuucugaguggcugauuuacaguaagucuuccucaguccccaaaguggguauuaugacuaauuuaaacuuucauacaccaaagcaauuuuuuucauaugaaaaucgugugucuugagggggguggggucuguagagacagaaggaacaguaaagcacugcgucaacuuacucacauacagauugauccauugucaucuccuuugcaucucauggauuguugugaauuauuugcucacccugggagagacgugcucugaauuauaauaauuuaaaaucugugaaucuauuaaaaccguauuuguagcucuaaaaaaauugauauucacugggcaguuugcccaacaagagaaagucaaagagauuacacacuuacccuagguaacagcaaccacccugccaauucuuccuuugaaagaauacagcagacccaaauuauacaucuguggauaaggggagacaagaaaagaacucaauauaucaaaaucagaaaguaaauuccacaauaauggcuacaauaauguuucaagaugguauuuuagcauaggccuagucauugaacuaaucauagcuuagagggguuuaaaauuguuuaaaguacauccugacguuguuaaguauguuuaccacucucacuugaaaucagaauauucacucauguaugguauacccugagaucauaucggagaaugacaaugacugcauuguuugguggaaaaagugaggcccagagugucacaaugguuuucugauuucucaucuaaaggucuuuucauaggauacuuaauuaacacaucgagcucccgcgguaugccaggggcuggcaguguaaagaugcauaagaagaagcuaggugcagugguuugugacuauagucucagcugcucaggaggcugaggcaggaggaucucuuccagacuagccugggcaacacagugaggucucccagugaggucuccuuccuuuagaagaaaaacaaggugcauaaaaauaagcuggucuuuccaugggagcuucgcuaaaugugaucuucccgaaggacagguuuaguccuguucaucuuucaggucucagcacuuaccauugcgucuggcacuuaguaggaacguaccuaauaauugcuugaugugauaaaugccaaucuuugugccauggaaucacagaggacaggaaaaccaaggaagaauuuaaaaaggggauggaguuuuaguugaguucuugaauaguguuuuggggugcaaauagaguggagaauagguaagcccaccuaaaagaugcucuccuugagggcaagaauaaaguuguguugaucuuuguauauccuuguauccagcauagugccccauacauaguagguccucaaaacauaugcuauauuuuuuucuguauauaaacuugaacuauaccuuucuuaacuuucauauuacaaaugugguaaauguuuugguuucaaaacauuucuuguuugauuauaucuaaauaauuuaugcuagaaagaaaaugcugucaaaaggcuaucucauuuaauuuaauuaugucaagaagaaguugaaaguauuauuugcucagauaauccucacuuucugauaauuggaaaucgacuuucuuggacuguuaaggaugaccaccucaaauuacuacauuuggcacuaaguggagagucccacuguuaauuuucaauuaacuacaauguugauuaucuugucaguaacaaugcuuuaguuguuuuuaccaccuaaucucaguugaggagaucauggaacuaacaagagcuugauuguggauuuuauucuuguauaggccgguuaaauuugcaaaaggaaaaacuccuugaauaaacauagacagcacuccaaauuuugguuagcuguuaaauaaauggaugcuauuauuacaaaagaggacuuggcuaaagaagguagaucaucacaucucauuaccauuuggauaaacaaccaaaacauguauucuagugacaguacuuuuauaacaucggcgugugugcgugugugcguguguguguguguguguguguguguguauguguaucugagugaugugugcuuuucugaaauuaguauuuagcuuuuuaguggaaauaggaagccuacaguguucuuuauugguuuuaaauuuuuucagaguguaauaucacucugguacuaguucauaacuauuugaauuuaucugugaauuuuuuaacuguagacugaagcagaaaaaaaaucaaaauaugucaggcaaacaaaauguucagguugaauaaugcuaacuacauuuaagugaauuagcacuuccucaaaacaugaaaaauuuguuaagaauauauugcuucaaaacgugugugcaucuggcuuuguauagauuaguguagacuacauuucagaugggcggcaaaacagauauauuugcuguuuagauaccauguuuaaacuaggaaaacaggucugcuggauguguguugaaguguuuagcuccagaaucacccagugagucucaguaaugaaagcugaccugugguuucuugaaagauguuuuuacuuaauugccaagauagcuuagauguuguuuacuguguugucaguugcauuguagcauuuagagaauugauaguguuggucgguaaccuuucugugcguguguuuuuaagcuguuguuucucucuuuuaaugaagcacguuaaauaucuuuaaugccaccuaccugcuuuauuggaggauucaugauguugagaaaaaccaaauaaaauuucuauauagaguuauaggagagaacauuugcagcggacauagcagagaucaagggaaugccaacauuaccagagugaagaaaacagagaacugaagaugagaccaaaaucagauagauagagaugcccucuggcaaacuauagcucuggaggaaaguauguuagaagguagcucuucauagaaaaaaaaauguauuuuaugggaaaaauauucuaaaaaacccacaugaucuccuauuuauugaaauaugaauucaaauuuuauacaagaaauaacucauugaaaguaguugucaaugaaguaguuauuaaaauuacuguguuuuaacaaauaaauaucugcauugaaauggcacaaggaaaaaaauggggauaauuuaccagauaaaauuuuaaagauaguuucuuuaauauuuuuaauccuggaaguccuuauugcaaguaugacugaaaaacuaaucauggaaauauguguuuuuuucaauuaguuacagaugauuuacuaggagagguucaacagguaggaaguauuuguuuacagaucguuuaggauuauaauuuuuaagaaaugaaaugccuacuuaguaaggaucauguuuguaaugauacuaacuccagagugccuagauccgugcaguuccagggcuugguuucagaggaaauaaauuuuguucugauuagaaaauuaacuugcauuaugcauuuucauaucucugaaucagucuugacuauaaauucaugaugcuagucaaauauuaaacacacuuucaugcuuaguagcauaaaauagugucaaaugguaaaauaagaugguaagaacugcucaaccucaaagaauuuacaggucuaguuuaggaaauuugcugugauuucucucucucucuuucuuucuuucuuucuuucuuucuuucuuucuuucuuucuuucuuucuuucuuuucuuuccuuucuuuccuuucuuuucucucuuucucucucucucucucuuuuuuuuuuuuuuuuugagacagagguucacucuuauugcccaggcuggaguacaguggcacggucuuagcuuacugcaaccuccaccuccuagguucaagcaguucuccugccucagccucuggaguagcugggauuacaggcaugcaccaccaugccuggcuaauuuuuucuauuuuuaguagaaacaggauuucaccuuguuuuucaggcuggucucaaacuccugaccucaggugauccacccgucuuggacuuccaaagugcugggauuacaggcgugagccacugcacccggcugaaaguugcuaugauuucuaagguacuuccuuaauuuauaaagaaguuacaggucuaguuuaggauaguugcugugauaucuaaggcacuucccugcuucugccaugaagcauugugcuaaugcugccuauaaccugccuauucugaauuuaagauucacuauauucugaaucuaagaauaggcaggguguaggcagcaucagcacaaugcuuaugguauaggugaagcauucuggugcucacauuucacguggacaugaauucugagaguuuauuccagagcagaacagcguuuucagcugaggacaacaaaaccuucuccuuauugggucucuuguagauccccuguuuuuuuuuguuuuuguuuuuuuuuguuuuuuuuguuuuuguuuuuuuccugaauacccuuauugccccuacuuuuauuuuccuuucauuuuuaugaaucugucauugaugagcauccuacccaacaccagaccagauuaggauacaggcaguuuacaggaauuuuuaccgcauagaaacccugaaguuguaguugcuuccuacaaggccagaaauucucuucaguguccccagacagucucagcuaaaaggagagaggccuugagcaaaaacuugguauaggcuuaugagucaagaccaugguuggaugcaauuguaguggaauuucucuggauaggaaaguucuggacccaugaacuugugguugggagggguagugagagucagacauucugggcaaagugcagcauuagggaagauuuagcaugccucugagcaacaaaauauguagaugccagccagggaaggacuggcguggaaaggagggacaaccuugggacucugaaguauguuuaggaaaucaauaacguggagcauucccuaucaaauucaguguuugagaugaaaugaauacugaugucacaaguccagagugucauuuuuuugucgugguauuucccuuuacauugggaaacaggaggaauaaaggccuauuauuucgagaagcaggauaaagguggaaucgaggaucaauggaggguuaaguuuucauaacuaaucucuaauaauaauggcacguuaguuggguuagcccuuuucuugccaggggcuuaccuccucccuuguuuuggaccacacauuuaauauagcaagacuuuauagguagacucuaggcaaguuucuauagguuuaacaguacauuuauucaaugaggaaauuacuuauuaaggcaaaaauuuauuuggaaaaaucuguuuucaugugucugcuuucagauuuuuuucuuucuuauuaaguaaggaaauaauauucacaccugacucuuuaaaauuuuguucaguggauuagauaucccagcaggcacauuugaauugacgcuauuggacauuauuacucuuucugagauuuuugaaaugcucuuuuguguuuuuuaccuguguaaagucaccggaaugcaguuacagaaauacauaauuuuagagcaaauauucuaagaacuagaauauuaguaccaagaauaucauaauauuagagaucaugaaguucagucccuucuuuuuauaguauaguccagaaucacagagcuggaauacauaaccuucuugguaaauuagaaagaacucauauuuguauuaguuugaaaacagagugggccaggcaugguagcucacgccuguaaucccagcacuuugggaggcugaggccaguggaucaugagguuaggaguuugagacgagccccaagauggugaaacccugucucuacuaaaaauacaaaaauuagccagggacgguggcgggcgccuguaaucagcccagcuacucgggcggcugaggcaggagaauggcuugaacccgggagguggagguugcagugagccgggauugcgccacugcacucuagccugggcaacagggcaagacuccgucuccaaaaaaaaaaaaaaaagaguaaacagaguggagugccuauggaucacuggaauugagcgagcgaguaggggagguguuagggauguuauugaugaaaucacuuggcuguauagugaagcagaugagauaaucagaaaggguauaaccagaauagacuguaaccuccuugagggcagaucauaagcuuuccuuuuucuauugcuacuacuguuuaaggcacuuacugcagguaauagcaacuuuaaaagcauuuguuuaaaauuauaauaaaaacacauugauuuaguaaccuuuuaagaaugguguuucuagagaaggaagcaguagaaagucucccugauuuuaugccaucaaauauucauuccuuuuucuguuuuagguaggauauuuucucuuguuuuauuuuauuuuuugagacagucucacucugucacccaggcuggagugcaguggccugaucucagcucacugcaaccuccaccuccuggguuuaaaugauucuccugccucagccuccugaguagcugagacuacaggcaugcaccaccauguucagcuaauuuuuguauguuuaguggagacgagguuucaccauauuggccaggcuggccuugaacucuugaccucaggugaugcaccugccuuggucucccaaagugcuggaauuacagacaugagccacuacgcucagcccggguauuuucucuugugaugaguuaaaaucuggccaauuaccucugaccaugccucauuguaaucaguauuuauuuuaagguaugacuccuagaauuuaaauaaaguauuggcgaugugguguaauuaguguagaguagaaugagaccuugcccuguuguacacuucauagguuuguuguguuuacuuuuuugagccauaugcucuagaauguuuuaaauauguagcaucacaucaucuaccauuuagaggaccagaauaucuauucugaguacacaaaguagacucaugaacuaauaugugaauguuuuccccucugaaggagaaauauugggaguuuaacagcuugaguagaaauuuccuuuugaaugguuaaccaaacugguaucacuuuuaagguccuaaaucccaaucuguuuuucuagggaaacauguuggcagcuguucgaaauaacuagugguuuaaagacaauuguuagugugguuuucuacacacuuaaagcuuagaccugcucugucacuugucuuugaugcuaaggaguugucuaaguaguugaguuaaauaauuucagauuaguuuuaugcauuaaaugguuugguuuuauuuuuaaaaaccucuguuauuauuuaacucuguaguagacauuuacaaaauaauuuuucuuauguguauuuacauggacauuaaaaacaucuuaagaaauuaauuuuauugauguuuuuaaguucaggaauguucucacaacaaaucacacacacacaacacauguagucuuuagaaauagacaugaaaauaagaucauuagauguucaugccugcuuaauaggagucuccaaagcaauagaaauauuaauauauuggaacucugauggagggaaucccugagugcagagaggaaacugauaacacuaaacuuuaauggccucggaaauuaugagacagaggacuccagagucuucuauaauacauaccuuagcuuuguuuucaucucuggggaacuaacauacagcuauauaguauacugaucacuuccccauauacuauugaagucagucuccaaguaaacuugugauuuaguaagggcaggugguacaugcuguuuuauaaaugaggaaacugguugagagaguuuaugugguuuauccaaguaaguucaaacaguuaauaaggacuagcuauaguaagacuuaaaaccuaggguuuuuuuguuagaagaugaguauauuacccauuacaucuguucuucugaugauacaggaaugagguaagggcucacaccuucuuucucucuaggaaugaagaaaggaaccccuagguuguaaaaucaauuuuaccacaugacguugggaagguuaauugcuuuucuugagccucaguuuccuuacauuuaaaaugggaauaaugguauauacacuuuagaauauuuaggauuaaguuagaucaucuacagucauccuucaguaucuguagagaauugguuccaggaccucccucaaauaccaaaauuugaggacgguuuaguuccuuauaaauggcauuacuaugcauauaaucuauguccauccucccguacacuugaaaucaucucuauauuacuuacaauacauaguauaauauaaaauguaaauacuauguaaauaauugguauacuguauugauuuuuaaauuacuauuauuuuuauuguuguguuguuauuuuuuuuuccugaguauuuucaaucugcaguugguugaauucauggaugcagaacccacagauacagagggccuauuguauagcagucauauuggcuggcacauucuguggaaacuuaguuuuucccccuuuuuguccuuucucuuuuucugcuauccaauaaaguuuggcuuuguuugugaaggcuaauuauaguccgugcuauuggauaccuuaggcagcuuauguucugcuaaagaguaggaggugcacacauaaacaaggaacuaauacaaagugguauguauuuuuuuuuuuuuuuugagauggacuuucgcucuuauggcccagucuggagugcaguggcacgaucucagcucacugcaacuucugccucccagguucaagcuauucuccuuccucagccucccuaguagcugggauuacaggcgugugccaccacgccugguuaauuuuguauuuuuaguagagacagaguuucuccauguuggacaggcuggucuugaacugccaaccucaggugauccgcccgacucggccucccgaagugcugggauuacaggcuugagccaccgcgcccggccccaaagauguguaauuuucaaggggaaguccaagacauugugggcaagggaugcaaagugcuaguaaauaguacaauuggagaacaacuaauuauggggucccuagugugaguaaaacuuauuugggggugagauguuagauuuguaaaauauuuugcagggaauaauuuggcugaauacagauauuaacugaacauauaauucuguuucaggcaucuauuugguugcuggagguacaguguaacaaaguccuuuccccuuggagauuauauucuaguggagaagacaaauaguaaagaacauauaagauagggaguauaauaagggcuaugaagaaaaaagcagagaauaaggggaugggaagugaggcuagagaggagccuguuauuuuacaucguguggccaagaaaagcaacgcugaggagaugacaguugagcagagaacugaauaaaaugagagagcaagcccugcacagaucaagggaagaauauucuagcagagagaacaacaaugacaaagacccugaugcagaaacaagcuugguaauuuuuuuuuuuuuuuuuuugagacggagucucgcucugucaccgggcuggagugcaguggugcaaucucggcuaacuucaauuuccgccuccuggguucaagcgauucuccugccucagccucccgaguagcugggauuacaggcaugcaccaccacacacagcuaauuuuuguguuuuuaguagagaugggguuucaccauguuggccaggauggucucaaucuccugaccuccugaucugcccaccucggccccccaaagugcugugauuacgcgugagccacugugcccgccgcaagcuugggauuuugagaagcagcgugguugccagugaacagggguccugaaauugcagaagggcacgaugaaacggagagcccuuuuacauggcgguacaauagaauuugacuguaauacuauugucagggcccucugcauuaagucagugcacgugugugcauucacaugcccccccccgccauccaucugccauuuacccacaccuguccaucuauccauccauucagccauucagcaaauauuuauugaguaccucucuuaaguuagccacuguucuaggaccuagcucucaaaugaauucaugcuuaaguuuaaucacauucaaaaaaagagacaguugcgaugaucaaugguuuguguaucggcguaauguauuuuucugauccuaguugaugauuuuaagacaauguaaacugucaccuuaaaaucuaauguguccuucagccauugcuuuuuagagggaaaagaguguaagagaaaaaaguuggguggggggugugggcauaagaaagagugccuucaacaucuggguaaagagagcacugguuauuugguagcuggauugucuguucugggauaguugguaaauuagcugugaggcaaaguacagucuuuccuuaagagacagaccaaguuguuuauugaugcuggggaggaaaagggcugggcacaugcuuauaagaccuaugaucuuucccagaauuuggaaggauaagagaauuguuaagaauuugacauuggaacuguucccucuaauuguggcuuagaccauuugaugggaaaaaaaauauuaaggaauccaggaggugauaugcugaacaauauggggacuauucacggugaaaacaagcauuuacccaagcauuugaccaggguaauguguguuuuaguuucagguaguagaaacugaaguggcuuuguuucacagugacauuuaggaacauugacuaaaauauacugggcuguuuaaaguuuuguuuucuuuuuucccccucucccuuacaguacucccccugacuccaaauucuccagccuuauagcuguuuccauguuuugagauuacugcaaaaacacuuaauggcacacauaugaaaauuuuuguaaaugucuaaauaguuuaacaaugaaaauuuucacucauucuacauguauuacugauuuggagaauuucuaaauugcugcacaguuuuauugcaauguagagauguccccauucccuugcaaauuaguaaauuaggaucuccuucuaccucugagugcuauggaugccaucccuucucuugucccgaaauuccggucuauuauugaacuucuguuuauucuacuuaggggguugauuccuuuaaaaguguauuauuacauauauuaaacauaagaauuuuagaaaaucagagauuacaaaaagcaggaacaucaucuguaacccuaacuggccugcccuaagaucaacacaccuauguaucccaaguagcccccacaaauuaugcuucaggugacaucauaguaugauauauaauauugauaugauguaaugucauugaugcauuuguguauuuguaugucugauauuaugaacagccuucuaucaucuuuaagagucugcacauuauuccauuauauggauaaaacaguucuccuagaguuuauuucuaauucuuuccuauuauuaauacacgauaagccucuuucugguccaagcacauucccuucagccuacugauggccaagucacaccucuguuuccaucuggcagucccuuucucucaacuuccauucagaacucagccuuuagaaagaggacauaaaaaauuuguuuccucuucugccuuagccucccacagucuagcuucuguuucuugucuucuccacaacaacagcucuggagcgcugaccucucaucugaagcauauuguagaagcguuucuguuuuuuuuacuuauuucucugugacauuugaugccacugaccacuuuugcuccaccuuuaagucuuuggauuuucuaacucuucauuguuccaguucaaucuuuauuuuucugacuccuuguuuucuaguucaucuuuguauccuuuuaaacauaaaucuuuuccagguauucuauacuggguuuucaccugcacacuugggguaguuguacucauucccauuauuuuaaauuucugcagauuugauguuaacugcccaccuguuucuccaacccaggcuucucuguagggcuccauauuuguauggagcucucucgguugauccacuucaaaacuaagccagucagaagcuaaauuuuuagugucuacccuugccccacuauagucagccuccaccguucuuuaaauagcaucaccaucuggcuagaaaccagaaagucagcuuagacuuguccuucucccuagcucauaccuccuuccccaauuuuaaauggcaacugacuucuguuuccccauucauuauucugcauccccagugccucuaaucuuguaaagauucccucugugaggaguuguuuugaauggguauaaauuuaguuauauaagaugaauaagucccagagaucugcuguacaacauauugccuacaguuaacaauaugauauugugcaucuagaaauuuguuaagacaguacuucucauguuaagcauucauaccacaaaacaaaaacaaauaaaacccuaaagguccacauggaagcuuuuggagaugaugaauauguuuauuauucugguuguggugaugguagcaugaaugcauacauauauccaaacucaccaaauuguagacauuaauuuugugugguuuuuuguauaccaguuauaccucagcaaaucuugaggugagggagccuuccauuauuucuugacuucagacuccacuuucaacauucuugaggcuguuucuccuacugguacugugaauucugucucuccccacccccgaauccuaccaucaguucuccuggugcaucgaaugagacagaaacuccucagcauggguggccccauugucgucccuuuguccuuucuuguaaccacuuuucuugucuccugcuuuuacgggugaguagaguucucccuuuccuccauucucgagguagaauuaagcacauucucuucuguguucccugagcaccuacacacaggguuacucagccuuggaacugguaacauuuuguguuggauaauucuuugugcuacacugugggauauucagcagcuucuugaccucuacucauagcuaccaguaacuguccuccacacucaguugugacaaccaaaagugucuccagacauucccaguguuuccugggugacaaaccuccccuauuaagaacacugccuuguaugugccucuucugaaguacuuacaaugcguggcgaauauguccacacguguccaucuucauucugucagaggucaguacaucuguggcuucuagaacaguacugagaucagaguggcccccagucagcacguguucuuugcugccugacugugcaugccaggacagucguucgcugcugcucuagacaaaugagaaaggaaagucagcaauuguggagaauuuugccauuuggaacaguuugguaguuugauaaaaggcuuugcuuuguaauaagugaauucaaggaaaauauucuauaauaggcacgugagggaaguuguauaauaucuuuuguuagaauuauuucaaaaagagacucgauuuuuuaaaagucugauucauucauuuaauuaauuugucaguaaugcuugaauuuuguuuugugcuagggacuuuuuuuauuccuggaugaaauaguccugccuuuuuauggccuuuuagacuuuucagauagauagucaaggaggaacuguaauacagugagauaaaauaagucacugcaggggagauuuccaagauaguuaccugagucucauacugucggcagaugcggccugcagguguguauaggggcaaauuccaaguaaucuuaauacauugaugcuuuguaggauuuagcaauaagcacuguccccccauauuugcuuuuauucaucuuuauuuuagugaauuuggagaauuuguguuuuaagauaguggcuuaaaauuagcauggucaugaagcauuuaauauuuccuuuaugcuguaucguaaugauuuucccucccccaguuuuuuccuccuuuacuugaauuucuguaauaugaagcauaauguggcaaggauucugaucucguggccuagucugucugcagagguguaugugagugagaccccuuuuaaucauucguauaaugauugguggcucccuguuguuaaaccacaguuauugaucuaucauuucugaaguacauggcugaaggaacuggugcugucaggcauugauugacuaggaaggaaguguagagcuauucuaacucacuuuuauuuucaucagcaacaguuacaguagagacuugugcaagaccuccaugauggaacgucauuuuuccugcauuaagaggugucugaugugacugaaauugcugggauaacucaaacugcugcauuuaaaauauuuagaacagaauacacuguccaaaaccuucuuaucugacuuggcuaaugguucaggcucuggaaaauaaauuugggggcaugggggauggguaaaaaagaacagaucuaguauaaaauuguuccaaagcaaauugagcaaccuauauguuaauauuuuacugaagaaguauaucuacacaaauuaacucagacaaaacaaguguguuuuuguguaaguuaaauuguuuaauggcuguucaaauaauuaaguucaagucauaauuaauagcugucuuuugguacuguuguuauguuuuggucuguuucaggaggauuugggaccugcaugcgcaaauauuuuagauaaggauauaaacugaagauaguaaagguaauuauuaaaagugccucucuuucauuagcacaacuuacguacauuuuaacaucugagaugagcauuguuuauuuuaauggacucuuuaauaaugcuuauguuaugcccugaacucuaguuagaaugaaaaugagcaagaacaacaaaaauaaaugguguugggguucggcagaggaaagaugggaggagugcauuaagagagugaaaccaaaagagaggacaaaaaauacaauuucuacuguaguugccuaagagccugugcuuuugucccucucucugaauguuuuauuuuugcuauaauuacagcaucuugccugcacuuugucccucugauccuuuguuaaagcccagaucacucugugcagacugcgcuuguaggugugauuuauugagugacaaguagcuguaggguagaacacccgccucuguaccugaguaaaguauuagacaucacagagcuggggcaggcaggaggggggccgaggaaggagugggggaggcgaaaagcaaagagcaguaacacagcagcuccuggauacagaucagacaagagguucugccacaaaucaccuagaaacaugucagacgcugcauguuuguuguuuuacacugagggcacagccguaguccaaaaguauugauucuuuucuuuguacagagacagagacugucagaccuagcaggcugaccuugguauggugcagacaacuauuccccacccugccgaccagaugaaccccacaggagcagccuaggcaagauaugccaauguccacuucacaggcacagagagaaaccgaugccugcugaaacggcuccuucuguuucccaaacacuucccccgccaggcccccagagugcuccuugugacagaaaauuggaggcaggauucuuggagggagcgugugugcuuuuuugugugugucuuaaaacacacaaaaagaagcccuuuuuauuucauuuguccgugagauaaacugaaggaugucugggcaaugguguauaugugugcauuuuguauuuaaggcggcaagaggagauaguuuauuuucuguuuguacauaucgaaggggagauuucugugugugggcacuuacauuugugagugcguguguuuccccucuucucuauuucaaaagcuuuggugagauggggaagaguaaucaacugucacacuuaauugaucugcaguuauuuuaaaaguuguuuaacaguaaaacuacacagacccauuuguccauaugaaucugcaggucucuuuauagucuuaaaauucacuguacucuuaagucauuuugcagcauuuaaaaaauucauuuauucugaaaaucagguaauuuuaaacuaaaaauacuaguuuguaauuuggagaucaucuaauauaaauagaaacauauaaccgccaacauuuugaaaucaagaguucaaaacuugaucccguaaaccauuagggaguagggcccacagggugcccuugaggaaguauacccuaucuccuguugggcuuggugugucaagacuucgguuugccagaaaugcuugccuccaaguagaagguguuucaguuacucuuugcugaagcugaguguuuuauuuugacuaacaauaacagggaggaugccuuucucccuuucacuuuuaggaauguuguugcaugcacaacuucuguccauaagauugagcuguccaugaggaaaaacuccaguagauuucagauuugcccgaaggaaaauaugaggcacacugauggggaagaaaagugaugauaucaugugcacuuaggguguaaaaaccucuccuuuaaaaacgagguuucucuuuuucaaguaaaauaaugcagacagguucaauguguguaauacuauauuacauuuguauaauucacuuuaaaucuuuuauuaaagugaauuuuucaaaaaguagaccacugaagauaaaaauaacaaguaaggcauucacuuucgugaaaagccccauuauuuucuacaucuccauuuucacauucauccuauuuguuuaagugacugguuuggcaaccuaaaagaaaacccaaugguuaaaaaaaaacauuuguuuuauaguuaguuuuuacuuguuuuuauaguaugagaucucuguguaguauugaguuuugcagacuccugagagaaaaaaaauucuaauaaaagugcuauuaucugaaaacaaugacucaauuaauuauuuugguuucuuauguugauucuaaauauuucuuguuucucuuuguugggucuuuaugucucauccaaaacagauuuacauuuugagguuagaaacagcugaacaagucugccuuuggguauuaacaaaauaagcaaacuauuuaggauauaucaaugucuuuacaaaaggauauuccacuuauaaaaugggagcugaggaacacauaugcuguguaagaaauaccaucuaagaaaaauaaugcauagaauagauuaggaaugguuuaagaucugaacacucaggauugguauuucuuaacacucuauuuuuuauuuuaauauauacaugcuaaucgucuuucucucuucuccguauauguuauagucacuugauuuacuacugaaauuauauugcuuuugaaagugucaguugaguuaucccuugccuuguuaguaucauguuugauuucuuggacagagacauaaaucacuaucucauaugcaggucuuuugaagacgcacccaagguuuauugccaguaacagacuaguggccuuauguggacuuuccaugaauaaaacagauugaugagccauuuuauagcaucgcaagcuguauuauaaauacaucacccuuuucaguaauuuaacgugaggaacagccuaaugagcucccagccaugaucagccagagcugggaguuuuguuuagcuucuaggacaagugacugguggaggguaagaaacccaaacccuguauuguuuuccccaguucugugacaaaaucuuguaauaugaaucauuugaaguaauaguaaaguaaagaugcauuuagaaucugucagaguaauaaagggaaauguaaagugggucugauuuugcuuauagcugaaaucuaagguuaagaugauaggcuuuuuaaguuacuuguuuuucuuuuacugauugaagucaucaauugaauaaacagauucucauuuugaaauauacaugauguaauaucuaccugauagcuuggaaaaggaacagguagauauaguuacaacaucguaacggucucuuuugaaaguauagcuuaagaugaccauuguuucuguauucaagccuucuuuuuugcauagcuuacaacacuuuaccuuuauuuuuucauuaauccuuaaaauaucccuguggaauaggaugaguggguggcaucuuaggguaaacaguuacuauccuuucuggugaggaaaccgaggcauauagaaaugguuguuuuuaaagaguuaucugacuagaaagaaaagcaagauaaaauuaauuuuuagaagugaaaaauauuuugcauuacguauagcacaugucaauauuuacaaaacuuacacaaacauaacuuuguggaccuauaauuuucuaaaaguuuggaaaguaggcgacacuuaggauuggaaaaggcauagcuuugugaauaauuuuuuugcuaccuggaagcugcaauauauuuugagcuagaagcuucuauaagauauuucccuuuucugaaugcaauugauuaugcuauacugcauaauacuacauuuaccuauauauaauccaguuaaagcuguauuacauauuuauagaagucagacuuuggucugaaaugccauuauuuauaaacacaaaucagugaguaauuagucuacuguguaaaaaaaauaaaaaaaaauuuugaaauaaucuuuucuacugugaaaacagccaggcaguuugguggacucuguuauucauaugucagacgggaauuaccuugaguguacagggaagaaugaagaacugaaaaggcuuuaauuuucuuuaaagaauagguaaaaacagaauauuuuaccacuaaggcaugaacacaucagugaugcccuaaccaguugagcucaguccugccuacacugagacacaaugcacuuucaauuuaaaaauacaucuaauuuaaauggaaugguccuauuuaugcccucuguuccuuauuaaaaauggucgacaaguaaaauuccguuuaagaauaccugcagacagucaauauuguuuugaauuuuaaagaguuccugugucuugugaaugacauuaugccuuuaauauuccguauucagggcagaguccuuuugaaaccaacugugcauuuaucuccauuuuugcuuucuuggucuuugccuuccucugccaugcacccaggguugagugcugacugcaggucuaagcuuaucagauuggaugaaccucuucggugucuccauuuuggaaacugugggugagaauuuaauguuccccuagcccacacuuugaaaaugcaagauuacagaagauuuaugaaggccucugugucuccauagcucuguucuuugggguaccucugaaguuuacuacugagcgaaugaucuuggcauguuaguauaggcugagccaaaguuugugcuauauuauuuaugauucuauagcauuggccucucaaacaaaugaaguuuauugacguaucaucuggaacaaaauuuuggcuaauucauaauuuauacaucagaaauagaugccuuucucuuauagauugugccacuugaacauaaaauaagauuuuaagauuaaaagaaacagaggccuguagaaguggcuuuucaagcuuguagucacugaugguuuuuuaaucccuaaacaacacaaaacaaaggaagacagaauaugcuuuucccucucccauacuucccuuuucugucucuaauuguaagcucuugugcaccagugcuccuacuuuuccucugaguuuagugauaguucauaagaaaagcauuaggcuuauggaaagaaagaucugucgccaguggacuugauucucccuugugauuuauaagggucugagaaagcagucuuccaggucuucucuucucaaggacucugggaaagucuuguucaaaacuaaugguucuuaaagaauuggucagcugcagaccacuggccucucaaaacacugggugguucagguggauagcacacacugcuuugcaacuccaagaugcagugggugugcuggggcccgugaguccguccuggaagaccuuuggaaauucuguguuagucaggcucauucucuuucacuugaugugcgcacagauuuuuguagaaaucauuugauaucccaguaguguacaaagcaugggaugauauaugcauucacacacuuacauaucaaagauacacuucuucuauguuuuugucuuucauacagagucuaaggcgacuaagucguuaugcuauuuuagcacauaaagauaucauugguuuuaacucaaagugauugacucaaacuauauuuuuaucauaguuugaguaccucauacuuguucacugcccuuaugugcauggucaccuuuagagggcauaauucugcuaaaaaacuauuccuaaugaauugcaaauggagaugaguuaaguaagcuguguuaauuaugucauuugcaagauugucuaauguggaauuggucaagagacuggaaacugcuugucaaauguuucucuuaacuaaugugauaguuugugguuugcaggugacacaauuuccauaacuuauuugauggagccucauuaaccaccccuuaguucgccuuagcaaaauuauguuauuaaacaugucaugauaaguucuguccucauuacuuugcauucggcacagugaauaguguuugucuugugacaccucucccagguccuuagucuucgaggaagccaaaggaauuccauguucagaauuguguuuuuaagcugcuuuccagcauuacacacaucucucuugacuuggcuaauagaaccuggauguguucucaaucacugcuaucaccaugcaguccuuauuuagcccucugucauuucuccucagagcuugguguccugauguucuacugucuuaaauagaaacccaaagaaucucugaaccauauaguuuuaguuaaaaacagccaaguguauggcaguaguaacugugaugauaauuccaguaguggagcaguuuucguuuuucauagcaucugccucaucuaggaaaucuucacauuagcagcagagcauuuaucucucuagugaauaauuuuuauguuugcccauguuuguugcuuagugcugagaaacuucauaugucuuuuuuuaaacacacacacacacauauuuuauugcguacauuggugacucucuguaauuuugucuucaaagggaccagucucagagauacuuuacagugauugccuuuuaguauuuaguuucugucacuuaauuuuuucugguggugggaauucauuuuuguuaauguauaaaauuuuucaaaauugggagaugguugaauaagauuagaaauauaguucauggcaguggaauagacuagcuaauccacaagugaacuggaauagcauauugaucuaaauguauaagauaccuuuauuaaaccugccuaagaggaucauauuuaauauuuauuuucuagugagcaguauuguacuuacuaaauugaugggaauacacauauugaugaaucucuuauauuuuacuugaaaaauucuguugaaggcuacuuuauccuuuaaccugauaaacccucucucucccucauucucaaaaaucucaucaugguugcacuuggaucaagcuucuucauaaagucauugucaucuuacacuuuucccagaagcgucacccuaggggaaaaaugauuguguaauagaaaaacucucucugcauucuaugcauugaccauucauuaucuuccauuuggcuacccuuugaccuccuuucccugagccacauagcuaaccaggucggccucugucaaagucugucuaaggauguuauucuuccuguggucucccuuuuucuuucuaccuucuaccggcccccacccguaccacacacauuccgccaauucucugugcagacuugacauaagauuccaccccaauccuuguuauguaaccuaccaccuaccccuuuuuggcaagggacacccgagucagcaaguugcaacaaagaguggaguuaauuggaacaugugcugugcccaaaucucaacaaagaagggcugauagacaucaggaaaacacaaccauauguagauguuugcuugaggaauaugaguguacaugggaaauaucaucuacaaccagguugcauuuaaauaaaaucaaccaucauucuccucuuugucuuccgacaccccuuucccccacauguaauacuuuuaacuugcucucucaugucugcucaugggugggcauggucuacuaaacugacaaaugaaacagaucugucugugauacuucauauggggaaccuuauguaacuuaugcgggggacucagcuauggaugacaucccaguagacccucuauggauucccagcuguuacaauaucucauacccuuugugaccuuuucuucuauuuuugcaucccuuuuagaaauuuaggauuuuuuuaauuuaaccccgaauuucuuaaauguggguacaauuuacacagaaugaaauagacccauuuuaaguguacaguuuaugaguugugacaaaauguguauacucauauuaaacuaucgccccaaccaaaguacguaucauuuucuuuaccccauaauguucccuuaugccuuuuccaguuaaucuccuuuccccuaaggcaaccauuauuuugauuugucacaauagauucauuuuaccuguucaagaacuuuauauaaauuggaucauacaguauguacuauguugugucuggcuuuuuuuguuuguuuuucucauauuguuguguguauuaguaguuugugucuucuuuauuaccaaguaguauuucacuguaaacaacagccauuuaaaaaaugaauauuuagacauauuuuaugaguuguuucuauauaguggagacaucuuaaaauugcagcaacucuugaguuuaacaaauaguugacugucaucagacuuucacuuuuuuacuacuucccugcccaagggugcuggaauuccccagcugugggcugaaugcccaucccaaauucucaggcuucuggguauucuugguucacauccugaacuucagaaggaauggugaccuccaguucacugagaugguuuagaacaucuuaaaacuuuugcuauccucacuuacguugugaaacuguuuugcuaacuggaagguagacguguugcuguguacaagugaggauucugaaacaauacgaaggccuuuucagaacccuguggaaugaccugaaaggaacuuugucuuugagcgucuccugauguguauuuucgauaauguauccugcccucaguguuuuucucuguagguuuuaaaggccucagaagucccagaaugguucuggaccugaguugcuacuugagaggaucuuguaauccugcuggucucuagauaccuuuaggacagaagugcugggugauuagguuaauaauacuuauucuuuauuaaacuauuuaaccauuauaagcaauaugcuaagaauuuauguacauuaauuuauauauaaucuaacauccuguuuauguuaauacuguuauuauucccacuugcuagcugaggaaacuaagccuaaauaacuuacccaugguuauacaacucuugugcugugaugggacaaggaugugauuccagaucugacauccagucccaccaacauucuauucuaagucccacaaauacuuucuggacaucuccucccaaguauaaaauagacagugugguaauguacauguguuuaguauuggguauaaaauauccaguguaauauaauuguuaagcuauugaauauuaugaaaaguauaaaaaugugacgugaacuggagccucuaacugcauugaauucuuuucauuuaagggucuuagaacaugugaaaaggcagaaaauaauaauuuuuuauaaagaauaguaguaagaacuguugugcacauuuugaaggugaagauuuugagacaagauucuuuaacuuuuccacagcaauauagaguuagaagaaaccuagacugucucccugugccucuuccucuacucuuucaaaucuucuuuuucucuuauccaagccaagguucaaggaacauuauuaauuguuaucuuuuuuaccugcaagucauagacaaggacuagagaaauucuuguauguguuaagaguuuaccuaagagacuauuaugacagcagucaggaaugauuucuuuaaaguauguaaauguagcgucuucauuauggcuuagauuuacaaugcugacgacuuugugaagcagagaaaguugaagaguuaggggcugcuuuacgaaguguacuuuggaacaguuucuaguuucuuucaaacuuugaauugaaagagaaaaagcaaaguaaguaccuaaaucagcacuagccaaaagaaaagaaagagaaagagaaaagaaaccugcacaaggcagcagcuacucuccauugggaagcucauccccuccuugacaguugcugggcuggcugugcaauguuugauaugugcuacuuauuuacugucuuucuguuucucucuugaugcucuuagacugacacuguguuaacugucuuaugccacugauuacaucuuuccuuucaucuuuguuaugacuaguuuaaaggauaaauggugauuuucuauaaacacaauacauaagcuuaaagaaaaagaugaacauuuuagagaauuugggauuauucagaaucccuaugacuauaaaugacuuagcauaucuagaaugcaccgaguugauuuauuuuuuucuauuaauagucaucaugauuagauaguaccagcuuuaauuuuaaguuuuguugccugugaaguuuauuuucaaugcucaauaccauccaagagagaaucuuguuuaaaaauuuuaaucaaaacauauuuaaggugcuuggaaccuaagggaucacuugauucaaccuugucauuucucuguucaucuugcaauaacuugagggggccaccuaagguuauucuagauaucuagauucuuuuccucuucuugccccuugacuccauugauaaauugagaaugaaaauaucucucuggaauaucuuuugauuugguauguauaggaaacuuugauaucauuguagaaaggcagaauagaaauaaaagauauuucaaagucuuuugauguagguuaccauuuguaaaucugugaaucucugcuuugacuuccugaaagguuaucagaaagcucuucuaagguucucuugggguacuuauuacaggcguauagguguagcccuaccccauuccacaccucccauagguucuucugaaaguuuaugguguuaagagaacucaagauuuuuaaaacuggcuacuuguuccuauuguucuugaggaaaauugugcugaagacagcuguuugaagauuucuuuaauauaaaaucuuuaaucuuaaaccaugcugaggaaggucaguuuggggcagaaaaagagccauguauuugucccauuuacuccagaagaagcuaaaaaugauuuuugaauagcagcuacccuuauaaguaccaagaaacaucagaugugauugcugcuuuucacaugcuuagaauauaauuucuccauauuuuuucaugcaaaaaaagcaaagaauucuagaauuaaaaauaagagggaccuaagaucauauauggugcagcuccuaagaugcuacaccauaaccaguguaaaaguugaaucuuugcuggagggggcuaugcguggauauuuuuuucacuuuccguaggugauucaaauguauagccaagguugaaaaccaggaauguggauuccagaccagccuuucuuacuuauguuugggguugcugagacuuacagaaaguaaaauuauucugugaguagauaacuaauuauuugagacccaaauucuggucucccagaauuugguaccucauuuuuuuuuuuuuuuuugagacagagucuugcucuuucacccaggcuggagugcauugucgugaucuuggcucacugcaaccuccacuucccagguucaagcgauucuccugccucagccucccgaguagcugggauuauagguacgcaccaccaugcccggcuaaccucauacguuuuaaucccaaauuaaugccagcucuauauagaaaagacaggucugugaucauuauucaucuguguaguuuucuuucuacugugauaaucauagcucaguuuagggagcacuuacuguuggccuggcaccaugacagcaguuuuacaggguuacuuucuuaauuaaguauacucauauucucguuucacaaaugaggaaacaggcccaaagagaaaguaacuugucuacauuuuuagagcaagaguaaguggaggugcuggaauuggaacccugauaguuagauuccagaacugugacucuugaacuacuuaacuguaccuucuccuagaaggauuugauuauugcuuuucauuccaaaacaaaguuuuguguagacuauuuaagccauagggacuguagacuguauuuugaaagccaaaauuaagaaaacaaaaaauguggccccaaggcacucacuguuuuucuuccuugauucuugaaucuuaagacagcaugggauauuagugaugacagucuuccuacugccaaauggacgcuuggccacuaguuguagauuugcuucaaagauuuuguguccucagaagugaaagaaaaauuuuagugaggcacaugcugugggaagggugguuuggucagugguuuuguaguaugguuuguguuguuuucucaguguggagaaaauaaggaaagcuauauaguaaggaagaauauguuaaaauauguacucuaccuuucaaagaagaguccagggugaguagcaaugcuagugccaccugaaagaacuuuggagauguuucuuaggucagaaugaaaagcuguugcaguauugccuaaaauagaauuuauaaaacagaacgcuauugagacuuguuaauguuuacagauacuguuuucuuucuccuuuuccuuaaaaaaauccuuaugugcucacuuuaaaguauaaaaguaaacaacaaaacuuguauuauauuagguguaauuucaaggauaacgaaguggaaggagcauguuggcaagguaauuuucuaguaucaggugaguguuuuagaagaagggucacuacuuauuuuggcuuauagaacaugaugguaaaucagaugauaaauguugcuuaauaacuugcugcauuggguguuuacugaauugcgaaggaaaaaucuuuaaccaguacguuaguagauauuugccugugacuuuuaauuaaauguuaacagcaaacagaaaaauggccauuccauuaaauagcaucaucuuacaugguauuuugauuauuucuuggcaucuuccaaaaaaagggaauucucaugugggaaugauggcuguagcuuagagagaaagagaguuuacauauuugauuacauauuugauacauauuuaacauggccauaucuuuguauauaugcuuuauuucauuuaauccauaugcccccauugaaauguaacauuuauuuggacuagaaguuuuggaaucuuagcuggaaccacugauuucagacacuuaugugauagcaggauuguuuaguccaauauguaauuugcauccgaauacuuuauuaaucuagaaauuuuuaguggugaaauuaaguuaucuuuugaaacagucuagcaaauuagacuaaacaaucaggaaauuaauuaaauagaggcaacagauugggauaguaaaccuauuuguaauauuaauaauagcucacuuuaaaauaucugagaaagugccucagcaaauuuauuugguguagauuuuuguguuucccagacaugggaaagggaagguucuugaaggagagaagaaaugucccacucaucugaccacuuccuuucuguuauaauuuaagaucuuuuccaugauuuuauuuuaaucuucucacugacuuuuucaaugauuuacaaucugaaguauuuugaaaaauuaucauacugugcauacuguacauagugugauuacuuuugugcagggauuuaaaaaaguaaucaguggucuuucuuugagaaugaacuuuucugguaaugauuucuacaacauagaacaaagccuucauucuuuguauuuuccaguaguuacuuuauccaguaauucucaugcauuucucugugagcauuucuaaggucuuguucugaggguccaauuuccuauauucacauccuggcacaucuguaaaugcucacagugauggugucuuaacucuuucuagagcugugaacguacugcuucuugaguucuuagacaccucucuuucuaaaguaacaggauccuaguguuaguuucacuguaagaacugaaauccagaaccuggauguccugugaccacaaggggcagagccaggucuugguugcagcuguucugaugcccaguuuggacucuucccuagcuagucuguuaugcugcaagcugaaguuuacaaauuugaugccuccuguugggguauuucugaaggguguauaggguuaucaaacacucuuaaaauacaugccuaaggucaugcuuaauguauacggcaaaccaucccucacaguuucuugcauaaacuugaauauguucuacauguuuucucagccuaauagaaugaccgcuuaauugaguuguauaauuugaaauguugaagugcaauaagaacaggaggacucucugcuuucuuuggaaacuauuaaccaguaaaugaaaauuuaguugaaaacuaguaguuaauaauugccauuuucuaacaugaaaggauuuuaucccucauguguuuuguuaaacauuguaaaagugucaaaauuagcugaacucucauguauuuguauuuaauauaaucuguuuagaugaucuggauaugaaaugugauaggaaugaugguuguagcuuagagagaaagagagagagauugagacccucucugaauauuugguuucuggauuuaaucaccaaugcacuuauuuuauuacucuuggcuuuuguagucugaggacuuuguuuucuucuuuugcuuaauuuucuuaaccugaaaugugacuuggcaaaauuaaggacagagguguaucaaauucuuugcuagucucuauuuuuuuuuuugugaagaagagauuuguauuacuacguuuuauuuauaaucuuuagaagagcuauaauagaaauggguucauagaucuguaaaaaucaaaaucacucuuaaaaaaucccucaagcugucugucacuaaugggggaaaaaauguaauccacuuuggagauuuuuuuuuuuaaugagacagggucucacucuguugcccaggcuagaauguaguggugcgaucauagcucacugaagccuugaacuccugggcuuacgcaguccuccugcuucagccuuccaaguagcuaggaugguaggcaugcaucaccacaccuggcuaaguauuaaaaaaaauuuuuguagagauggaggucuugcuguguugccgaggcuggucugaaacucuugggcucaagcggucuuccugccucagccucucaaagcacugggauuacaggcaugagccagugugccugacuugagauuuuuuuuuuuccuguguuuucacauguguuguuguaagguucauuugguuuuguuguuauuguuguuaauaaggacauaaaaaaauuugauaugagaauuaacgaagaggcacuaacauaaagauaauagaaaagaauauagugguagcauucaacagugguguauugagauugcaauuauuucuuaaaacuugaaaucauuuuugaaauacauauguuagaccuaugucuacagaaacaaacaugccagacacugagcuuuucuucuuucuagauguugguaauuaguaagcaaaugcuaaaauuuaauauuagaauaaaaugaccagauuuuuuccauugcuuaacagagaccaauaacaacauuguuaugaauauaaauuuucauuauuucuguuauugaacuaaaauuugguuuugauaaaaugucuccuaaagugucauccaagaauacuuuauuaacuucuguuuuuaaaaaauaaguacaguaauuuuuuugauaaccucaaacuuauuaaguucacauuaaggaaaaguuucuuuugagggaaaauagccuauuacacaugacauccuuuuucuucuuaugagaguuucuuaaaccuuggacuuuuagaauguauuuucaaaucaauaauaauugaaucauuauucuuacauuacauugcuaugcuagacauuauuacuuucuaauuauuaucuuuaacuuuugcaauuuauauuaucauuguguuuagauguuacauucccuacugagaaucauaaauccuauccagugguuuuaagugaggcaauuuaugugcguuuagaaagagacucaauuuuacucauuuaaaauaaauggagagaaggaaacauuaaaaauaguauuaucguacucuauuuguaguuugccauuuucuguuuaguguauuuucguagaugaagguuuuuuuuucuuuuaaagguugucuaucucuaggacuauaguuuuaugaguggaaugucacauaaugcaugauaacauaaccuauauguaaggguuuuacagguaauuagagccauacaggccauuugagggguacaggggagaaccugagccugaagaaucauguguaggaaaaauccuuguaaucuuaagacuuuuuuuggguguuuaacuuacuaaaaugucuuaauuauuaaacuuucuuaaugcuggacaguuaggagaauauuaaaaaauauaaaauuauuuuuauccaaguuuucuguuuuauccaguaaucaguaaugaucugccuugauucuucaaaguacuauugaugaauuucauuugaguugauuuagaaacaacuuuguugaugaaaaguuugcuuauguauguauuuucaacauuuuuaugucuaugcacuugguuucagaugagauaggaaauggaaauaacaaaacacuguuagaaaaucuuguuucuguagacggcucaaccuugccagaaaccacgaggcaguggaaauaucacgagaaagcuuguuccuacaagacucccagacugauuaccagaccaaagaaguucccagaaauuuagcuugaagcaaucauuuaaaauuuaggaggcggauccaauccugcucggagucauccauugcuaauuauaguugccuaugaugucccagugauuuuguuaucagccacaccuaaguauauuucugauuuuuugcauguucccuccaaaauauauucuugcugggcacuuaaaaucuguuuauuucacuguauguauauuacaccacaauacuguucgcauuuugaaucuaugcauuuuuuuuucuuugccugauauaucuuguucaaccuugaugagacagauggcuuuuuuucuuuuaaucuaguuucauuuguaucuuaaaauuucuaguagcuggggcacucuccucacccaggugaggccugcuuugcccuacagguguguuagaugcaugguuguguguacacaucuuugaaauacaugaggcugcugccuuuuagaaaaguuacuguuuuugcuuuuuuuuaaauaaauauuuuggccagccucagaaauuuaguaauggcuuugaacacuuggaauuagcaugauaaagccagaguuuauuauauacuguugugauuuaaaucacacacugguuauuuuggggaguuagagcaaucuacuugacacagacaggucuucccuggcggaggcuugccccugcauguucuggauagauggcuuugauguugggugaacaucacaacuugaacugcuguguuuacacuguaagaaugcuugcugaaucucucacugcaucucucacauaauuccaacuucacuuuaguucugaauacaugaacaguaaagggggcaguuugcuuuuaaauuuugcuugucaguuaggcacuuuaagagucuuauuucuuuaugugauuuccuguaagagcucauauauggggauuguuauugaguaauuuugaacacaaaauuaauucuauacccuuugauguggcuaauaaaagccauaaggguaugguaggaaaagaagauaagaagauagagaaaaaaaaauugccucuuucuauauggcaagaagaagaaaaaaaaaauuaagagcaguugucuuugaaccacagcaggguuuacucuuaagggucuucuagcuuguuuuucccauuagcuaggaaagcacuaugugagcuuuaaaaaaaaaauacauauauauauauauuuaaaucauggaauaauauaggacaaaugauuuaaauugaaucuagauuuugcaugaacacucuucuaguuuauugguuaaauaaaugcuguaguuucaaauaacaucccaccuguuugccuuguuugaggaucuggugagauguagaauuccaguagcuuggcuaaaaaaggaagaaauaaaagauagaauaaccuggaaguucuccacuucccuucagguauuuucuuguuguucuuuagauuuggaaucuguuacuggauucuucuuucauccaugcuucauggcauauagauauguaggcauuauacaaaaagcuuaucuagcuggguguggcggcucacaccuguaauccuagcacuuugggaggccgagguaggaggaucgcaugagcucaggaguucaagaccacccuaggcaacauagugagaccuuaucucuacaaaaaauuaaaaaauuagcugggugugguugccugcucuuauagucccagcuacuugggaggcugaggugagaggaucgcuugaguccaggaguuugaagcugcagugagcugugauugugccacugcacuccaguuugggugacagagcaagacccugucuccaaaaaaaaaagaaagucuucaccuaaaaacuugcaucuucuagaaccaugaacuauggauggucagaccuucuuauuuuuauguuagcagauuuuuuuuucuguagauaauuuuucagcauuaugauuauaugaccaacaugcgaauguaauuucacauuuuagccuuugagugucugcugguucacucaucuuaacagucuccauauucuaaaauucuggaguaguccaaggaacauuccuaagauuauuuugccauaugcuuugugcagauuuugagucuuuuucaaucuuaaguuuaaauuguuuccaguuucugaauauuaauaaaacaaacaaaccaacccucuuaauguauccccuguucuacacauucccuuacuuuuugggaacucuuuuguccccugcccucaccaccauccuacccuuugccauauggagugugggauguauuguuuguuagguuuuaaauaagcaaauuugccuucucuguguugaagaaaccuuuacuuuuaaaaacugauuauggccucuaggcaccaaaucuuaaacauuucuguagcuuaucuguugaguuuauuauagaucguaucuagaaauuuauuuagcuuguuugaguugccaacaaaaguuggccaagaaaucuguauaauagaauugucuguccaauuuugaaauaugacuucuaauuauaucuuuugcauacacacaaaaaucugcaguauuaauuugagcucuguccuaaucacaauuauuuuuuguuacuuuccaguaaaauagcuuuuucuuguaaauuuuugacauaaacaccagaccacauuuauuaaaaugaaaaaauacuugcuguuaucaagguauucaaaaguauuauaaaauauuaaauaaaguuagaguuuguggcacauugacuaacaaauuuuaucugacagagaccaagaaaaaaauacauaaaauuauaaaguaaauaaacaaaaucaguaauuuccacaaacaaguauguuuaugcaggagcacuguuaaccuacuaguguucagaguaauuucugaaucaagauaauuucugauggugcuuuuaaagagucuaguuaucuuguaacuaauaugacaugggauuaaaguuaaucucuuuuuaacuacagugagaaaauuuaaaagccuuggcuucauagacuaaauaccugaacagacaaauugcugaaauaaugcagcuaagacugcaagagaaacugcaaaagauaccccaaguuauguuuguuauuaagcauagguuauuuugaaaauagguuuccauauggaguauacgguauguaauuuauacagaccacauuacuaauagauucugucaaguggcacugaauucaagcuacaauguccauaauggaauauguaaggaaauugcugguguuauuggguuggauuaaaagaaaaaaaaaaacaccuuuauuaguauguguucccccuccccucaguguacacugcuucuugggcucagacuuugggguuuaagaaugagguauuugggccgggcgcgguuguucacgccuguaaucccagcauuuugggaggcugaggcggguagaucacaaggucaggagaucgagaccauccuggcuaacacaaugaaaccccaucucuacuaaaaauacaaaaaauuagccaggugugguggcaggugccuguagccccagcuacucggaaggcugaggcacuagaauggugugaauccgggaggcagagcuugcagugagcagagauugcgccacugcacuccagccugggugacagaaugagacucugucucaaaaaaaaaaaaaaaaagauauuugaaggucuaauuauaggauaaauuuggugacuaagagguuacucuuaauaacaauaaucauauuugguuuaccuauuugucaccagacaguauccagacuucaugugacuaauggugacaacuguauuuugagaaauuuggaaaaucacauaagcuguuggugauacuuucaaaucagaauguuuuaaauagcggacaagguaaagcaagcucagaacuuaauaauagaggaauagauacaguauauugaaggaaaaaaauacauugacauuugcaaagagaaagaugcuguuucuauagcauaccuaaguccauugaauuugcacaguggacaaauugcaauuggggaauauuauucauauaaauaguccugucagaacacgggaugaguagagucuuguggaacaguuuguuuagagaaguacuaguuaggaaucacuuguauuagcugguaagcaucaagagaaacgcuuggauaggguaguuuaauaaacagugucagcacauuuacauggauugugacaguuuuaucuuuugcuaaauagccuagaguaagcauuauuuuagcauguuaucaaaaauaauuauaauauauuuggcacccacugaaauucugacuuaccuguugggguauguuuuugguaauucagaacagauugauugaagaaucuucuuuaaaaguugcauuuuagauguuuucuuugggugguucuuguagccaucacagaaauaaacauaccuuaguuugcaaaccgcuauuuacuuggaucugaauaggaaacauugucacgauguuacgauauacuguauuuccggauaccuuaacaauuauuagauaaacacgaugaagauggaaaauauugaagaaauaaugauauuauaaaaacuuuugaaugguuuuaguugaaaacaaaccaagaauauauugguauagacauaauugcaaaguagagcuaccgcacuaccaaaaaaaguuauuugagguaguugcuggaagcagaauuuucacgguuagaaaugcuuaaaaagaggcucuuuuaaguagaaaagaaugugagacuuuaguuauuguaacaguaggcuucagaguagccauaaaugaaguuuagcuggaguaagacuaacaggguuuuaaucuguuguuuuucuaguuaaggcuuauuaauaacauuuauguauggccuuguucauuugugcacugggacagaacuagaaccuugggcuccccauuuuguucuuugguacagggccaucguauuucaguaaauagagaguuuuuucucuucuuagacgucuaaacaauggcaauaauuuauaacuaacugcucuucguuauguugcagaggcaaauugcgcagaaaauuauggauaauuuuaaaaagaugaaauacagguggcucaucuaaaacagacuccaauuaaaaccacauuguauuaaauagagccugcuuuagauaggcuccucuucaugcuaaauaugaaugaagcaacaauuuuagauauaauagcugguaucuggauuuuaauaugaucaguucucaugcuucggggcccaaauauugccagcugguauuaagaaaccuacccuccuauaaaacucgauuauauuguuuucccuaagaguauugcuuuaggaauuauugagaaagugguuuuuacaggguauagacuuuugcauaaaaguuggugcuaaaauuugacucaucaaaauuugcaucacacucuugcaucuggaauauuaccagauggcguuaaauuagaccuugggaugggugucucauucagagacauggcagucuguacucaguguaaugggugagcaaagauguguucuagaccuaaguguaugcugucugcauuauggcuuauauaaaauggccacaucuguuauuuuaucaagagaauaaguuuucuaaguuuugguuggucugauaugcuaauaucugcaauuagcagagccuugacaaauuguucccuuaaauuaagaguucaucaguuuggcagaaugugaccugauaaaaugauuugggaauauggugcuuuuacauacacagauuuuuuuuuuuucccguuuuagucuuucuuagccaucagacuccagaagauguacaaggcuaugccaguuuuuuuguuugugcuuuuaaagaaauuauuaccgaaugugggggauccacggaaagugaacuccuggagggacagaggaggagcaagacugucugauccugagaucucagugccuaaaacauagaagggguucaguaaauacuuguuugaaauaaaaauaacgauuaaaaaaaaggagggaauaguuccuaccaucauaugcaagaugacauggguaguccugacucuucuggaguaaggagacugagcauucucacugcugaauuaggugaagggaaacuuagaaucuccuuaaaagggacaaacaagacccuacaugauuggaccugccccuuacccugucugccauucuugucauuucuugccucagccuuauugccccagcaacacagaucagcugguaguucuuugccgauuuugugcuauuuccuaucguggaacauucucccauguuguucucccuaguccuuaucuugccugguuggcuacuaaacuuguauuuaagcuucauuauguucugucuuuuuuucugaaguuguucuaaagcccuaccugaguuggugccuucuucuguuucucuggaaaucucuguguguuucugcucuucugcacaacgugauaaauuauuugaauuuucuccuucacuagaugguuuuuaugucaagaugcuuuuccuuauauuuguucaaacccaaacauuggacacgaugguaggccacggaaaucaguuaauaaguauuugccaaaugauuguucauaccagcccucucaguugcagaaugaaaaacuuugaaugcuucuuuaauaauaaaucuucuugacuauuggcugugauucuaagucccuuguuauaggaguaugguuauuaaccuaguuauuucugccauguuucaauguggauaagcguauuuaacagauucgcucuguugcauugauccugugaugguguuauauacuacuccagugcccuggacugugcgcuacagggcagccucuagacuuugggauuaaguaauggugauucgguggggguauggguucuuauuuuaugggaguguuuuggcaauuaagugcuauuuaaagguauuauuuuuguuagaaagauaaggauuuagaucugugguucauuaauuauguaaaaguugaauuagcaaaggcuaguuuuuggcucaaauuaugaaagaauacucuugggaaacuggguaucggggagaggauaaguaaguuugguuauuugucuugagauuuuauagagaacacacacguaccccauaaauguaguuuuaaagaauuguucaaaguaaaucaauuuuugauuuuaagaaaagcuccaggccggacaugguggcucaugccuauaaucucaccaccuugggaagccuaggugggcugaucaccugagaucaggaguucgagaccagccugaccaacguggagaaaccccgucucuacuaaaaauacaaaauuagcugggcgugguggcgcaugccuguaaucccagcuacucgagaggcugaggcaggagaaucgcuugaacccgggaggcggagguugcagugagccgagaucgcaccguugcccuccagccugggcaacaagagugaaacucuguuucaaaaaaagaaacgcuccacauuuuuaaauaauacacagguuuugcaguguaacuacuggugaggaccagaaaucuaguuacuagauuucuuaaaaauaaaauuucucacacuguuuaaaaaaaggaaaagaaguacacuuauuuuuccuauguguaguuuauacaugcuaaauaaauaaaguuuagaaaauggaauuuaagaagaguaaaagcaucgccaauaguuccuuccacacagguguuaaucauuuuuuguuuucacuugucuuuuguauucauuuuaaaaauagaggaccauauugcguacacugcuuuguaagcugcuuuuugcuuaucaacauuuuguaacuaucuuuccauguuauuaauaacugaguuuuaaugcuuuuaucauaauuuaaucauaauuuuggcucagccauauuagcucuuucuugauagauuuuacuguguaauuuaauaauccaguuuuggacuuuucccacuuagacuaguauucuuuauuagauuuaacaugaacuaagugcuauaaaugagucaauauuuuuuuaaaauuauaugucuguuuaucaguguacuguuucaagucuauguauuaguuaagucuguucuucaggcuugaacauaggcauaccuccuuuuauugcacuuggcuuuacugcacucugcagauacugcauuucuuuuacaaauugaagcaguggcagaguuugaaagaauugacuccaauuuugaaagaaguccuaguguggauaacaugcuauccaaagcaucaaugcuacagagaaaucuuuucugaauggaagagucaauugaugcggcaaaccgucuauuuuaugaguagacaccacagccacccgucuucaucaaccaccacccugaucaaucagcagccaucaacaucuaggcaagacccucugccagcaaaaagauuacaccucacugaaggcucagacgauuguuagcauuuuuuagcaauaaaguauuuuagauguauguaugcuguuuuuuuuagacauaaugcuauugcacacuuaauagacuacagcaucgaauaaacaaauuuuauaugcacugggaaaccaaaaaaaaaucaugugacuugguuuauguggugguuuggaguggaaccugaguucguccgauguuugccugcagaugcucauccuuuacucuuuccccacuacuguuggugcucccaguucugcugucugccuuuauccaauuguaagccucaaugugauuucuagauucacccuaaguacuugcccuugaucagcccagcacugaacucccccaaacacacaaacauuaaaguucauuuagaaagagugaauuuuaggaagaaaccacagaggccaagaucuucucuaauuaauguagugaaucuucugaauguagugagucuucuggccauuuuuugaguauuacauugauagcucauucaaaacgaaaauuauucacacaacuaugguguaaauaaaaagaugugauguuaauauaauuuuuggauuagauuauugccgaaucaagcaucuuuacaacauuauaguuuagaguaauguguuuggcuaaauuaggcaauaaaaguaaacauaaaagguaaaccuucccgauuaguccuuacauuugacuucucuguaugugaaacacugacaaaaaccaaaaauaauuucacuacucuguauuuauuuuucugauugagacuuuggaaaagucaagaaugacaacgguagguauuucuuuuuugcagaacaagccugagaugguacuuaggugcuuacauacaagcuacugaucacuuaaugacauuaaaaaaauuuuaauuacuuauugccuucagacacuacagaaguuuaaaaauccuacuauuuccacuuaaauuucuagaccaaugcuguuggacuuucuuucccuuuaacagcaaugauuauccaguugaauguuguuucacagaaaggaaaagugcauuuguguaaaaauaucuggggcuugccagggaaucuuuuucagaaugcuuugugguuacaaaugaagcuuauuguuguauaaauggcaaguuuaaaaucauagaacuuuuuugcaguagcucauggcaugaguugauaaucugcgaauugcucugcguguguguuuguguguguucgcaugcaugccucagcccaucuguaaguagcuggauccugugccguuccucccccuguuucccaccucacuuauuuagauacauaaauacgcacacuuuuacaucuaaggcaaaccccaaaagaugcauguggaaggcuggaugugggagagagguguuuuccuuuaauugaccucucacggcguuccacuugauaaagugacaacauuuucugaaaacuuaagguuuuugaauguguggauuuucucccuaccacuguaauuucugaaacuuucucuaaacaagauggcuggcacauuauggggacagagcagagacauagaacagagacaaagccgcccugagaaggcagacacacuuauauugcuugugguuuuucaguacagcugcuuucagaugagccggcuuguucuaagcuggucccacugccaaagcaagacugucacacagcugguaguacuuacuguacuugcgggaaaguaugugauucauuaguuggaaccguauguuuuucaccaguucuggucauguuuuuguuaggaugugguaaaaacacaagcagggggugaagggacaauggaaacaugugacuucuuaaggauuggccugaacccguuauuagcuaaauuguacaccguaaaauguccuuuguaccucauaagacaaaugacuuaauuuuuuauuccucaguugaggucauucagucauaagugguaaaaauuaucaacacugagcucuuuuucucuuuuuacuuucugcaaaguauuaugauccguuuaaaccccaaauuauaauaugaagggaagucaugcaaguaaaagacauuaauuugcugaaaaaugcccaugacgggugaagaacuuuaacuggagugaacucuugcuacugauaaaauaugaguaugguauuacagcucauaagaaacacuucuaauaccacagggugugaggagaacaauaaaugggaguuucuuugucuacacaugaucaagcagacucaaauuguauggcuggaggauugagagacuagucuuuuaaguaauuuuggugucauuaaugggcuugcaucacaguaucucuguaaugcucaauccugguauugugcagaacugcuggugugagccgcauugaauauuggccuguuaucaccagguuuuugagcuugugaauauuuuacaacugcacaggccgaaccauauucuuuggaaaaugaaugccauugcugcuguguuguguucuccuuacauaggaauaugcuuugacauuugcuugcuucugcuucauucugacacuggaguuguuuuacuuuuguccccacucccauagccugcuauugagacaggugguauuuucaaagucuaaguaaaauauuggcagauuaugccucuacccucagacucuguuuuucaacuguucccuucuaaaguucugcaccguucaugccucacuacauacacuccagcaguugcuggacucugcagaauuagaaccaggucugucucugacaauuagcucaacuggcugcaggauaaauaaaggaaugcgcucaggggcuguagucugugacacaguguaacagagcguaaaaaggugcaucuguuccaugcccugauucagucgccucacugucacugggaaguuaccgacacggagacaugcccgugcuguuugguaaacaagcggcagguauuaaauuaacagggcugugagugugcaaacgugcugcuuuauuaaaagcccugcuaucuuggcucacugcugggucacaggcaguugcuagagcaucuaguaagaugacucauggcacugcauacuucaauacccuguucucgcuuccuuccagaggggaccguugacauuugagagccugauuacggaaggaaaaaaaggagaaagaaaagagaauacaggguguguguguguguguguguguuugccuuuuacguuucguaggcuaggcaagaaggagaugagggccagcaccccagagccagguuuuaguuuaaauugggcuucugaauccaauacuaaauugcaaccaggucucugucuuuguuguuguuuauuuucucugccuuucugucucacccuccucaugacugcuacuugauuugugguugaaauaaugaggggauaacugagagaugaaaguuuugcucugucugccugcacugggugggcaccaugcaucuugcaaauguacuugcaggaaaaaacacuucgacuuuuauuauauucuuuaagcauuuaucgccuuugcauuuaauauuuuuaaugaaaaacucgcauuuuaaagacuuucugcuuucauucagcaaugucaugauuuuugaaguuuguuuucccuucagcuucaggaaugcuuuacacagggucaugugugguugccuuguugaauuguuccucacuuuuguggucuuaucuuugaggaguccucuuuagauauaccaaggucuguaggcaaacauuacaagacaauuuucaguacacaugucugugcuaaagagacuggcauuucugaagguuuccugcuccccuccaaguuguguuucuuuuaagggccccaacuagcuccucauccauuagaagaugauguaaugcuaaugguaucuagcuccacacagcuuggaccaaaaaugauuccaguuggcuguauuugaaugugaaugaccagaaggugcuagacauucuccacuguaauugcaagugcuuaccuuggaaaucucuuuugguuguagagguccuuugguccucauacuagagaucauaccgccacacaugcauuccuacuguccagacccaucuuuauuguuggcugucuuuuuauagugaugucuagguagaggagugcgaugcccagggucggggauagggaggguggagaggaagcagccuuucucauuguuugcucagaaaggaaaguaucccacuaucuagagaguuagugaugccucagaaucucuuuaucuuuguaaccucuuuucuguaugaaguuuaauaagccggcugugcaguuuuuaaaacgccaguggauuccgcuuuucacuuggaccgccccccgccuuuugcucugagcauucacucccuguuuccuuauuucccccguucucuuuuccuuuaucucaggggaguucccugaguagcaagacugaaaaagagcugagguuuauguuagaagaaauuaagguuaaugaucauuggcucauuuucauauucuguggguguggauggaggaguaaucagugcagguggcccugccaguugggaguuuuucuuugucaucaagaaaauaaggagagugcagggauugaauuaccacaacuauuucaggacuaaacauauuucauuucccgaucgggucugguuuaaggacgcaaagcugacauuaauuuuauccaaagaaagcacagcauuuuuuuuguuucauaauuugacuaaugcauaggguagaugcauguucaaauuuaauucuaguauaaucuuacaaauaauucucugaaaagcaaagggguuuugauucaguuugacaguuuauguuucuguguccaauuaccacuuaguuauugaauguuaaaaagcugcuuucuaaaaugugcacuccgacugcaccaauuggcuucccagcugccugcuauuacaugcgaggugcucucuucuaacuuuuuaaaggauguacacaguugaaguaguuauguuuagcuagcaaaggaagugggggauuugguuaggaagugcuugcuggccuugaaaaacuaucaugugugcauucucauuucagccacauaaagaucauucuuuaaauaaauacuuguuggauuaaaaaaaccuuaaaugcuccgauaaacuagagaaauaacuuugauuuuuuuuaaaaacaugacuuccauuuggaucaacuuuuuaaaguuuucaauaugcuuuuaauaccacugauguaacuuucuacaagugagguauucugauuccaugcuuggaaaaagaagaucuacagguugaccagagacaauaaaagucauugaggaagagugucaacacuugccaugcaugguagguuuugcuuucuuagcggaaugcagcagacgacucaagugaccugaucuguuuuuaaagcacaagguuuauuuggcuguuacagugugaguauaauauuaaugauacuaauguaaaauuaacuuuuauguugugugagcaguuuuucuuguuucccccuuuaaaauugcagauauuuccuugugcauacaucugguguuguugccauagugaacauuuauauaacuuuguuuaagccaugaaaaguuugguauaaucggguaguuuggcaaguccacgugaaggugguuuucgguuuucauagcccugugguaugaguccacaugcaguugaauauucauuguauggccauuaauauaaauacuucgucuagcuuauuaauaacacaugaagagaccaugcccagacauucaaagggcaagaauguuuuagugguuucuggaagcuccuugcugugaagaaauaaggcuuuuaaaaaacauuguaguuuagaguuuugaaguagcacuuuaaaauauuuuaaaauacauuugguauaucuuaagaaauucuugacuaggcuaaaacuuaauauugaacgaagugaucuuuugagaucaauaugauuuccaaguuugacauuuaagcaaaucauguucucuguuuuaagaaacauuaaacaaggagacaaaaauacacaauacaucaguuucuaagguaacauuauuuccuaccuucugcuuugcuuuuuacugaauccuuuuuaccuuuccugcuacugauagaucucaaaacuggccucacgggguuuucccaaaggcuuuuggaaagauccauuuacuuuaugacccacauacaucugguauuagagcaacuaugaauuaauccagccucacuucaguguuuaucuguuaugcauuaggaauauuuaaaaagcaaauaauuuaaacuaauguuuuucuugcauguaaguuagauccuuaaaaucagcuacacaucauauuaacuugaaauuuuuaaauagucgacugaauugcuuuacaaaguguaguuguuuaagccauucugaugguuuucucugcaggcuccuuagcuuugacaauacuguucuacuccuucacuugcaucuacuuguuagugccuuuuacuuuggucuuuucguuucuuuagaaaguucuuccuuuuggauacauagaauauaacgucauuuauugaucucucuuuucugcuaccuuuguauuagaauuuuaaacacgucaugacaggaaauaauucagucugguacaauaugcccucucucuccuaguuuuuaaguccugagucuuguaugccgcacuuucaaucucugguggcuaaccugacuacuuugugucucguuuacuggaauacguccauaaagcaaggauacaugugugucuuacauguccaacaacguauuccaacaaaggcuuucagugagccaggauguguggcuuaguuucaccaucauuuugguaaaaauacauguauuaaacagauacugaauuucugacuugcauuuaaucuucuccuccuguuuuauguuuucuuucuuugauucagacagcaaacugauucaaaucuucaguauaaccuauaaaaccaaagguuuauuaauauuaggguacccagagaauaaaguuguucaucguuuuuuaacaguagagaaauaaaaauaauaagguuuuuuuaguauauaauuaagcacuuaaauugucaccugaaauuguuguucuuuacaugcguuucccuuagcccuuuguaauuaccuaacacugccaguuagcgccaguugugggagcaacaggcuucuaaaaauacccuccuccuggccuggccacccaccuaagaaccaugugaagagguguuuugugaauuaucagaaaguuagguauaacugaugcaaucugugcagcuauuucugucaaaaauugugccuccaagagggaucagcuacauuauaucuuguaauuucagauacacuuucuuggauuuaguggaaaaaccuucucugaggcuuugguaaccuucugaccaaauggauugcaaucaaguguaccugugauagugagcuugaauucacaaaacaagcaacucgauucauugcuuuguuaauccacauccacuuaaggcauagauauucuuuauuugauacgucaucuugguuuauucaucaugauuaguaaguuugucuacauuaaaaauauuacacaaauccugaaaaauuuuagucuaaaagucaucagagggagcuauagguucuuaaauuaauugacuaaugaauaaaaccuauuuuccuauuggguguucuucacugcuucuuuuagagugggcgcagaugaaaaugaaucauggaguuuaggaaugaaagugugaaaaguaacuagauaaaauuuuauaauuuggggagcuauaaaauuuagaauccauuuccuugauuuucaucccucucauuuggaaaugaugaagcucaggagguuaagaagaccacggucaucacaaccaacaagagauugaaauggacaagaauccuaguguccagaccaguacugugcaauagaaauaauucugcaagccacauaugcaauuuaaaauuuucuaguagccacacuacaaaaguaaaaagaaacaggugaaauugauuuuaauaauguauuucauuugacccaguauaucaaaaauuaugauuuccauguauaauaaauauaaaaaauauauaaucaauaugaguguuuaucgagacauuuucuuuucuuuuuucauucugagccuucaaaauucaguguauuuuacacuuucagcacaucucaacuuggacuagccacauuucacguggucaauacccacauguggcuaguggcuaccauauuggauggcuuaggucuagacaccaguccaauuuucuuuccaccacagcaguguaguagcuuuuaaaggguugacuuggauuuucaaagucuuauuuugguuaauuuaggagaccuggugucuuugauauacaagugaaaaaguaacugaaaccuuauauaagucguuauaauagaagcacauugcucuagaaucaucuuucucauuaacauuuuugauuccuuggcaaaugcuuaguaauacuucaaguaaauauuuucaaguuacuuguagacuuuuuuccuucgucacuuuacucccugugaagccauacugucucaguuuugcuaaccacagacacauuacaggcaguguugugggagaagaaaaaguuucccucuguuucuccuuuuggagguugaaggcaguauacccuggugcugcccuggacugaggcuguccaccaucuguguaaggaauucacaaucccagacaaaagaaauuggcaaagucuucccucugucugcucuccagauccucaagauagccauaaaacaccuggacaaaaucagcaggugauggcaagggaaaaagaaugaucagucacaggcguuguugaauccuuugaacauuacuuacggccuggacauugcugucaccaggcucaauuugaucuugggugaguuuucuggaagagcuuuauucccuggcucugugacaacagcggaaccagauaacauuguggauagaggagagaaguggaaagucgagguuucccugccuuaagguauagcaguuccaggugguguuaccucuguguguguaagaacauccuacagaaauaagucauaucaccagaugcauaaagugugcuauuuagaucaguguucuuacuguaauccugcucaaggaguuuaaauauucacucaucuacuuauaguuuauaaauuguuuucagaaugaucagcauuguucauaugcugaauuuuaaaauguaguuuaaaaucuguuuucugcacuuaacacugaaaaaagggaguuggcacuaugguauuuauaggcuuuuacaaaucuuuucuuaugguggcucuacauaagaaacuuugcuacauacucauuuugugucacaugguuugcuuccauaucuuuuguuuugaugcuguauguagaaguuucaguagcuacuaagucaucauuuggguugucugaaauuuuuauaaugauaucagaugguggcagaauugcauaucaugaagucugguagugaaggggcacauuuuuaauggaucaggaauuuagccaugaagaaauaacacuuuugccaguaaaagcuccgagcaaaguccguuagcuguugccucuuugucagucaguaagagaguuuaauacagugguauuuagcuuucuuugcugcugccaguuuuaagggucauauuuuagcucugaucuuuauuuccagugagagggcuaaaccaaagcagaagcagcacuauuuaacucggaauucagaaugauuuuuucucucccuuuggcucugucuacaaauguagcccuuuuucauaucaauggcgucaagcuucauugaauuuagcucugucuuguuaaguacauuaaugcuguguucugucauucauuacaugagaauuaguugucuauuacaaaguggggguuuuuguuuggagccugaucuucacgggaagaaggccauacguggcuuaauuuccugagugcauugaaugcuggacuuauuuuucugugacuuguauguccacugaaagcaucaugcaaaauguugauucuaccguugggaggcccacuguauuuuaagcaaggaaacuuaaaagagaagaacacuuaccaccuuucuuuuuuaaaauccccuuucccccaugcauuuugucacauuuuucagugaucuauacagugcccuuagaguguguuacagaaaguguuaauaucuuagagcagcaguaauaauaauccuuuuacucaggguaaucaugugcuaauccucugguaagucaaaaguauuagaucauuugaaauucauugugucagcucaguugaaauaacugguauggugcuauaaacauuuagagaaagggagucuuugaacccaaauaauaaugucaaauaguuuguuaguguuacauguucauguuuaaggguuucauaagcucaacccauggacaagagcauuucaguuuacaucaguguguaauauauuauuuuaacugaagguuuauuuuuauuuuguuauuuggggaaaguuucuuuuccucuggcacuuguggacuggauuuuuaugguacaguuuucacucugcaaucacaggaagccugcugugccagaagggugcuuuuugguauuuuuuuuuuguuuuuuguuuuuaaagaaaacuauuuuuguuuuucuaaagcauuauguuggguuugaauuuucuccuugcucccuucuuucguauucuugagaaaaacauugaugguguacauauuuauuuuucugugaauauuuuaaccaggaauuuuggcuucauguuucccuuuuccuccugaacagagucaccucuuccuuggaauuuuuauaauuuucuugaauuauucucuuucccucucucacucuaaguccccaggggauagagagcccuuagauucuugguuuuagugaucuuugcacccagcauaccuuagguguucaauaaagaaugcuuugaauugcuucacuuauagaaaugcugguaaauuuggugacuuagcuaaaguuguucccaugucagaaaaugaauauuuuuggugacaaaucauuuucauuucuucuuuccugaaagucguuugaguuuuagaagggcgccuuuucuuagagcuucaggacuguuugagcugcaacuguuguccuccaccuuuaugaaaccacucagcuguugacaaagccgguguuagagcuucagagagcaccagcacaauuaauugguuuucugagaaugcauaacuuaacuuaaguaauugugcaaucaaggcucauguggaaaggaugaguaucuguccuuucuggaccucuuguuaucacuccuuguuuccaccugaucuuugauucauaguuuuggagaacuuguagauucuuuuauccuaggguauauuaaguacuguaaugugaaguccuacuccucuuuuuugaagaugaaauuuacagaucuugcugcugauugcauucuguaaauaaagggagagcucugaacaugauguuugauguugugucccuaguccguggccaugcucgauauagcuuucuuccuccuggcguccucccgugaacagauucugguaaugagaagguucaucaucuaaaaagcaguccacaggauagcuuucucuaugcuguuauagaaugaacugaaaucuacguagaauagcucuagagcuaaaauuggguagagagaagagguguuaaaugcaaccugaacauuuuuuuucagggauaacccagcucagagaauaagguguccagaugaucugguuuaagucacagagccaguguagccaaccaguccccaaggcacuggccucacugagaggguagcuggcguuccauuggguaugggaucagggauuauugauggcauuguuacaggucugucagugagggcacguagaauagguagccccgaaaguugcuuuuagucaccguaaaguggcgcuccauuuuagaguucaguccaggcauggcuuuacugccauugcugggaaaguacagcaugucacaguggcagagaacauggacuguggagccaggcugcuuagguuugaauccuguuuccaccacuuguacugucucugugauacuggacagguuucugaagugucugggcacccaaguucaucaucagugaaaugggauaauaccuacuuccugcauagcugaaguuaauugugaggauuuaaugaauguauggugccuagaacagugccugaaacauaauaaaugcugcauacauguuuauguaguaaaauaaaacugggugcugagagcugcugaugcuucagaaaaccauuagugaaaccuaaccccuggaaccugacccuucauuaaggccccaagguuuuacuaaacuuugugccugccacaaaaaccauacuuauaugugccuuguauagaagcuccuauagauaaucgugguuuuuuuuuuuuuuuuuccuccaucuguacguaaaauuuggaggagcuggcucuacagggcuuuguggggauucucuugggugacaguguagcugaggaaacucuacuuugaacuaaaaauagggccauuuucauaauucuuuucauauuccgcuuuguuuucuuugggugauacauucuuuaucagguauaauuugucauagaaugauguuuucaauuguauuuuuucguaaccaaagugauuaauuuucaauuuacauguggcuaagaagauauaucugauaaucaaguuuaguucaaaaguagguuuuuuuguuuguuuguuuguucuauaagaaguaccucauuuugauugcagggccacgguuaaaguggacuugacaguaaacugaaauuuacguuuaucgaugaugaucaugaccccauaucaauuucuguguucucaaaugcauuauaugguugucugaauaguuacuccagauugccaacacugugauuuaagccuuucacaaauuaccuguuguaauucacaaaacuggguuucauauuaucuguggcaacuauuuuuuuuaaagauuccucaaagauguaauaauacuugcacaagugguggcaacuaggacagaaugguucaaaacaagaggaaagaacauacuaugaaaugcuauagagagccaccuacgaaauucccacgugucaguagaacuuccuuccuuccuuccuuucuuccuuccuuccuuccuuccuuccuucccuccuuccuccccuccccucccaucccugucuuccugcccuccuuccuuucccccuuucuuccuuucuuucauucauuaauuuuuaauuuuuuuuuuuuuuugagagaggaucucacucuguugcccaggcuggagugaagugccacaaucucagcucccuguagccuugaucuccugggcucaaguagagauucuccugccucagccucccaaguugcugagaccauggggcuggcuaauuuaaaaaauuuuuuuuguagagacagggucuugcaauauugcccacacuggucuugaacuccugggcucaagugauccaccugccugggcuucccaaagugcugggauuacaggugugagcuaccaugucuggccucuuuuauuuuauuuuauuuugcgagacagggucucucuccgucacccaggcuggagugcaguggugugaucauggcucacugcagucucaacauccgaggcucaagcaauccugcugccucagccucccaaggagcugggacuauagguaugcacuaccaggcccaccuaauuuauuuauuuuuuauuauguagagacagugucuuacuuuguugcccaggcugaucuccaacuccuggacucaaaugauccucccaccccagccucccaaagugcugagauuauaggugugagcuaccaugccuggcccggaacauuuucaauaugguuauggaaacauuaucaacuggacacaguugcuugauuucucagcuuaauuggaguuaucuugauguaauggaauugaacaaaugugaccauugagcucucagacuugguuuugaauuccacuuuuuccauugaccagcuaugaggccuuagucaaguuccuuaaucuccuugacccuuagucuccuuaucuguaaaauggcgauauaauaguaccaaucaugcucaauugucaugaaaauuaaauuaauucaugcaugugaaguauuuacauuauagaggaagaaaaauuuauuuuccuuccacucgucuaaguucuuggcugcuaacucuguaacaaaagacaaauuaacaaagaaaagcauacaaauuuauuuaauauaaauuuuaugugacacauuuccuucauaaggaaaugaagacuugaggaaacaauuaaagcugaauguuuuuauagguucgaugaagaauggacaguccuggaaaaaugugauaagacaaaaaagaguaugugcuaagaguaguaaaccgaaggaaacguagcaaggccuucuuauuuagauuccuuuugauguccuuccauuuucagauauacaguugcuuuuuuccucuggguuuugggaagggcaccucucacaugacgaucuuauggccugcuucuggggaaaaggauggggaaaugucagagaguccuugcauauaucaucucucaaaacucuuaaucuuaaauauucaguaugucaaggugccauauuuugggguagcauguccugagcuccaucaacauuaauguaaaaauauuuagccuaaugccuggcacauaucaagagcuuaagaaaugcugacucuaaaauuaugacaucuaggaagauguggggcagaauuguaaacuuaccugcuaaauuaccuaugagcugcccaccauucguuaauuauggcaauaauaauggguuuaucaugcuguauccucacucuugcaagcaguguuccuugugcuuagcaguaaauguugccuaauuuggggcaugcuggugugucugcagacuguucuuguauguggaaagguaacuggccugcuuggcuuuuuuuuuuuuuuuuuuuuuuuuuuuuuuuuuuuuuuuuuuuuuuaaagagacagagucucacucugucauccaagcuggaauacaguggcccgaugacagcuaacugcagccuugaccuccagagaucaaguaaucuuuccaccucgacuucccaaguaguuggggccacaggcaugugccaccacacccagcuauuuuauuuuuauuuuuauuuuuuuguagagacagggcuucccuguguugccaaggcuggucuugaauuccugagcucaagggauccuccugccucagccucucaaagugcuggaauuacaggcaugagccaccacuccuggccauuuuuuuuaacuucaugcauguagcucuuccauaucaccuuacuguauaaaagggaacaauaccccagaaaccuuucuuuuaaauaguaccuggaaacucuaaccuugcuuucuuuuuauuuagagaaaaggugcauuuuaccaugauagugaaggcauuuacauggauuagauggaguuuuuuggauuuuuuuuuuuuucaagaaaagguuuuuccaagugguuuuguuggcuuuuaaaacaaaagcaaucacaguaaacugaaucuguuucucuuuugaagcauacauguguugauugcuaacucugugcuagguacugucuuggauuuuggaggcugugaugaguaagacccccauccuugcuaauaaggucuuuaugacaguaauauuauagaaagauuucuaaguuuuggccaauggccaacuauuucuacuagaaguucuuccguagaucucaggguguaccccuacgucuguugcuuuuguauuuuuucuucaggcuugugacagugaaauuuaacauuuuuggguuucaaucccaagcguuaauuucugguuaauuucauucccaaguguuaauauauaggacaugcuguaauuugguuuugagccuuguuucauuagguuuggcuccaaggacacacaaaccagaaaacaacuuauuuucauuccuuucuuuuguggcuguuauccauaugguacugcucaucucccucuugugacuguuaccuuucuuuuguaaucgaguugucucaugaugucaucgaggcaauuaauugaaaauacacugccugucuggaaucagagacaacucagaaaauuuugcagucuuccaugacaugcccagugacagcugugcuugucacuauuucuucugggaaaucccagggaauugucauagucugcuguccugguuacccaggauuucucacuuaaagcugaauuggugguuggauucaaggaugcaggggcgcccaaauuaugguaagaggucuaagaggcuccuccuuacauuuaccuguugucacucaggaaaaguagcagggggaucuucuugcgcacaaucucaguaauugaaaaaugaagguaguagcugaucuccuuuucagaaaagguacagguguuggcguuuguuauaaauaccuauucugagaagccugcacagcaguaauggggaauacuccauaaccugcuguccccagugauuuucaauaacauguggcauuuggggccaccuuuccuuuugacuuugucuuuuacauuuaaaauuuauuaaagcaacauuuuucuggguugcaagcacaaaauggauuuuuuuccuagaaguuuugcauauuucuuguuauuucuuuaacacaguacguuuuccuucccuugugugaucugcauuuuaaaauuggaaaaguacacuggguauuugcuuauucaaacuggcacaauaggcauacaggcucuaauaauuagucauaugcuuggaaauugucaguguuccccaugguucacaaauuuaaaauaaaacucacugcuaucuuuuauuuugauccaguugauuuuucagacuaccuuucuaaccuuaugguccuagguauucuccuugcuauaacucauauguucuuugaacaagccccaugcugcuuuaccuccguaccauuggcaguacuuguccaucuucuuggaugaucuucuuuccccaucuuggcuuguugaaaucacuuaaauagguuugucauaagugaugaugguccagcacugagcuaggagauaugugugggugccaaguaaaacaagacauggucucugaccuugaggaccuuugaguccagugccucuugaaagccuauccaucuuccaaaccacuuccuucacuaagcuuuuucucauuaccucaauagaaguagucugucuccccugaacccuaaagcauuuuguuuaugccugucuugucacauugaucacauuccacuuuauaguauaguuauuuguggucagguuuaucucccuacucaguuguaaauuccucaaggacauauuuauguuuacaugucaggguuuagaauucuguuuucuacauaguagguauuugauaaauauuuauugaauugauggggccacaagaauaaaaauccaugcuaagaauuggugaggggaucuugucauauaauauuuuguauuucuuauucaguacaguuaagggaauuuaauuuucaaauucuacucuaauaaaaggauggaaaauggaaauaugaaugccuaguucucuaaguuugguaugagaaaguggcuggggaaggggugggugugugagacuguuucauguguacaguauuguaucaugaggcagauacuuaauuucaggaaacagccuaaugaauaugaacacuuggaaaauuaguugcccauucuauuaauuguuuauuugugaaugaaaggggcuagucaggcuggaggauugcaugguuucuggaagucgguauacuaaacuaucuccagauguggggagaaagaaagacguccacauuuuauugcauauaacacuuuguugcacaauucacaauuugagcuuagagguuuuuuuuuuuugcuucuguuuucuaguuauuuauuuuaguguuagaucucuguucucucuucuaccucuuacaaauuaacuaauagaauaauuuaaaggaaacauuuaguaaugugcuuuuauugaaguuagguggucuaguuagaagaaagagacuagguuauuuuuauauggaggaauauuuguucuuccucgaguuauuuauuuuguuuggagacauuuauaugauaaauuuacuuguauaugaauuuucaaaaauuuuguuaaaucaagaauuguuccuuuacucugcagguagaauauuuuaaaauugagcuuaaucauuauuccagagaauuugauaaacacauuuagugaaacuuggauggcauagccuuacaagcuggucuuacaaguuauuauuuucauggcugaaugcuaacagacugcaugucuugcuuuaucagaguguaaagugagaccuuuuuuuuaccuugaauuuuuuuguuguuguucuuuaugcaaucauuuaaacaauagcucuggcaucacuugauugugcuauuagccucaccuuuucagcaacaaguauucuaaauuccuaucuugggagcugcuugggaaccuggauuuuuguaugauaaccagucaaaaaauaacauaagauugauguccaggguuggauuuuuaugugucauuuaaaaauggcauuugugccacaguucacuuuacagccguuuuccagauaauucaaaauacuagaaaaauccaucugguccuuuagaaaacuauccuggagcccuucccuucaugugcagguuauagaaaaaacucuggcuggauggaugcuuuggugacuaauuuaaaguaucuggcaggacgauugauagcgccuuuccuuuguguuguaacaaauauauuucggcugcaguuuauuaacauaauucagcacaaccacagacauauuguacauauuaaagcauagaauuagaaccauuuuuugcacaucacagucuucucuugcuuguacuuuuuuuuugacaaggaucuggauaauugcuucaacaaaugaacugcuguguucagucuguuucuauaauuucauaaauuguuuucaugcuaaaaccaagcaagcuuucacugaguuaauauaaagaaccgcaguguaauuacaggagcuguauuauuaaaaaguaugacagcaguggcagccuaagugacagcuacuuucuccuugcuuuaucaugacaaauuaaaaaacucuuuuaagugccagggagcaacagaauuugcuauauacacgucaucuugaaaauggguaugcacucaugacuaauuauuuuaaguguguguaugauguuguaccccuggaaagacuccauguaccuaaugaucuucugaguguugcguuucuucaacugugaagcaaggaaaggugaaauaccauguaugagaaugagaguuaaguuaccacaggguagaugacauuuuaaaagcagauaggaguuuuuuaagaucuacuuuguauuuucuucacugauugcguuuaaauucuguugggccaacugaucagagacuaccuaucucuguuucaauucauagacccuuauaacccugauaaauuauaguaauuuaaauauuuugucaguuuaucauuccuucaaacuuguaucuguagucugcuuucuugucauacauacauuguugggaaccucggauuccuucuggggguauuuaaggaaagauguuacucacuggccguuccuuucaaguuuuacugaauuuaauuauaguggugcaucuggcaggcaugaaaaccauuagaugagcaaagggggcucccaaaugccacucuaugagcauaauuuaaaaugcuucggauucagcaauccuccuucaguugcguuauuagguacauugccuuguacuguuauccuucugguugugguuacauggugcgcccaguuuuugccaccccuuuucccuucccucaucacugcauugugugauaucuauauuauguugcugggccuuuccuuuagaauuuguggaaauaaugguauauuuauccauaauauggaugagauacaaaugauuugguauuaagggacauaagugauuugccuucuuaagagcuugugauuaucagacagaagauggcagagaagaauaagagcaaaacaaagccaaaccuguuucuucuauugucaauucagucaaaauggaggauacuaagagacaggaguccugagaggaggggguaccaagggaaagguaagaagggcagguaagggauucaagaccuacuggagacaagggggaagagcaacaguuuugucaaaaagaaaaagaucagugaucuuucuggaaguccagcagagaagaccuuucuugagauuaguuuaaauuaagaacuagaauagaaauaugucccauagauaaauuccauaaagcacacuccugggauucugcuguccagguaccugaauaguuuguagccaucuucuacauaccuuuauuaccuguaacauaaggaagcauaggagauacaaggaugaaguucggucuucuccuuagcaggcuggacacaguuuuagcaguuauuucuauaugcucauauuuagcuuguuuuccagcugagcuccaauuuuuguuguccuggagcagcucaagcuuucaccuuugggccuguagauuccuaucucaguucaccuccaugaagcaagacuagguuggugcgccuucucuucauaucauaacacccuaugguuucccccccucuauuggaaauugcuuauuuacuuuccuugcagcucaagcuucuugaggauacuguggguuuuauacuauguauacaauccccagcacagaguaggcauucacaaaauacuuguuguaguaaugauuucaugucugagacuuuuguuauaaaagcucucugagccuuugaaaaguggcuccgaaagguccccuggggugcacuuuucucuaggcaaucagugaucagaguuagccaagccugcuguauccccuuucauucaaacagcccauguugcgcaucuuucacaaggcuguguucuaggugcuaaagaaacacagaaaaaucccaagaucccuuccuguacaggagacugaacuuagguuggcaagguaugauguuuaggaaccuuaaguacauaauaaaaacauuauaaaauauggaaaccuagagcuuugaagaaauguugagcauauugaaacuuaugcauguaauggaagaggaaguggaguuugacuuuugccuauuucaaguuugcaugcuucugccgggcuuuggaaacaguaccucuauuuuucagaucucacugacucccugucagguuaucuuuucaugacaucaacuuaucuauuaaguaauuagggcauauuuuaacauguaaaguguaugucugggagccauauauuuuggaaauguacagugugcaccuguggucccagguacuugggaggcugaggcaggaagaucccuugagcccaggaguucaaggcugcagugagcuaugaucuugccacugaguccagccugagugacacaacaagagucuaucucuuuaaaacaaaauuuaaaaaauugauuauuuuuaaaugcuuauuuugucuaagaauuaauaaucauaauaaacuuuuuuuuucuuuuaguuuuaaggagcagggaguuuaauagacaagaaagaagggggaagaaagaaaaaagaagcuccccuguacagagacagagggagggggaagaaacguuuuuauuuaccauuuacucugugucuaucacugugcuuagcuuuuuaagcaaaauauuucuaauguguacaaaauugcugugugaaaaguaguaccauucaguuguuacaagugaggaauuggggucucagggaaaauaaauaacuuaaaaauaggaaguaggaaguaccccuaaggaaucuuuuucugcucauggaaaguagaggauaaggguagauuuaguuaaucacaagcuuucuacucuuuuugagccugcccuccccugacguaaauuugaugucucaaauuucuugaaggcuuuauuuaaacagugcuuuguggucccuucuggcagugugacugaugcuuguaccauggggguuuuuggauaccuggaacuccauauuggucauaagaguaaauuggggauccugggaacccugucuuacucuuuaaaaacuguguucacacauuaauguuucaggagagucaaauuuauuuugccuguuuuguguuuuuaaaaaagagaucaauuuuguuaaucuauaaguuaggucacuagaguuggaacuacaguauuaaggggccuuccaucuggaagucuuaacugccuagacaggguaggaaaacaucaccuuagauuucaaaaagacuuaaaaugaaccucaucugaaaaugaaagcauccguguagcauauacaaauacauuagcacacuaugcuauguucaaguagaguuguuaauuucucuguguauuauuuuaaacaagauugguaaaguaggaaaaccaaaacuuuuuuugcuuugaaaauuuauucuguaagaauauaauaaaauuguuuacuuacccuaaaguguagccguuaucaaaacucuuuccuuuagacguguuuaguuuaaccaccugccuaaaggaccacugaguuugaauuguuacagccaaguuuacaaguguggacuugguccuguguuucuuuuaaaugccacuucauaagaccaccccuuuuuuucuacauucccuaauuauuuucuccgucucuccuuguugucuguuuuuuucuuucucugagguuuugcauuacuuuuaucaaaacgaauccccuuuuuaaaacuggauaccacagcgcacuguggcucacgcacuuugggaggccaagacagaaugauugccugagcacaggaguuugagaucagccugggcaacauggugagacucuguuucuauaaauuuuuuuuuuuuuuaaagucagccaagugugguggcacacuccugugguuccagcuacuugggaggcugagacaggaagaucgcccgagcccaggagguugaggcugcagugagcuguggucacaccacugcacuccagccugggugacagagugagacccugccucaauaaauguguuaguccguuuagaagcaagucacacauuauguggauggccgcaggccaaaggagcuugugcagauaaauuccuguuuuuaaaaaccaucagaucgccggccaggcgugguggcucacaccucuaaucccagcacguugggaggcccaggugaguggaucaccugaagucagguguuugagaccagccuggccaacguggcgaaaccucgucucugcuaaaaauacaaaaguuagcugggcaugguggcgggagccuauaaucccagcuacucgggaggcugaggcuggagaauugcuugaggcuggggcuggagaauugcuugaacguugugggguggagguugcagugagcugagauugcgccacuucacuccagccugggugaaagagugaaacuccgucccccuacccacaaaaaaaaaaaagcuaucagaucuugugagacccauucacugucaagagaauagcaugggaaagaccugcccugaugauucagccaucucccaugggucugucccacaacaugugggaauuaugggagcuacaagaugagauuugguuggggacacagagccaaaccauauaaauaaauuaauaaauaaaauugaaugccuauauauuucuccccucuaauccauuccucagagucucugacagagugaacuuuuuucuuuauuauuaacuuuuaaagcuaauccuuuaaaaaauauuuuuucuauucucucaaguuuuugucuuuuauacauguuugaauuaagucauuguucuaaauauacauguaagcugguuuauaaauacuauaauuacuucucuuacuuaggacucaaauguugcucauaauugaaauuguaagcccuuauuuucuguucuagcagcaggcacucuaaauggcuuguuuaaaaaaaguucuugacugggcgccaugggucacgccuguaaucccagcacuuugggaggccaaggugagugggucacuugaggccagggguuugaaaagguuagccaggcaugguggugugcaccuguagucccagcuacuugggaggcugaggugggaggaucaccugagccugggaggguuaagguuacagugaaccgugguugugccacuaugcuccagccugggugacagaacgggaccaugucucaaaaaaaaaaaaaaaaaaaaaagaauucuugaaagguuggacucuuuauuaguuaucacuaauuauaucacagacucugaacucuaagaaugcuuguuuucauggcucuggucucuguugugcuguaauaaacuuccauuucauauuuucugaaguugucacuuugaguucuuucuuuggcaauaagaaaagcuuccauucaguccaucuuaaauguggaaaacaguuuuauguagcacuuguuacuuaacaguagucaugggacuuaaagaaaaauguugaagcuuagaggugguaaagcauagugguuuagagaguagguagugaaguugaucggaaguccuggcucugccuuggcaaaggugguuaaugucugugcuuuguuguuguuuuuaccuguaaaauugagauaaugauagcgugauacccuccuaagagggaaaagucaggauaagcugaguuuguccauucagaguguuuagaacacugcuugauaguaagugcguaagaagcguugccaguauuuuuaaacuuaacuuugcagauaauauaugaaauaugcaaauaaguagaaauauauacuugaaaacaugaaaucuuuaggauaauuuccucuuuucauucucuacuaauuuauuguuggugaauuagauagaggucacaaucuagucauguguuuuacagaaaguaguuacaauguuguguuccuuuugaaauacugacuuauucuuuggcguguaugaggggacaucacaugaagucauuguugaaaaagauguguccauuaagaaaguuggugcucuauuuguguaauucccgagaguggagggauuuguuugguacaguagccuuauuagcuuuacuaaaacaaacacacaaaaacagacugacacccacaaguauuuuugucuuguuuuacaaggucugguuucuuuauugaaguaaaauucacauagcauaaaaauuaaucauuuuuaaccuuuucuuuucuuuucuuuuuucuugaguuggaaucucucucuguugcccaggcuggaguguagugacgcgaucucggcucacugcaaccucaucuccuggguucaagugauucuucugccucagccuccaaguagcugggauuacgggcgcccaccaccacgcccggcuaauuguguuuuuuuguauuuuuuaguagagcugcgguuuugccauguuggccaggcuggucucaaacuccuggccucaagugauccacccagcucagugucccuaagugcugggguuacaggcaugagccaccgugcccagcccauuuuaaccauuuuaaaguauauaauucaguggcuuuuagcguagguuuagcauaguuuuguagccaucugucucucaagaucuuucuaauugaaaaggauuuauauuuaaaguuuuaugaguuuugcuuugcauuuaaauuaugucaugcagcuuuucuaaaauaaacauagcaguucuguguuucacaaaauuaaacaaaaguuggcauuuaauuaauaugaauggggcauugcuucucuuuuauaaaguguuuuuuaaaaaaucucucuuacagagagagagagaaagagguucuaauuaagaugggucccagauguuugcuuuguauugguuuguauuguacuucuguugacuaagcagguaguuguuagugguuuuaaaauugugaacuaauuagaacaauacgaagagaauugaacaucuaucuugccaacauccagaucaaauaaaauuuagacuuuuauuauuauuuaggauguuauuuaguauacaaacucauguaaaguuuuauuuacuagaguuuacauucuuuuguaucuuuuugauuugaggaaagaaaaaaauggacaauuuauaugaaauuucuaacauuuuaagcaguacugugacagaauguuuuuuuauaaaauaccuaauuuuuaagagaauauuugagagagguuugaaaauauaccuaaacagaaaaaaaauuaaagaaaaguguauauuuuucugggcauuaauaaaaucagccaagguuaugagcagaaauacuaacagcagguuugggauguugauagugaagcuuaccuaaaaaucuuaaguuaaaaguuuuaaguuauugccagauuucauggcacuugcaaccuccuuuuuaguuuugccuaaagugaagcaucuuagaccagaaaggaugcucuaauuguugagucuuuauuauggcauuugagagcugcuuauugcugauaaauaguguuuauguacuauauguuuagcgucucaaaauuauuuucuucaauggagcaauuuugcacacagacaaaaaauuugugacuuuuggugugugauguuagggugaaccugauuguuaaaaguuuaacaaauauuugcauugguagcaguuaauguguauuaaauguuuauuuuuaaaaucauauguuuuaaauaauaugaaaaauguaauuuuaacugguuacaaguuuucuuguauaacauuagcauucuaccugacacuguguagaaguaaauuuugauuuuagcucuguaaccacauaaauacaaugcuggauuaaagccuuuggcccugacuuaucugcuagugugugaacauuucuguuugcagugccugacuucauugcuuccuggaccaaggaaggauuacuuuugcuucuugauagauuuaaccuaaucuauuacugguuugacaauuggaggcauaaaggguaaccaucagcaucuuuucgaagcauguaaugcuacuuggagaacaauauuccaguaaggaaauuucuuguuuucggaaauucccaaaaauucaguggauaacucauagaaugcuuuuaauauauacaguaagauggcaucuucuauuucuaaaguauuuaguuuaucauuuuauuagucaaggaauacuauagaaaagagcaguagaugaaaugaggguuuggcagcaucaaaugauaaaaauccauguuccuggaugcaguuaaaacagaaauguaaaaauguucccaucugucuaagccaucaguuucugauacagucccuggaggaaguggcugaaaagucauuuccaccuaauggguuguuagguugcuucuguacaguaaguuggugguugcagcccacuuccucuaagacaaagguccaugucuccaaaaccccaucacaacugacacuaauuggcauugcucucggcccagggcugugaaagcgggccugagugggcauagaguggggagcacugaggggguauguggcaccacugaaaagacauuguagauuuuccuaguauaccacauuuagauuuuuguuuucugaccccuguucaugcaauuuauaucauuuuuaugcugucaucuggcuugggaaaaauuuuuccaaagccccauuggugaauaccaugucauuagaaaguauuuucaccuuaccuaauguugggacuuccaaauacuaaguuaccuaugaaaaucucuaugaaguaauuaagaugauuaguaguaaauacaauaaauaaguacacauuuuuaccucacauuuuuacacaucuaauaaacuaacauuuuguuuuccuuuuuucuuaaauaagaaaccagaagagggcauauuagucuuucagaaaucacuuugggagccacuuggcccaguucaguuacaauuaccauaaauuaggcaaagaaccugcuuuguauucauaagggucaggagugaaggauuuaguuccugcaaggggguuagaaugacaaaaauuaugaaagcagaaugguacccuccucuuaacaacuuuuaacuaugucaaagcuugauugcuguauauggcuccauacuuugacgauuauguagaagacagggaagagaaacauuacugagcacuuauuauauuggagggguugugcuggguacuuuccagaacauuaucuuuuaaacuuuagagauauuaccagacuccugguuauagaaaagugugacugcaguuacggccaguuguacgcaaucucucuacuuuccuaaaugcguauugaaaaauuagugagugguggcaguggggaggaagggaauuacuaagggaauugauuagucauauuaaucauuuauaucuuuucuccugcauccauuuaaaaugaaaauggauagccauuuagguacccagacccugcccucccuggcuuccucuuccccucuccaucauuuucaggcucaggaguguguaguaggaucuugcuucaacaguuggcuuggacucagcucccucugagaagcucugcuuucaaaucuuggaaaagcucaugaggcccuccucaggaaacugcuuacuucucuugcaaugucccaggggauucgaaacaaguuugggauuucccuuuaccccugaaguccuuuaaacagagcaucuucuugcauuugugucuguucguuuagaucucagcacaguucccugccucuucugguaccacaaguguuaacaauauagggccaggaguagggugagccaaaugaggugcccgagguacaaaauuugaggaggcacuucuucucggguugugcaaguggacuggaaguugcgauuccccgauucuggagugugguccuggauaucuguacuuauguaaagcaccacagaugauucugacauauaccuguucuuuuuuauauuuaauagguaagaguuuucuuuugcugaaggaaguggagacauuugguucauagcuaaagaagaugagauugugcuguggaaccuuguuuucgcagcacgugauaaaucucaccuuuaauuuacagacuccucuugccccuuccaagauguuuaaauaauaaaagauguaucaucaucauuuucugugaucccaaauuaaagcaagaggcacuuucacauugaaggcguuauuagcacauauuuuacauuucuacccuuuguugugcauuauuauuucagaugaaagguaggacaccugacaacuguguacagagauccucagguuacuagcucagguguaauuccuucauacacaaacuaacuuuauucauguauaacccuagcucuuuauauuacuucuaacaccagaagacucucgccacccgccgcacccccgcaucauuaccuuuuuaaaauaaaacaaguagguugauuuaggggagggagaguuacuauuuuaacuaauugaaacacaaaacugaaauauuaaauauagguaaacauuaaaaaugauguuuuucagcuagaauaugguuaggugaggaagcauguauaccuuaacuuuaaaaucuguuauuuucugauuaaggaauaaaaugcugaauuugucaauagacuggaaaucuaaagaaaauaauacuguacaaauacacacccacuuaaaauuguacuacgucugcuuuacuuuuuuaggagacauaccaucuggcagcugugucucaguguuaaacaacuugagcacagguaauauauuugacaauuaaaauaauagccucacauuuauuggauaugaucaaaguauuaaagcaugcuuaucaccagcucuauggauauucagauaauguuucagugaaaaaucauauugaauugugcuuuccuuaucuauuuaugauucacucaaguagaacacacuaauugugcaaauaggguaggaaacagccaucucacaaacuuacaagguacuuuacagaaauccaacugauguucagugucauaaauagcaguauuuguggucaucaauguagggccccucuuggauuacuuaaaguacauaccguagucuagauauagguuucuuauauaucaggguuuuaaauaugagugagugauacaguaaaaccguugguugccccuguuuuccuuuaucauucuucguagaccagcaaagcugguuuguguguauuuggucauccgauaauauauuggcuuguccuauggugcuuguauggaagaaguggaagcaccacaacacaugggcaugcgcuguuaucaauuuaucaaugaaaaaugcagauguaugaaaguauuaagcauaucuuaauauauuacuuuuuuuugacauggagacucgcucuuucgccuaggugggagugcaguggcgugaucucgguucacugcaaccucugccuccggguucaagugauucuccugccucagccucccgaguagcugggauuauaggcaugugccaccacgccuggcuuauuuuuguauuuuuaauagagaugggguuucaccguguuggccaggcugguguugaacuucugaccucaggugauccaccuaccucggccucccaaagugcugggauuacaggcgugagccacugcgccuggccucaaacugcuuuuuaccuuuacuuaaagacaaguugagggaaccauucauuugaagaagguguuagaaggguguguguguuuuguuaugacacguuuuuguaccuaggcuuccguucacagccaucucugccuugcagcaagagagaguauugaauuucuacuucuuuccuuuugauccuaugaaaguuguaaaucucuguaguauguaaguuaugaccuaacucuccaaauuacuugaauaugauugacauuaagcucauauuccaaaucacuuugcuccacaguucaguuauuuguaggcaggaagcauauuuguuuaugagggagcaggaaguauauuuguuuauguuuuuauauuucauaauuucuagcauugucuuuggaguagucaaaucuuagcaaaugaagggaugaaugcuuugugauaggcuacauacauuuuaauguucaguuguuuuuauaugggugaauggauauuggagagacuaaaguuuuacauguccuugaaguauacuuuuguuguuaauuuauucauauuuaaggcacaacccuauuuaauauuuugugcaaaaaccaacuuuaaggaaauagaagugaaaaauacauauuuugauguuuggcuuuuucaaaaaugcaaagcaucucauuuaauuuccagguagaaggaauagguauugcccaggauauauacacugccugugagccagugcccgccucuuaagcugugaugagucuguuuuccuauuuuggguuucagguacaguaugguaaaaguagccuuuggugguagagaugagaaugguggaggggaacauaugcuuuucuauaaugacagggagaucuaagguuagaauguuacuagcguugccuggaagaauaguaaggcauguggacuuagaagaagguacuuauuucuaguguauccaaaacgucucuuccccguaguggugaguucauucugccacagccaagccuaccaggaaugauuaucuuuugucucucuuaugugaaguuggaugacuaaggcagugauuucugaacagcaacuuuugcauauucugcuaguaaauacaugcuaaauauuucaugugaauuuuauaguuucuauuuuuagaaaguugucccuggaauuuguagauaauacucaguaauagacauuuuagcaacuucaucacuuuuauuuuuuaauucacauaauuuuacaaaaguuauguccacuuaaaagcuuuaucugcuuuuauuuuuuccccagucagaucauacuuagaaaaccugagguuaacauaaauuauauauugauagcuucuuagcagucuagcagauuucaauuucuuagaaagauguuauggaaccaaaaauuugacagauaaauguaaagugucuagcacgugaugugaauaguaacaaagauuuuauuucauuucuaucaauuaugcuacuauuaugaauauuacaguauaugguucuuacucuucaggcaugcacauagggucucuuucaucaagaagcacauauaccuggacugagagacaaauuacugauuugcaguccuuaauuauuuaaugagaaauuacagugagaucccaauauauggauuuaacucuucaaaacugccccgaaaaccaggcacggaaugaaagaauaucaucuuuauacgauaaauaaauaaauuauauuuaaaauagauaaauuuauauuuuaaaucacaacuagcuuuguacaaauaggagcagauuuauuuuguacacuuaagauuaugggggaaaugacauaaaagcucaugcagguaaagcuuaugccuucucauguguaaaacaaauaucuaaauauaugucuauuuguguccacauacagaguuaaaggacacuuuuccaugaaauaacacauuccuuuagaauugcuguagauuuucauaauuuuuuaaaaacauuucuauuguaaccuacaucaaaagggcagccagcguuuuuuuugucuggcuauacauaugcauuauaaaaaagugagucuacuguaauuaccaguuugcagagcaaauuccugcaggguuuguacucuccccauuaguaaaagugauaaguugaaauguauuaaaauuucacuguacaacugggaguuuuuguucacaguaaauguguuaauguuucuucauugcuugacuguuuguguuuaaauuuaggcagcgugcccaacagggacaaaauuauaggauaaagcuauguauaaaagaaaauccuucagagagcaccaguaaggcucuuuuuaaaaauaagcaguuacauacaauaguacauggcuguagccacagagaaaaguuuuaucugucuaguucagaauuauuggaauuuuucuuucccuuguguaaaaguuaagaggaccgagcuuaugucaauagcuaauauacuuugauguaaaaacauccauuauuuuauucagugucacuucuauaaaaagaaaaagaaaugauuucuuuuuguuguuccuaugaugaagagaagcuaauagcauuuugagagagaggugauagaucacauuuucuucccgaguaaaggaauucuuucuuguuaagaauucuaauuacagccuguuauauuuuuggaguauuuuucucugcuuuucuucguugccaugaacuuaguaaauacaauuauucauguagauaggcuuauuuuuuaaaaaauuaaucuacaaccacaaucaccuagcaugaauauguaaugaaauucacaaucacaggguaaaggcuccuguuucucugcagucuagagagggcagaaguugcaguuaucugaaaaugcuggcuguauaaucguuggccagccagggaaucaacucuccucuuucucuuaaauguucaaaauauauuguaguuuuuacuguuuaccuuuuguaguuucuucugccugcuucucuguaagugaaaaugaaagaauuugccaguauccauauucugucccaaaugucuccauagauccacaaacaaaugguguaaagagguaaaaauaaaauacgaauuuucauuuugcauuguugcuaucuuagaaaucggguuuugcaauuuaccuaguguguguagauaucuggaggggagagagagaaaaauaugaauguauauguguauguauuuuagugguuuguauuuguacauucacguaccuauaggaaaacauaaaaagccccuuggauauuucauacuguauauuagcuuuccuucagaaaauauauuuuuccccuuaaauagguugaucuccccugccccaagauguuuaauuuuuauuucuuccucuacacuguucuuuaaaacaugaauuuguagcugauaaaccuuaaaguccuucauagccauuacuuucuuuugacuaauuuguagaaaggcaccauaugaaaauuggauuuuugaucugauggagugauucuugaguucuuacgagccauuuauagucuaucaaguaaauccuucuuaguucacggauuauugacccaauggaccauauuagcugcuucgaagcuguuauagcccauuauguugauucagcugacacacaugugaacccaguccacaugcccaagaugacauuaacguuguucuagaagacuuuuuuuuucuccacaaggcuuuguauuuauuucuuaauuuucaagaguuagcucaaaguuccugacaaccauuacauaggucucuugcuuugcucagugauguugaagcauuuguuuuuagcuagucagucuguuuuuuccugucuuucucuuuaugucuguuuuuaaaaaccaucuaaucuuuaaaagaaaaaagagaauaauuuuuuuucagcauacuagcacacauuuuaccuucagauucauauagaugucauagaaauuuguggaauuucucugagcauaugaauuuagcccuuugaauuugagaaaaccaccuuuuagaagaaaugguaacauuguauuuguguuuuuuaaaaauguauuaccugagagguuucacuugaaaaauuccagugacucuagccacugguaaaaucaagaugugccuucauugauuuaugugaagcgcuaaugaagccaguccaggucucagcacagaccccuggggaaucuaugaccuaacauaaauaacguauaagggggcacauagacuguucaucauaucacuauuauuauuuguaacagguaugauuccuuugcugauaccugcuuuuaagugaagaaacauauucuuuuauaaucagagauaauuaugauacacaguuagauguacaauagaagguauuaaaauguuuguugagaugugucgcugauggacagucccaagacagguauaaguaaaaugcuguagaauaaaccaaguguuccugggaauaucuugucucacuguuuucagauuuugacauuucuuaauauaaccauauaaagacuauaaaauacugugcugggucacuuucuuuauuuaaaaguguaccacuuuuuggcagaaaauccuaguauauaugguuaacugcuuacuuagcauuuucacuuuucaaguugcuuaaaccuuuacccaucccucucccuuuuuguguaguuuuguucacaucuccuauuugguuauaagcuccuauuggaacugaaaacauaucugaggaaaucucagauuuguuugaggaggaggggaacaagggggauuaucaggcuccuuuccucccaugcccaggcugaguagaaagagcccuggauuaguagcuguggccauuuagggacaucucagagccucauuuucugcuguuugaaaaaaucucuaauuuuagggauuuugaugauuaaauacaagaauguauuugaaauguuaugcaagcuucauagcacuguacaaacaugggauauuauuagucuuacagucugucucaauuggccuggguaaucaguugucaucugaaauguuaaauucuaaaacguaacaacuuuucuccccuguugcuuuacugggguaaauuuuaucacaaaccuagaggaguaaauuuaguuaaaaggucaccuaccuaugcucuugcuuaggaaauggauugauuacagugcuuuggcauuugaaauaaggugggcagcuccuuuuauaaagaggguaaagauuuagaggaacuccuuucuuuagggagcccuucacauugcaucugggaagggaaagauacugacuuaggaugagguguuauauuuggcacaacuugggacaacuuuuguguuacuucuguacaucuuugcuucgucaccaaagugugugauaaucaugcaaaucgauuguucuuucuaggauuggaggugcuuuugaaacauaccagaauuuaagcuucaucuugucuugcuucuugcuuaaugaggaauaguuucuuuguaaagugcuuaaagguuuauaagucuuuuugcaucucauuauaaauccuguccuuauuaaugucuucucuaucauauuauauuaguaauuguuuucaugaaugccacagagaaauguaaucacauuaccaucuuucaaauugcauuagugaaaaugaauaaaauauauaucaauggaauacaaaauugcugauucaacauuaagaugaaaugagauuauuauuacuuagcaucaucagauaugagaagugcuuugccuccuucuauaaaguuagguguucugguaaauauagacugaguuaaaauguguguuuuucuuuuuuuaauggcgagcuaaccccuuauuuucaauuaggugauaggucuguucauggaaggacuauuuacuuucuauuuauguuauuacagcugccuaaguagccuguaaaauuuguaaguauacaggcaauaaauggaguaucuuaauuguuaaauguuagguaagaaaauaaaauguuuuugccuaaauugaaaugccuuuucauuucauguuucuuuaauauuacuaauugccuaacaaaaucgcauguauuaucauaggccuaauuuaauugaaacacacacacacacacgcacuccaaagcuugcguaugcuuugaugccauagaagcauggguauuuuccuuauauaauuggcuauaucccgcuguugauuuuuacucugaacuucuaaauuauuuaaauggggccuuucuuauaucgauugauaguagguugugauaguagguaaugacuauggaugcuuauuggaucucugucugggaaaauuuauaugccugugugugucccuuucucccuguuuguauuuauauauucacacaguuguagaaacauuuacacucauauauaaacauaugcccagaaguuucugguuuucccucuuugccuauucccccuaagccaaauuuguaucuuggcuuuugcugaaauaauuuuuuucaucacaguaaauugaggauuuuuuuuuuugcugguauacaugacagaauucagcauugucaauuuuuaacaaauuaucuuagaauuuuuuuaauacuuugauauuaauauugcugagcaucauaacugagaaguuuuguuuuuguuuuugcuuuugcuuuuuugccccgcaaauauuugaaagauguacuggauuuuuccggauagaaaaauggcaguggauuuuuaaauggauauauuagguuuuaauauuuucaaaguagaaaggauuuucaaauauaagcaacaguaaaauuucuuuguucaccguccguguauuaacucacuuagcauuuguguauuggagaccuacugggcaaaagaugugcugcauuaugucuccuggggaaugauaucuuaugggauuaaaugguuuuaacaccacuaaaagaaaguagguggggcagugggauuccucccacccuuucccuguuuuaaacagcuugauugagauauguuucacuuaccauacauuccacccauuuaaaauacucacuguauuuuacuauauuuaugguuagguucaguuaucacugaacauuuuuaucaccucaaaaagaaacuccaugcccuuuagcugucacccuaagccucaucccccacaaggcagccacuaaucuacuuuuuaucauuacauauuucccucuucugaacauuucaucugaauggaauaauaauauuuggucuuuuaugacuggcuccugcaacucagcuuaguguuuuucauguucauucauguuguaguauguauccgugguucauuccuuuuuauggccaaauaaaauuucauuauauuaauauacugaauuuuguuuauccauuugucaguggauggagggauagcguuuuauaaaaugaaguuuuaaaucuccugauuuuuaacaucauuugauguucaaaggucaacuuuucccagugaaucucuuucgauuauuuuggauguguuuauugugaagaugauguauuucuuugguucauaacauuuuucucaagguuuuuuuuggggggaggggaggggugguuaaccaucuuuaaauugcccagcuuuuugucuuuuaccauguugccugcaguuuaaaccaaugguaccuggccuuuuagugaguccagcaaacccaggcucuugcgaaucuccugucucaguuauaagaucuaauguguuuuuucguugagaagacaccaagaaauuucagaacacauuaaguacaacaaaauaaucauuuuuuaccagcuugcuauuucuucauaugacauuaaaaacaauuagacaaauguaaggaccuuucuuugaauuguuaauuaauuuuuaauuuucugguuaccaccaaauaagagacauacuuuuagguauaauuuuccaucauaugaauguuugaguagauuuuuuuaaggagacagaauaacuucauuguuucucauuugcugcuguuacuauuacauuaggaguagugacauuugcacuaugguuuaacaugcuuguggacccuuaacauuuauaaucaguuuuauaaucacugauaaucauagcauguaaauucugugugcauuguucauucagacuuagauuuauguauuucuuuguauaaauggagaaaacauacccaccuuacuaaaacuauagauuuauauuaauacucucauggucagaauuagauagacguuuuagguuguuaauaaagcuuuuuugugggauguuuaaaaccguagaucuuuugacccauguucuguaucuuucugacucaccucuuccuugucuccuuuugauacuugguugcaaaacucuucaguacaacagguggauauucuuuuacauucgucauagaugaguuuuguaaucaaguacaagugaaauugauauguagucuuguaguucaugcuggucuuaaguaagcuuaguaguuguccaccgugcaagaaaaaaugcagaauuuuuucgcucaagcuguauugugauguggccaguuaggaagcugauuucuucucccaaggcaguauuauauaaauucugaaaauuauacagggagauauuugcugacuuaaucaccauuacuaucaugugaguuuuuuagucuuuguggcaauguuugaaguacugucuuagcauaucauacacaaccuauauaaaagugcuuguuucaucuuuuuggucauguuuauaagaucacucucugcauccacaaugcuagcaagccauuaguuuguuuauugcaguguauucuauggcaauccuggaauaauuagcuuucagauucauuacagauaauuugcuauuccagauuuucguccacuaggauagacgucuuuugugugugugugugagaugaaggucucacucuuccauccaggcugggagugcagugguaugaucaugguuuacugcauccuugaccucugaggcucaagcagucuucccgccucagccucccgcguagcuagaaccacaggugcaugccaccacgcccggcgaauuuuucauauuuuuauagagacgagguuucgccauguuguccaggcuggucuuuggcucaagcuaugugcucuccucggccucccaaauugcugagauuacaggcaugagccacuauucccugcuaggauagaaaugucuuugaagaacaaauuuucuuuuuuuaagccaggcacaguggcucaugccuguaauccuagcacuuugggaggccgaggcagguggaucacaugaggucaagaauucaagaacagccuggccaacauggugaaacccugucucuacuaaaaauaccaaaauuagccagccaugauggugggcgccugaaaucccagcuacgugggaggcugaggcaggagaaucucuugaaccugggaggcggagguugcagcgagccaagauugugccauugcacucuagccugggcaacaagagcaaaacucugucucaaaaagaaaaauuaaaaaaaaauuucuucuuuucccuccauuagagcauuuuauuaauuauugugaugcauuuucuuuuaccgcuguacauacuggcuaauuuuuauauuuuuuguagagaccggguuuugccauguugcccaggcuggucucgaacuccugggcucaagccauccuccugccucagccucccaaagugcugggauuacagguuuaagccaccacaccugaguggcugcuuauguuaaugacuagcuuuuucuauaauuuaauauuaauguaggucauguacuuaacuauuaagcauuuuaaaauauuuuaaaauuucauaauucauauuguaaaucuugcuauacucuccagaaauuaacaaggggaaagaagaguuaaaaagguuuuuagggccaggcaccguggcuuacgccuguaauuccagcacuuugagaggccgaggcggguggaucacgaagucaggaguuugagaccagccugaccaacauggugaaacccugucucuacuaaaaauauaaaaaauuagcccggugugguggugcgugcauguaaucccagcuacucaggaggcugaggugggagaaucacuugaacccuggaggcggagguugcagugagcugagauugcaccaccguacuccagccugggugacagagugagauuccgucucaaaaacaaacaaacaaacaaacaaacaaaaaauggcuuuuaggccaggugcaaugacucacaccuauaaucccagcacuuugggaggcugaggcgggcaaaucgcuugagcuuaggaguuugagaccagucugggcaacauggugagacccugucucuacugaaaauacaaaaauuagccagaagugguggugugcaccuguagucccagcuacuugggaggcugaggugggaggauuguuugagcccaagaggcagagguugcagugagccgagauuaugccacugcacuccagccucgguaacagagcgagaucugucucagaaaaaaacaacaaaauuuuuuuuuuuaguuauguaugggagauuggugaagguuaaugaacccaugaagggagcuccuugugaauaguuguuuuugguuuuguuuguguguggaacaccaaaacccagaaccggaaucaguuuuuuccccucucauuaugauuagucguucagaauaugugcuuuaugcuucuauuugcccaaaggccauauuuugcauuuuuaaauuugcgucagauaacugggauaagugucccuaaacaacugcuaauaggaguuuuaucaguuagccuuguguguaguucuuuugugaaguacccuauauauuuacugaaacaacaauuugugcuuuccugagaaauaugauuuggucagaagauugggguucaauucacauaaacuugcagaauuggaaccaacuguagagcuagagaccucagcuuuagugauaacagaaccuauccucuguauuagagcuuuggaaugcauccaaaauacuuucaaauguacuuuuauuuaauauucagauauaaaaguguuacugaccaaacauugauuaguuuuuuuacuaaauuauucuucuuuguauauuuuagauguacuuuugcauaugaauauuuauaauuauuuuuauuguaaguuuucuuuaguuuucuacagguaauggaaauaaacugagucauaauugggagauuugucuucuucuccacuagaucauuuaagagccguguaaaacacauaaacguuucugaaccauaauaguaaaacagaaauaauaaucugugugccuaccuuagaggacuauaguaugaauaauaugguauuauguaugucaaaguguucauuuauuuauuaagacuaaauauguguuaagcaauuugcaagguguuggaguaaaacaauacauugggaagaaucauaagagagaaaacaaucauuuaaauguaauauguggaaaguuucuuguggccauaaaugguugucauuuauugagcuuuuccuguugccggauagguuaacacuuacuuuuucuucauuauuucauuugaguguuuugccacuguugcaaugucauuguuacuaucauuuuacagaugaggaagcgggcucagagaaucauguauuuuuaaagugccuuuugagcaccuguuauuugccacuauacauugaaagcccaacagacaugucuauccugcccucauggaacuuaaauucuagaggggaaaacaaacccauaucgauaaucacaccaauaaauauaauauucacaaccuguacuaagcauuaugacagaucaauuaugauacagaagucuaguggggaacuugucuugaaugggagacagggcagcugcccugggaaaugagugguacuugaacuccaaagaauaaguagccguuaacaacuuaagcaggacuuggaaggagggaagcuagagagcacgguguuggagaaguagggauugagaauuuggauagcagaggagucagcuguccaaccaaggagaauggacagccacuguuucuacucuaguaggcagaaucugacaggagggugaaaauaaccucagucaagcaaauagcaaucaaccguguggaucucuuaagaagagagaauguucaugcagauggggagagaagagaaacguguagguuaauuaggagacaguuuaaauagucuagaaaaaaagacuggaauuaugguaguaaccgugagaauaaaagacaggaaaggaagggauacauaaucuuuggagaaaggcagaauaucagugaaaacucugcccuauaacuugcugugaauggaaucguagcucaggauucuuagcucaacgugauggugcacgccuguagucccagcuacuggggaagcugaggugggaggauugcuugaaccugaaagguugaggcugcagugagccaugaucucaccacuguacuccagccugggugacagagcuagacucugucucuuugaaaaacagaaggaaaaaaaaaaaaaaaagauuccuagucaguggaauggagaguuguuucugauuuauagaucugugacuuuacuaguugauugacuuuagguaaguuaguaaauuaucucuaccuuaguuuccucugugaaauaaaaguaauaguaguaacaacuuuaugcuauuuucugagaacuaagaaugcugauguuuguaaacucuguagcacagugucuggaaaauggaagauauucaauacaucuagcuauuauuauaacagguaauaauuuacuauuguaaauaaauaaauuaaaauccugagguuugguagaggaggaauaaugcauaggagauaguccuccaaucuguguaaggguuucauuuauguucuuaguuagggucucuccucuaaacucacugcccccaaaccccaaacuaucaaguccuugaucacagggacacugccauccacuucccaccacuuaagaggcagugccuggcuccacagugacgguuuuugcuuaguggugauauuugaagcuguaggagggcgugaaguugccaaauuaaagaaugaagagcuuggccaugggaaacaccuguauuuauuuacaguggagagagagagagagagaggagagagcaguugaugccagaaaaacuaggauagucagucucuacagcccaggaaugaaggagaguuagugcagcaagcugcaucacagucugggaggacaaggagacuagaaaaaaggaccagaugggaugagaacauugccucucagagagacaguuucaggcacguguggggcagaaucuggauuguagaguuaaaauguaggugguggugaggaagugggagcacugguugcugggugcauggauuucucuuucaagaagucaaugguaaagguaagcagaaggaauaauuacuuucaauaaggugcagacuuaagaaaauguaugguuguuguuaugguuguucuuggggaguugggauaugcugaucaucuucacugcugccuccauucagcucaugucugagagccuccaacccucuucugggcacucggaacaagaccaagcuguaugugguacauucugugaacgacaaacuuugaaaaugcagguauaaagaaaagagcagacaguuuccaauaauggaaauugaggaaagaauuacaaggcacccuggcacccuuguuaggcuggguccuggaggccugcuuuacccagaccugaauacuaaucucugcauagauaggugggaacacucugacugaacucucugcuccuuucugcauaccugcauuuucaaaguguguaguucagagaauauaacagcuuggucuugucccgagugcccagaagaggguuggaggcacucagacaugagcugaauggaggcagcugugaacaugcucacaagaaugaaagcauauucauuucgacucuucccaacugucuccuuguaaugcauguacauuuuugaggcuuaacugguuuugauaguuuuaugauaacuuauguuauuugcgugugggugaguuggccagugaucacguugguucuauuuuguugugaauaaauaguaugucaaaguuuuaugcuguuucaaaaauguuauuuagaauaaaacuuccuuugaagcggcaauagucucuuacucaaaauauuuauuuagaccauauuguuuaaauauauauaauucucuuaagggaaaauuguagucuauauaaaucugaauuuaaaacaaauagaccuucuggaauucauagauauacaaaauggauauucuagugcuuaaguguuuauauacaaaaggaguugagguguuccaguguuugcauguuuagguacaaaaagaauagaauucauaaaaaggaauaaugaucuaaaaaguugaauucccgaauguaccaaauguguaaaguuauuuaggaagacaaaauauuugaaucauaaacuuguucagaguaagugaaugaaugauucaaccaguaaaaaaaauaaauacacauaaaaauaaaucaaauccacagucuguuaauuuguucucgucuuaaauauggcuguaauuaaaguugaugaaagugugcuuuaaagacaauacaaaauuaggauauuuuuauaaaauaauuaaauauuaucaaauuaaugauuuaaauauuugugucuuuugugcuggaguuuauauuaacuguccuugaaauaccaucucauuuuauuggcccucccuugauuucgguaaagcagagcuauuuuuuuuaaagcauuuaugaaagcuuuuauuauugcacuucaaauuauaugaauguuuuaaugucaacauaguucccguaucugaauuuauaauuagauaauuuguaaaguucuuguuuuuaguggaaaugcuguccucuaagcucuuuuuauuuuggucacaguacaaucaaguuuugaguucauuaacuaaugaacauguuauuuaaauaaacuauuucugacuugggauguucugauauauuucucaguuaacaaauuauugaaauuuaagaacuucuggaagaaacguuucuccuuauagucuacaaauuaaucacuucuauauacaacaaaguuuacaaccuagcuacaauuggaccauguuuggaagagagauccugaaauaucagggagauuauacaauuaaauauuucccuagugcuaaauugaagcacaaauuaaagaugggggugaaguaugaauggagucuacagugaggacuccaacaucugaaaccaauagggauccauagauuuaauauuaauuaauggaagagaaauauuuuacacuugccugaucuaaagcauagggaaugguaaaagccugcucagucuuauucucugugaauggaauuugucccagucauguuaacaauauccaaaauacugccuguuacaaaugagacaguuucuauaaaaauccuaaugguuccagaaauaugagcaucuggagcugugugagugagcauggcuuucaggcacagagcugcaguuucagguauccccaugcccaccccuccaccccagaaucaguaaucauugauugcaucuaaaucugcagagagaucuuuuccuggcaguucaaguaguuacaguagauuguuaaucugcgaaugaucagacuaaaucccuucugucuucagaauuucuaugcaaauuagaauuaacuguaugagauaaauuuauuaacuguaguccgggagcuuaggucagcuuuagcacuauucuuaaacauagguuuuuauucauaaaaaguuacacuccauuuaugcuaauuuucuauggauucauuuuauaauauuaacuggugagaugguuuuuuaaagugguuauaaggaaaugaaagauuuuuaaguguguuuuucaguuuucugcaauacagguguacuguuccagauauaaaauauucacauaaaugauuuuuucuguuccaugucugaucugaaaccaaaauuuaaacuuauuuucuuucuuaugucacuguugaaauaagaggaggauuguuuuuuauuuuucaaaacaggaacgaaaauagaauaaaaaauauucaaggaauugggaugugauuaaauaauaauagaaauauguuaggucuuauugagcacaggagugucuuuaaaauauauuugagaguuuagcacaacauuuaauugaaauucagcagaagaaaaguaauauucuaauaauaauauuugugugccauauuuuacuuucacaaacauuucacuugaauauuauuuuguuacaguguauuuuuugcuuuauugacaaguagagaaauuuaaguggaaauauauauuagcagcaauauacuuuuuucuuuuuuggauuugugaugucguaaauccgguaucuuaucgaauauguaauccuuuauuuuuauucuaaguuuguaauuuaaagguuacugugaaugaccuaaaacauuguauuagugaaugagcuuuuguuuucuuuaccuuuuuuaauaagagauuuuggugauaucuaaauuuauuuuuaaaacucuccaggccccuaccaucauaaaaucuuuaaaaauagaagugggcaauauuuauugaaauggugaaaagaguauaguaucuuugaacagaugcugaccuuuuuuuccuccuuuauuuuucaggccauccguugcacacugguaaacugcacaugugaauguuuucagccagggaagauuaaccugaggacuugugaucaguguaaacauggcuggguggcacauggugaggaaaaucugggcuuuucuucccguucuuauuauguucauguucgugugugugugugugugugugugugugugugugugugugugucuguuuagaggagucacuggccuggagaagagagaggucagcugugcuccaaguguuaguuaagauucagccugcggcucuaaaacagcauauucucagcuccaaggagcuaggcgagcagcucucagcagaaggccaagauguuuauaggacaguugggcugugaaguucuuacugagcaugggcgcagccagcaagcaccaggccugauggaaacucaaacauaccacaguuggccuuucagggccuggaccucagagggaagcuggcaaauccuccuugcuugagaacuccucgaugacugcucacccuugucguaugugcucggggcugagcuuauccuucuagauguuaaauguuguauggucucagguggacgagagagugaacgggaacauuauuuggcugguaucugaaaauauaaccuguaaauacucccuuucagugugcauggggauuggagguggucgacguagguagagugugagcucuguguaggugugugcugggguggggagaccccacgcgaaggauaugaguguugaggguuuuugccaggugcacagagccguucugucagugugcccugaccgagcguucagcauauuccuguguaugguuuauguuuauucuguuuaaguaaaaggagacuuggaaauaagcagacguuuuuuuuuccaccucccagacuguagaauuuaaaaagauagguaauguuuauaaaaagaaauccuggcuugagauuuuuugacagccccggguauugccucuuaaguggacauauucuucauucccaagcagugccaaacauccaguggguuguauuuuuauaaaugucauguuauucuagcaacaucugagguaacaacacugggccaugccucgaaaugcuuuuaauuuaucauguaccuugcuugugagggcgugugugauggaguugcggggacauuucagccauguuucugugagagagaguacucugagaggaauacccgggaagggguauguuuccaccaugcagccacaauccugcaguccuucaugcccacagggauagagcgcuuuccugcuuuauuaacaaggcccaaaucagcaacaggucucaguccagucuugaacaacagaugagcugcauuuacuucugcagucucuuuauguuacuacauucaaugauuucgucucucuucauauauuaguuugcuagggcugccauaacaaaaugccacaggcuggguggcuuagagagcagaaauuuauauccucaaagcucuggaggcuagaauuccaagaucaaaguguuggcaggguugguuucauucugaggcuucuccuccucauuuguagauggucaccuuuacauggucucuccucugugggagcaugcccuggugucugcaaccuccaacucccggguucaagcgguucuccuuccucagccuucugaguagcugggauuacaggcaugcgccaccacacccagcuaauuuuuguauuuuuaguagagacggguuuucaccagguuggccaggcuggucucgaacucccgaccucaugaucugccagccucggccucccagagugcugggauuauaggugugagccacugugcccagcacuggugucuucuugugcauccagauuuccucuaauaaggacaccagucagauuggauuagggcccacccuaagggccucauuuuaacuuaaucaccucuuuaaauacccuauauucaaauauagucacauucugagguaguagggguuaugacuucaacauaguaauuuugggagaacacaagcccauaacaguucccaaauauccuuuuuuucucugaagaaguauugguuuugcuggguaauagguacagagcuuauauccuaaacucaucagaaccauaugaauauuggaggcaguuugguuguagacuguucugaggucaaauccuggcucugucaccucaugacauguuaauauugcuggacuucaguuuucuugccuguaaaauaggauuaauaguuccuacuuuacagucuuauuaugaaaauuaaagagaaaauauaugaagccuuucuaacuaauacauauuaaaaguaaaauggacaguagaugagcacuaaaggggaggccagucguugaacaaaggcguuucauuuauucgcucucauuuuugccaaagccaucuuguauuaucauuaucuaucuacuaugguagccuuggaguauaaaaguuaacugugucaccaguuuguuuuaucuauuuaauguccaugugcauauuacauuaguaauguaaaggaaaaagcaauguuuuuuccuucuugaacaacauaaauuauuccuggccagugauuguuucgaggacuuucugaagaaugucauuuuucacccaacuugaauaagauguuuuuguuacaccagacugugcuuuuucuacuguaccauuaaaaauucuauguuucuaggauauuaauuuugguguuucucagaccuuagcaaaauguauucuaauucuuuccuuuacaauuaucaccuugaccucuuuuuucccacaacagggagauaucuguauacagcucaaaaugcauacacccaagcaugugaaucccacacucuccccauucaugaggccaaauacagcagugagggguuggccucuagccuuggaguuggcagugggaugacagcacccacucuuuuugccccuagcauuacaacuaauugcuucauucccucucucugcacagaaacccugaaaucgugucuccaaugacuucugcucagaggugaaacacagcauucuuuccggcugccuuauacugugcaguguccuggguguggggcaaugaggaagugacuuggguuuucuaguguguaauuuuccucugaaaugcauggaacagcaacaaaacuaccaagauacauugcccagaaugguuucaugguagcacugaaugcauucuaccugucauuaugucaauaaaaaaauuuuuaauaucugcugcuaaaaaauaaccaaaugccaaaaucauguauucucucuaaaacagauuuuuagaaauuuguugaccuccuuucuugaauaaauuauccuuguuaacagcauuuucaguucauuccuaagauguuggauuucaugggucauuaucuaccauauauaugcacauaugugugucucuguauauguacacacacagaaacacacgcacauucucucuguugacuuacagauugcuuacuaaagcugcguaaguuguugacguuaacuacuuuacaaaaaucuuuagaaauguguuucuaaaaaauuaaaagcuggguguggugugucugacagccuguauucccagcacuuugcgagguugagacagguggaucgcuugagcccaggaguucaagaccaaccugggcaacauggcaaaaucuugucucuacaaaaaguacaaaaauuaguccgguguguuugcgugugcucucggucccaacuacuuugaaggcuggggugggagguuugauugagccuaagaggucaaggcugcagugagcugagaucaugccaccacauuccaaucugggugacagagcaagacucugucucaaaaauaaaaaaaaaauaauaaauuaaagagugauuaauucauuauacugcaacaccuggguuuugaaauuauuaauacuuagugggcuguguuacuuuucacagaguauuuucuuaaaauccuuagcacuauugaguuaagggaggaaggaaucucagagcaguucugaauaccaguagguauuucccacuaaauuaauaaaggauuuccuaccuuaccaccacccugcccacauuaaggaaucuuagcucuuucacucugauaauagaaagcagggcuuauugaauuuacuuaaacauuuuuuuuucucuugguaaaagauggccauaccuagucuguaauaauuuaguugaugggccagaaauggcucagaauuucuaauucugucaagucucuguaaaaggacuccaguuuacugccacuacuucacugaaauacuauaaauacuauauuuuuuacuuucccuuguuugcuuuaucuucucagugcguuuccuucauucaccuaaaacaaucugaguauggcuugaaaaacaauaacaacaaaaguuuuuuagagcucuuuuugguucgaaaguggcaaaauaagauuaagauaucaggauaagagcaguaaugggcuccuuuucuggugauguaauuuuuuuuuuucuuuuuacccuuugccuccacacuagaguagcaauuuggccauucacagaauucagacuucagccaaauauuuuacagaauguuaaaaauuagcugguacaacuagaauacacucagcauugggugcaggugggagugaguccuacuuacuauucucccuugaagaauaccugcuucuaacaggaagcauuaccaauaggaguuugcugucuucgugaaaaaaaacaggaggcaugauguaaagguugaggacugcugcacgaaaccauuuuuauuguuuaauauuugcaaguuaguuuuaauguccauaguuuagaugaggacuuuauuucuaaaccauuaagaugaagguaaauaaaauaguaaaaauaagaaagaaaacaaacugaauucuaaggcguuuuaggaaauauuuaaugauaauccaguacaacuggaaaauuguuuuuaucccaugauauuugauuuguguauuugauaaaagaggugggcagauuuuacagagguaauucauuuagaauuuuuuuuuaaacuagaucaguaacuuuuucuucugaugaagcucauuuguuaagaccaucucuuuuuuggaaaaaaacaaaaaaaaauuuuuuuuuaauuccacuguuuccuagguaugugaggugagcauuuggcaagaauaugagacuugaugaauaaaaaauacauuuuauagcuuaacgcacccacagcagcuuucucugugcaaauuauuuucuuuuuuuuucuuugacuuuaaaugaaaggauauaccauuccaacaagcugcaugaauacuagaaucuucauucacuuucaagagaucugaauuaauaccaguguuauuuccuuuggcugaggucugccugcaagaaugcuuguugcacuggaauuuugagaccuuucuuuuauuauguucuguaaaugugauuuccuuuuacugcaugcauuucauucgaggaaaagauaguuuuacauuauuacuuuaauuauuuacuaauuaagccagcuuuuuuccugccuauauuuucuccaaacuccugauuuuuuuuuaauguaaaguaagcagaccuggucuacaucauccagaucaucagucaguagauauuuauuaaaccuaucucauacaugaaggauugugccagguagccuucaguucuuccacggaaaugaugagaaguauaaaguuaauuuaguaucauauaccaaccagcuuuaugguuuaauguacuguaagacuuaauaugcauauaacccauuaauuucaaaccuuuuuuuuuguauucacuggauauaauuuuucuuuuuuuuuucucagcaugguugaauuugaauuuucagcuuguacuugauaugucuuaucagaccagggguauuuauagagaccuucacccaaauagaaaauauagaauuuuugauugaaucugaauaucaauaaacaauaaaugauuuuaaauauaaauauuaccaugcaaauuuaggugagaguccuuuauguuuauuugcuaaaucuggcaagcccauaccuaaaagaaaauccuauucagacucaauuugcauaaauccuaaaucagggcuauuggucauaagcauccuauaaucaaaaagguuuugggccaggcgcgguggcucacgccuguaaucccagcacuuugggaggccgaggcagguggaucaggaggucaggagauugagaccauccuggccaacauggugaaaccccgucucuacuaaaaauacaaaaauuagcugggugugguggugcguaccuguaaucccagcuacucgggaggcugaagcaugagaaucgcuuaaacccaggagguggagguugcagugagccgagauugugccauugcacuccagcauggcgacagagcgagacuccaucucaacaacaacaacaaaaaaagcuguugauuauaucaguccuacauuuagaaucaugagaucucaguauuuuauuuacaaauuccucaaguucguuggaggcaugguaguuuguaaggacuuacaagcaaggcagaucaaaacaaguaauuuuucauuuuguccuaugaaaguucacaugucuuuauuauuugucccagucuauguucuuauaaauugucuaaauaucugugaaagugguuuguucccaacugguaacucucuaauauucucccugacuugaguccaaaaccuagcauaacuaaaguaguccagucuuuuccuugccaaucucuuuucuucccuagucuucucuccuucccacuccgcauagaaauuccuuuaucauaagaauaaagcaugacauuucugugauaucaugcucauucugagugacuccacaacaguguccauaugauaauuuguaaaugugucaagauaaagagaggagacuaaaaaacaacuaaguuucgucugacaaagggagauaauguucccagcaagcucuggcuuggagacuaucccaacgaaaacaacauuuucuuucguagaaauuuuuuuccagagggguguuuaggguuuggugaacaguagcacaggcacuaauuugaguccucaggggaagggaaguacaugcuuagcaguggcaaaguaagaaccagauccuuaggggaaauguuucuagggcuuuguucagaaacacaaggauagaaacacuaucgucuucuucccuuggugcacucguuuggaaaaagcggaagcuggugcaguaucugcuuaaagaauuugucuuucuaguggacuuaguuuuuccagauuguaaaugcugaaacccggcuuugccuagcugcaaaauucucuuuugcucagggaaaacagcuuuuagcugccuccuaguuuuggugaggcagcuggauucuggucucuccaugagcaaaguccuuggacuuuuuucuucguuuuagagagcaaaagcaaggccauuuuccugccuggcacaggaggcuuuuuugggcuugaccugagggcacagugcccucuucugccucucuccuuuacuugcugaucacugcugauaagcucuaaagggaagacauccucauaaaugcaaagguuuggugcuugauuaauggcacuaaguauuuucuuauugugucucugagcagcuuuugauuuguuucucagccugcacacuuuuuggauggugcuuugcacuccuuaaauuuucuuuaaacccagcgcaaacagugccuccccuucaaaguccugggcugucugccuauuagcuccccagauuuucuuuuuuuccuagcuauguuuuauucagauggaacauaaagugaggcuggcaagaccuggccuccaguguagucacugcuggucugcugguaaggaguuucgugggaggguguugagaaugaaacacacagagcuguaucccgcuucgggugaaugaaugggaggcaauauacaaaauagguaagaauguuguucuugaaugagacuguuuacauucacgucgcggcucugucaccuacuguagguagaaucuugccaaguuguauaaucucucuguucugucaucugugaaaugugagugaugauagcuccuagcucauaguguucuucuaagauuaaaugagauaauccagaugccucauacauaguauacacuuaauaaguguuaguugcuguuaucacuaacuuccuauaaaaguaagacuucaacacuguggacaugauagacauguuuuagcaaaguagagugauuaaaaguuggguguggccaggccaguggucaaaucccuucucugccuuuuguuaguaaugccuucucuaagacucaguuauuucaucgagaaauucggauaauaauagcaaugcaucuaaauaacacagauucauuuugagagaggauuacaugaaagaguaggguuagcccaauauucuggcacaacaauuuuaggagcuaguauuguuauugcuaagucaauaaaauaauauuaaacaucaauauuaaugauaauaucuagugucucccuuaagguacgaauguggaauguguugggaugaaacuauuucuccuuccagggaagguuuucuucaguaugcaguugcagaggucaggucaccaguucuuuuggcuguuggaccaaguguuccguaggugaaauuguuuucccaagcaaauccaguauaguuccauaccuuccauuuccccuaaaaugucauuugagcccuuauuugaacacaguaaggaauauuuuacaccaaaagucauuuugagaauugcgccaguuaaaauaaauuauaguaauauuuaccugcuaaaaauccaaaagcuauaaguaggugaauuuuagguaggauuaaggcuacuuuuaccuauuuucacaccugucuuuuugcaugugaagugcuucgaugggcucgccacuuuaucauuuuauugcauuuuauuacaucauaaauuuuuauaucuugcuaacgauccuacaggaagcuuaauuguuuauaggagcaucuuaauuaacuggaguucaccagguuaagcagaacacaaauugaaggguuuauaaaugaaacacacucaacuccucuccuuuuacucaggauaaacuaggagauucggcugggucguaaggaccccauaugccucagcaauaucauguugauccuuucaaccacucuuccuucucuauuaugucauaaauggugacuucuaacuccucuccccucuuuacugaagugugaaauugcuggauaaguacaguauuucaaagauaacucugaauuguauucugggagcccuaaaauguuguuuauacaucccauuucuuaccagguuuugccuuuguagauguuuauauaucuucaaaagguucuugaauuaauuuguuauuaguucgcauauacccaaagaauuguauaagaagugcuuuaaguauuacuuuaaguauuaccacaacuggauagacuuguaaccaguauuuguuaaaaggcccaguagugagauuccucucuucguucagcugcucccugguacccagggagauccccacuuugaccucaugggccucuuugccuucuguacagucaagugacgcuacaaauuuaaaugcaaacccaucuaauugaaaggacagucuugggccuuagauucuacucgccaagaaauguaaaggcaacucuacaccuggcuguccaauaaggaagccacuguuauggcuuugaacacuugaaauguggcuaguccaaauugagaugugauguagguauaaaguguacaccaaauuuuggagcugucaucuuauuuaaaaaaagaauguaaaauagucauuaagaguuguucuuccauauauuuuugauuuaucaugucaaauacguuuuuaaacaucacuuuuuuacuauuuuacuugaaacuagaaaaauuaaaauucuguaucuuggcuugaauuauauuucuuucuuuuucuuuuucuguuuuuuuuuuuuuuuugagacagggucuugcucugucacccagaugcaauggugcaaugucaucucauugcaacuuccccuuccuggguucaagcaauccucccaccucagccuccugaguagcugggaccacaggugugcgcuaccacgcccagcuaauuuuuguauuuuuuguagagauaggguuucgucuuguugcccaggcuggucucaagcuccuagaugcaaaugaucuucccgcacuggcucccaaagcacugagauuacagcugugagccuccgugcccggccauaaauuauauuuccauuagacgugguaaucguaggcucuagguaugagagaauauauuuggagagcuaaagccuagguuaaagugguuugguggcagaguaguuagaauuggugugauaauccuaacacccuaaauccaggcucuugucccuugagucaccacuguaaacucuuucccaguuuuucguacuuugacgcuugcugcacuauugauccuggccaguuuuuccugugccuuguucaucaagaaagugggauucccaccccuuuacuccccucugcaccaccacuccccacccccggagcaauuaagugcucccuucuuuauuuucucaauacacuuugcugagaccagagguuucuggguaauacugauccuuccacuaacuugaaaagcucaggaagggcacuucaccuuugugugcuggaacauacugcagcaucucauguggugcauggaacaaagguuuauugaaacucuaagcuuauggaaaagucucacucagauuccuaauugccauuugcuuuuccagcagccucuucccauuuuaagguauaagcacagcccacaaacaccuugucuuuaugcccauuugugcguuuuucuuuuccaguucucauucuauuuucaccuuugcuguuucccucugucuucagacaacaaaauaagugaaagguaagugggagguuuuagcagcccaaacauccaggaaguaaauuuuagagaaguuaaauuuguuuaaucauuaacagauguugguguuuuuguuuuauucagaagauaagaucuugagugaaauaccuucggcuuuccaguuuuuuuauauuccuuugccugcaaaaaucugaggguaagacauuacccacccgccuccuuuuggcuaaucguguuuuccacuaucaguaaaaauuaaaaaacaaaucaaccucuaacauaaaagaaaacaccuguuuggcuuggagaacuuggcuagggagguguuuuuucugacaugccaaaagcgaccaucacaaggccccuuaaaaaaaaagucauuuuuuuuucuauauuucaugugagcauuggcagaaacucugacaagcaguucuucauauuuuauuauguucuugucugcagaaucugugucaggcaaaaaccuugucagcggaaaaccugucguaggaucagaggagacaaaaacaggugucacacaggcagucaaaacugaaggaaaaaaaagauuaggcuaaagagagagaggcagacaauuacauuaaugccauugcuuuuaucuuauagauguguguuauuaucucggggugcugagugcgcaauugccucaaagaaaaguagacaggagacaaggggaaacuugauaguuauuaacugaagaggcagugugucaaagcuggaugggguucaaaguuuugcaaaggaaaaaaacugcaggcagcaagcaacggcugugugguucugcuuucggcuacauaaaccgaguagcuaucuaacauuuucuacuuggaaacagaucauagaaggaaaaauuaaugaaagauuucauuuggaguucuugggggauaacauuuauccuauauauaugugaaugaaucauauaaccuuuucucucuuacaaaaucuugcuacaaugugagacauggugaggcaugaagacaggcauuugucaguucagcuguguuguuuggauauauuuaaaacaccuauuaucaacacacuuuuaauuaaaaaaagcuauuaagaagcccuuuuacuaagugugaacaucuguaugugcaagcuguaaauuaggagaucacauaugugugccucagucagagacuaaaugaauuuggcaaguguuuucuuuuacugguuuuuaaauacaguaaaauaucucaaggaaaaauugcuacauuuuacaauuuguauugacucuuuugauugugcccguugguacugauuaauugaacuuaucuaauuagaaauuuucuaauuagaaauuaggguuacuaucaugaucaaauuaguaaacagaauucaaagcacuaaccaauauauccccucuguuucuuuauucacauuauuucagaugucacuucuuuucugaaaguuugcgcuccauuaaauaugugugaugguauaaaauacuuucguuuugccaauggucuaaaucccaaaagaguuuuugccuuguugauaacucauacaugucaaacagcccacuaauagagaaugggaugguaacuuuagguuucccuaucugcucaaugauauguugaucacauuaguggaaaaaucggcagauacugcuuuaguucuuaacauuuucuacuugugcauuuaagauuucguuagguuagacuuuuccuaagcccuaggacugcccucuuaacccguuuuuaugaggaaaucuuuacauagggucuuuuuaucccaccgguuacugauacaaagcaguuugauacuugauauaugcauuaagcaaauccagcaguccagaagaaaacacacgucagugccaaaagugugugugauagccuagagauuuuaagggauuacaguggggaaaacagauugauuauagauuuagagugagauuucagccugaauuacugggggaaggaggaaaaauuacuugugacacaaaggugacauucauuuuucuuuuucaagacugaguauaauaauuucuuucuuuuagauauuucccuaccagaugcuggcuuuuuauaccacgacucucaauuuugaaauauuuuuucacaugugauaguuuaaagcauauauuuuaucaaauaguaaauaugccuugccuuugcacuuuuugcuuaaugaaauucuuauauagauauauguuccuuuaagaaaauuaagucuuuaaagugaauaacugggggguagggugauuauuuucuuacagaagaauucguauuuuuguuuaauaaaaggauguacauaguuaauucagguagcaaaucucaauaguuacuuuuaaaaugagauauguuuuauagucaguguacuguguauuaaauccauugguacauaaacuggauaaagcaggguuuguguagccaacuuuaagcuggcugaggcaacuggagauuggauagaacagcaguggcaauaauaauaauucccaaaccugguuucagcaaguagauucaguuacuaaaucucuucuuagaucuacugucaaauuugcagauaaaauuuucucuuugccuguuaccaccuucauguggaguugcugcaaaagagcaaaggcaugcccccaaaagugggccauguaagaaagaagaagcgggagaauaaguauaaccaaggaccuguuuaaucuacuagccaggagagagagcuucugaacaaccgaguggugaaauacuuuuaugugugccucagucagacuuuaaugcuuuucaaagucuguuuugaggacuuuauuaugcguaaggccacagggggaaaugccauucaguuugaaauauuggcuguauagucucgaguggagcucagugucuacccuggacuaauuguggguguuuauauguguauguauauccacauacccugaaagcuacaugucaacugagguugauuaaaauccguaggacaguggggcuuaacuggaacuacuuuugucccucuucccucccuacaguuuggaauuacauucauaauaaaccaugagaguauuuauacauuaucccucauguauuaagagaugagaaaaaaaaucaagggccauucacauaauguauauaagguauaguaauguaaugaggauuuguagagguucaguggaguuuauucauuuuaaaaaacacugacacacuauuuguugaagaaaaaaaaaaaaacccuuuguacauaaggguugacaguuuuuaucaccacacuuggggaucaacucuuuuagcuaaauaccauucguuuucuucuucucuuuaaaaaaaaaaaaaaaacucuagaagcaagccuugguauuaaauauccuaauuaauucaaccuugacaguuacaguuagaaaguugugacuuaaauggaacaugaguuauuuuguacuuaacuugcucccaguuacauaguucuuucccccagaaguagugaauaaaaugugcagaucuaaauauuacuucacgucauaagaaauuuuucucuuaaucacaauuguugccugccuucacgaucuccugauucacuaaaaaguuuuaaugugucaucauugcccuauauuaauguucuccccaaguguuaaggcuuuuauuaggaucuagcuuacaaucuaagaguagacuaagucuuugccuugagcccugaugcuuuugccugguaagagagcugagucuuacaaugggaaaggauugaugugauaaugauuccaaagggccccuuuaugaugaaauucuaaauacgcaaaaucccauuaaaccuguggaagugcaugggcuagguacauugaaaugacauaucauuauauuggguauagugugcuuauuaugaagugugguauaauugaaaauuauuggucguauuagcaaaaaugaagagccaccacccucauaaauucagagguuauggccuggacauuugagauaggagugguaaaaauauucuguuuauaaauaaugaaaacuuuaaaaucugaccccagaaauugcuccaauaaaaaucucaucgcuaacaacuuuuagaacucuuaaaguaaucguggaaagaguuucauaaaaacaaucccuaaagacguguguuaaauguuaaucuauuggaaauucaaauaguagucuaggauccagagcuccuaaaagcugaccacuugaugcuuguaauuuggaauucuaaagggaguugaggcaagagacccagaguucucgaaacaauuagccuuguaauuuaaggcucacuuggcuuucucccaaaauaaaagaauaagccuucuuuuuuaacuuguaaaauuacuucaaauuagcauuaaaaauuuugaaauauccagggcaggacugaaaauuagugaaauaacagguuuccauuuagacccuuuucguacagauuuuuaauuguuuuauucuacaaaguaagugguuuugaaaaaucauuguacuucacauacuucuuaucuuauugaauggcugcuagcuucacacugccaugccugaacagcuagauggacuccacuggaccucaggaccugaaaugagcauauuccuguggaaaccaacugagucacuugaauuugacuuuuaaggaaaguuguguuuaaaaaaaguuguggaaaacuaagaacuauaaacuaucacugagagccaauuuuguaggaucagugaaaagcacuuuuauacucuuacauuaagaaaaaaaaguaucugaauauguucuuauuucugugaccuucacagaaaauauuggaagugaagucuguagaauuacagguuuacauuuauuuuaauuuauuugaagguuugaggagcaauuccuguuauuuaaaauagaaauaaaaaauuguuauucgcauuucaugugauagauguguucuuuuauaacuaccccucacccacccccagcacuauuuuauacauuugaaaacugaauuuuauaaaggacauuacuuuguucuuuaaguuagcaguauaguuaaaaguacauauuacuuuacauuuauuacccauuuugcauuauguuuuaugcucauuuuacauuuauauuacauacauuaaugaagcacagaaaucucagcuguuguccuuauggcaauucuguucccacauaaaugaguuuucuucauucagacucaagugucauuuugggguccuguggcuuagccaccauguuccuuuggaaaacuauagaucuuaucaaaauauuuauugaaauuauauccaggccucaauuucuccuuuguuuuguagccauaaaauugccaguuuaggccucuguuucuagcauuuuaggaaauccaaguaaauuaugucccaucaguaaccucauucacaguuuaaggagcuuguauuguaugaauuuuuuuccuuuuuucuaauaucuuuaucuugcaguuaaagcuuuugcuuuuuccagaugaaauucugcauacuaaaaagagauuaauugacccuuuguuuguuuuuccuccaggucuuuuacaaaagaaaaauaauccugucuuuauagaugcucuucuuacagucuuacugugugacuauucucugacgacuuuccagggucuauacuacaccuuuuucuauagcuauaaggccaucagucuagcguauugaucacaaaucuagugauuugugcuaccauuauggaugauuuucauaaagucuguguauuaugauucagucuguguaccuugcaauuaagauucuuuuucuuaaccauauuagacuucuauccuguuuuucuacuaaaagugcauuguaaucucccaaguaauacuugaccuaguaagaaagaaaauaugccaaguuuacucaggauuccugcuuagcuagcagcgccaccuuacccuccaaauugccuuaauuacccaccuucacuuauucugugagggggugcugucuagaacaaaagaaggguugagaaagggacauggaugaaauuaagaauuugguggcaugguggaaucauacauuuaccccuuccauugaaaauagaauaauggcuuuuuauucuauuauauacacuuaacuguguucauccauccaacaguaugauuacucaacacucuuuagugauuuuguuucagguaugguugcugcucaaaaucaaggucuugagauaaguaggaacauaagugaucccaggaaaugguagaguccauuuccucuuauaugagggagccucucuaggcuacauggaaaaagaaaauagaauauaaaucgaaacgggaaagaaaagguaguuagaggaguuaauaagaaagaagaaagacacuugaacagcguugaaaguaaacguucugagaaaauacagcuuuacggauggaaccucgcuuaucucucuggcgucaucuugguucuucucuuguucauguccuggccgaauuggcuuugccuggaauacccgacucccaccccauugaaauuauguucucaugucacauauccaguuuguaauuuuguguguuaauguguuuguuuauuuguuuguugcuuuuuuuuuuuuugagauggggcucauucuuuugcuuaggcuggagugcaguggcgcaaucuuggcucacugcagccucgaccucccaggcucaagugauccucccaucucagccucccaaggaucugagauuauaggugugcaccacaaugccuggcuaauuuuuguauuuuuuguagagacagggucucaccguguugcuuaggcugaucucaaacucgagcucaagugacccacccaccucagccucccagagugcuggauuacaggcaugagccacugugcccugcaguguaauuuuuaaaagucuguuuucuucacuaguguauuaacuucaagugggcccaaaucauagcuguuuuguucuucacuaaaucucuaaaacuuagcaugggacaggaaauacacauuuagugaccaaauaguaaagugcuaguaauaugugaaggugcugggaaccuuacuuugggcagaucagagggcccaugucagagaguuacuagacuggaaaguaaaucaaucuguccaaggucuucugacccagguuaaggauuuugugugugggugagagagaaguggggcaguuaugugugugaagaggcuggggacgucauuggaaauuuugaacagaggaaagacuaagcaguauuuugagaagauugacuugguuuucuuuagcauauaauaggccagugagaacagagagagaccaaaucaguuaggagcccuuguaguaaugaaguuaugaaggucuaaaagccugcucuaaaaugguauaaauuagacuagaaagaagaaauugauccaggaaaaacugcaauggaagaguuuaaagugauuaaggaugacgaugaccuacggaagcaagggaaaguagucagagauaauuuugaauguucgugcuagauaauguuaagggagacaacaccgccaccaagauagaaacuuuuaucuacaguaugaccucaacuauauaaaguuauguauugaaaaaaguagauguagauacaucuuaacauguggacaaucauuguuuuggguggugggauuauggguaauugucuuuuuguuuuccuuuuucuugaauuuagaacauuuugucaauaagcaccuaugagaaaaugacacacaaagaagucugauuucaaauauuuuggccuaguuucccaguucuaccuuucacagcaaaaggagucaaguauguguuuggaguugagcuugggcagagcgaaauuuaaagguuagggaucaucugcauaguguaggaauaguuggauuccuaggggcaaaugaucacaggugggcagguggagaggcaguuugucuggaaaccugauguuuccucugaaucucguugauuuugccuccagaucuuccaaacuggaaaaucccaaucauuuuguagcugugccucaucuuuacuacaagcaucuguuuuuccuccuacuucuuagcuuggucuugauuuuaugcuuucuucuccuuucuccuuacauuaagauuguagucuucaggucacuggcuugcuuauacuuaaaauaauuuugaaaacuaaggacuacccuaacauucucauaugcugaguuacuuacgaauaucuuacagcaaguaaguggcagagcugggauuagacucuggcccuagagacucugucuuuaaucuggaagacaacgagcaucuuuuaaaaacacuggaaacaugaaauuguugcuuucugucauuauuuuuuaaccuuaacuguuguuuccacuccuuuucccccaaauaacauuaccauaaauguucacuggaaagucuuuuaucacucaacaugcaugccuacaaugaaaauuaauaaaauauuuagaaauagaaauuuuauuuuaaaaacugucaucacagugauaaaauccaagcgauauaaauauuacuaauuuuaacaauuuguuaaacauaaaguggguuuuuguuagaaauguaucugucagugaaguaucugccggugaaauaguugggacuauaaauuuuuuucuucucagauuaguucauguauccauggaugaauaguacuuauuacaaaaaagagaaaagguacacuaucaguucuagucccaauuuucauuucuacagcuguaacugcugagacaucuguucacaugaauacaugggacuaggagguuuguuaccacauugucauucauuucuuagaagucauuucaaguuauaugccaaaaauuacacagcacuugauugguuugcuaaaagcuaagaaauugaaaccauccuacguauuacucagauauuguuauagucauuucuuuuucaauuuauggaaaagggcuuuaagaaauuauaucaaauaaugauuuauaauuuuuuuuuuugguagauacaggguuucgcucuguuggccaggcuggucucgaacucuuggccucaagugaucuguccuccuaggccucccaaagugcuaggauuauaggcaugagcgaccaaguccugcccuauaaauuuaaucguuagucuucaguuuagaggcauguuguuuaucccuguauacccagaaaagauugagaaaauaaaaauacuguauuaguuuuuaauucaaauaacuucugcaauuuuuuuuuaacaaaaugcuuuuaucuuacuguugcagacuuagcuaucuuaauugaugaaaauuuccaccagguagccuaauuugcaaauccaaugauauggucaaaugaucauauuugaucagugggacugacaaauuugacuuaauuuuuauuagaaaaagcugaguucacauuucacuucaaauaaaugcacuuugugaaaacuuauaaaaacauaucaauaaguuauggaaugcaucuuuuaugauacauuacuaaaacaguccagaauaaaauguggugcuaguaaaauuuauuuauucagcuuauaauacacaugcuauuucucuuuacuuaauuaguaauuauguacuauaauauauaacuuauuuaugaaaugagaaguauguuagaagucaugauaucacuuugauaaauacgguuccauguguaucacacaauuuaguguuggacuuuaggaaaaaauuagguaagaguaauauauaaaaauauuuaucaauuuugcuagguaucaugaccaaacuguuuuuauaugcuuaaugaaagaggaacuuacauacuugcuaaaaauuaagugcuuugacauuuggauuauaauuuauucuguuaauuuuauuagcaguauguagaagguauucaaaaucuuuuaagaugaaaaugaugauuaaugguaaauauuuugcuauuauuugauuauguaggcuguaacuaccuuacuaaaugauaaacauaguuucugaaagaaauuagguaacauuucuauccacaccuuuuauucaguguguucuacaaauuuuguagggacaggaaaauauucaaacuaaaauuaaaagagugggcaucacuuacauuugcuuaggggcuuuucuucccaggugaagacgccuccuagggaugaaugaguguugaggauaguugaaaagaauaucuuagcuuugaauaugugggguucgaggagggagaccauuuucauuauuggacacucaugcuuugcucccauaggaugcuuucuaaagagcaauacauuacuaaaauagauaagaauguaagaggagaguucauuaucauugcccauuuuacaugaugucugaauucugaacauuccagcauaguccuaaauccuguaugagaucuagcuacacuuuacucaucuguguauagucagggaaauaugagccuuuauuaauuguuuuuuuuguuuguuuauuuuuugagacagggucucacucuguugcucaggcuggaguguaguggcucagucacggcucacugcagcuucgaccuccgugggcucaagugauccucccaccucagccucccgaguagcugggacuacaggcacgugccaccaugcucagcuaauuuuuguauuuuuuguagagaugggguuucaccacguugcccaggcuggugucgaacuccuaggcucaaacaauccaccuggcucagcuucucaaaagugcuggauuuacaggugugagccaccacagcuggccuauuaauucuuuuaauaaucaaauugugaauuauuuuagcacucagaagaguuuuacacccugggcuaguguaccauauagaauauaagccaaguaucuaccuuuauuuuguaaagaaggaaggguacaauuuucagaagagaaacaagaaugaauucauguacuuggaggcccauucucaaguggaucaguuuuagaguaaauauggaacugcaagaucuggaaauuggguccuuguguuugcauaccucauggaaggccuuuuuauacccugagcuuaggcauacucuacugagaaguccacugaauuaagucaugucccaguggaguaaugcaaaaaugcccugcucucuucacuuggcucuaagccaucccuccccguuucuaucuccaauuuucagugugguaugugagugggggcauaugugucaugaucaucuggggcaauuuucaaaggcuguggguuuuguuuuuuuuuuuuugaggcggaguuucacucuuguugcccaggcggagugcaauagggcagucuuggcucacugccaccucugccucccggguucaagagauucuccuaucucagccuccugaguagcugggauuacaggugcccaccaccaugccuggcuaauuuuuguaguuuuaauagagaugugguuucacuauauucgccaggcuggucacaaacuccugaccucuggugaucccaaagugcugggccucccaaagugcugggauuacaggcaugagccaccaugccuggccacaauuuucaaaguuaaaacaacccucuuacuucugaacuuuccugcguugguugguucuggcucuguggccaagguucauccaguaccuucaccagcuuuuguuccugcuggauaggugucaugucucccaugugacaacuauugcuuuaauuaaauuucugcacucuuaucagaauuuuacaucuaaaacuaaaaaucauuuuuaucuuuuaaucuuuugcuguuuagagaugcggucucauucugucauccacgcuggaguauagugcaggaucauagcucacugcagccuggaacuccugggcucaagugauccuccugucucuguugcuucaaguaacugggacuauaggcuugcucuaccacacuuguccuugccuggcucguuaauuuuuuauuuuuuuuuuguggacaugguuucacuguguuguccaggcagaucuccaauuccuaucuucaagugauccucccaucuuagccucccaaagcauugagauuucaggcauguaccaccacaccuacccauuuuccucuuauaaaauguuuaauacuuuccuaauccuauuaacaagaaauaaaauuauaagcuuuccacaggucuuugccuuuauaaauacagcuccuuacuuacagucugcuaaucugaucuuuuuggacuaauuuccaacuauuuugcugcaaguguuacauucuuuagaugguucccuaacacauacccauuaauucagugauucucagaguaugguccuggccaguagcaucagcaucuucuggagacuuguuagaaaugcagauucuugaugcccagacccagugaaucagaaacucugggggagguggcccagcagucuguuucaacagguccuccacuugauucugaugcacacaaugagugagaaucacugccuuaguuccgucuaccuacaguagucuccuccuccuuucuugccugcugacuuccgaguuaggagacugcauucccggcagcauugcccucucuucugugucccacaguacuuugucaaaucuuuuuuauggcauuuauauugccuacaucugucugcuuuugaagguggaggccacaacauaaauuacuuuugcaucugcauacagcacguaccucagagauaaguuaauaggugcugguggauaaaugaauguaugcaugaaugaaggaggagagcauuuuaggaggaguggugaucaauaaggucagcugcuauggagagacuguggagaauaaugaaggaaaaaagcuauuggauuucacagaaaggcagguguuggugaccuuugaaaugcuugcuucagcagagugaugggcaaguagcccagauugcuggcaguuagggacuuccgacaugaugaggacuugcagguuucauauugacuauuuauucgaacauguggugaaaacagaauuuucuugaaugaaguugcuaagugaccuuaggccaguuaccuaaccugauugagccuauaaucucagaauaagcaauaauaauaauacuguguuuguaugcuuuuuaauugaaggauuaaaugagcuaauagccccuagaacagggauguccaaucuuuuggcuucccugggccacaauggaagaagaauuggcuugggccacacauaaaauacacuaacacacuaacgauagcugauaaacuaaaaauaaauggcaaaaaaaaaucucauuuaagaaaguuuaugaauuuguauugggccgcauucaaagccauccugggccaugguuuggacaaauuugcucuagaaugaugccugauauauaguugauacuuaaaggguuauuuucuuuauacucuuccucaccauuauuuuuccuuauuaaugcuguugaaggcauucgucccucuuuguaaauccguauaagaugugaaauuguuuagaauacucuucauuccauucauugcagaaauugugaauugcauucagccuggaacuaacauacuuuuaguugaacaccgaccacuacuuugaaauuacuuuuuuuuuuuuuuuuuugagacggagucuugcucugucacccaggcuggagugcaguggcacaaucucagcucacugcaaccucugcuucccggguucaagugauucuccugcuucagccuccugaguagaguagcugggacuacaggugcgcgccaccgugccuggacaauuuuuguauuuuuaguagagacgugguuucaccauguuggccagguuggucucgaacuccuaaccucaugauccgcccgccucaaccucccaaagugcugggaugacaggcaugagccaccgcaccugacguugaaauuacuuuuuaaucagcuagaaaaguaccucaaaggguaguuguaauagaacucuuuuaguuccaacuuacagaaugugacuucaaguagacagugagaaaauggcagaggggacagggagagguaguggagggacaaggaaauacagauuuuguuggcucauguaacagaagauuccagggauaguaccagccucaaagcacugccaaaucuucucaaucaaacaauauuaucaguacuagauauuugucagauugucuugcagccuagaucuucuucauaugauuugcauucucaagcauauucauuagguacaaauuuagaggaaagagaagaaauucccaguaguucuaaguaaguuccuggauucaauugcacuguccagacuuaggucacuugccuauucuugaaccaguuguuaugcucagggugcugggagcagacugguuuucuaggccuggcuaaggaguauucaguucuaugaaauacugguauugucugaguaugguggcucaugccuguaaucccaacacuuugggaggccgaggcagguggaucacuugagcccagaaguucgagaccaggcugaacaacauggggaaaccccaucucuacaaaaaaaauacagaaaaauuagcuggguaugguggcaugcaccucuaguccuagcugcuugggagacugagucccaggagauggaggcuguggggagccgcgauccugccacugcacuccaacgugggucauagaguuagaaccugucucaaaaaaaaacaaacaaacaacaacaaaaaaaaaacagaaaagaaagaaauacugguguugaguguaagggacaaguucccaaaaggaaauguagcuucuauuaccagagugaaggggaguggacacaagucaggcaaaaaauugguaucaacucacuauagagaaaagggcuuuucaaacuguacuuaagcaaguacaguucagcccacugagauacuuaagcaaguugaagagaaaaagggaguaauaccugauuggauguucucugacccaugauuacuccagcuucaccuagaacagcuucacuuuuauauauuuuguauaugcaacuucugguuagauugcauuuggaaaugaauuuuuuuuuuuuuuuaaauccugugacagagucucacucugucgcccaggcuagagugcagugguacgaucucagcucacugcaaccuucgccuccuggguucaggugauucucuugccucagccuuccaaguagcugggacuacaggcgugugccaccaugcccggcuuauuuuuguguuuuuaguaaagguggaguuuccccauguuggccagccuggucucaaacuccugaccucggguuauucgcccacugcaaccucccaaagugcugggauuacaggugugagccacggugccuggccugaaaaugaaucuuaacaauaccauugguaugggacacaucagcagaugguuaggcccauaauauauuaaaguaggugacaucuuuucccacuccauccugauaaaugaguucuugaccuaccuuuuccacagcgccauuggccuaacucauauuccuaacccuacaagauccagaccugacuccuccacagucagauaugugaagaucaugaaauuaggcagcagucuaguucucagcuuacagauuuuaugacacuuaaaaaaucaucauguaucauaguuccauggauacuuccccaaaaguugucacaacuuggugacucgauaugaucuaguaauuauaaagcagaaaauuuugauauauucaagaaauuugacagaucauaaucuuugaugauauguuuaugcugaaauuugcaaguuaggcaguuuaauuuuuuuuuuuuuuugaguuagagucucgcucugucgccaggcuggagugcaguggcaugaucuuggcucauuguaaccuccaccucccagguuccagcgauucuccugccucagccuccugaguaacugggacuacaggcgcgcaccaucaugcccagcuaauuuuuguauuuuuaguagaaacaggguuucaccauauuggccagaauggucuugaucucuugaccucaugauccacccgccucagccucccaaagugcugggauuacaggugugagccacugugccuggcccaguuuaauauuuuuuaagucuucaucuauggcucaucuccuagguaacugcuuccuaaaccacacucuuagagcuuuuuugugaucuacuauugacuuccauuaaauaucuaguccgccuuuucaucguccucagggcccaaacaaagcuggugaggugucuguuuguguaaauaaaguuuguuuguuuguuuuuggagacagggucuuacucuucuacccaggcugaagugcaguggcacaaucauugcuccacugcagccuugacccccagggcccaagcaguccucccccaucagccucccaaguagcugggacuacagguaugccugccuaauauuuuauuuuuuuguagagacaggguuucaauguguugccuaagcugaucucaaacucuugggcucaagcaauucuccugccuuggccucccacagcgcugggauuacaggugugagccacugcaccuggccuaaguacaguuuuauuggaacauugacacaccuaauaguuuaagucuuaucuguguauggcugcuuucuugcuauaacaacagaggugaauaggugugaaagagaaugcauaacccacaaaccuaaaauauuuaauaucuggccuuuauagaauaaguuguugaccuuugcucuauauuuaugugguuuauaacaguuuuucuacuuuuuucuuuuuuuuugagacagggucucacucuguugcccaggcuggaguacagugauacaaucauggcucacugcagccuggaucuccccugggcucagauaauccuccuacuccagcaucccgaguagcugggaccacaggugggcgccaccauguccagcuaauuuuuccauuuuuuguagaggugggaguuucaccgcauugcccaggccggucuugaacucuuggcuuaggcaaucugccgucucgccucccaaagugcugggauuacaggugugagccaccuugcccagcuguauucauacuuacuaacauaugguacacuuaugaagaagaaucaacuaguguccuuauaauauccucagucucagguguucucgaaagcauaucuagggaaauauuuuuguucuuucugugcucuuuuaauucucuuuucuucuguacccuuaacaguuuagugcucuucaucuuuaaaacaaccaaccuuggccgggugugguggcucaugccuguaaucccggcacuuugggaggccgaggcggguggaucacgaggucaggagaucgagaccauccuggcuaacauggugaaaccccgucucuaccaaaaauacaaaaaaaaaaauuagucaggcgugguggugggcgccugagucccagcuagucuggaggcugaggcaggagaauggcgugaaacugggaggcggagcuugcagugagccgagaucgcgccacugcccuccagccugggcgacagagcgagacuccgucuuaaaaaauaauacaaaauaaaacaaccaaccuuuuuuaaugagugggagggagagugauugugguuuuuuucaccuacaauuugaacgcauuugcacacacaccugcauguauuuaaugcagacaugcaaggugccaaguacacacacaaaaaucaggauuuugugucauuuuauuuccuuucuacugacuccugucaguuucauauuugcuguugucauagaagucuguuuuguaaagaacuaucugaaacgguugaggagagcugaugaagggaaauggaggaggagcagaucgcccccgaucuggucacuggauucuguuagcagagcagccacucaucagaaggcugaguaguuaagcuguacuugaagaagaacagggauaguaauaccccaucccugcuuuuuugcagucuaaaugcccuguggagugagagaaaacuucaaucccuaggcuugugaagcccuuaucuuucccaaacguuaaauuaauuuuuaaggcuauuuauucaaaguugacuuaaccacuagaauagggaagaucagacaaaucagcugcaagaaaugaaguaugagaaaacccgaacucuuugacaaaguauuccugggaguaaauguguugaaugaagccagcggguaaaugauaagggccuuuacacuguggauguaagaaagcaauuuaucaagaguacaugaacucucuagugaccacaagucaggaggaaaugagaguggaggaggagcccugaaaaaauacauaugaaauacuaaaaaaucugugugcacgcacuuuuaaauuccuccaugauuaugcaguaauauugguguaguaaaauaggaguugcugagaaugcacguguaguguagcccguaccauuagggauaagguguuaggaaaagccgcugagaaaggccacacuguaguuuagaauuugcagaaaccuuagguucauaacuuagguguaguuaugacuugagccuagauguuggcugauacccauuugccugacucaugagguuagaugaccauccuucaggcuuauguguucaucuuguuuaauuccuaaaugggcauaugcauauaauucugacaguuuugaaugccuuuuguguucucuuaaggaguuuagagugccucucacucguuaucucacuaaucuuugcagcaucucuuuaagcccuacagauaagacaguguuauugcuugagaaacugaggcaaaauguaauuauauuaucagcaauagggugugcaguaacucagauauggauggggacuggaauuuaugaccuuauuuuggccuuuaguucuagagaagagauggcguuucuuaaauuugaggagaaaaagcacccaauuguugaacuuuucauuuuauuaaaaguguuuacucugagaauggucauccucagcuuuuucuacugagauaauacaguuagcugaaauacaccagaaauucucaaauguugguuugucauuuguuuccauuuucaucuguacccuuagagcuauuaacaaagugacuuguuauuucuuucuuuuuaaaauuaugacuuuaauuuucuuuuuuauccugaauaacuuucagaaaacaugccaaugaacacaaaagcuaucuaacaggugacuaacgagagaaauugagagaacuaaguuuuuggauaacccccuauagcuaauaugacuugacuuaaauuacuagcccuccacacagaugucagcuuuccuuauucccuccaaauuaggucuuucaccccugucgucuaaagaacacucucuuccuccucuuuaaccauucagguauuauaaggggugaaucuuauucagaaaagugauauucacugagccugcccauauggcaugaguuaggaauuguuuuguuuuguuuuuggugggggguaggggacaccaucgucacucggguugaaacacaguucaguuaacaaaucaaugagguuuuuagcaccagccacggucauuugaaaacccccucagugacucuuuaucugaaaguugaauguguuuucuauuuguuguugccugcaauuuauaaacacauccaauuaaaaaaauaggaaagaaaagggguaaaacagaaaggaggugucagagaacuauuuucuuugcaagaucuugcuuaaacaccuauggcgaacauucauguguagaaauggagcccugguaacuuccagcaauauuucuaacuccuguucucucucuuuaucuuauucccaacacccccaucucuggaacuuuggcgggaccaccacagccuuggauaagcucagcacgcagcaccuguaccaccccacccaaguggagauugugcaguccaacgucguguuugacaucagcagccugaugcucuaugggacacaagcagugccugugcggcuaaagauccugcuggaccgucucuucagcguccugaagcaagaggagguacugcacauacugcacggccuuggcuggacucugcgggacuauguccgaggauacauccuucagguagggagaggacuugaacgccgcccguguccggggccgacuguggguggggaagggugagaguccuugacaaaccucgcaggaagggcugcacacccuccucugguuaaaguggucguuucagcaggcuugucagggaaggggaaaggagagagacaaagcaggccaccaucgggccucaggcuguauuagaaggaaaacuuggccucuugacuugcguuaccuuuguuugcaccuuuuugaauucaacucuuucucuacaucaugggcuuucuggcuucuucaacaagucuuauuauaacccuauuaaaaaggagggcucuuugaggcggguaaugggugugugaaaaucugagauuacccuucauuuggguuuauuagggcuuuuucucauacucaguuugcagguacgguguuuuucuugguugucuuuguaccuaaagguacacauuuuacuauuuauuguuuuuucagccaacucaaagguagaacuauaauccauauaaacuuauauaaccaguaaacccucacaugauagccuucagauuucuaccuucugaaacacacagacaugauuuuagauuucgucuuugcagaaccuguucuuccagccuugagugucuccuuugugucaauggcacuucugaccugguaagggcucuaagaguuuucugggaggcccacagccuucaugcacccccaucucccaucccucucuuucuucaucucauuuuugcaaugugucauguguuauuugcacuguauacuuugccucugaaauguguuuauggcuaucugucuuccuguaacccuugaggggucaauguugagaacagcauuuugggagaucccaggauccaaagaggcuacacuggaugaugaagaaauaccccucucgccgaaggacaucucaauuugagaagguagaaucugaagcaauuuuucaaauuucccaugaggauaauaccaggagacaugaccccuucaaaaacaauugguuuuggcugugccagccuuguauagugcuagacauaucuccacuguuuauucccugagcuacuguguguuacaugaagggcauuagcugccagcuuggcaugugaggaguggggagccucagucuaccucucguuuuaaccuggcaucagaacacacagauucuugucauuuuccugugugguaccuccagcuguuagcugggacaggagagcaguggaaggauagaaaguagaaguagggaaagggaagggaguuggaauaaccugucugcucucagaauagaaugacgucuuaauuuagugagaaucucaacugggaagacacagaaaauuuggcccucaaaagaugagaugauggugauaauaguagcaauuauauauuacguuuucaguuuauacagaauguuuacaagcauuaucucauuugccucaggauggggacauuucaguggguuaaaguaggaagauaagucuuggacggucagggggcaugagggggaacaagaucuaggaggaaggggccaggaaaaauaaaucaggaacugguuucacaaucccugcuuauacuggccccaagaugcauacagugcugcgucuuucuacagucauuucuacagcgugauuauuaaugucuguuuugaauggauuuuacccuacacaaagagaaaaaccucuuacaguuguuuguauggaacuguuagcuuggcuaacaguccuuucuuuauuccaaaccaacaaguguuuugccccaaucugguaccaucuuuauuaccuccacuaugcugcuuauacuucugucauuaauauuguauuucaguuucauguguauguguugccuaagauacuuacaccuguauaccuacgcagagacacaagcauauacauuguaucuuucuguccaaacaaauagguaugugcagggcuauguugguuugccauuuuaacaaagcucagguagcacuuugauaggaguaaacauaaagccugauaauguuucuguguuaugguccuauuguucugccuuggccagugccuguuuuuuauuuuacuugaaauaauuauuuagauguuaguuuuuccccaacuugugaacauaucucuaaugcagguauaaaaaauguaaauguacucuguauuucuuuguaugggagggcccaguauuuagcaggggugucaaaucuuuuggcuuccugggccacauuggaagaagaauuguuuugggccacacauaaaauauacuaacacuaacaauagcugaugagcuuaaaaaaaaacucucauaauguuuuaagaaaguuuacaaauuuguguugggccgcauucagagccuucaugggccacaugcagcccgugggcuguggguuggacaagcuugauuuaaagaaacaaaauugcaagagaaaugaaauuugagaggaaaauucaguaaaaccaggaacuaaaauuuauaaaucucuuauuuuagggugaaauacugcuuauagagagcauuuucauuuauuguaauacuuaaauuauaauuaauuuuuauuauuuuaauauagauuuugacagucucaaauuuaauauaauauuucuccauucagucuaaaauugacauuuugagaaaacgauagaugauuuuuacauuagaggaguucuagguuuaguuucugucuuguuuuauugguagaauugauguaauauagauuuuauuuaaaugaugguuuuugucauucagcauuuauaaucuacuuguucuuuguuaaaacaguucucgguuuggaaaaaaaagcaaauggucccagaacaccaaaacuguuaccacuuuuguagugagaaaaugcuuuguuuuguaaagaaaaaagagagagacuguaaaaguaaacccauucuucuaaaguaauguuacuugauaauuggccaauauuuuaaagauuguaugugguaaugauaaggugugcacaaauuacuuugaauauaauuguauauggcguuuuuguaaaaguaggcuauaaaauguguguccgaaggcuguggaaccccauaaugcucuauuaguguacaagucauuuuaucuggcuaaaacucaauugucuuguagcccucaaggcaucaauuuuagcauuauugcucucaacaacaguauauugaauauuaugucaguuaaaggagaauaauuaucaaggcagguuaggguggcuguuagucuuaccacauauugacuugguuagcaguuggcuacagauuguguuccugggcaaaugaagauguacgguaaguugaacuagucaagccaggauauuaauuuaacucucugugggacaaagccugcauccuuuauguguacacagcuacuccugccuucugagauaccuuuaaauguggaagaaugacaguugucugaucugauuuugaauuuuuggauguagggggaagaggggagcagaacuuucaaaaguaugugguuuaagagguuauuauuagaaaaagggagaugauagugaugcuacagauacauuuaaaaggcuggcacaucggucaaggauccuguacuuuuuuuauaaaguuaauuuucaccuaugugagugucuauauaauucacaagcuagccaguuggguauaaaaugcauaacauaacuuggacuacaacuacuuaagaagucagguaauauauuaagaacccaauauucuccuguguacuuauuaaaguauuuauucagaaaguacagaaaguuagcuuuuaagcauuuuccagaaaaccacaaaaaugggaauaugcaauuagaugauaaaaucuaaauacaagggagaauaugauguuuuucuacuacuaaagaauaauucuggccaggcgugguggcucacgccuguaaucccagcacuuucggaggccaaggcgggcagaucacuugaggucaggaguuugagaccagccuggccaauauggugaaacccugucucuacuaaaauacaaaaauuagccggguaugguggcaugugccuguuaacccagcuacuugggaagcugaggugggagaauuccuugaacccgggaagcagagguugcagugagccaagauuguaccauugcacuccagccugggcauugcagcgagacuccaucucgaaagaaaaaaaaaaaaacgaagaagaagaagaagaagaauucuuaguucaggucuguaucuugugauacauuuauugaccaugaauggaagcaguggcccccucuuuuguccuuuccccauuuuccccucuguccuugaccuaggaaauaagaauacgggugauuaucauuguugaauuuagucauuuaaaaaucaaguuuuuauagucucuuucaguuugaacguauaacugacuugccugggcucauccaccagccugucuguggaaaucuucucauuugcagguggguccugccagaauucagagaagcaguugagacacucugaauauuuagcugagaugucaacagccuuauaagaagagugguauugaugccccucucaacucuucugugucuuaccagcacaauugguacauuagaagagcauuucucaaagacgaauggggccauccgucuuuuagagguccagcuuuagauuugggaguaacuacauacuggaucuuucucuuaaccuucaugauacucauuaguauaacacaggcucugaggaggucuaggguacgagccuguaagaguagggaaguagcuuucuccaacccuucccacuucauaaccucuucccuucaagcucauuugaaguacuuaguucugaacacacucaguucuucucccacaugagcuauuugcauguaagguuucuucugccuggaauaccuuacuugugucucugcguggguaauuucuucucuucuaggcaucagccaaagucucacuuucuuacagaggaccaucuuagccaauguaggucuuuuguaguguagcuauaucuuaggacucuguuuccuucaaacuccuaucacaauuuaaaaucagucaauuaagucaacuguuaaaauguuuauuuuucuggccuccucacuagggaacaacacaaaugcagagcacugaauaaguauuuguuaagugaauggcuagggaaaccuguuuagcuugguauagcuugauguuucaccauggaacucauggaauaaccaguaacuucaguuugucaaaaggcccuuaguuuuuucuccaggcuuccuaaggacugacugcuauagcagcagcugggcuguugagggcaauaagaagaaaaguaaaggcucccaugccuucuagcuagugaucuguguagaguaaguguuuuaugguauccaugugguagaaaacauccauauuaagcaaacacuuguauuuaaacagcucuuugcggagcaaguucauguaaguuaccucuuuuccuccucuuacaccauccucuuauagauguugccaaugaauuaacauuugguauaguugaggcucaaauaagugacuuuccccugaucacagaaguguuaauuggcacaguugauacacuguaagcuuccugaagauaacacaugucucuuauucaucacuguaacucgcuucccagcaccagcacccaggcuuauacauaaaaggguguauuaaauauuggaaggaggauguuuugaaguuugauuugaauucaggucuuugacucuaugggcaauauuuggauguuuguuuuuuguuuuuaaggcuaccagccugucuuuccagaauguaauaugugagagucuguagaugcaguguggcaugauuugggggaagagaagaggccugagucuggaacugacagacuaacuuaagaucucguauauucaguggcacaccaaaugucugaccuuagguaaaauugggugaaauggauuccucuuucguguuccuuuucuugccuauuuccugauacuccauuuuguuaucuuuacuucuauucgcucucauuucugugacuaaaaccagaucugguauuuauccuuaaugcuuuauuguaaauuccggucuuugacuuggccuuuccagggauacauaccuuuuguaguugagcauaaaaacaaagguuuuguaccuaguuaguaagauuucagcuauaccaugugcagggauuggaagagagaugaaguagucuuuccuggguuuauaaaagcauuucaaguuggauggcaaaagggcucuggauauugagacaagauuggguuaaaucuggaagacuuugccauucuuagucauaguuucuuaaucuuuacaauuaagauaacuccccauaccucucuaaaauuaagauaaccuucaugucucuaccuuugagugucuaaaaagaugaaauaauauagaugaaauguauguugugaacuccuucucaauaaauuggcauuuuuucacuuauaucuauguguaaaguuaacucugaguaauuauaacagagaaauaucaguugcuaaacauguuucucuaccaaugccaaauguuuaaaaaaauagggaaugcauuuuaggcguuaguaucaauaagauaaauugcaguuguuuuaguaaguacauccugaaauacuacuaguggcauaacacagcagaaguuucucuuuucucugcaagccuagucuaguggugaaugcuuuccuuccauaagugauuugacaagagguaauuuagggcuauugcuguuuuauggcucugccauuuucucggaucguagauuccucauccagguggcaacccugagagaagaugaagguucucugugggauauuuucauggauguggcucagaaguguaguagggugcuuauucucccaucacugaccagaacugauuuguaaaugaggccaugugacugagaggaggagccaggauguaugggcuuggcagguacucucagggaaaaugaguacaggucugugcuccacucaugugugguggaauagcuauaauuaugccuucuuuuuauagaguuggaccagaaaagcuuaaugcagcagagucaugcagugaaggcagauucaugggcuugcauccuggcuucaggucuuacuagaugugugaaaaaauuaggcccgugucuuuauucaccucaguucacucaccuguaaaacagggauaauaauaguacucauggcuuugaugugaagacaaaguagaaugauucacagaaagcacuuaguaguaccacuugcuaaguauccaggcaaugcuaacuauuaauaugauagugaaaaagaugaugauacagacuguuacagacuacugccaaccugaugauuuuagaacuuuguuucuauaaaguagccuuaaauccuggauuucacuguaccucuuagagaagaaucccuuucuaaccaguagagaaaaagagcagcuacuauuuaauuaucaauaaauaauacauacacauacacacguauauauguauguacauaugaauguacuuggauauaaauaagaggcaggaguaugcaguaacaaagacuuuguacuucagaguuggacagacuugguugugaaucuugguuucacuuuuugguagcucuguuagccagcagagagaacauacuugaacaucaguuucuucaucuauaaagguuaaaucaaagaauauuuuaaaaguauguagugcaauaaccagcccauaguacucuuauuaauauuaacauuacuacauugugaagauguguauuuucaugugugcauuuuuuaaaguaaugguuuauucuuuuuuuuuuuuuuuugagguggagucucacucugucucccaggcuggagugcagugacaugaucucggcucacugcaacccccaucuccuggauucgggugauucuccugccucagccuccuaaauuacaggugucugccagcacaccuagcuaauuuuuguauuuuuaguggagaugggguuuuaccaguguuggccaggcuggucucaaacuccugaccucaagugaaccacucaccucggccucccaaaaugcugggauuacaggcaugagccacugcacccggccaaguaaugguuuauucuauauaugacacugucauuuuuaucaccuuuauauuucccuauuuuaucaacucuuccaauacuuuccaagcucuggcacagaaugaaugauuacuugauauauuuguuuaaaugauuagaguaucuaggauugcaccuuaucgcauaaaauaaaacauuuaaaacagccuuugaaauagguauuaucugaccucacagguuuuuaggaaauuucuggagcagaaagaucaaugaaucuagauauaaauuaauuuagguaauccuucaaauagcaaaaaaaauugauuuauugguauauauugagauaggagaucucucagaaaaccagcacucuaaucggugagcucuaaacaaaugauggaaaguuguauuauauaaacuacaaaaauauucagaucacccagaaaauugacauaaaggggggauuauuugauaccaaguaaagauuggauuaucaacaccaugacauaaggaaggugucgcugcauuaugucaccaauaugugauucuuuuucaggaaagaaggaucacauguaugauuggucaggaucccccugucuuuggcagggauauacaaaaaauagaugauucagagcaguguguuguauuuauagugucuguuuucuaaagugcuuggaccacucuacaaacacuguccuggcaagccuccuaaccucccuauuagagagauaguuucagagacuauuauccuugguuuuaaaguuaccgugauggggaggccucaggcagaggcaaagcuggaaguggaauacagggauuuugaaucccaugccaaagcucuaacuauuugaacggcaaugaaaauaaacaccuuagauccaaggacaaagcuugauguuuugugcucagaguuaaaaugaaaauauuccucccuuuacucuugcaaaauaaaaauauauggcuuaccagauuccaggauggaaugcagugacugccggaauaggauuugcgccugugggacaugaagaggcuuuugcauucccccaggaggagcagaaaugaguccacagcucacuggccagucuccauuugauaagaaucaguucagauuuacuugaaauggacauugucugugauggcacugauuaaaucauaugaucuccugagcagcacucauacauccuucuuguugaauuuaaaguggaaagcucugagcuuuggguuuaaaccuuaauucuagcaccaauuaacucucuagccauacaaaaagcacaaaauuucuaugagccguauuuucuugauggugccuucuuaaaggagcuuucaggaugaagagaaguaauauguuaaauucauaguggagcuuaguaaauuuaauuccugaaguagaaugaucuccuaguccccccaccccaacccuuaaguuucuagagcaacgggagcuuuaugagucuuccaguugcccauacguuuuauuugagcuacuguguccuuuucuaguauuucccccaauuugacagaauagcccaguggaagaugagggggacuuguacaggaaugaaauccucugugacuauaaugaagagucaugagaaaacucucaaggcugagucuuagucuacuaucuguuucuuuugagugacuuacuucaagugcugguguaugaaaucuugaagggcugugaaaaguagaaaaugagauaaggaucuguguggguuucuggaagcuuuugcuaaauucauacagaugggacaaaugcaaauaaagauacauuuauuugauuucuucaugauaccuguauguaaugcugacggaaguguaaaacaaaaugugggccaauacuuugcuaggagaaugagugaccaugcaugguuaggccacaucuaggccugaugaucugaagcucuucuugauuugucugauguuugcauacacuucuuucuuagggaagucacuagugauucugauuguuuacaaacuuggcauuuguugccgauagccuuagauuuuaaagauguggcuaacuagcuagugaugcaugaacaauuguuuuagaaaccuaccauugugguccuguugguaucuaggaaguuuuuucauuuguugguggcaacugagugaucuguuaugucuacuuuuccucucucccuguccccucccccaucuucuucucucucuuuucuuucucucuuuuuuucagucaagguagacuugagauaggggacuugcauggcuauaguagaucauaauacaugaggccccccaaauaagagagugaaacauugucugggauguauuuucugcucgaacucaucgucauuuuucuguguauuucuuacauuagcccccagaaaagcauuuuucaaagacuuugagaaccaaagguucucucuguaaggaaauguguuaaccugauuuccuuguucucauguaauuuucucucuuaaagccauaauaauagugucagaggcagcuuucuaguuagugugaguaaugugguuacuguauuuucuauuuuuauuuuaaugugcuuuuccugcuguggauuuuuuuuucuuucuugauuuuaaaaacagcaguugaguaaaugugguuauuugaagacuggcguauauugcaucuucucugagaugcaauuuugaaggaaggcucugugcacaauaggcauuuuuuuucagauuccuuaguaggauaaauaggagaauguuuggaacacagaucagugacaauauugguuuauggucaugguaggucaggcuuccucagagaaacugacaauagaguaucccauagguuuugucucuagagagucuguuaauaugaagucuguuuauuuuaugauguguugauaagaaaauuagguaaccagggaagcaccuuaaauugcugcauucauuugccucuuuuuaagcaugcacacacauugagaaauuuugaauuaacaacaacaaaauacacuuaaauuccccuggaaagaguaauuaagagcuacuugucucugugcugucaucucugccagaauuagaguuccugcugaguauauuccauugagucagccaucauuccaucaccagcagggauugcuuuucugcuuuuccacguauugacaugugagggaaugucugucuugcaguagccaugggcuugugccagauuuugagauccauagaggcaguucugggagcuuuucaauucugaaucaggguuccaauucauaauagcugagccagggaaaccggguugaaucuguggccaaaaccgugguaaaaaacuuuuucccccuuuccuuucuugcagugcuuuauugcuuuaaaauaugagugccucuguccauugauucucuggugacuuuccguuggauucaaauuguggucucuuaggugaaaaggucaguguguuauucauucagccacacaucgauggagauuaacugagagcaguacaagacauuuggauccugccagaccuagggcaccugaaggaaguuuauuucuuuucucucuagccuuuacuaugccugcugcagaagaggauggcccugucuucugggaguaggggaggguuuugauuggcuguguguuaacugccucaaauccauggccauagggcgaguaagaacccuggagaaucaaacaugucaucuuuguagcaucaccugauuuagugcuuuuccucaggucugagaugucucagggggccuuuuucccuugcagcacugaucuuucaaugaggugcuagugucuguccugagcaauaacaaggaaaaaccaugaagugugaacagcucuuauuagggggguaaaugucauuagcgccuuuguagccuucucugcaaucugaaugcuccugucaaaagagcgacuuacugaagccuccuuuaaaaucacauaaauggaauuuaagaugcugaaguuuuacauuuuaauuaagcaaggccauuaacucccuuuacauauacacuuuuuuguagccaguuaugcuuguaugccuuauaaggcuauugaaaaauuauccacaaaaauuauuuuaaggauuugagaaauaguugguuaacuuuaagucaaaguuuuagauauagagacccuauacucaugugcccaaccauuguaauaugcguauugacguauaugauaggagaaaacacuagcauuuugaguuaauaaguaggucaguuuggauuaauggaaaguuugaagcuuagaguguuuaaauaaugauuuuauucuuuucaauacacaaguggaaauguuucuccagucuaaauucccccuaguauucuccugaaacaaaauuuuuauaugcagauauuugcuucuuuugcaaguuugagaauuucacaguaacuucugguuacccuggguugugucuugcaguuaccaaaaaaaaaaaaaaaaaaaaaaaucacguuaaauaguugcaugguugcgggggucagauacagaaagaaaauugucuuuuuuuuacuaugcauguuaauuuuuaauaaaaaugaauugagacaucugguuaaaacuuugggaggugcaucuagaaaaguuacagguggugaauagaaguuugcuacucauuacugcuaauuuaagauauauaauuugauauauucuguuuauuuaguguguagucuuuaaaauaugauccucuauuccuuuucaaaauuccaauuaggucacagauuuuccuuuccuuuuccuuuccuuugcuuuccuuucccuucccuucccuucccuuccuuuccuuuccuuuccuuuccuuuccuuuccuuuccuuuccuuuccuuuccuuuccuuucuuuuccuuuccuuuccuucccuucccuucccuuucccucuuuuccuuccccuuccuuccuuccucccuuccuuucucccuuccuuccuuccucccucccucccucccucccuucucucucucucucccucccucgcucccucccucccuucucucucucucucccucccucgcucccucccucccuucucugucucucucucucucccccucccccucucucccucucuuccucucucucuccaucccucucucccucuguugcccaggcuggagugcaguggaaugaucuuggcucaguacagccuccaccucccuggcucaagucauccucccaccucagccucccgagcagcugugacuauaggugugugccaccacaccuggcuauuuuuuucacuuuuuaauuuuuuguagaaaugggauuuuaucguauugcccaggcuggucucaaacuccugaccucaagccaucugcccaccuuggccugccaaaguguugggguuagggguuacagacgugagccaacacgcccagucguauuuauuuuuccccacaaauauucuauuuguuuuuuucccccuguuuugaggauucaggaaaauguauuuauucaagagauaacugguauauuacaaguaguaaacagacagacaacaugccccucuguuacagcuuucaauuuaguggaagugguauauuauaagugguaaacacacacacaccaugguauauuacaagugguaaacagacagacaccaugccccucuguuacagcuuucaguuuaguggaaguuggugacucaggcuaaauuaagggaaaggggagaucacuggguauguuuucuaaugaaaacguaaguaugaucuauaauuauugcagucauuaauuauauguaaauagacucuuuggacauacuaccaauuuacuugaaaagucaaugcuuuaaggaauuuuaaacauuuuucaacugucuugguuguauuuuaauaauauuaauucaaacucugcaauuaaaugacugacuaacguaaauuucaaccuggcccccacuuuuugaauuaaaaacauuuauauuaguuucaguuacugagauuuugcuguccauuauggaaaacccacuuauuuauuagauuauagaagguaagcagcaaaagauauauuuccuucccauuccuuaaaauguuucgacaaguuaaugaaaacuuauuuuaaaauuuccuuuuagugagaaaucaaagaugaucauuuuuagccccaucaggaucauuuuagaaaaacugccugugaagucacucauuuagaacgagacgaucucuguggaauugcuguugccagugccacguggggaguaauugggccaauuaaaauguagauguuuuauauuaaguuguggugccuguuaaaguagaguaccagauuuagaauuagucuguauucccuuuguuaguuuccuucacucaguacauagaauuuuaguucaucugauagcuugacugauaaguaauauauguauauaauuaagaaggugauagucuagugccaguagguucuucugaaaagcaguguccaauugguaggacagugagaagaaccuucaggcaguaccaucugcuuugucuucucuuuccucuguucuaccuuacaccuggauccaggcuguuaauauaaauuaugauugcuaagguucauauuuuaggauaacuuugacaaagagacgucuggaguaucaaaauuaucaaagauguaaacuucuucauaaauguuuuucaaggcaccagauggaaggaagcuuuacuguauuacauuucccauauggaaaaguaucugggaccugaaaggggcacacccuuagaaggagaacacuucuuaaaaaggaacuuuauaaaagaaugcuauaguauaggguuuucacguaugauuuauucacuugagcauauugcuuugaaggcccaaacagcauccugagcauaaguugugguuuccuagaccuaaggagugucugauaguuuaaauuucacaaacuuuuuagauuugccuaugccacaggucaaauaugccuugcuaugagucugguugccauuuauuuuagucaagguuuggcuuuuguuaaaauuguugcauuggguuuaugaaagauacaucuaccuucuccuacauguguuauuuuauauuaauagaaagucaagaugguagaauuuaaauaccauugugguggaaaagguaagcauuauuuuucuacaguguucuuucuuucauuuuugauauauauauuuugugaucauuuucacuugguaaauauuacauaacuauugaggagggcuugggaggauaugugguucuuuuuuuguuguccacuuuuuuuuacagcaauaauauuucuaaaagaguaauaugugguuuuuaagaauacuuuuaaaagauuuuucaaauaauacuauaguguuucgagugcgauucaaggaaaccguauguacucaugcauuucauaacaccagacuuuuacaguguacaucaaaagauaguccuaaagagguguauucacuuugaaaugacauucagaaaauuaaagcauauuuuccugcagaauaaauguauaaaugguauagacaucuucuauccaggguaguugaaaaaccuaaauaauuauguuaaaucuggagcuucuagacauguuucaggaauauuuuucugcuuaggaugagcucuacaauaugccauauaauuuucacuuuauaggguuuaugagcaggauaguagugagauuuauagaugcuaauauguuaguaacauuucaaauauuuaguuuugauaaaaguaauauacuaaauggaaggaauugccucuauauagccgaacuaaccuugaggagcauacaguucaugaguaaaacaaacagguaauaaaaacugcuuuuguuuauagaaauuugguuuaggacagaaacuaaaauuuggcuuagauaauguucccauaauuuucucuuauuuccuuccaaaauauaucuuuggaagaaagagcaaaaauacgaagauucaucugaaagauuauuauauuuucucuuuucauuuaaaguacauuauuagcuugaguuagaauucuaugaaauauuuaugggauauauauacaaagcuuuauuuaauguuacaguuauuguagacagggcuuaaauacaagacugaaggagaaggggaauuuuuuuucuccaugucaaacaggcuguccaauuuaugaaaagaaagggaaaaaaauaaaaacaaaaggcuguguuuuugugagucuuaaauugugaggcuagaaauacauuuagauagaauaaaaacucacauaccucagcuuauuagugauugacuuuugagaccuucuacagaaaagaauuuugcugaacuucacaacaagaaagaccacauaggguauuuuagaccacuuuuauuaaauuuaguuagcauuuuuaauuuuuccacaauguugcaugccuuuaacaaaguccauucugaaauauagaauugucuauaaaagauuuggaugagguauagaaagguauacaagaaccagagcaccaagggcguuuauuauuaguuuaaagaguuucauuucacugaaagcugauuuuuuuuuaaagugaguaaagcauauauuaguauauuaauagugguuuaaauucccagcauuuuauuauuuuucacaagucugugggucagcugggcauaucugcagugagcuggcauguugaccugggguugguuggucuaggauggcccauuuacauaucuggcuauuagguuguuacuggcuguugguuggggcaguggagauaacugggcaauuuaucaugcguccuucagcagguuaauuugggcuuguucaccugcagauaguuguaggguucuuaagggcagcaggagagggcaaguccaagugugcaggcacuucuaaagugucuacuugcuucauauuugcuagcaugccaucagccaaagccagucacauuacaaagcccagagcugcaguggcagaugacuacuccaggacauggauaccaaagacaugagcaauuuggggaccaguacuguaaucuuuacucaccugauuuagugucuuaggaagcuucauuugguagugguaucuauguggaacuaaggaguccugagccaggaugucuggcuugaaagcugucacuguaguucaagcagacauaaggcuggcauuuaagaguaauggcagggaggauaaacagcaggguuagauacaacuacuugcugacuagaugcacuagaugagggagaaaaaaaggugcucauagguugauuccaggcuucaagauuggguauaugggaaucuaggaaacugguaagguuguagaccuaacuauguuuauagugaacauaggacauucaugcaacuuccuaaacaauuucuauuccucuguccagaaguauuaauaugaaagagauggaaucuaugaaauuccuuuuuugaaacuguugcuuaaaaauuacgccagugcuuucuuuaccaucagccuugcaaagauguguaaaugacaccaaguguuuucucccaucuuuuaaaaacauaugggcaacguugccauaaacaauaaacccaaaaguuuggauuuccuaguuucauuucucugaacugagcagcuaccuaggauuuuuggaaacuuaguuuuauaggugaugaagauuauuuuuauauguagaaaugucaauugugacaaaaguuaaaaauuuggaaaucauuuuauuaucuacagaucuacagaaaaaaauaggcagauuuuucuuuccaccuagauuuaauuuuaagaauaugaauauuugauucauccacauuuucaucuuaacagauacugcuacauguuuaaccaaaagauuaggauuuuugaaugguuugcuauuuaguuacguuucagagccaaaguauaaaaguuuugauuuuuucugccauuuacuuugucaucuagguuaaacuccuccaaacugugaauguuuuuuaaagaaaucauaucuagguuauuuaugaaaauauacaaaagccaucuuccugcugaguaaauagaaaacuaguuuguucaugguuucucuguacuucuuauagauggguggagaaucauuuuuuuguuaaagaguauaccuaccuacaaaagacgauaaagagagauacuuggggagaaagcaacuuagugcauuauuuguuuccagaagacaaacaugcaauuuauaauuuaaauuaagaucaggguacauaaacuauuaaguaugauaaaugacaauguauuucaauuuuauauuaugucaguuuagagagacggauuaagggaaaggguaaugaaggaggaagagagacacagauuuuuagaaaugauuuucucaugauuuuuuaugaugugguuuugcaaccaugguacaaaucagaauuagguugcacaguuagauguccauuccugcauuacuauugugugauucucuccuucacgggcagucuuauuuacuguaaaacuaaaacagggagacuuccacaauguuagaucgaggaagaaaaccauaauugauaaugguaagaaagcuuaacagugccaaaacuaguaauccucaaaauugcaucuucuaauaucacaucuagagcucuuugcauugaguaauauuucucuuuaaaucauaacaguaguaauucauucaggauaggacuauuuuaaaaagcacuuacaccauuauugguuuagcugauggucacaaagucuaccaguguuagguagacguggauguuuuuaaaaacgaauuuuagaagucagacguuuuuuguaguuacauugaaaucugcuguauuacuacuaagaaugauugucuuaaaaguugauuuuuagauuauguuucucucuaauaaaauucacuucuauaaaauuuugccugcugcuauaggaagaccuauaaaaacauacauuuuaacucagaaauauuuuuccugccuaauuaucuccuuguuggcauuugcuauuuaguuacauugugcuuccuuuuuauaugugauuuacaaauagcaguaauguugaaaaauguaauguuuguuuuaaguuuauaaacgacagauugaaguaaugaguuuguggauguaccaugaaauacaaauaggcagauuuuucuuccuaccuagguuuaguuuuaaaaauaugaauauuugauucauccucauuuucaucuuaacagauacugccacauguuuaaccaaaaguaacuuaucccuaaauuuuucuuacauuuuaauaucuauaagcugucuuauuuuuauuggcuuugauucagaauuauuucucuuuuaugcuuuauuccuuauuuguauuuuuaucauagaucaaaugacaguuuucaacaacacacagauuuguaauggcuagaaucucauuuacuaauuuauuauaaaaacagaauaaucuaggcauuaaaaaccugugugccugauacuuaaucuuuguguuuguuuccagaggcaugcaggguguuuccuguccaagacacaaaccauauauuucauuugucauaucuaauguuuuucauauccagaaaucaugcuccauguuauguuuuacaagacuucauaaaaauaagugauccaaauaaaauuuauaguuaauuuuucugucauagcaaaauuaucucuuucucuucuuuuucccacaaggguacagaugggauuauaaaguuuaaaugaguguauauuuacaaauaaagucuuaaguuuugaaacuagacaguaauuuauuauuuagacauugcuagcguuguguugguagcauuacaauagcuuucuaaaugaaaacaaaccaagcaaccagccaacccugauuugcaaguguuugcugauuucucuggugaaaauaucccaugauggcugauuucagccugucaacaugagucacugaacauggaguugggaagagaugcuuagucacacauuauuauaugguauuuccaccauaccagacguaaguagaagcaaguaaucuucagagcacagauaauaguaaaauguagucaaauaauuauaagaacauagauaauaguaaaaugucaaauaauuagaagugaugaauuuugaguaccuauuaucauuguuuuuaauuuuuuucauugcauguuucuaaaauuuaauuuuuaaugucgucuguuugaaccaccaacucccaaaauuuccgaauguuuagcaaucagcucucauaggcuggcaugagccagcccuagcacacuacugcacaaaaccauuucuggugaauaggaagauagguuguggucagugucuauuguaggagaggaugucuugugucugcgugcccagggaggaaaagcagccauuuucuguuucagcucacauuacuaaacaccaccuggucccauaaauuuugguauuuauauuaauauaaggccuugaaugagagcaaaauaccagagucuuuuaauaaaaggacagggaaaauaaauauuuucauuacaaagauuacaaaaauaaagauuuucauugcaaaauuauucuuauuuuuuuuuuucuguaugucucuuggcuguuguauaucucccacuugaauaauaagcagauccuauagucagugcuuccuaaugccacuccaguaucaaggauaagcuacuuaaauaguuuuacucaacaggauauauugauaauuuauguguuaacagaaaguaguagcuguguuguuaccaaaaaaaaaagaacuuaaaucuuuaaaaauuuaauaugcguuagcaacugagauaacgaaaugaacaguguggaguuaaagaaucucaugcaacaaauggcagaauuuuaagugcauuuugucaaacuuccccauuuaagaagagggugagcuccuuccuauauuacuauuggcagcuuaucggugguguuagucaagcauuuugaauaaaauaauauguuaaaaaauauaauugauuucuuugggggaauacaggagaucucuagauaaauucauuuagauggguugacaaaacuaauggugugcaugauuaagaagaaaaauuugacauauucuguguauaacccuuugaguauuaauucugaccagaucacacuguaaauaauguuaacugucauaaaauaaacacagccggaguuugcaccauauguuuuauaauuauuuugcagcuucuuuuuuuuuguuuguuuguuuuuacugaaaauggaaccuacugauaacucugugaaguuauguuuacauaaaaguaaauuauacuugcacguuaacaaacuuggcuucacagaccagugucucuagguuuuuguuuaaaaaaaaaauuaaaugaaagaaaaacuucucccucucucgcuugguuuuuuguuuuuuuuuuucuuauucccucagaaacaucgucucaaacagaaaucugcuguagcaucuugucgccgcuuucuuguuuuugcacaugugaaggagaagccuuuggaaugccacccagaggagggaaaagccuaaccacugaacucacagagaguguuugguuuaaguagcccuggaguggccuuucagacugaggcuacuguggucuucuaguuuguuuuuguuuucuaccuucuuccuugcaaguguuuaacacugccagaaauaaaggcucccuuagaacauuuaaguaauuuuuaaaacuguuauuauuuucauaaucaccaucuccucuugaucucaggggaggcuaggcauccuuguuuaucuuuaauagagccuuggaaacugauagugccaaugggagguggguggcaaguuucguaauaugccuaccuccuccugcccccucccggcucauugcuaaauaugucucuuggcagaucugacaauauccauaauuaucaggcaccgugagcccugcugcagagcugcuugugcaugacaccuguccagcucaugcucuuccccugcaucuccucaugccucggcuugcuggcuggccgugcgucagagcaacagucugccguuagugaacucauuucucuucuugucagauucucagacaccagaaguucugcccacacagcuuacaacauauaccaugguuuguggugcaaucuuucacacaguaggcauuucauaaacuuuugugaacaaaugcaaaaaguuaaugcagauauuucucucagcauuaugguuuacauucucccucuaugaagugcuuuucccgcucuugacagauuucucagcauaauaucauguuuuccauaaaaguggaucuugaucaucgcccucucuccuagacagagaaaagccuugucaguuuuuuuaugagagagaaaauccagggaaccccaauuggcuuucauagugcuuagcaauucucaugaagggggugaaauguggaguagagaaauguacagugauuucuggaacuuuuguuccagaagauguuaauaaggugaaguuguuguuaacuaaauuuugcagguauaauaaaacuugaagaugaagcuauauucagggagaaaaucugcaaagagaggaauuucguaaagggcagggugaacaguaaugccgcuucaguaguucaugccugugcauagucaaccuuagaaaggcuuuuuuaaaaaaaaaaacaaaaaacaaaaaacacuucacuuuuuuggccaggugcgguggcucaugcacuuugggaggccgaaguaggcagaccacuugaagucagcaguucaagaccagacuggccaacaugaugaaagugaaaccccaucucuacuaaaaauacaaaaauuagcugggcauggugguccguaccuguaaucccagcuacucagaagcugaggcagaagaaucgguugagccugggaggcagagguuguggugagccgcgaucaugccacugcucuccagccuggacaacagagugagacuccaucucauaaauaaauaaaaaauaaaacuaaaaccucaguuuugaaggagaggucauagauuucgguuuggggauuuauuuaguggaacaguugucagguauucauagaagguuggauuaaggaugaaacuuuucauccuuagaaacuacagcagucuauuuaaugaauagcauacucaaaaauuaugacuuaauauuuuuauuauuuauaaaauuuuauuccacuagaacaacuaguaaucaucaucuauuaugcaguuuugacuaaacccuuuuuccacaacagggaccagaauuagguaagaaaauuugggaagaugucaaaauauaucaaagcuuccuuuuaaauauguguuauugguuuuugauuaugaaaguaauacaaaauuaauauaaaauugaaacauugcaguaauguauaaugcaaaaaugaaaacuguccauagccccuuuuuguagagauaacacuucuccauauguuaucauuaucauguaucuguggcacuaauuaugauuauuaguaaauggauucauucuauguauauuuuucuuauauccuacuguuuaaaaaauauaucuugugguugaccaaaaaauaucuacccacuuccacucaaaauauccaugucaaaucccuggagccugugaaugguaccuuauuuggaaaaaaggguuuuugcagaugugauuaagucaaggauuuuaagauaaggagauaaucucggacucuguggguaggcccuaacuaccauccuguguauccguguaagauauuaggagauuacauacagagcagaagacauaugcaaaggaggaggugagguaaagauggcggcagagccuccggaagcuaggagagaggcaugcaacagauuauuucccagagccucugaguggaacacagcccuacucacaccucaauugcaaacuucuggccucuggaacagagagagaauauguuuccauuguuauaagccacuacggugguaguaauuugguguggcagcccuaggaaacuaauacaggccucuuuccacguuaguauagagagaucucauccauuuuuugaaccuccauauaauuucccauuauguggauauaccauaauuuauuuagucacuuauuuaaagacaguuggguuguuuucaguguuugggcuuuucaaacacuguuguaggaaauauccuuauauguguuuauuacuguguauguuuguuuuuguagaauaaauauuuagaaguagaauugccaggucauuauguagguacuucuaaaacuauuguauuuuggguaaauaugacaucugccacuuugauaggaauauuuaugcuacucuaucaugacucuggaccauaaacaaaguagauaacuauagaaaccaucucauauauuaacauuuagaaaaucaacaguggaaguuguuccucucaacucaguguucugaaaagccugaaagcucaauauauacugaguugaaaaucuaugagaauaaauauccucaacaaguuuuuguauuuucguuucucuaggaacugaaaauuucugugacauaccuauuguuuucccaccaugaaacaagagcuguuaaagagaugacaagaaaaaauaagagaaaaaguuauauucaagaacuauugucauuuuagaaaauaagucauauauuauuaauggaguuuguuaguaacaauuaucuuaaguaauaauuauucaaaauuguaaagaccaaaccucuaucguuucuuugucaugauuuuucuucucauuuugucauucuaaccccacagcucuucaaucuuuccucacuuccaaguccauuuuacuguugauaauacaagaugcauuuggcaucuguucuguuguuaaagcccucaggaaaaauuauaaagcuguucuugcaaauucaucauuauuguuaagaaccguaauuuaccucaugguuaucucauccuuuuuccaccucuuaccugagcuccaggaugacauugccuuccugggugaggcagcguugcagcaucucaucucucccaccuuaauuuguagcgaugcguugcauuugggugacaggcaguuguucgugcuugaauaacucaggauuugaauucuacaguuuguggcauccguguaaugcuuagcaguagguacagcuguuaacuauucgcuuauaaauaaucuuuuuugccucucaaccugucucccagguaguguaccugucaccauuaauaacucuuuagccgcucccuagugauuugaccuaucaguugucguucacagaaaaguggugcucuggccugcuauugaagcuuaugcagguucuuucagcuccucagucaccccagcagccauauacuuguaggaaguuguguuggugggcuucacaagcaggcagcugaacacuucguacaguuugauaaagguggcauuacauuuugaacaauagaugauaagacucccauuuagaccgcaaaacagugccacagggguagacaggggucugggggagauaagauggguggugaagaugaccaacagcaaauaaacuuuccugucucuuugaugcuaauuaucucuuugcaccuaauuaucauggcaucaucaucauccucugauguuugcaaacuaagaguugauguguuugaucagguuagugaaucugucagguauggcauucugccuguuucugaagcuuaagaaugagaagccaguagcuaucaugcggaagaugugaacugccccccaguccuuguccuuuagcagugugucauuccucuguuuggacaugugcucucuugcuuccucucuuccucucucuguuccugaagugugcugcuuccaacacuuccccaaauuaauuccuaccugcauuuaggucucaaccuagccaucacuuuuucaggaaacugcuacugcucucucuauuuggcauugacuguaccaacuaaaaugcccauauggcaguuuucguuuauuucuuauuaugcucuacaauaacugcuuguuuacuugucuuuuucuccuacuggauuguaaguuuuuucauggaugguacauaguguuguuugcuauauccacguucugggagugucauagaaucucaauaaauuuaugugaagagaaugagaauuuauuuuuuaugaacucacuuuccauugacauaucauggucauaucaauggggaguucaggcaauaaauuauggcauauauugucuacuguauacugugcuggcaccagggguucagauaggaaaacauuucgauugcuuuuuacccuuuuagugagugacuaauggacauuucuuugucugaggauauaucuuggcaguacaggauuucuucagacguggcucaggaaauggccgagaguaaggugaaucacaaggcaaaaaaaaaaaaaaaaaaaaaaaaaagcauuaaacuauguugggaaguaaucccagcauugguggacacacauuauguuuuuaaaaauaaauccuccaaggagguaaaucaguuagguauuauguugguuugguuuucauuuggaaaggaauuuaccucguaaacgaucuuuguuauccuuaucucacuggguguaaggaguuagcaaaugaucacauuuuuaauacccagaaaaauaccauauucuuugccacacagauguacgcauaugccacauauacauacauauauguguauguauguguuccuuuauauauaauuaaauacaacagugaucugaaaagaccaaaaagaguaagaaacuuagcauuuuagggagaacaaaaacaaaaacccaggaugaagcauuuuaguuuaccuuuauaaagaucaggacagguuaugucuguaggaacuuauauacaguaucuaguagauagaaugauaaaauaagaaacaaaaaguauuuagucauaaguucaaggauagacucuugauugugcuguaucaaauacacuuuuaaaguuaaaauguauucuaaaaaggaauacaugccuuuagcaaaaaaaaauuauauaaaggacugugguugaaaguaagugauauugggguauaguucuagaaauagucugugcauguaaaacacaacauaucuuucuguguguuugauaaaaauggugaaggggaauauagugagcacauuauucugcacuuuuccuuuuucacuuaauaauauaucuuguaaacaacuucauaucagcacauaaagagcuaccucauucuuuuuuaacagcugcauuguauggauguaucguaauuugugugccuauuccuucauacacugguagacuaggugaugaaacauauuuuugaucuuugguauucugguuguugauaggggauaaaugguaguacauugcuuuuauuugcauuucucuuaaugaguaagguuuaccauccuuuuaugauuaucagucauuucuguuuccauuuuuuuucuaaacgucuuuucagguucuuucuauauuucuauugcguuguaaauccguuucauuuuuagcaccuuuuuguaucuaaagaguauuagcccauaguauaucuguauugugaauaguuguucauaguugguuuucagcucuuuaccuuguuuuugcuuuugcuuuucauuuguuuuuguugcguaguugguuuucuuuuuuuaaguuuugugugguuuuauuaccuuuugauugacuuuugauucuugagucuggcuuagaaagaucuucaaguccuuaaaacaaugugaacuaguuaauguuaucuaguuaucaauguuaucuacuaguauuuuauguaguaauuguauucagugaauuucaaucuccuucccccccccucccccacuccgggucucugucugucacccagcuggagugcaguggcgcuaucacagcucacugcagcuuugaccuuucaggcucaagugauccucccaccuuagccuucugaguggcuaggacugcagguggugccaccacacccagcuaauuuuuguauuuuuuguagagacagggucaaacuauguugcccaggcuggucuugaacuccuggccucaaaugaucuuccugccuuggccucccaaagugcugggauugcuggcaugagccacugcaucuggccugaauuucagucuuacugaauaaaauuuuucagccaggauuguuauuuucuuaagguaauaaauguuguuguauagagcuuauuauuaauaagauuuuucauucaucuauuuuuucuuccacuguauuguuauuuuaaugacauuuauuuacacagaguauguuaaacauguucaguagauuauuauacauaggaacaucagaguccuauuuagcaaauagacuaauuuaagcuccuaauauuuuuagguauaauccugaauguguauuuagaauaagaaaucaccccccaaaaaaaaacaggaaauggaaacaggaaucaaggagauuugggcccuuuccuucuaaauuuccuuagggaacuugucagaagugcuuaccuagaaaucuugccuguuugcacucuggcgucuccuuaccaccuaggauguucucuuacucugaaacuccuaacgaccuaggcaaaugagagaccugagcugaagccccauucacucucagguuaaaucuggugucuacuaguagcucauacuguacuucauuacaguuucaucagucauuaacacugguagcaguuucaaaggggucacagucaacucuguugcuacugguuuccuugucauuuuauuuaacuuuuuugucuuuauuauaauucgcuucuuuuaccaugcaugguguucucaccccaagugcucauuagguaguaaagaggaaaagguggagauugaagaagcagcuuauuucacagcauaaucucauauggugguguuuuguuuuuuugggugaagcuaaaaucuguuagaguuguaaaauagaacaguuauuaaaauauucuuuuuugagauggaauuguuguccaggcuggagugcaguagcacaaucucagcucacugcaaucucugccuccuggacgaucucaguucacugcaaucucugccuccuggguucaagcgauucuccugccucagccucccaaguagcugggauuacaggcgucugccaccaugccuggcuaauuuuuuguauuuuuaguagagacaggguuucaccauguuggccaggcuggucucgaacuauugaccucaggugauccgcccgccucggccucugguguugggauuauaggugugagccaccgcgcugggccaaaagauucuuuuaaucuuuuuuuguauucuuuuuccagaaaguuuauaccuuucuucucuuuagucauacuuugaagaggguuuaacaagauucaccuucacaguuguuuuucaaggcagcguuaggaccugacauuaauuguuuuuuuuuguuuuguuuuuuuuuuuuguuuugagacggggucuugcuauuucguccaggcuggagugcaguggcgcuaucucggcucacugcaagcuccgccucccggguucaugccauucuccugccuuagccucccaaguagcugggaccacaggcgccugccacccugcccggcuaauuuuuuguguuuuuaguagagacaggguuucaucguguuagccaggauggucuccaucuccugacuucaugauccacccaccucggccucccaaagugcugggauuacaggugugagccaccgcguccggccaguuguuuuauuuuaaaaacccuuuccguguuauguuugugaacagagccauuuucauugauaccgcuuugaaaacacacgaauagacacugaaacucgauaccuguguuuucucucaccaguucugcuuccauguuucauuuucacuguucucagucuucugauugagugaauaauuaaaugaugaccugagagauuggugggagugaacucuuggagcauccagcuuucuuuaugaggcuuagacuggcuuuucuuucccaucaugguuuuaggcuugauagaugacuuuauacuuuucuggacagcuggggguuaaaacagaguggugguuuugauuuuuggcauuuuucagcugcuccucaggagaauauaaagugccuguggagcagguccaaaucgguggauguuuaagagaagggggaaaaaauagcugaagaacauucuucugugacuuaguugccuucuguugcauuaaauggauggaaagggggaauaaguguugugcuuuaucguuuuuaacauuaaaacucuuuuaaaaagcuucaaaccuuaaaaaacacgaaaugaccuucaggccucuuggcucccacuguucagguuaucaagucucagucacacccucccccaucccuguaaaaaaucuaaagagaagugugaaaagcaucagaaagucuccuuuugccaguucagccuuuuagucgcuugccagcaccuucaucucuucauaugucucuagcuaaggucuuacauggaacaaaaacccgacagcaauggagaccagaugccgguauuucuucucugucacuuggcugcugagcagauggaauuuauaucaaucgggcaugcuaggaggaagaggccguggcagccaacauguggaacuggggcugagugacauuucugcuaauguuuuguccuuguagaacauuaugcuuccucuuugcuuaugagcugugguuuuccugacucagacuagguuccagcuccagcuggaauggcuguugcucuuccccucuccuccugccccccuuuucagggagugcugggagcuaaggaggaguaguggggccugcacaauggagcucuuuauuaaaauaccugacaucugcaugcaaugcaccaaaaucaucucagcucaagcagaggaaugugcugggcauuacuagucacuuuuugucuagugcugugugcuuguuugauuuauauaaugagugagugccucuggcaaaagaggauguugagcauauuauuggaggaagggagcuuuuuaauuuuuuccaagaacauugucacagacaggccuaauacucauacaaaaauaugaguauuuaaaaacgguugcagcuaucccauggauuucuugcuguggcuuaaaaaauguuacaccccccucugcuccauuuaagguaaaauuagaacucaguaauccaauuuaacaugauauggaguuuuaauguuggugacuacuguuaguaggaaguagcacuuuuaaggaaucucacguuacaaagaaucucuggaaggaaaacguaaaauacaugucaaaaaaccauaaaggcacacacauagaaagaauuauuggugagucuuuaauucccguccccucccucagaagaguacauuacucuuuucauacugcaggaaauagguauaugugcgcaaauuauauuuucuucucuaaugauguaaaccauucacguuuuaccuauuuauggccaguauaugacgaauacugccaugcuaacacguuauaucauaaagcacugaagugucaugacauugcugcucacauugccaaaucagcaacauuguccccauucccacuuagaccuuuuauuuccgguggaaauuuaacuuaagauuucaguuggguuguggguacauucggagcaccagacaggggagguagagggagauagagcuuccacuauuuuuguuccuuucuuuugaaaagcagccucuggcagaccuuuccuggucucuuccaaauaugucggccacaucugucauaucuugaguuuucuagaaaacucccagggcaggcuagccauucuuuaucuuuaagaagccuaaauucugucucuuuaucacuuuuuuaagugauucuccugucugauguauguuccucuuauaucuugcuccaugguguggggauggccccacaguucccuugggauugaaguaaacccauguaaauugaugagaagcuggaguaaaauacuaauauuaguaugucuggagaaagacccaagucagucauucuuggaggaaauucuucaaaauugccuuggauuucuguuuuucuuugcaauuuuuuuaaagcuaugcuugugccauacugaagacaggauuucuuauuuauaaagucauucaaguggccugauauaagaaacuuauaguaacacaacauauaugcccauagcuuaugcagguacaguggaaccuggaaucacaaaguacaguuacuccuuacugugugaacuugagcucucuguacucaggaaugauauggauucagauaaauuacuuagauugggcugcugggaugaaaggagucucccuuggucuacacucucuuaugugcuguucagagaauguccuaucucuugcucuccaacucuugcuaucuaugcuaucauugucuaaacacaggaagaagacagauuuagguagugaaaaaugucugugcaugcaacuaccugcaauauugcagaggaauaggaaucucaugcucuccauucagauuguucuuacaccaguuccuuuccuucucgauuuuguacuuaaccauuccugcuuuucuuuuugaaucuuuggcuucuuucuuguucaagguuuucucucuugcuucucucccuuucccucaaaaucacucacauaaugaagcacugaccuucgauguuuccuuuucugugacccuuaugacaagaaugcuucaagcuggaagagcccaagugucggguugguguucagcagugugagaugauuguuuuacucuugccugagagucccaucaagaagcacgggaaagguuuccucguaggccuccuggaacuacugugcgugugcauuuagcuggaagagaagggagcagacaucauccugcagaagucagauuaugguagccaaaaugugucgguaucugcccauuagaguuucucaagaaggauucuuaaagauaauuugauuugguccuuggauucugggccuugccauguuuggucccaggaacuauggcacuggucccugccagugucuguugacugucucguggguauggucaucuguccuccacuggaacauaacuccuuuaguucuaccuggaaggaggccaaacacagucuuugguguuguuucaaagucugauucuuucucuugccaguuguaugacuugagcaaauuacuuaaccuccaugaaccucacuuuucucuucugugaaauagaaaugauaaugucuaccuuacaggguuguagaaaaaacuggagaaaaugguaguuaagugcuuaguaccuaaugagaacuccacaaguagcagcuauuuuuguugucauugucugcuaacagcauggcagccuuggacagccuuuccgucuaaccucauguuucacuugaucagcagcagccccaggucuaacuagugugcugccuuugaaguccacccacugccacuagggcucauucgccacuacaaaaugagaaacucucccagaagugaggguugucucuaccuguccaaaggaacacaucucuacauccgaagagguuaucuccuaaaucugcuaagguugauuugagauaaaagcuccaauuccuaucuuuugggacuuuacguuagaauuuucagaauccuugucucuggcccuugauccauucaacuagggcuacuccucuuuccagcucuagacaaaauuucuucuguaagaaucacccccucauaccuaucccuccccucuauugcuaauggaaugcacugggauuuaucaugcaaaugaaggucacaccucccagagacacagucccuagacacuacuggguuauauuuuaaugacagcugagaagguagggccaguaaaggaggcauucaucccuguuuaaaagaaaacgaagcacagugcuuaccucugucucuuucuaaaaauuaaucugacaauucuggcaagcacaccuucucuucucagcauagagacaugcugauaacacacuugcuuuuuguuuguuuguuugacucaccaaacuauaugauaaagacauuuguuuucugguuuuauuaaaauaugacuuuagggccgggcucaguggcucacgccuguaaucccugcacuuggggaggccgaggcagguggauugccugaggucaggagaucgggaccagccugaccaacaugaugaaacccugucccuaccaaaaauacaaacauuagccaggcaugguggugggcaccuguagucccagcuacucaggaggcugaggcaggagaaucacgugaacccgggagacagagguugcagugagccaagacggugcuacugcacuccagcaagacucugucucaaaaacaaaacaaaaaacaaaaaacaaacaaacaacaacaacaacaacaaaaaauauauauauauaugacuuuugcaccuguacaucccaaaucucauguaacagagacuuuaguagaauaugauuaauaauaguaaggugggggcauuugcccuuuauaccuaaaaggcauguuuucuauuuuuauuuuauuauuauuauuuuuaaagauaugguuucgcccuauuacacuggcuggagugcaguggaguacucaguacagccuugaccuccuggguuuuugcaauccucccaccucagccuacugaguagcugggaccacaggugcacaccgccaugcccagcuaauuuuguauuuuuuauguuuaauagagacagggucucccuauguugcccaggcuggucuugaacuccugggcuaagugauccucccgccuuggccucccaaaguacuaggauuacaugcaugagcaaccacguucagccauauuuuuaaauuuaauuuucauuauuauauuuuuauaaauaauucaagcuacaccgaaguauauauaauagaaaaugaauacacacaucuauugucccuucuuuccagauuucacucucaagaugcaacugguaggcccaauaaccagucuguguuccuucgagaccaguaaguuuuaagggauuugguagaaacccuggcaugagauauuugugccaaguaccauuucggauugguuuacacaucugaaguauggcugagaauucugcaauuaucuaguauauuaaucaucuuagaaaacucaggacccuaugacuuguccacccugcuuuagaaauaaaaauguauaugguuacauggaaccuacaauuuacuguguuuauauaaacaccccaggcauauuuccuuucaaaaaugaaaugaaugauaugauuuuuuugucuccuuuaagcuuuggaggaaggaaguaaacuaaugaacuuuaugcucuuguaaauguaaugcuuugcaucauaggacaccaggucagguuuguacauuuacuuaaguuugugugcacuuguguacguguguguguguuugcaauuaauuugucagguaaauuacagcauauaggaauuacccucccacugccccuucuuucuggcaagcaauacuguuuaaaacacauacucaugaucagaauugggcuaaaacauuuuguagagcuuuauuuauuuaaugagauaccacuaaagccuuaauacuguaaggcaaauauugcagugaaugccaguauuucaguauauaguagcauauccuugccuuucagucuguuaagauugacuaacauuuaauuaccuugccuauguuaaaaaaggaaagaaauuaccuuauagggauaugcaagcuccugagguuucucagcugugagcccagccaaguugcccuccuccaacuggcuacuucccuccucaacacacagaaccuuauacacaacaguaaauaacccucaauaaauuugaaucuuaucucaaucuaaagacaccaccaucauuaugggggaauguuguuaguccucaaaaccucagucaguuuagaacaacacagcaguauccaaacuuuuuggcuucgucuggauauuguuacugcaaguguuggugcugcauuccuggaugccguuuacagagugauuucuuaaacauugguugugucacagugcaacugaccaguuuaaagccuuuugcuauuuugcucacaaucaaagaaaccagaaacaucuaauuaacguuuaccucauuuagaguuagaaucaccugauuauuuuacuacauuuggaauaagcauaagagaugcuuuuaauacgacaaauuuuaaaacuaucuggauuaaaacaccuuuuuauucacuuuuuuauuaagauaaaacuauaaauuaauaauuagucuccuauuagucuuaagagauuuuucaaaugacuuuggauuuuaagaugaaaaaagaaaaaaaaagaagcacacauuuaacugaguuuguuuugugugcuuguuuguauauuuagacuguguguacuagaaagaacccgcuuugggauagaaauaaagacucuuugaguucucacccuguauuggggggguuucuggguaccuauguauguaauuuggacauugaugauacauaagugauauuuaucucaguugguauagaaggucucaugaguuaucuugacagcugcauaacuguuauccacuguaaacucgcuucuuuagguuagugugguuaguuuuuuuuuuuuuaaguuuccgcauaaucauuggggaaucuuagcauuuaacuugcaaacgcuucucagaguucugauaccugaggcggcaucacaagaacguuaucuacaccagccccaucuugguaggacugaaaaaaaacaaacaaaccaagaacaacacaaagaaaaugcauguuaauguggcugaauauucauuagaacccugcggccuggggcuggaagcacaguuaggcuguguguuuaccaggccacccgaaaggcaagagggcauaaggcacuuagaaacaguggcucagcucaagcaguguugucuuugaaaaguuuucauuuucccuugaaucagcuacagucucuuacuuaaggucacugcaguuugcaaucuuuggcagaagacuucuuccuuuuaugguaguggcagucugacuuuuuuuuuuuucccuuuuggaaguguuuuccucucaaacugccauuaucuuccaaaccuguuucauguuacaauugucagaugccucuuuucugaauuucuuagaacauaaugcaaugagauguauauauauauauaucuuuuuuuuagcauggaauugaaagucauaugguuaugauuugagaaugucaagcuugauuuuuuuuuucagagguuuuuuuuaaauuuuuuuuuuuuuucaaauuguaccuuuuucucugggcagugaacucacugcagagacaucaaagagaauguguacuggaucaaggugauuuuuuuucgaccacaucauugccagcugugguguuuaugauuagagacagacguuccagacaccuccgaguccucacuaagcgucagaucuuuaacgggauccaucccaacugagugacacuaaacagacagccagaggggaguuggugggauagaacagggaagagggcgggugagggugagggaggcuuuggugccgggugcauucaccagccaagcuccgcuaaugccaggcugcaggcugcccagaggccccguagcauuccuuucagcacagcuuucauuagccaaggggaugacuggagcccagcaaacacagucauugauccucuucucaccgggcgcagggaugcaguguucaggucacagcccagucggcuuugaagcggcuccauuucagacacugacagccacagacuauuggcuucuuggagcugacaugauucccucucggaucuccaugcucugcuccaugcagcuaaugauguugaauucccucuggauguugcuuccacuugcaauauuaacacuuguucagugguccuauugaugcaagaauuauguaaauagccaacaguacugauagcugugcauuaaagggaguucucuuuccucccgucuguucccuucugggucaguguaacugccagacaguuuugcugguuccagaaaccagaauauauaucuggaaucaguaaucaauguggugguuuggaguucaauaauuggaauuuuuaaaaucaagaugaucugcuuauccagugauugccauuagcaaugaagaaagaaaugguuuuguugacaacuacuuauuucucucuccaugugaaaguguuuuuuuguuuguuuguuuguuuuucaauucugucaucaucgagacguggaucccuugcuaacaacaguuccuggugacuauagaaauuaagacuccuuagaagaaaaauguuauuauuacaauucaaaaaagaaacaaaugugcucaccuguuggugggaggacaacugaaauuugcaugucaacuguaaacaucugaaagauaaauaagagaggaaagaaaguuuaugauacagauaacagauugcuaguacagagcugcuuuuucagaaccucuccuuuauuaccaguauuuuuccccccuuuuuaaaaaaaaaucuaaacaauuagaugucagcauugggugaaaaacacauaacaaaagauucuggcuuuugcucaucauucugaucucccugcucugcauacugaagccccacuuccuuuuguuguccucccaguggaauuucagccacucagaccagucagggguguguuggcagcuauccucuuugaaugguagagaguacauuuauucuuugcacagaaggaacaugaaaauuugguuugaaaccuaguaacucucaggcugcauggucuggagacaauagaaguauuucaucccuugaaaccagacgaaucuugaguaaucaggugaaccugccuugcuggcugguggugcuucacugaaggguuggaccaggguguagaaaggacuuuggugguucagauuuccacuggaaaacugugacauccugccaucucagagaagaaaguugcaggagauagccacacguauaggugauuccugcuuaucuggcuaauaauauucuugcuaauauuuuugaaaagaaauuaguuuugggccuucacggaagcuaacauuuaaucucauagggcauaaacacgagcguaggguggaauaacagccuaauguuuugaaccccaugaauuugcuaauccauaggaaguuccauuaagaaacucccuaguucaucauucauaguauuucaccuguagcucuaauccccaggcccaugacugcccuucucucuucugaguugugugucagucuucaaccuacgguccuucccgacuauggacucauguacaacucugaaugaaacuagcaucuuucaaagaagagucuaguuuucuuccugguccuguaccccucuguguuucguuguacuagagaaauuucuuauuuauuaagaaccuuuucggccuggcgcgguggcucaugccugugaucccagcacuugggaggccgaggcgggaggaucacgaggucaggaaaucgagaccauccuggcuaauauggugaaacccgucuccacuaaaaauacaaaaaauuagcggggcaugguggcaggcaccuguagccccagcuacucgggaggcugaggcaggagaauggugugaacccaggaggcagagcuugcagugagccgagaucgugccacugcacuccagccugggcaacagagcgagacucugucucaaaaaaaaaaaaaaaaaaaaaaaaagaaccuuuucucaugucuuagacccgugucuucauaaaagcuauuuacuuuaauaaaguuuucacauuuugaggggaaaauaguaauaaauaacauucuauaccuuucauuugcaugaacacuuuauuucauuauuauguuuuucuuuucuuuucuuuuuuauuucauuugagacagagucucauucugucacccaggcuggagugcacuggugugaucucagcucccugcaaccucugcagguucaagcgauucucaugucucagccucccaaguagcugggauuacaaacaugcgccaaaauacccagcuaauuuuucuauuuuuaguggagacggguuucaccauguuggccaggcuggucucgaaauccuggccucaagugaucuuccccccucagccucccaaaguguuuggauuucaggcaugagccaccacgcccagccauaucucauuauuuuuuaaaaguuuauuuuguaugaagaaaguuaugcuuuaugccagugcuacccuucuccaguaaaacaacuaauugaugguugagaugauuguuuuauuugaugaaaaaugauacuuuuauaucaaaaagauucuuacuaguuuuuuauagaaaccccuuaaaacaucaaaguuuuauaguguacauaaaagauguguuuguccacauacuaaccucgcaaauaaauguauaaaguaaaacaacaaaguaguuuuauuagaugugccuuugucaucaugcaacaaguuaguucaguugguuguuuauuuaauuacauugugcucagguucuauuugugugugugugugugugugugcgcguguguuaccuuuauuggucuuuaggacugcugugugucagcauuaucccauuuuacagguuaugccacggaggcagaaacaagcucucaucaguuugauugugaguuauuggcuugaggauuauuaugacucaugauauuuuaguguccucaguaacaauaacuuuuuaaauugcucagaauuuuauuuaccacauguugaaauagcaugauuuuuaaaaguacucaguccuucuauuugacagaauagaauaauuucaucaguaauuugaugaucaaacacccuuuuaaggauuucauuuccucaucacuucaaggaaagaaaaaauauuaauauugaggaggguaaugcgugugaagcuuucuucaaauuauguuuguguguauucacauguguauacaauagauuaauagguaaaauagaucaauagauuaaucgcuugauucaaacaaauaaaaguagguuucacauaaauuuuugauucuguuguauauauuugcauuaguauuauaaguaucauaaugagauuuuuacggagagcacuuuugauggaauuuuaaaugaauguuuuaauguauuauuggcuggcacagacacacaaguacacaaauccuuuagugugauggccuugugcuuguuuuggugaaauaguauuacuucuaugauacaugaaaaaauaccuuugcuuacuuuaucggcaaaaggucuuuauucuucugccccuggaguuagguuaagaguauauuuauuagccaggugcagugugucucacgccuguaaucucagcacuuuggggggcugaggcccauggauuccuugagcucagaaguucaagaccugccugggcaacacagcgaaaccccgucucuacaaaaaaauacaaaaauuagccaggcaugguggcuuacaccuauagucccagcuacuugggagaaugagguaggaggaucacuugagccugggagguugagacugcagugagcuauguuugagccacugcaguccagccugggugacaaagcaagacccugccucaaaaaaaaaaaaaaaaaaaaaaaaaguaaauuuauugccaggcaugguggcucauggcugugaucccagugcuuugggaaaacgaggugggacaaucccuugaguccagaaguucaagaccagccuggguaacauagcaagacccuuucuuuacaaaaaaauuuaaaaaccagccagacauggugucaggugccuguagucucaccuacucaggaggcugagguggaaggauccugugagcccaggaguuugaggcuguagugagguaugaucgcaccacugcacuccagccugggugacagaacaagaccuguuucuuaaaaaaaaaaaaaaaaaaaaaguaaguuuagugaucuccauuagcuuuucugagaaagauuucauauuaaacaaaagcuaaguggcuauuccaaguuuugccuauccuucucucugccuuuuguggaacaaauguguguuuccugacagccuucagguauauguguaggucugaaaaaguauuucaaugagaauugcauauugaggucaucuggaaggaaauguaauauuuugcccauguaaaaucucgcaaucauuacucagauuaaagacaaagugaagccagcuagcucaguuaaauuuucaguucccucacuuuagcaccaaauaccacccuggcagugaaucaccugagaauuucauccaucacucagugauaaaauuugauaacauuuguaggucaauuuauuccccuggaauuuccucuacaccuucccuauccugucaugugccauaguuugaggaagaggaaaugauucaaaaaucuguaaaggcuuaucuguugauuucugaccuaggaaaaagaaauuaaccaaguuuuaggucuuguauuugaagagcuggugcaaauauauacagcauguagcuaugucgggacuuggugaauuucccugacuuuguagauuauacaccaaauguaaggguaagcgaaagaagaaagaguacgugaaaggaggucagauaccucuguguuuccugccuuuuuauauccuaauuuuauuacagaggggcguuaaguggaucuccuugcuuucuuuucaugacgaaguaggagacuuuccuuuugguagcuauugugcaccucuaggaaaaucagcaacucagcagaaaggaaaccaggaugcaggccuagcaggaggcuguccacccagugaggaaguuggacauuuucucuuuuguagagaugacugaugaucuguggaaaaagaacagugggcacugaggccagcuucucuaagacagcuugagugaauguguggcuagcgcuuccuugauuaacagaggucucccugaccguggcaauguguuaugacucauagccuugcagagaugaauuguuccugaacgguuucuccaacaucugagauacaaacaggucuuuuagccauuugcuagacaccagaagaaaaaauggucuaaccaguguaagaccuggaaacagccuagaaucuucaaaaauacuugcacucaaagucaccuuaauuuuagaacccaaaaucuggacagagaaccaugucagcuaaccauuacaguugaaaguucauccaggugaccucuguuucuuagaaauguacaaacaaccucuacauauuucuucuuuaguaguuaaaugacuuuauaacuuggagcuuuggagauucuuuuuaaaauagcaaguaauacugcuuucuuuggccagauaacaauuuuccugcuuuccugaauagaaauuugacagguuuuggaaccuuauacuuugguauggaacugaauagaucuuugaagccuucagaauuacuuuuacccagguuaguaacuuugacuuacucucaguuuaaacuguuccuuuugcuauccugguuuucuguaacugggauggauaugcacagaggagucgguuguuucuuaauacuguuuuagaaaaccuugugacgugguauggauucccaguaugucugauaccaauguuacuagugaaauuggcugaguaacuuaugugugcaagguccuuacucccaacaguuagagacauuuauguguuuccuguccucgaggacuguagacaacagcugccuugcaugaaaugauuguaguacauuuaccaacauuuauaugccaauaaguagaaauguauauguuagaauuugaggauuuaaguguugaggugaucuguaagagaagauaccagagccagguggcuuucuuugacagcuuccuggagaaggugagacuugugccuagauaucaaaguugcugaagaugaaguggacauuuggggugaguuuaagaugugcaaaacauuggcugaacaugguggcuuacgguuguaaucucaaugcuuugggaggcugagggaaggaguuugaggccaggaguucaagaccagccugggcaacauaguaagacucugucuuuacuaaaaauaauaauaauuaaaaaaacagccaggugugauagcauguacuuguagucccagcuacuugggaggcugaggcaggaggauugcuugggcucagaaguucgagguuacaaugagcuaauugugccacugcaccccagccucggugacagagcaagacaauguccuaaaaagaaaaaaaaaaaaagaugugcaaaacauacacagaggagggaaagaguagagaaguagacugauuugugggcagaaggcagaauauccuggauagaagaaaagcagauaguugaaaaauuaacuuugugggggcuagcauaguguaugaaaauuuggauuugggccucugggcauaaagagccaagaaccaauaagaauuuugaccugcguggaacaauaggaugaaaauuucaugaccaaagaauucuggccauaauaaauucaggugugaagaaauuagaagaauuuucuucagauauucaagccaacauguacaugccagaaauacaacagaauggauaguggcuugaacgucuuguagggagagaaucaacaagaauuaugauguuuuuuuacugagcauuaauagugagagaucgaaggacugugucucuuuuguugcuuuguauuauuaauugcaagauguuggugauacagucuacccaaguauguggcaagaauucuacauaccaaaaccuguuuaagaguugacugauguguuggaaauguccgcgaugaucaaguccaagaugucuuugaccagaaguccugaggaccuauggagcagaauaaguaagucuccuuuuaggguuuauagcagaaucuuaaaauuuguuaguguguugaauuauggacaaagaagcaaugcggaccuuuguugcaguacuuaaacuuuauaugcuguuguuaccuguuuuaucucucucacuagacuucaaauuccuuguggcagagaaaguauuucuugcuuaucuucuuauacucugugccuaguaaaaugcuugauaggucaucaauacucaaugacuaaaauuuucuguaauuugcauucucauugguagugaaguauuauaauaaugaacgauuguuauguacuguuccauuuaacucuauuuuggaauguucucaauaguuuggccgcuuuaagcaagugggagaauauucucaauuauauuuggguuuguacuagugcuauguguaauuaagguucauuuauuuauuacuaaguguuuauuauggaccuacuauaugagcaaguuguugaauggaagcguagaagaaggaaauaggccaggcgcgguggcucgcaccuguaaucccagcacuuugggaagccaaggcaggcggaucacaaggucaggaguucaagaccaaccuggccaacauaaugaaacccugucucuacuaaaaauacaaaaauuagccaggcaugguggugcgugccuguagucccagcuacucaggaggcugaggcaggagaaucgcuugaacccgggagguggagguugcaguaagcugaaauugugucacugcacuccagcuugggcaacagagugagacuucgucucaaaaaaccaaaggaaaaaaaugagcuaggugugggggcaugcgccuguagccucagcuacuugggaggcugaggcaggagaaucguuugaacccaggaggcguaggcugagccaagaucaagccacugcacuccacacuccgguaugggcgacagaacgagacuccgucucaaaaaaaaaaaaaaaaaaaaaaaaagcaaauggacacacugcccucaaaaggcuuguagacaagggagaaagaugagauuucucuauuaauaacugcacuguuugguagaaaauacuauguacaauaugagaugucuagauauaaagugcuguagaaguuuuugaaaguaggaaagguuccuuuuauuccagaaggucaggcgggccuuauagagaaguguaggcugggcuugguggcucaugccuguaaucccagcccuuugggaggcugaggugggcagaucacugaggucaggaguucaagaccagccuggucaauguggugugaaaccuugucucuuacuaaaaauacaaaaauuagccgagugugguggcaugugccuguaauccuagcuacucgggaggcugaggcaggagcaucacuugaacccaggaggcagaggaggcagugagcccagauugcaccacugcacuccagccugggugacaagagcaaaacuccaaacaaacaaacaaacaaaaaaaaccaaacaaacagccuggccaacauggugaaaccccgucucaacuaaaaauacaaaaauuagcugggugugguggcgggugacuguaaucccagcuacucgggaggcugaggcaggagaaucguuugaagcaaggagguggagguugcagugagcugagauugcaccauugcauuccaagccugggcgacaaggugagauuccgucaaaaaaaaaaaaaaaaaaaaaaaaaaaaaaagaggagagagagagagagaaguguacuuuaucugauccaguaaggguagauaaaauuucaacuugccagaugacacagggucagaaaaucaugagaccuauuuaggaaacagcagauaauuucacuuaagcgugggauuaagaagagucacaggaaagaagcuaguuauauccaggacuuuccuugacaaauaaugguugucuuccugaaggucuuuugaggucucauccagagccgaguggguggccuucgucuacucucacauaaguauuuuugugacuuuucuaaaaacuuguuaugccuguaaaaaguuuguggaacucaguauuuuuuuuaaccuacacuugaccauuaaaaagguaaaaacuuuucuacaauuuccauccaaguuuuaaugggaaaaguuugcgauagauuuuuaaaagcuuucauggcccagugucugugccaguuucgucaacuggcuuuucagaguccacuucuuacuaagucuuuggacuaaaagugaaaagagcuuccagaaagcuacaauuaugcuuuuuauuugaggaaguguuucugguugcuguacuccagaauuuuugaaagagauuguaaaugugguuaaugcgacuuuguguaccugugacuguccuacaaaugugcuaaaaugagacucuggccuuacagcuucagaaacugacuuguucugcuugggguguuaauauuauuacgaaugcuaacaugaaauucaaaucaccugauugaaguucuuagcacugugauuaauggaugaauuuaggagagggaacuauauaugauuuuuuuuugucuuuaacuguuacugauaaggacucagaaucuuucugauucucuuuuaaaaaguuuucucuguaaacuuaaagcacuauuuucuuuuagaacagcuuuaguguuucaagcuuaaaaucuucucucuuuaaauccuggcugcauauuuggcucucucccuccaggcagaguuuucuccagaccuugguuggcucugaaucccaagaguuaagacagccuagcuucuauaaaucaggagacagcuucauuaucaaaguuauguguuuucaccuucauagauagccagucuuaguguuggugccuggcccugccuuaucguguaaccaucagcacugcauacuggaauguucuuuguuucgauuauuuacuccuucuauaaacaaagauuagagcaaaaaaugucaguacugggccccaagcaguggugacuguuacuggaaaauugcaguggcauggugugggaugugauuugcuacucaggcaggauagcacugacuugacaguuauaauuauuucugaguucugugcugcaucucuuuuauacauuuuaucucauuuauacauuuuaucucauuuaucuucccagaagauagguucuguucuuuccauuuuacagaugagggaaacaaggcucagaaaaguuagcaguauugccucaacuuacguugugaguggcagauaguuguguuucaaaccuggacaguugacuucauagucuucucuuuuaccuacuacaugauaaagaaauuccaaagaugacacuguuuaaaauaauguuaccuagaauuugagcuucuuguaaccauuacauggucccacaguuuugugggguuuuuuguuuuuuaagagaugaggucuugcuguguugcccaugcuggaguggaguggcuguucacaggugcggucauggcacacugcaaccucgaacagcuggccucaagugauccugccgccucagcuuccucaguagcugggacuauaggcauguccuacugugccuggcugguuccacaguucuaauuuguuagcgcaggaugagaacacauuuuuaguauugaaauuuuuauuuauuuauuucuaguuuuuuacagaagaucuagagauaauggaauuuaucaaaucuugacugaucuccaguauuuggagggucuguaucuuucuugcagcuuucagggucuacuuuauuuaagaguuuacauuuuaaucugaauucagggaaaaagcaaaguuauuaaccagucuauuuugggagucaguaugucacagagguucaugaagcaucuuguaucauuuggaauagauauaauugugagagaggaagacaauuauuucagaauauguggacuuggauucuggaauacauguauuaauacauguauucauucuggaauacauguauuaauacauguauucauucuggaauacauguauuauuccaaacuuuaagaaguuugauucucaguaaaugguaugacuaacuacuuuuuuuggaacaugauuacuuaucuuuauaagcauuuucacauacaguguaggaaaauaauccuuauuucgcagaugaggaaacuaugacuuagauaaaugggugcuguugcuaagaugacaucuaguaggugcaggugauguguuuuugcuuaaauuugccauauggauuccgacuugccuguaggugcuggguauguuuauaagaucagaguauauucauuucuugacuagaauaaguauguuuucugauucacuacaagguuauuuuucuuacugaacuauaauuccuggauaaaaccucuugaacuuaauaacuaucaccauaaauauguuuaauggguuuauuggcauguugaaaaguguauuguguuggcacaugaagaggcccacauaauugcuaaauaaugguccuuaagguauuuauaaagguguuauugauuuguaguuuguauauccauauauauuuauaacauucuggugacaaagaaaaacuugaguaaacauugucaugucuguggauaucagugauaguaaaaaguugagauaugccuuauuuagguccacucuuccagauuaucauuaaucagauuuuuuugagagacugcuugaccccauuuuccuauuucuugaauuuguccuaucaccauaugauuagagaccuaguucucaacgagugacuguauuuccugauguugacugaaacaugaauguccucuccccuuuccucacugccuuugggcccauguauuuuguauuuuugauuuagaaaaaaaaauucuuagggaaacaaaaaugaguaaaaaaaaaguuagauggauugugagggcaugaauuagaguaggcacaggauuguuaauuugucuccuucugcacauccgugguauaguguuuggagcuuggcccaggaagaaugauauucugcuuuguuuuuugacccucaaaauauccucguucuuggcuauacccagaguuccuuagaaaugauguuuguuguaacguuuugggacaaaauugugggagggggcuggaggagggugguaaaccauauauauuacacuuuaaaaauguuuuuccucuuauauucuuuucuguuuuucuuucaaauacucucuguagcaaacugugcgcaauuucucuucuucaugugaaaauuuaucucagggcaagagacaauucauuuaacugucaugaauucauuuaacuuccaugugcuuuuggaaagucuugguacgcuuucauugauugaguuacaaucccauaaaucuaggguagauuagaauacgcuuguuguagcucuuccuuuagguacuucaugaggccacaugaaaccaccuucugauauuuaugccuuuguuuugcccucugugggauuaaccccaucucuucaucaaguaaaagccuguauaccaauucacagacuuucuuuucagcagaauaaaucuuacuguugauacaaucuuuugaaauggaacaucuuuauauuuuuauguaaaguaugauuuuccugcaauucuggcuaugacuuuguauagcuuuccuacaugauucuguggcuuccucagaccuguggaagaccuugacucuaaaucugagcagacagaaagcuaagugcagaaugauauucuucaaguaagccauucaccccaagaagaaguaagagggggggaaaaaagacaaaacaaaacaguguggaaaugugucuaaacuaguguccccaaggguaucccaaaaccauuuauucuauggaauguuaguaacuguugugcuuuaaaaguuacaaagaucugauaaguuugggaaagccuguguuaaaaaaaaaaauuaacccaauccuauauucaaaacuuuuuagaaacuucuuuuuguuguuagagacagagucuugcucugucgcccaggcuagaaugcaguggcgugaccauagcucgcugugaccuugaacugaauucaagugauccuuccaaguagcuagcacuacagaugugugccaucacgucuggcuaauuuuucuuauuuuuuguacaggugggaucucaccauguugcccaggcuagucucaaacuccuacccucaaguuauccucccaucucgacuucccaaagaucuaggauuacaggcauaaaccacuagacccccacuccuuccaugccaaccaaaaaaaggauauguuacauuuccuaaacucauuuaucugaggagaccuuuuucuugggacuagcagucaaaaaagcccuuacaaauuagaaaugcauuuuaaauaugcaagaaaauggcaaagugucuugguauuccccaggcuuagucacuuauucucuguucuuuagcaauucaaccaauggaguagaggcuguaguuuucugugggugucuuaccuaccuuaccagaggucaggguaacauagaccuuagcuuccugaccuuccuuugaguguugguuacauucgcuuuuuuaaaacccacuuagccauucauccagccccuaaugggaucagcguuuccaucaaaccaauuguggacagagaguuuuuagggcccuuauuuaugcuucuuagauuuucuauguaucucaggauaagugaacuguagagaaauacucuauguuaugcagacugugggagacuggaguuuaguucuaaaagcauguauuaggcucugcaagagcuacucaacccuaaugaagucaucugacucuaagguuuuauauaucuuucaucuuccauuuggacacccagccaucuauccauccaucucacugagugguugugaugguaaaauguaugaaaaguguugaaaaguuguaaacuuugagaagguuauauaaaaagcauugguaucauuauuaucaucagucaagagguguguugaggaaugguuuucauugcugacucaugagauaaguuacuucccuuguuccucaagauuuuuggugaaaauguuaagcauuacucauucguaugaauaauaaagacucccuucagaagaauguuugaaaggcuaauuacauuucuguuauuguacaaucauaauagcauuagagagcacauauauaauuuuaagugcguuacuuauauuugcucauuuuguuaccacaccaacucuguaguaaguaugauuacuaacuuuauuuuacaaagaggaaaacuaagacgcagaucacuuagguaacuuguucaauaucauauaguuauaaguggcagagcugggauuugaacucacacagucuagcucuggaguccaugcuguuaaccacugucuuaguaugauuuauaccaggauacuagaagacacaccacugucuuauacagauugguucaaauacugaugguuaguuacuaguugugagacauuagacaacccaauaaccaccugucucauuccugcaaaaggacuuuauuuagguauaaagcaccaacagauaguaguaguguacucuuaaaacagagugauggguguguccuauuuugccacuagaaaugcuuuuuucacaucuguauuuuaaaaugauuaagggaugaucauuauuuucccucccucaugccuccugcuccauccacccugaaaaacuaaauucuuuggccaaaauuugcaagcgcauauagaagauugguuagcauaacucagacuugcauuuaugacuguaugggcaaggacaaaguagacucuguaauuguuuagucauauaugagcuauauauauacuucaagugagugaaauguuuuguucauucuagauuuuuuuuauuuauguguuuuggguuuggaacccuuagaaaaucaaagaaaaaaauuguuuguucuugcuaucagcuuucauaugguucccgagacaagugcuauacauuuagaaaauuaaaaggguaaacauuaaauaagaaugcaggaguuggcaagaagucaaaugaauuggauguucauuaaaugcccaggguuuggggacaggcaagguuacuaaaaacuggagcaggcuuaaugagacacaucagacuugaguugaguuugguggauggguaggauucugaauggugaggagaauagucuugaaaagggguagaggagagagggaauguaguggaaaccaggguagagucagcaugcauguggcuagagacauguuucagccagugggcugggcugcaggaauugaggaggaguugggaguagcaggccacuaggcuaagaaucugggaguuugugaauucccagcuaugaaauggggccccauuucauagucugggauuacugaagguuuaaaguggaagaaugaaauccagaaagcugaguuccaagagccuuaguaugauaguaguaaauugaguaguuagaaugaagauugaucauauuuucuuagccaggagaaccaauuagaaggcuauuuaagauauuuagggagggccaggugcaguagcucaugccuguaaucccagcacuuugggaggcugaggcaggcuuaucacuugaggucaggaguucaagacccuccuggccaauauggugaaaccccaucucuacuaaaaauucaaaaaguuagccagacaggguggcaggcgccuguagucccagcuacuugggaagcugaggcacgagaauugcuugaacccaggaggcagaaguuacagugagcugagauugugccauugcacuccagcuuggacaacagagugagacucugucucaaaaaaaaaaaaaaaaagaaaaaaaaagauauuuagggaggagcuauauuugauggcagugcaaauggaaagauaagggaugggcuugagauacaccagaggaagaauuggugugauuuagugugguauaauuaaaaugccaggucauuuucuaguaauauaauuaauauuuaauuaauuaacaguagauuaauacaaacuaauuucuaaacauaggcucuggaaucagacugccuaaguaagcaguaaccuccacauugaccucaaaaaaguaacuuaacugacugagccucaguuuucucauuuguuaaaugagaauaguaauacccaccuuggaagauuuacuaagaauuaagugagauuuaauucuuauuuauauaagaaaguccuuggcaugaugcccaacaaauaguaagagugcaguguauuuuaacuauaaucauuagcguccauauuuuaaaaugggaauuugauuacauugugguuuguuguaagugcugaacauaccugugcuuuucuuauggcagguauaguaauuguguuaacuaauaaaacgguuauuaaauauguucaaucugucuaguauuuguagaguuucuguuguuuguauucacauuauucuacuauuugauauccaguagcccagagaagauggugacaaccccuggcagggacacgcaccuccucugcgggccacugagaauuggacaauaggauuuagaaucagugguagagcuggaccuggaauccaggcuucuucauugucgguaaaggucuguuucccaauaugaggcaucauaaauuaagguaggagacagaagaaaacauauaauuuuuugggggucuuuuuuuuuucuugauuauagauuuuauuuauuuuuuauuuuucuauaaguuauugggguacaggugguauuugguuacaugaguaaguucuuuaguggugauuuaugagauuuuggugcacccaucagccguauacacuguaccauauuuguagucuuuuaucccucaccccccucccacucuucccccuaaguccccaaaguccguuguaucauuguuagguguuugcguccucauagcuuagcucccacauaucagugaguacauacgguguuugguuuuccauuccuaaguuacuucacuuuggauaguagucuccaaucucaucuaggucacugcaaaugcuguuaauucauuccuuuuuauggcugcguaguguuccaucauauauucauauauauauaugauggaauauauauauauaugauggaauauauauaugauggaauauauauauauaugauggaauauauauauaugauggaauauauauaugauggaauauauauaugauggaauauauauaugauagaauauauauaugauggaauauauaugauagaauauauauaugauagaauauauacauaugauagaauauauauaugauggaauauauauaugauagaauauauauauaugauggaauauauaugauggaauauauauaugguggaauacauacacacacacacacacacacacacacacacacacacacaccacaguuucuuuauccacucauugaucggugggcauuuggguugguuccacgauuuugcaguugugaauugugcugcuguaaacaugcauguacaaguaucuuggaaaacagagaauuucuuaaagucucuuuaucuguucacagauaugacuggcuaaccugcguuuuucuguauaauuguucuuuccaggguauauaguauguccuuuauguugguggauguuuuuagcccaaccuuuuuacuugguuaauuccgacuuuacuuucaacuuaaaugccacccaaucuaaaugacuuuuacccuuuuuucuuagccacuacguauuuucuuuagagcgauuuuuauaccuuguaguccuauauuuguuuaccuauuuguuuauuuauacccaucucccccaccaaacuuuuagguccaugagagcagagaucauuucuguuuuguuauuuaggguacuugguuuccgguauaauguguggcauauaauaagcaauaaauaggaauuugagaaugaauucaugaauuagagaauauguaauauucagacauaugucaaagggcauggucucugcuuuugcugauaaaaccaacuuggauuaacauuauuaaaacuuucagugcuauacuuucaucaucuaauauggacagaauaauaacuaccuacaucuacuucacagaaauguuuuuaggauaaaugagauacugaauacuguuuucugcaauaucuagaaauuaggccuacaucauaaacuggguauuuagggaacuucccuguuccacacuuugagaugacuaggaaaccccuuucugauauuagagcuccaaaaaggcuaccagaguggccaugcacaauagugaccacaagggugaacagacucucugagcccuuccccuuccugccaggcaaugccugacucugcagaacauauggaucacaaccuaauguguguggaauuacucugcuaucuucagaaaaagagcaucgugcauaucuaaugccauguugaugaugguaguaguacugcggagaggcugcugaugugaugauggaaccaaaguugugagguaagaagauccuuuagaagcaaacaccuuccagauccuagcccuauaaacagcaacugggugucugguaaauacagcaucggcuugaauagacauauuugaauaagguuuucucaccauagccugggcuucuaaagagcuugguagaauauuuugauuguugagaucauccccuccccaucuuuaaaaaagauauggauccccugcuccugauaaacacaagaaaaaauauaaacuguaaauauuuaugugaugaaaauuauauuaaauauuuaaagaaacugcagagcauugcuuaaucaucuuauuaagaauccuagauuuaaaccuuagaugucuguucuuaggcaugaaggaaucagguuaaacugccuuaaaaauaaagugccucacaguuguaucauaaaauaucaacugacauuaagguaauugugcuuaagcacaacuuagggcucuucugaauauuugucauugucacaauaauggugcuauuuuuaauaguccaauccuaguucuaaagaaauaaacuauauucuuuguguguguccuaaacagaaucaugacuagggagaaaauguagacuccgaauucuuuaucuuaguaaaagaagcacagaaccacauuagauauggguucugguaucauuaugguguuuuuguuuuguuuuguuuuguuuuuuuguuuuuaaugaaacauucuaaagggcugggugcaguggcucacgcuuguaaucccagcacuuugggaggcugaggcgggcggaucaccugaggucaggaguuagagaccagccuguccaacauggcgaaacccugucucuacuaaaaauacaaagauuagccgggcaugguggugggcaccuguaaucccagcuacuugagaggcugaggcaggagaaucacuugaacccaggagguggagauuguaguaagccaagaucacaccauugcauuucagccugggcaacaagagugaaacuccaucuuaaaaaaaaaaaaaagaaaaagaaaaagaaaaaagaaaacaaaacauuuuguaguaggagccugccuaguccaggguaguguaacacuccuaagagucucagccauuuccuacguuaggaucaguuuuacagauuugagucaaacugaugucugagucuucguuaaccuucagagagccaugaaaucaagugcagauuucuaagccccagccacugggcccuagcaagcucauguugagccuuuaugaaauuagaaaagguguucuuucugagcggauaaagcccaaaccagagcacauggcuuggccguggugagccaggccugaacuacauucagcaccacuugccacuuugguggcacuuugggcagugcauauguugagcacccuguccccagaaggaccggacccaaaucucuagccagaacgcaagcacuguuuacaggcaacccaggaaccauguuauuuuucagauugacauucacgucacaaugcuggugcuuuugaguaugugaucugcuuaaguccacaguggucuuuuggccuuugagccccaaauccucagaguucauggcaugaucucacuauauggaacagaaaaguguuucauuuuaugucgaauuuaaauaauaucugggaauauuugcuguugauuuuuuuccuccugcuacccucucucauguuaggccaagaaagccaaugagguuaaacuacgacuguccuuuuuuaggaucugcuaauaauuuagauagaggcugaugauuuaucaccaccuuauucaggcuguaauaauccccuauccacuuggaucucugcagaaccucuuaacugaucuucucuccgccaaccuguucuuuacuccaacucauggaaagucacacuugcuaaugauacgucauugacuuucuccuggguugaaagaacauccaaacucuuuuauuuuauuuuauuauacuuuaaguucuaggguacacgugcacaaugugcaaguuuguuacauagguauacaugugccacguuaguuugcugcacccaucaacucaucauuuacauuagguauuucuccuaaugcuaucccucccccagcccuccaccccacaacaggcccugcugugugauguuccccucccuguguccauguguucucaugaaaauccaaacucuucuacacggccugccaaaucuugaucaaaacccuacaggacgugccaggccuacaugacgugucuccuuuucccuucaucucugacugcaucuccucucucccuccuucacuuguucaacuuuggucacacuggcuucuucgcuguuccuuuucccugaaaaauuuugccuucacaucucagaccuugacucagaacucaucucaaugacucuugcccugacugcuguaucugaauuuucagccuuuccucacccacaccauuucagguccucuuucuccacuuugucuuuucuuccuuaaaaauuauuuucuggcugggcucgguggcucaugccuguaaucucagcacuuugggaggccaaggcagguggaucaugaguucaagagaucgagaccaccccggccaacauggugaaaccccaucucuacuaaaaauauaaaaauuagcugggcaugguggcacaggccuguaauccuagcuacucaggaggcugagacaggagaaucgcuugaaucugggagguguaguuugcagugagccgagauugugucacugcacuccagccuggugacagagcaagacuccgucuccaaaaaaaagaaaaagaaaauuauuuucuaauauauuucguauuuuauuuagugugucuguuucucuuccaccaggauuuaagcuccaccaggguagggguuugucuguuuuauucaguguuguaucuccagugccuaggacaaaaccaaacaugcagcauauggucaagaccuauuaguugaguggaggacugaaugaacuuggccccugccugccucucuacccucgugugucaucagacuucuucauguccuacaugcccacaucuuuuccaucuuucugcucucucuaaacacgccaugcuuuccuccacucucugugccuuucuacuuacugcugcaucuauuuagaugguucaucuucaccuguuuggcucuucaggcauggcucagaagucaccucugcuagaaggacugccuuagcccccugcugugcaaguagaguacccuuucccagcaugggagcaaccugaaugccuuacuuuuauccuuuugccuagcucuuccauuaaaccacauaagcuccuugagggucuuauuuggauuuguagucucagucugcacauagcacaguauaggcaugucuuaaauguuuauuaacuggagaaaggagggacagaggccagcauagaacuggaagauuauuucaggauuucauccauccuuagucuaccuagucuaccuaccauguugccacguuuauuacaguaggugcucaagacagcucugaaugaaugaguuguuuguucccucuuacacauacccaccccuaauuaaaaauucaaaucauuuuuguaucaauauuguacuuugaaaagaucuucugaauugauggcuucuaacuucagguuguuggccagaucuggauguggucagauaagguagauguaacuguuuccugagucuaaaaccuaucaggaugcacugguugggaaauggauagagcaccuuaguguauuuucugagaaacacagaucagugguuuugcuuaccuguguguugauaaugagugcuuuuucugcgugcguacuuuauuucuucgaaauaggacuuacgugaaaacaaaguggcuuaaucauucaauuacaguuuccucuaugaaauuuuucaauaaaaaugaaauaaagcaggggagcucuaagucuguuucauacucugcaguauggaugaucaccaggaaacauuuucuuaauggcaucauaauauucugaauguuauuuauacuaaugaucacgaauuucaucuuagugaugccuguaaaaaacuuaaccuacauguuaaguugacuuaagacacaacguuucagacuacccagacugaagacacaccauuucagauuacccauaaagauuuuagcagcaguguucugugacugauuuguaaugaugcuuacuacucaucauuaauugaguagacuugauggauagcuauacagaaaaaaaaaaaaaaaugggcaggccuuuaccacccucgaaggauggagcuuuugguauuuauucgaugcauaaccuguauuccuaaaagacaagaaauacaucauaugauuucucaguggaccauacaucacagcaggaacaccuuuacaaccugccagguaaacacauauuaaaguuaauucucagaggcuuuuguugcuuuaaagaaaucauaugcaguagaaaauuccuccuguuuucacaaccaggaccaacagccaguuaaucaguugaaguggugaaucuuuaccaaaacaaacaaacuacauguuuuaagcauuuuuagcugaaaauauagaaaugugcauuuugagauuagccaaggccuuuacuuaaguauggaugguugugcucauuaaaguucugacuucuuacauauaccacaacugugauguaucaccaagauuuucaccucuugcugcuuuaaagugaaccuggaacuuagacaugaauagguugaguguagaaucauccaauccuccaauauuuugcauuugucuugcccacaccaugugaaagcaggauuguuuuuguuuuuuuuuuaaggguggggaaaaaaaagaaaaaaacauugucaggacucccuaaagcauucaacuuaauuuugauagaaugaacuuuuuauuuuacaaucguauuucacugguuuuuauaauauuucauuaaaugauaaaaucguauuuguagaugaaacgguuauaaucaggucugagaaaaaauaacugauccuugacuaaauugauuuguaaaagcggaaguaugugagcauaccagaguguaguuuauuaguuuuguuuauuuagcaugcuauggacaucaauauauuuuaaagaagaaaaacgauuuugauuaaucugguagcguaagcauacauguaguaguaacuuuuucuuuguugguguuucuguauaacuuaaaaagagaugaaacuaaacugcagugaaauaacccuuagagacugguaauccaccccuaaugagcgagugcacaugugaacaagguaugaugcauaucuucagcugcucacuugacuuuuucaguuggauaaauuuccauccucuuucauuguaauauggcccaaacuaaauucacuguuuucuuaagccuuccucccauuucccaggcucucuuagaauuacugccauuuccccagcuaucaagguauccaauauagcuagaaaaaaauuauuuugaaggaauacugcgugugcuguaggaguuuuauguguguuuuuuaaaauuauuuugacccuuaccucugauccucuuaaguuuugucauuaccagaucuugucauuucugagaaaugcauguuccucuucauuugaguggccuccccagcaugagacccuuuccaccuguugaguauaucacugcaguggaaggaucuuacuugauuagcagcauugccuccagccauuuguauccuuaaagcuguggcaagauccuuuuuucacaaaucccauucucagcaguucacucuccauucaagauucucaguggcuuuucacugacugcaacauguaauguaaaaauauuugucuuugcucucggugccuugcuuaacauagauccauccucauuucagguaucagucucuauucuuuuaugcccugugggaacccaccacaaucacguugucugucugcgucucuguccuccagacuugugcuccgccuccacaccucugcucauauggagccauguggucuguaggaucuuaggucuuauaugccacugauucauguccuaaaaguccuuauucaauucugcuugacucucuuccaaggaacacuccuccgcaaaccuuugagcaccuagagauuagggacugcucauucugacaugaaaccagcugcacugcauuuuauuguuauguaguuguguuuaucuccucaacuccaaaugaaccccuuugaaaguugggacucuucucuuaaauguuucucuuuuuguagcuucucuucuucagggaguguagaauacuuucaacccagcacaacuguaugaaagaccugauugaggaaacauaagaaucacuaggccagggucccuucccucuaggugcucacagucuaauggaaaacagauguguccuuaaacacacacauacacacacccacacagauacauagacgucugauaugaagugagaaaacucuaaaauuucuacuaauaaagguguguauuagaugaaaguuuggaggaaggugagugauacgguuuggcuguguccccaccuaaaucucaacuugaauuguaucucccagaauucccacguguugugggagggacccagggggagguaauugaaucaugggggcuggucguucccuugcucuucucuugauggugaauaagucucuccagaucugauggguuuaucagggguuuccgcuuuugcuucuuccucauuuucucuugcggcugccauguuagaagugccucucaccucccaccaugauucugaggccuccccagccauguggaacuguaaguccaauuaaaccuuuuuuucuucacagucucugguaugucuuuaucagcagcaugaaaauggacuaauacagugagcuuucacucuaacaauggggagaaaggucuuugauuuggagggguuccuacuugaauuguauuaaauuagacauuugcauuugagcauuauuggaagaauagaaagauccguguauuguuuucuugcagaaaaauuuuuugagggaaggagaaacaguauuguuaaguaagaaguaaggaacuuaauaacuugaucaaguucuuguaacuaaucaguggcagauacacgagggcucuuguucuacugccgguaguuuugaguaguaaguucugcugccuccucaaguuuuguuaacauucuuuugagucaccugaacauauguaugaaauuuuuagaggguaagaaacuuuuuagcccccguuauguaacacucaaaucacucaggaguguuuccuuuucagaguacuucaaaccugccauggaguuagccuuugggaaggagaaaggcagguaacauaaaauaucaacugagaggcuuugaagaugggugauguguuuuuucuccuuaggauguuaaaucacauaucaccacaugugugcauggaaaugaaaaaugucagcaacacauuuauguaaaccauggaucauauuugcauauacauuucaacucagccuuccuacccugagaccagcaaugauugaugcuuuguauuuugucuuuuuaaagauuucucuaguccuaggauuuugcugcauguuaaaacucuuaucucaaugaaagguaaauuagauaauaaacuauaaaccuaugcugucuagcacaguagccacuagccacaugugucuauuuaaauguaaauuaaauuaaaaauugauuuccuuaguugcauagccacauuucaaguauuccauaccaaauugagaugugcaguaaagguaaaauaccagauuuuaaagauguauuacaaaaaccaaauuuaaaauacugacaaauuuuuguauugguaauauguugaacugacaauauuuuggauuguuuuauuaaguaagacacauuauuaaaaguuuugccucuuuuacuuuuuuauaauuguuacuuagaagcuuaaaauuacuacuguggaucacauauuucuguuugacaacacugacuuagaaaguucauauuuuaauuuuuaauucuauugucuuaguguauagguuuauacugaaugagcuuacuaggcauuuuggaaagcagagugauuagcaaugacugaaacauaauauagaugauuuaaugauuccuaccauuuuuugccuguaauuuuuacugggucuacuaaucaguuuuuuggguuuuuuuuugcuaaaagaagccuuuauccuuguucaggccaucaccuuuuaagacuguuuugguuuugaucuuguuuagccuuuaaucuuugcuccuugauuggcuagugacaggcaaacugaaugaucgggauuaagauucaaauauuucaugaaugcuuucacuacagcauuccuuuuuauaggaaguuacagucaauacaguauauaaggcaguacuuaaucugucauauuugcaggcuaagcccugaauuagauauuuuagugcaugaaaagaucuccagacuaaacgcauucauuugcuaauuagaaaaaaauuuguuucccacuaaaacauuuuacucaguaguguuuauguagaaauacugugaauauuccuacaaaguugcuuaauuuauuucugugaguuccaacuagguucaguauaauuuuuccauuaguguaaguauaggccugcuaguguuacguaaacccuauuuagcuguuaguacuguugucaccacucugauuacuuaaagaggucucuagagcagaaaacagacuuccuaacuuaugaguuguuaauauuuuauuuuuuauguuauuuggaauaucaagauauaguacguuggggagaaaaauccuuugugaauuugauagaaaauuggaaacccaagaaaaaggccauuguuaagguuuuuggcuaaucucaccgaaauugucuguaguaacccacacugccauauaaggcgaggggaaacggugccuuuuugcaugcuauggggaauauguagcuuaguaguacaaagauaaagcaaagagcuccaaagaugcggccaaaaauagucguauugggguuuuugcugaauugaauuguacugauggcugaauauuuuccgggauugagcccucucuucuaaacuuaaaucuuguccuguuucaccaucuaugguaaaauauccauggaaacaaaguggcuuccucauggguugcuuacugauccugcauuaggaaagaccacacagacauucgaggaagagaaagaauauuucauauggcugcuuuccuuguuaagggggacccagagaaauguuuauuucugaauagcuuaccuucauuccaagaaaucggcuuuugggcuuacauagcaguggacauguuacuggaaucuuaagagugacaagaaauuauuguuucugaagauagcuugucacuuuuuucucauaggacuuggcugggguucagugcucucuuuggucuuauuugaaugguauuuuauaagucagacaaaauaauauucaacuauuaauauuguucugcuaaaacaguuuagaauaaagauuuaauguucucuuuucagugaagagcuugugcccacugugcaguacuguaauaaaagagaaacaaaugaggcagcucaaaguuauggcucuccguggcuuuuaggucucucauacauuuuuauaaaacauauaucagaacuucugaauuguuaaauuggguuauuuuuuaagugcaguuguauucaaauaaggacccgagaguaacacuccauguccuguuaggugucagcguucagaacugcccgcccccuccacccccagccgacagacuuacugcuguuauuacauccucuggucuguagcuaggagaggacguuugacccccucaagacugugcuucuaguuguucuucaaguaaacugacucagccccaggcuuacugucuugccuuuaggcaaacagguaacuugaguuacacaucucuuuucucaucuguaaaaggggaauauagaaagugucacuucuggauucccaguggauuuaaaaggcaaaaaugagauuaacgaugucuauggccaagcaugguggcucacaacuguaauuuugguacuuuuugaggccaagaugggaggacugcaugauccgagagaccagccugggcaacauagcgagacguuaucucuauaaaaaaaauuaggcauggugucaugugccuguagucccagcuccucaggaggcugaggcaggaggaucgcuugagcccaggaguuugauguuacagucagcugugaucccaccacugcacuccauccugggcaccagagugagacccugucucuaccaaaaaaaaaaauugucugugaaucucccaaauugcuacaguuuaauaauuugcaucccuauagaaacccaggagaacuuuaaagaacagaaaguaaacuuuagugcaaauauuugagagccuaaugugucauuaaauguuucugaggaauauauguuugcugaaaagcugaaaauuaggguuaguguaagcaucacucauaauaaucucaugaagagaaucuugcagaugacauugcccaagcauaguacugggaggauaauaaaaggugugcgcauuuauuugggugucagaagauuaaguacagggugugcuucaguauuaauucuuccugccccaaccuaaacauuuaaccaaauaaagaaggaacaucaagucccacagaacuaggaaugauacuacuauucugauuucaagaaguauaauuacuguccuaacacuuagaaaugaccagaauuuaauacccaggucuucauuuuccucugacuucauuuuccucuggcugaaacaggagugacagaggccaggaucaucagaggcagauggaucccuauggcagguuguuuugacucuucuaaguucuuugcauuaaaacaacauuccucaaacacauuagccucccagcacggggguggaaacaacaaagcaggaagccugcuggagccuuggggaaaucuugagugcuuuggggugauuuauuuucagaggauucgaacuaagaucagcucaagagaagaugggaacauucaggauggugggaaagcaaaguaacugacucccuccuuuuccucucuguaaauggucuccuggaaagccaucacaaguaaauguuuuauuccacauaaauuuguacccuuggggguacaaaugggggauugagaaggguuguggacugccuggaacaugcuuuuuucuuuuucucuuuucuuuuugagacagggucucacucuguugcccaggcuagagugcaguggugugguaacagcucacuacagucucgcccucgugggcucaagcaguccucccacgcagcuggaacuacaggcaugcaccaccacgcuucucuguuuuuaaaaaucuuuuuguagagacagggucucacuauguugcucaggcuagaaugugcuuuuuaauuuuaauuuuuugguaagcccuagccacaugaaaugagcccagugggguggaggaccggcccugacagagccuauaugaucccuugacuggguuaaugcaaaguugggucucuuauuaaauuaagcagaaauuccagaaggcuuguggcugggugauggauuuggccucuaaaaccagaaugacccacaaaacagguuuuugaguaacagaugcuuaaugaacaucccugacccaacuuuacaaaaaugcaaacugggcuacaagagacuuaaucagagcaggaugaaagcccaaguuagugggagaugaguggaagucucauguacccaacugugaaagggcuucuuuuuccaauucagaacaauuguauuagaugguuaugaggaacgaucauuuagauggaagcugaacucccuuucguucacucagugaaaacuaaauuguugggcagguucagagaaaaaaaauagaaauagugugugugugugugugugucugugugugucucuguguguguguguguaauuucucuggaagcacaggaaugauguguucuucuuuguuaagggcauuaugaaaccacggcaguccucuucuuguacagugguuguaauuauaaccacagggauauuguguucucaaacaaacauucaagcucccugauaccagguugccugaagccaagcuucacauauggauguguaaaacaaugccuauuaguaaucucccccaucacuugucauuggucuuccccucugacaguggaaaugucuuuauagucugugccuggcauauugcuuuuguucaucuuagguucauuaugucuguuuuaaacaaugagaacauauaggucguggcacagugaaauguagcaccugaaacuuaagagcuugaucggguauauacauaaaggcuguccuucagaaauuucuucaugaugcuguugcaugccauuggaacaguuggaaaaaggaaaauuagaaccacuugcaugccagccagcucuguuuuuaacgcaugauuauuuuauugggguguacauuaauuaaucccgaaauaagauccugugugacauucagaguuguuuugaguagcucagaguuuaaauauuuuaguuuuacaacucuguuaugcuggcagccaacaauggugucucagugaagucagcauaugagcccugcuugugaugacaucuggaaagcuuguuuuaucuauaagcacaguuguagacaaaugaaagcagacagauguaaggcugggguggcaucuucgccucgagcacucucuggcuguacauuuuccagugugucaaaaacaaggagcuuuauuucggggguggaauaaaaacauucugucacaucccuacaccagcuacugugcugccuuuuuugagcuauaagguguaaaacggccuagacuguucaaaauuuaacaagagacagaguuaauaaguaaacaggagaaagucaguagucagauagaggugccugaguuuggaggggacaugacaccacgucaaaagccuuggggucauuuuaagaaguuaaucacaaccacuuucuccugggagagccagaaagaauaaaagaguuggcaggggauuuggaguucuggguagauuuuucuuuugccauuaccuuuaucagccaggauuuauuaaguacccauggcguauagaaaagucuacaaaguaguuugggugaguggagcaaagaaaagcuuuaggacagggucaugcuugaagaugaguacuuagaagccugaaaguccgugacaucuuccauggguggcucucaaguccuuuugcucagggaccauuccuuaggaaaucuuauacaagggcagcuugccuuuuaucccacucccuuuuugcugcuguagaaauaaguaucccugaaaauaaucuccacauaugcgugugaauuugcuuggauuugaguuaaagcagaugcuuuucaaaguucuugauccugcaauagcaauagaauuagcuaugugggguaugaaauuaauauuuucaucucuggagauuuauggcuuccuccuauuucauggcauauacuguguauaccacucuguauaccauguaaucauugcuaauuauugcuaaauaaguuuuaccaaaauuuugggaaaccuggacauggucuuguuuagcaucugcuuaaggacuggauugcccaccugcagccaaaaccacauagcuuuauaguauuugaaucuugugucuugaagaaaccaugcagauacauguaauuugagagcaaugaaauaauggaaaugaaaggaagggaauaguauguaaggaaaugaaauauggucaguugcuuguaucaggacagaagccucuugguuucagcagugucuuuuucaguggccaaggugguagagaauauacuuuucauuuuagcaaucaaguuacauuaugguauaaacaggggaaaaccgaguuuuucauuucccgucucauucccaucacaccaucauuaauccuuucagagugcaugguguuaagauccacugagcccugguaagugccuuuguguauacaaaauggcacuuuuuguuuuacaugcuguuggaugugguggagaaaauacauguguaaucgaaaauggacagcaaauugccauuuguaccugcaaagacuaaaugguccagaaagauggauaguugggguguuagucacacaugaguagacugaugggcuggccacggaaagccccggaccuuugcaugacuuuucacuuagagccaucugagggguucagugacuccguggcuguucucugagaccccagucugguccagagaguccuggagucugaaguuugugaugauacagagguugauuccucugaguuuauucauuuaaauuagaaacacagagggaagggaaucuuuucuugugaucccaguuauuccugauagagaagaaguagcagauuuucuaaauuaucugccggcugugggguuggaaaguaaguaagauuauaugucucaucauccuucuaugaguauguagaaacgagagucuuagaaucagugucugcaaucaccuucaucggugcuagcuuacaauuuaaacugucaaaauagacuuuauuuccuucuuuuguuguucaauauaagaagaggguuuuuuuuuucugccuauuaguuugaguuucuauagaugacuauuuauagcauuuuuuuaaagguuucccaacacuauuggguugacacaaugggauauaauagccaacagggaccuugcacugauaccaauuugauuuauuuauaaauuaaauuauucugcuaaaucugcuguaguacuauuuagucauuuugauuuaaucagaaguauccuuuaugaugcaaucugcuggaagacuguguuuggccaagauuaaacuuauucuuuugaaaacauuaaaacacaauuauggaucuauaauuuccccugugguaucagugaacauuaguuauuauugacauauauuggucuucuauuauuacuaauauuuuuauuacugacaacaguuuuuaguauuuagcaugugccacauauagugcuaagguuuuuauauguguuuguagcuaacauuuauugaguacuuauuuuauuacacauacuuuggagcucagauuauccaguauaauucacauaaugaucccgugaaguugguacuaagauuauaguauuacccucauuuugucaacaaggauguagguucagagaaauuaauuaucuugucuaagaucacacauauucuuugcauauuggacuguauguguuuguguauaggcauuaauuucauucucaguguagaucuguacuuucuuuuccaaauauauuauaaccacacuguaccuuguacauguaauuuuuacucagaaacuaacaacuuguuggcuuuaaaaaauacucauugaaauugaacauugcuucaguuucugaaaugaaaauaaccaguuccuaaguuagcagugauaucagcgaugguguguccggaauugguggguccuuggucucacugacuucaagaaugaagucgcggacccucgcggugaauguuacagcucuuaagguggcgugucuggaguucuuucugauguucggauguguuuggaguuucuuccuucuagugggcucguggucucgcuggcuucaggagugaaguugcagaccuucguggugaguguuacagcucauaaaagcaguguggacccaaagagugagcaguagcaagauuuauugcaaggagcgaaagaacaaagcuuccacgauguggaaggggacccgagcggguugccacugcuggcucgggcagccugcuuuuauucucuuauguggccccacccacauccugcugauugguagagccgaguagucuguuuugacagggcgcugauuggugcguuuacaaucccugagcuagacacaaagguucuccaccuccccaucagauuaguuagauacagaguauggacacaaagguucuccaaggccccaccagagcccaaacccugagcuagacacagggugcugauuggugcguuuacaaaccuugagcuagauacagagugccaacugguguauuuacaaucccugagcuagacauaaagguucuucacuucccuaccagacucaggagcccagcuggcuucacccaguggaucccgcaccaggcugcagguggagcugccugccagucccgugccaugugcucgcacuccucagcccuuggguggucgaugggacugggcgccguggagcaggggguggcacuugucggggaggcucaggccgcacaggagcccauggagggggugggaggcucaggcauggcggacugcaggucccgagcccugccccgccggaaggcagcuagggcccggugagaaaucaaguacagcgccagugggcuggcacugcugggggacccaguacacccuccgcagccgcuggcccgggugcuaaaccccucauugcccgguccagcagggccggccugcugcuccaaguguggggcccgccaagcccacgcccacccggaacuccagcuggcccgcaagcgccgccugcagccccgguuccugcucccgccucucccuccacaccucccugcaagccgagggagccggcucuggccuuggccagcccagaaaggggcucccacagugcagcggugggcugaagggcuccucaagugccgccaaagugggagcccaggcagaggaggcgccgagagugagcgagggcugugaggacugccagcacgcugucaccucucaaugggaugguaaugauuuaacagauuggguuuucaucaggcagaggguuguuuuuguuugcuagagaggcugugcaguguacugagaagccgaaaagugugcagugcuagguugccagaguuugaaucccauuucugccacuugugaggucuuugacucuuuaugccccauguuucuuauuuuuaaaauggagaugauaauauuaaaaguaccuauuuaauggagauguuacauguaucgaaugauguuaccuguguugaauguuguuacauguguugaaugaacuuagaaugguacuugccacauaguaaauacugaauauuauaauagcugcuauacuuauuuuaugauaauaacuuuagcugauucaugggggaccacaaguagcuugcaaauaauuuuaaagauuuuagaaacauuuggaaacugucaaagguaaguauucuuccaaagguuaagcuguuacagauaacauuuuaguaucuuugugccgagcuauuaaaauaaacauaaauaaucuaacaaauauuuuacccaacgugcauaaagaaagaagucagaucuuaaaugcaagcaaaauuauauuagccuaacuuaagcacuugaaauguuuauuucuguacuuuaaaaaugagugcugacccagugauaucaggaacuuuccccccaaaauuguaaauuauaggacuguuaugcugaucaaugauacauaaaaaagacucuuacaagcaaauguaauaaaauguuaauuguagaauuuagaugguagauacauaagugcucacuguacaauucauucgacuuuucuguguauuugaaaauuuuaauaauaaaauauugaagaggaaggcucuuauaccucccuaucacugaagggaaaaugaaccuuuuugaaacuugaaaacuuuugcuaggugcuguauucuuuggcaugagagauagcaguugaaguggucugaaacacacacaugaacacacccucugaaaucccauuuuagucaaaguuggggauaaauuuccaaccaccaauuuuuucuuuucuuuuucuuuuucuuuucuuuucuuuuuuuuuuuuuugagacagagucucguucugucgcccaggcuggaguacaguggcgcagugggcucacugcagccuccgccucccagauucaagcaguucuccugccucagacucccgaguagcugggauuacaggugugcgccaacgcgccuggcuaauuuuuauuuuuuugguagagacaggguuucaccauguugaccaggcuggucucgaacuccugaucucagguuaucugcccacuucggccuuccaaagugcugggauuacaggcgugagccaccgugcccagccccaaccaccaaguuuuucuuuuuuggaguccucuugguuuuugugaauugaagucccauuugcuuauuggucaucuguuuaauaucagggucaugcuucuuuucuuuaguccgagcgggaagagcuuugagagaugagaaugcagggagccacaaaauaguuacuucaauuuagagguacucuuacacacugacauuccuuuuugaccuagaagaguuugccagcagcuguaugguuaauauggaguucacauuuucugaagcuaauaagcaucuguacauucugugaucuacacuuacaacaucuaaugguccuuuccucuuauaauuugugguaaaagauguuuuuaagcugaauauucuguuacacuaacacuguucauugaagaauaagaucagaaauuagguuauagauuacaucuaaaaaaaggcaguauuuuauaaccauguggaagaaauauuaagcugaaaauguuuguauuuugugucauuuaugucauaugccuuuuuaagaaaaagugucuuugcucauuaacaacagaauuacggugguauuaucuccuucuucacagaucacuucugggaucuugcuuuuaauucuggguaccacuguguaugaggagcauugagcaauugaaaugugaucaccacucaugaccaggguggugaagggucugcagacugaccacggggaagccauugacaguguuuggccuggagaaaagccugccagaauggaguccuccuccccaucuguaagggcuuccacguggaccaggaagcauauugcuuuuguuaauaucucagaggaccgaaauuuauacgaaggcagauuucagcccaguggaaggaaagacauagaacaguucgagccaugaaacaaugaaaugaacuaccucagacugugaugagccagauacagcuggguuuuuuuuccugccugacuacuccugucaucuguuugcaggauauggaaagaugcaggggcccgcucaagucuuuuucuaaggagaaauuuuaguuccuaagcaccuaaaaaaagacaugcugagaaguucaaauugggggccagguacccccaccggaggagacuauccccuuuguucuaugaguugcuucuaaaguaggagccaaaggaaguuucccuccaggccuacucugaggaugccuguccuuuugaaagcauucaagaaaaaacaccucuugauucaggaucaugauacaaagaaauagagauaucaaauuuuugauaaaaaagaaaauucuauaauguuaaaacugaaaugaaauauaauuauauauguuuccccaugaauauuuuuaaacuuuuuuuaggguuauaaggaaauagucuagauauauuaaaugucuaaaugaaguucuuagcuuuucagcaagaagaaauagcuaaaaauuuaaagucaggaagcuuacaaaacagauccaagagaguaagagacaaauaacuaauucuuuuugaaaaaauguuuaaguuugccauuaauaaaugauugucuaagugagacagcuuuggcuguugcuuagacauuuuaaaaucuugauuuguuaagaaaaucaaggacuuuuuuuuuuuaaucuccuugucacauuguuaucaaggaaagauuuucuuuaaaagccaauacuagacccuaaagguaaucaaagaguauuccgaagcugcaugauaguuuuaaaauuuucucuuuuuaaaggcaguguguugcucugucacccacgcuggagggcaguggagugaccauugcucacuugggaaccuccagcuccuggccucaagugauccuccugccucgguuucccaaagugcugggauuacagacccaaaugauacuuuggcuguucuucagggagaggucuuuuucucucuugcuccuuuucuuccuguccucuccuuuucuacccugauggagcaacauggugguuugggacacuuguauuuaaguucucauugaauaucgggguuccucuugaaggcucuucuggauccuacauuacuucugacacccucccugcuaauguucuuucccuaccacagacacauguaaaacccacaaauuggacaauuuuuguacauuucaaaccccuugcaucauuaugcuuuuuucaaaaauacgauuucaggaaugaucaccuuguaauauuaaauagcuguagaaaaugacagaaauuuggcauguauaggaagaccauuggaucacaguagauuaacucagcauucagucauuugacauguauuuuuugggugccuacuaugugccaaagcugagagguucuagaaguuaaaauggugagcuagauaaacccguggucccugcuuucuuggagcuuacagacuagggggaggggacagugucaaacugccagaguuuuuuuuuuuuuuuaaaaaaaacaacacacacacacggguuaaaaagcaaguuaucuagaguacuucuggaaucacuuccuugacaaagugagcuuugagcagaggucugaaggaugaguugcaauuaaugaggaaaauggugaugaugaggggugagauacuuggagaagcauggccugcugaaagaacuggccacggcgaccuaaagggagcaccucagguguguacaggagaaacuccagggcggugugggagccuagguuuagauacgcauucccccucuuugcucugcugcuguuuuuaauacuucuuccagaacuucccuaggauuaucuuccacaggggaguagauacuguuuuuauuguaaugaaucaucauccucuauuauugcaagugaugaaggcuucuaguagcaguggaacuaggaauggcgucaguggcucagcucuugauggcagaucuuuagggggaaacccuuucaguuuuaaugguggauaaagcaaaacuccucguucucaucaguuuccccucuaggcuguccuggguagggaguugauaggagaucuuuuggacacgggaauugcuucacuguugacagaaagacauggugcauuugauuaaauuaaauuaggagcauguguaugcuugacaaagugagcuaaugaaggaaaaugcaucaaaaggauuuauggugaauugauuaaaauuuuucuuuccagaaaacccuuccagcuuaaagcuuggaauuguaaggcuaucggugcugcuaggcccucuagguucucacuugccuuuacaguaggcaguuuggagacuuuucuuugagcagcugcuccuucuguagcauacucuguugcaggcaaaaguauucccaaccugcaaucugaauuguauggaggaaaggggauaaaagacacuguuugauuuauuaauuucuaguggauuagaacuacaaauguuugcuauguuuuuaauuugagaaguagagagaaucacagcagcuuuuaauuaugcauuuuguguaaugcagcucugaauagagcagaacaaaauuaaaauuguggaucaaauaccgaaucugaguggaugcuuaagugagcuguagcguaaugcuaaugguuuugcgucuuccuggcauuaugucaauaauggcuguaaucacauuaaguagagagcccauuagcuuuuucuuugcagcagcaugcaccauagcaacauagugugaguuucuaaaauaacuuuugacauuguuuuaaaaaacauagccauguuuaggguaagaggcaaguauauauaauguguacaggugaacacagauguguucacaaggcuauguuauauguacaguaagaucaucuauuauauaggcacauuaaccccugcuaacauuauggcuuggaaaaaucuaacccaguguccuuaucuucaugaauuuaauagauucucugcuauuuucacgagaguaaagccuuccuggaguucaccaugguguaaagucagaccuacuuucugaauaguguuguaccuagaguguggaaaagccuuuuaauauuucccuccuuugcugcaaucucauauggcauggcauuuccagcuguccaggucuauguaguucuuucuguguugaagcuggaacacagaagucugauugaaguucuuuugcuuuaaugccauuuucaguaccuuuugauagagagcucccaagaugagcccaccaugugguguucaucauggguuuuuuuaaugacugggagauuagaauuacuaugguaugugaauauuccuucuacaaauaacucaguuuugggauauucucugaguaguuaaacauucuaccaauuugauuuuuuuucaacgaaagcuucaagugcaauuaaaacacuuugcguuuuucuauuacacuauaugaagauaaacuaggagucaguaaggcaauuuucaaaacaaaguguugcagagauacuuuauucucaguauguguauuaauaacuugacucaucuuucucaucaaaccuucuccccaccagcacauaccuggaggacauccagggugcaauauugaggguucaucucccaugcucuccucuuugucaccuccucuauucaauuacaaaacaaaagaaagaaaaauggugcugccucagccaucuaaguaaauaccauugccucagccuucuaaauagcccuugaacacuuuucucccuucauucagguccucauugucucuugccuauuuucacaucuaauguucccaaguguucuucuuucugcuguuucaugaaauaauuuuuaaaaaacaacauauagugauuuguauguggaguuaauuuauuuuuuccugggagauauucuuuucaauuaggauguauaauccuaacuuuuauucaguaugcaaggauaagugacuuaauuuuuacagcugaucacugugcauucuguuagugcaguuaaaaauuacaguucucucagaacuuuaaagcaaaugcuacaucagucaagauugggugucuuuguuuaucuuugguaucaaagacccagagaauuuggagaaacaucacacagcuugaaaaguuauuuagacaagcuauaauaucacaugacugcccccugagugguaagacauugcccaguggaucugaaaacacuuuuaaguacuuaaucaucaucguaucuuuuuuaaauuuuuuauuucuuauuuauuuauuuuugagacagagucucgcuguguugcccaggcuggagugcaguggcacaaucucggcucacugcaaccuccgccuccuggguucgagugauucuccugccucagccucccaaguagcugggacuacaggaguacaccaccacacccggcuaauuuuuguaauuuuaguagagacagaguuucaccauauuggucaggcuggucucgaacuccuaaccucaggugauccaccugccucagccucccaaagugcugggauuacgcaugagccaccacgcccggucccaucaucguaucuucaugagauagucaggaauggaauuugaauacuuuaaauuggaacauggagaggugaggugacugucuaagguugcuuugacagugguggagcugggaucaacacuuuuauuuuuauauuuuaaaauauacuuccucuuagccuuuuaauucagaaaaguuaacuuuaguuucuuaaaggaauucauaagugcuaccucauaucccuguauagcagucuuaccuuuacagagcacuuuccgguuuguuucuuguuagaaccccacaagggaaaaaaguaggauccccuucugaagaugagaaauuugaaggauggucgguuguuaaagaaucugaauucuucugacucuucguccauggcauuccacuguauaaugcuaauuaaaauaguuucuucucuucugcagagauguaagguuccacugugacaagugccauuuugucugcccacacacuaggaacaccucaauagggaaagaaguaagagccaccugauuugcucuucuuguaucaugcuuagcuccaaaguagucucccagauguguguccuuuuccacuguugucuccugucugucuagaugugccuugggacucugccauaguauccacauacagcugcugccucucuguggaugacccauguccauuucccaugcuuccaccuuccuucuguaccaguuacacauuuucaaauguccacugacuucugaugccuguuggcacgauccacaaauccauaucaacauaacuaaaacuuaauuuuuuauauuucaccccuuucauuaaguagcuguuucucauaacuuccaacauuaaccuuucauuuacuauucauugagccuccaauggcugaauuuucuggugcaucucuuggcauuucuaaaguuccauaaagcagcacuugccucuaagagauguaaaaagaagaaggauuauaagaaguggaccauucuuggauuuuagaaguuucacuauguuugaaggcuaagaggcugguuuaggacugagugaauaggcgagccagucuggaaggaguuggaagguaacuaagccaugugaccucuucugaauuuuuauccuaaaagagugcacagccuguagaggagaguagguauauauaagaaccuaggugaagguaaagcuaccagaacauguuuugaaggcuuagaucucaguuuuuccuaauuuccaucauucucacugacaaaugcagggcagcaccucauguaagcuuacuaccagcuuuucuauuuaccccugcaacucugucucacacugacccuuucuccccucuuucuccuaggaagugagaggggaaggagaaguaagaugagaaagcagugagguuauauaccuguacuguccagacuccuuucccuuuguguuacuacaggacaauauagugcuugugaggccuuuggaauauauccuuacagaucuuaagaaaaucauguauuaguucguuuucaugcuguugauaaagacauaacugaaacugggaacaaaaagagguuuaauuggacuuacaguuccacaugacugggaaggccucagaaucaugguggaaggugaaaggcacuucuuacauggcagaggcaagagaaaaaaugaggaagaagcaaaagcagaaagcccugauaaacccaucagaucuugugagacuuauucacuauugcaagaauagcacggcaaagacccgcccccaugauucaguuaccucccccucggugccuccuacaacaugugggaauucugggagauacagcucaaguugagauuuugguggggacacagccaaaccauaucauucugcaccuggccccuccaaaucuuauguccucacauuucaaaaccagucaugccuucccagcagucccccaaagucuuaacucauuucagcauuaacccaaaaguccacaguccaaagucucaucugagacaaggcuaaagucccuuccgccuacaggccuguaaaaucaaaagcaagcagcugggugcaguggcucacgccuguaauccuggcacuuuggguggccaaggcgggcggaucacgaggucaggaguuugagaccagccuggccaacauagugaaacccugucucuacuaaaacuacaaaaaucagcugggcaugguggugcaugccuguagucccagcuacuugggaggcugagucaggagaaucgcuugaauccgggaggcggggguugcagugagccaagaucgugccacugcacuccagccugggcaacagagugagacucuaucuuaaaaaaaaaaaaaaaaaaaucaaaagcaagcuaguuacuucccagauacaauggagguauagguauuggguaaauacagccauuccaaaugggagaaauuggccaaaacagagggguuacaggguucaugcaagucugaaauccagcagggcagucaaauuuuaaagcugcaaaaugaucuccuuugacuccaggucucacauccacaucacgcugauguaagagguggguucccauggucuugggcagcuccgcccuuguggcuuugcaggggacaaccucccucccagcugcuuucaugggcuggcauugagugucugugucuuuuccaggugcauaguacaaguugucgguggauuuaccauucucgggucuaaaggucgguggcccucuucucacagcuccacgaagcagugcccuagcagggacucuguguggggucuccuucccuauguuucccuuuugcacugcugcagcagagguucuccaugagggccccgccccugcagcaaacuuuugccagggcauccagguguuuccauacaucuucugaaaucuaggcggagguuccgaaacuucgauucuugacuucugugcaucugcgcacagaacgccauguagaagcugcuaaggcuuggggcuuccacccucugaagccacagcccaagcuguauguuggccccuuucagccacagcuagagcggcugggauacagggcaccaaguuccuaggcugcacacagcauggggacccugggcucagcccaugaaaccaccuuugccuucugggccucugggccugugaugggaggggcugacaggaaguucucugacauggcauggagacauuuuccccauguucuuggggauuaacauuaggcuccuugcugcuuaugcaaauuucugcaucuggcuugaaguucuccccagaaaaugggguuuucuuuucuaucacauagucagccugcaaauuuuuuaaacuuuugugcucugcuucccuuauaaaacugaaugccggcugggcaugguggcucaugccuguaauccaagcacuuucggaggccgaggugggcggaucaugaggucaggagauugagaccauccuggcuaacaugaugaaaccccaucuauacuaaaaauauaaaaaauuagcugggcgugguggugggcgccuguagucccagcuacucaggaggcugaggcaggagaauggcaugaacccgggaggcagagcuugcagugagccaagaucaugccacugcacuccagccugggcaacagagcgggacuccaucucaaaaaaaaaaaaaaaaaaaaaaagaaugccauuagcagcaugcaaguguugagugcuuugcugcuuagaaauuucuucugccagauaacccuaaaucaucucucucaaguucaaaguuccacagaucucuagagcaggggcaaaaugcugccagucucuuugcuaaaacauaacaaaagucaccuuugcuccaguucccuucaaguuccucaucuucaucugagaccacgucaucugaauuuuauuguccauauugcuaucagcauuuugggcaaagccauucaacacaucucuaggaaguuccaaacuuccacauuuuccugucuguugagcccuccaaacuguuccagccucugccuguuacccaguuccuaagucgcuuucacauuuucgggugucuuuucagcaacgccccacucuacugguaccaauuuacuguauuaguuuguuuucauguugcugauaaagacauaccagagacuaggaacaaaaagagguuuaauuggacuuacaguuccccauggcuaaggaggccucagaaucauggugagaggcgaaagccacugcuuacauagugacagcaagagaaaaaaugaggaagaagcaaaagcagaaaccccugaaaaacccaucaaaucucgugaggcuucaucacuaucucgagaacagcaugggaaagaccagcccccaugauucaguuaccucccccggguccuuccuacaacaugugggaauucugggagauacuacucaaguugagauuuugguggggacagagccaaaccauaucaaaucauuaguacuguuugagagcauguucacuuuuucugagcugcuuauugcuguaggugaaagcaaguuuuacuccuuauaaacuaaaauuuagucauauacaguaccuaguuuguuagcaguguuuaaaauauaaaaagcacacacagguauaaaguauaauguuccauagcacauaagcugaaaagcucauaauuaauuuuuaaaauccaagauuuuaacuagauauauucauucagcaaacauuuucauuaguuuucugugaauauaagagugaaaaguuacuaucccuguugucaugcaaacugacaauugcaaugcuaugugauauuuguauuauuggggauauggacaacuagagguauaugaguaugcaccucagugucacauuugggccuagauaccuccucugccuucuguuagcugugucaccuugaauaacacuuuuaagccucuuaaaccucagcuuggagaugauaauaguaccuaccuucuggugguuguuggggaaauuauucaagauacugcauauaguccgggugugguggcucacaccuguaaucccagcacuuugggaggccgaggugggaucaugaggucaagagaucaagaccauucuggccaacguggugaaaccucgucucuacuaaaaauacaaaaaguagccaggcgugguggugcacgccuguagucccagcuauucgggaggcugaggcgggagaguugcuugaaccugggaggcagagguugcagugagccgagaucaugccucuguacuccagccuggugacagagcgagacuccaucucaaaaaaauaaaaaauaaaaaaaaauaaagauacugcauauaaaauaccuagcagaauacuugguggaaaacaaauguucaaaacauauuagcuauuguuauuguaacucuaguagcgaaaggagucucuaagugugucuugggcagucaaggaagacuuugcaaaagagguagguagcauucaaagugaugcucaagaaaugaguguagggccaggcaugguggcucaugccuauaauccuagcacuuuggagggucgaggcaggaaaaucacuugagcccaggaggucaaggcugcagugagccauguuggugccacugcacuccagccugggugacaggugagaaccugucucaaaaaaaaaaaaaaaaaaagagaaagaaagaaaugagauuaggaguuuuucaggaacacaguaacagaacagcauccacucaaggauagaauuggaagaagugauagcauguuccaggauuuugugcaucaguauuucugaagcauaagaaccuggucaggcaccagaucaugagagaccuuguuauccagaagauggcauuuuuuuuuuuuuaauuuuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccacgaccccaccacaguccccagagugugauauuccccuuccuguguccaugugaucucauuguucaguucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugccugugucucuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguauaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacagucaugucgucugcaaacagggacaauuugacuuccucuuuuccuaauugaauacccuuuauuuccuucuccugccugaaugcccuggccagaaccagaagaaggcauuuuaauugcauacucuguaccagucaucuccuaaguggaacuuuuuuuagauagcuaauuuaggcaguuuauugagauauguuaagaaaguguugaauuucuguugauuuuuuuccuuaucuuguuauaauuugucuuauaauauucauguuauauguguaauauauuuauaaggcauuaaauauuaguauuguaaguacguguauguaauuugaacgugauagucaaccaguauacaauugugacccaauaauuguuuuuauggcugguguuuguucuaaucaguaauggcauguuggcaucuguucagauugauuguugccuuguugccuggcccuaccgguuauuaacccuuuuuuuuuuuuuuuuuuggaguuggagucucacugucgcccaggcuacaguguaguugcacaaucucagcucauugcaaccucugccuuuuggguucaagcgauucucaugccuaagccuccauaguagcugggacuacaggcgccugccaccacaccuggcuaauuuuuguauuuuuaguagagaugggguuuugccauguuggccaggcuggucuugaacugccgaccucagaucauccaccugccuuagccucucaaaguguugggauuacaggcgugagccgccaggccuggccuuauuaacacauuucaaucuuacuccuguaaauauaccagaguggcacugugugcuaauauuuuguaacugaucaugggccuguugacuacucuucuggaagacagggagccauuacagaacuuugggcaagagagugaaaugauuaaaagucguguguuagaauucacugaaucauccugagggcuaaguuagcauuggaaaggccauaggaggagcuaucacuuccuaauuuauuuagguguaagcauauagaucauaguucagucacagacaucacccaucuugauggaagacuuaugaaagaagaacaugauuaguuuuaacuuuuucaggauuaauaaguagaaaggauaggagaugaauuuugaaaaaaccauugcaucacaucauauaaugauauaguuaccaucucugcuaaaauacaaaaauuagccaggcgugguggcaggcaccuguagucacagcuacuauggaggcugaggcaugagaauugcuugaacccgagacaaaaauuaaagacuguucuuucaaaauauucugagaagaaaggaaaguagauauguuuaggaaauauuuaaucuuauauuaauuauuuaaucuuaucagucugcaaagagaugccccucccugucuuuguucuuugucuucauguaugaugugcuaguuauuuaauauugugucucuuuugugcuucggauccugaaugaccucagcugaaguuucuucccuucuuccagguuuguuugauacuuaaauauuaaguauuuaaauauuaaaaaauaauauggguaauauuuaaucuuaauccuaaugaccugaauggcaaagacacuguacucuuggagcagauguccagacauuggccugugugccaugccaguccugugcagauugucugaacaucagccuggagagaaaaugaauaaauacauuuuuaacaauuauuuauuuauuugaggaucuuaaagaguuguuagcuauuauuagggucuacuacuagcuccucccauuuuaaaucauuuauauuugucuucuuucuuuuuuuuuuuuuuuuuuuggagacagggucuugcccugucuccuaggcuggaguucgguagcacaaucuuggcucacuguaaccucugccuuccagguucaagcaauucucuuguuucagccucaaguagcugggauuacaggugugcaccaccaagccuggccaauuuuuguauuuuaaguagagacaagguuucgccauguuggcccagguggucucaaacaccuaaccucaagugaucugccugccuuggccucccgaagugcugggauuacagacaugagccaccgggccucccaaagugcugggauuacagacgugaaccaccaugccugacccuauuuuugucuuuuucaguugugaauuuuguaguuggaggaggaauuagaaaauaaucuccuaucauuguuaauauguaaccgucauuugcaacaaauggaaauuuaauucuguuuuugucagugcggugagauagcaucaaguauacccuucauuuggauagauuagucaagaauuuggccgggcgcgguggcucacgccuguagucccagcacuuugggaggccgaggcgggcggaucacgaggucaggagauugagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaagaauuuaauacuuguaugcucacaguggcaaauuuucagcauagucauuuuuguuaacuuuccaaaauguugucagaacgugcugucauucacucucauucaaucuccugaaaguuaacuccugucucauuuucugugagaugauccauguuuccuguuacacacacagucaguacacucuuaguguacuagucucccugcacaccuuucagaacaacauugcuuucaguaguaaaaauggaaagagagaggccaguggaguaaugugaggaaagaaggaaaugggugggcugcgggggaaaugaucaguuccccagaaauggucgguucuggagaaggaagaggauaguucuaaaauuugggcauaaaacuaggacaucaaacaagccuggaugaagggaagaaacuucagcuggggucauucaggaucuggagcacaaaagagacauaauauuaaauaacuagaacaucauacacaaaaacaaagaacagaaagagggaggggcaucucuuugucaaaggaggacaaugugaagaccaggaacaagcaggaauggagaaaaugaucuggucuuuggaucuguguugcagacugaugauagguucugucucccccgccauuuccauuguggaagagguaugauguagcuggaagaaacuugauaaaguauccuacaaguaaagcccuucgugugugccuuugccacuuuccauuauguggaguuuuuuccugguguuagauagggcuuuuuuucucuuacuuuucuccaaacuuugucuuuuggcucuucguguuaaucauuuugccagcaggaguuacaagauuugguuuugguuuccacuuuacaccaguuuacacuuaaaggcaaacauuuaauucaagcuuuggagaagguagagaagguauaggcauaggugcuuuaucucaauauaaaaguugggggcagaaucucaggagauggcuccugagcuguucuuagauguaucacuuuauuaauucuuacaauaaagccaaauugaauugaugucggcaugucauguucuaacuggcuuuaauaauuuuuuucuuuggcugguggauggagaugguuuugaguuauaaaaaaguaaagaacgugagugaggaaauccuggguuagcucagagacagcaggaggauuucugagagaguggcugaggaaaaagcaauccauagacuugccaauggacacucauuaaauguuaauaggaacugcaugugaugaaaggcaggcggcucuggauucaucuuguaacuguaugucuacaacuggaggugugugaaugaaaucaaggaaaggcauuaaagaaauuauuuguuaggaagcagaagcaagaguuuguuuacuuucauacuaaagagaacacuaccagcauuugugaacugcaugcacaugagaagugagcaggcuuccagcucaguggcaggugcaagaugauguuagaaacaaaauaacucuuauacuugaauaaauucacaagaagguugugagucccugacacaguagguauguaaaaccacguagcugacaucaaggccuguugcacuuuuguaaccuccuugaaucacuggagcgagcagucccuggugaugcagcguguugcagggcucugugccuugauagggaguugcaccugugauacccgaaaccuccuuacaaacuccccccgccaccccccaccacguuguccuggaucauuggaaugcaggcgcuggauugaaacguuuauucauaguagauuaagagucuaaguaucugugaggccucacuuaggaggcucuuagaggauuaauaaaauauuuacaaaauaaccuaugcaauugcuucauuuuaaagauauuugccucuuaucacagcauaaauccucauucaaguggcuucucuguucugugaaggaaguucuguacuuguucuucuggagaagcagaaacagauuccugccauacuuuaauuaaaaacauggaagcgccugguuucuccacacgugcacauucuuguucuuacacacacagccccaacaaagagaucaacagagggauauaaaaugaucauuuuugaaaaagacuuacugauucaagugagcggcauucacauguaaaauguuccgaaaauuuauucuguuauuuaugauaaagaaucuuaucccugcauguuuuaccuauaaccaagagagccucaauugaucaaaguauaguuuuucuaguaauuaaaaaugaauauugauguaauuaaaaauguuauccuuaaaagucuauuaugguacuuacuguauacuaucuugucugccgucuugguagaucaaguuguacagucauauuucuagauguaggaucaagauuucaguuaauccuuggguuuaugcuaaggccacaaguauguauuaucuguaugaacaaccauuuauggagugccugccauaugccuagaauuccgugaggccuuucacgaguacugcugugucauuuaauucaauccugauaauaacgcuaaaaaucagggauuucucaucuuguuuuacaccuggguaacugaggcucaggguagucaacgcagaucauaguaaguaaaagacucgguguugaagcaccgcucugugacuccaugccucauauaauagaggauugcauuguauuuuguuuugguuuggguuuuuugauagaaucucacccugucacacaggcuagagugcagcggcaugaucucgguucacugccaccuuugccucccgaguacaagugauucuugugucuccacccccugaguaacugggauuacaggcuugcaccaucacaccuggcuaauuuuuguauuuuuaguagagacgggguuucaccauguuggccaggcuggucucgaacugcuggccucaagcaauccacccgccuuggccucccaaaguguuaggauuacaggcaugagccacugugcccggccuuauuuuguuuugacuuuuuuuuuuuuucuguuccguuuuaccuccacuuauuuccaagaagggagaauuucaggguuguuagaaccagagcuuaauccuuuuuuccugauggccagugcuuuguaauaacagugaucuuuuacugaauuucccuucaaugauguacuauugcucuuguugucuugcugccuuuuaaauuaugacuucucuauauuauaacuuaaaguugguacuuugauaauuguuaucaacuuuaauaaaauauguauuagaugacuuaaaauuuaccagaaaucuguauuaaaauagucuuuagggcaaacaaaaaauuaccugacaacagucuacucacuugcacgugcgcuuucccucucuagguaauaagauggaaauauuuuuaccucuuucauuuucuuucucaaagccguuucagaaagggauaauguagcuggcagcuguggccauaggaagucugugcaaucugugguuuauauacaugaaaaauauaugccaaaauauaugcauuuacuaugguuuuuuuucuuuuuauuuguugauaaggugcauaagccccaacuuuccacuagacuaacuugugauuaauugggacaucuuuguucucuccaaugugggaucuaaaaaccagccuccgucuucacuguauggcagugcagcugcuguuugcaugcuguuuucuuuguugcuaugugugugggugccucaggcccaaguccugaguccccauucuccugccguguauugcuuguguuucuguggagaauuguaauguucuuggaucagggacuuuuacaaauagguguguucuuccuaguuggcuuggagugaucaaagaccaccauguuucauuuugcccagagccuucgaaucccacccaccacccucaguaaaauccuuugcagagagcuuuacccuaaagacacagaaaacaaaugcaacaccugugacccuaagagcauuacuuacaaaggccuggaaacucccugaaugcuguuuauaaaguacacccucaguuguguuucuuguuuccuuucuagcuacaugugagcaugaaacucuuuuguagaggugcaggaaggucaugcuauaggagaacgugauugcacguguuagaaugcaugcuaggacacaggccgauucaugacacugaauucugacucauccuaagggagaggaaaugcauguauauggauguguuuuggcuucuauuuaacucuauaauuguuucuuuuuucccuuaaauaaggauuucuucuugauuaaugguguuauucacaagagacuguaggguuucuguacuugcuucacccuugugaaggggaaggaauguguuuucuuuugccaugucccuccucaacaggggugcucuuauuaaaaccaggaaacuaaacagaaggacggugcauguauuugcucauuguucucuccucgugcuggacuugagcugaaaugugguuucagggcuucaugugugcacugagugauggaguaauuaagugagguaaaugcauaugaagugcuuguucccuuggugcccggcacauagugagugcuuaguaaacaguaguuguuacuuuucauuggagccaaauguauaucacaccucccuuucuguaauacauauuuaugauagcccauuaguuaagucugaaggucaguguguucuugccauagggcuguaggaaauguuuuuuguacacuucuacauguaguuggcggauuguuuuuuaaaaaugcuaccuacauuguuuuccucucccuaaauuaucucaugacucuagcagauugcuauaaauaaguaggguauaucauauuuguaggccaagaauugacaacccaguuucagacaacaaugaagauuuucuacccuauuugaauacaaaaucaaaaccaagauauuuguuaauaucccaauauugauuuuuguuauuagaaguaaauuuuagaaguaaauguugaaaaggaccacaaaagcugcuuuuccagccucuaauggaccagcagccucuuuugggaaaugauuaguugcaucuuccaauaaauaacuuuugauauauuaaauacucauuugauggcugcucucuaaaggaaaugaagcuagcauggucccuuggcuuccaugagccuuaaucucauguaucuguuauugcacaguuuauaaugguagggguuuucccccuuaggacugacuauguuuucaguaauguuauuuuuuuuuaacucaaccuaacuggacaccguagagggcacuaauaaaucacaccucucugugcucaaauaaagacagacauucuaccucuuucucccaccuacccacccauuccuggaucgagcaacagaacugagcuuaaggccaccuagagccaccaucacagaaucucucuuuauguuggauggcaguggggaugcagaucugaaacacuagugcaucugaaacaacaaugggaagguguggaaaaaaggguuagcaggccugagacugcccucuuuagggaggccugcuugccagguuggcccuuggcuggcauccaggaacuuggauuuugggaguauucccaccauuuccucaccugaugaaagaguggcucauugcuucuacacuguaaauaauaugcuuuaugccgaacacgcgcuuuccuucugggaaucuggaauuuugguccaugcuaggcaaagcaugccuacgugaccacucccacaaaaacugugggcacugaguugcaaaugagcuucccuuguagacagcaccucacaccuguugucacaauuuaaugcuggagaaauuacaugcauccuaugugacuccucugggagcaccacuggaagcgugcacuugguuuccccuggaguuugcuccaugcauguugcccugugcugaugcugcuuuguaucccaucacuguagugagucuuaggugugcguaugaccacgugcugaguccugugagucucgcaauccugggacugaucuuagggaccuggacccccaacacaggucccuaaguaaguuaguccccccaaaacuaacuuacauaagauuccauaugaggagaaaagucagaaauucagaaggugugccugaaaauuuuuucuauugacaccccuuguuccauaugaucuucuuccuaaggacuacuucauuuugucauugaguuuagucagugaauauuuuuggaauauaauguaaucagguaggcacuucuugcauauuuacauauuacugcaaauucauuuauuguucuccacuaccauuagaacugagggauaaaggagagagacauaacacaauguucguucucuuugucucucucucuccccaccacauauacucacacauuuucccugcuuucuacuauugaauaauuagaaaccaguacuaacuagaauucuucuuacugauaaagugacaguugacccucauauggaaauucuuuaugaguuaacaaauuaaaauaaaaauuaccugaaauuagaguuaaauuuuuugauguuuuuuacaauauuccaccacugucccacuucuuggauauuuaucuagaauaugucuuucccuacccuaccgacagauaauuugcuagaguuuuucaugucuaucuccauuuucaaggacucuuuaguugcuuccuuaucaggacaagaaagaagcagaagugcugcuaggaaauaucugccagagcauuuggggagaaaguacaggacagagacuggaugcaggaguggcugcuggccaccagugacuuuaccugcugcucuuggccugguaggacucugauuuuuuuuuuuuuuuuuuuugagacggagucuugcucugucucccaggcuggaaugcaguggugugaucucggcucacugcaagcuccauccccuggguucaugccauucuccugccucagccucccaggacucugauuuugucugcaaguguucaccucacauaaacuuugccuuuuugaucuagugggguaaccuucaugccuuacuccaaagaaaauugaacauagagcaaauagaacaugugaauuuauaggcaaugucuauuugagacuccauaaaaacagaugcugaaagaaagauuaggugacaaaaauguugccuccugacuugguagguaauuacaaguaaaaaaugaaauguuuuccaccuucuuuucauuagugaaauuuugaccuuaauuucauguuaaacuggcauuaaguccuugauagguaguugucauguaauaguaccuuuucuuccucuaauagauaugaugaguaagaacaaaguccuccuggugauuuagaaaaucagcuaccuguugauccuaagcaguggcuugagcucuuucauugcacuguaguucacagagagaagcaauucacuaauuauaaaaguuggaauaaggcaagcuuuuuuauuccauggaaccauuauagcuacagauuuggaaauaacaaaugcuacuagguaugaaaaguaaaauaagugaaagccuuuuauauuuuauaccuuagacugccugaaguuccuuguaugauuuuuuuuuuuuuggagauggaguuuugcucuugucucccaggcuggagugcaauggugcaaucucggcucacuacaaccuccaucuccuggguucaagcgauucuccugccucagccuccugaguagcugggauuacaggcaugugccaccaugccccacuaauuuuuuguauuauuaguagagacaggguuucaccauguuggccaggcuggucuuaaacuccugaccucaggugauccaccugccuuggccucccaaagugcugagauuacaggugugaaccaucacgcccggccaauauuucuuuuaaaauacauuucauauccauucauuaacauuguuuuauuucugugcuuuccccuacuccccccacucuguguauuuucuuuuugguauaggagcagagcuccauauuaagaauuaaauggauauauucaaaauuaauuagucucuccuuucauguaucuauguguuuauuuucucuuggccauuuuagucuuaccaagucuucuguaaaagaugcucucuaccacuucucccucugccccaccugcagaugcugauauaucucaaacucuggccaggacucaacuacauauuguuuugguuaaaguauuuuaaaugugcuaauauucaguuucaccauugggcaguucaguuuuugcccacaauuggaaauugccucuagucuaucagcuuuuaaauguauauucauuucucacauuugcaccuggggcuccguuucucauacuuagucucuagucccugcauuucuuuuucuuuccaacuuguuuuucugagauagccacucuuuuucucucuugccauuuauuuuuacauuugaggaaauuuaaguuuuugcccuuaaaacuauaaacaauucuguaacaaaugaacuaagaaucauaggcucaaccaaggucuuaaaauauuuucagaaagaugaauauuuacuuguauuagaaaauauuaauauucuuauuucugaguauauuauguaaaacuucuggauaucuacauuugcaaaugugacugccuaaucagacauugaaaaacagguuuuaggcucacacuggcuguuuuuguuuguuuuauuuuuuaguaaggaugucgcuaaagaagguaguugaguuuacagaaguaacaagugguuaguuuucaacagaaacaaauuagguauaagaacagcauaauucauaaaaauuguguuguguggcucacgccuguaaucccagcacuuugggagacugaggcaggaggauuacuugaacucaggaguucaagaccagccuaggcaacauaaugagaucccaucucuguacaacuaaaauaaaaaauuagcugggugugguggcacaugccuguaguccuagcuacuugagaggcugagccaagaguaucgcuugagccaaggagucaggcugaagugagcuaugaucacaccacugcacuccagccugggcaacagagugagacccucucucuaaaauuaaaaaauaauaauuguauuauaaaugugaugguuuuaguaccauccaagcucugcucuagggguagaaagauguguauuuuacagacucuguacucagcugguuauacuguaagggauuaucugagauuacauguggcacauagauauaaaauagaaugugauuaaaaaaacacaaaaaaaagcagaaugggacuucugaacagaucacagaauucaagagagagagauaacauuugauaggugggccacaaaugauuccccagcagacugaugacagaauucuaaguagaagagguagcauaagcaaaacguugguggugggaguauauaguguguucacugaaagcuaaguucucuaguucuggugcagugucagaguguguaugugagaacuaagacauaaaagguagauuggggcaguucuugaauggcagcauuaaagaauuuaugcuuaaaucauuuagcaaaugggaccguugagguuuuguuuguuuuguuuuguuuaagauggagucuacucugucacucgggaaaguggcaugaucucagcucacugcaaccucugccucugggguucaagcaguucuccugccucagcugaauauggaaguagcuggaacuuacaggcaugagacacugggcccggcugagguuuauuuuaaagggaggaguuguaauguggucagaggugcacuuuagaaaaagcaccuugacaccagaaugucgucagaaugugaguggggugaaaggagugaauggaaacaaugagcaccuaucaaaauaauccaguuaggauguaaugugagccauuacuaagcuugggagaauagguauaaagagauagguauaugaaacucucuuaacucuucaggccuggauuucagaagaauagugggaaauaaaguaggagaggacauugaugggguuuggaugggugugagcaggcaggagugccuucugugaagagcaucucaguggagggcucaacucaaacugcuucuuugaaucauggcuucgaaaauuacucacuucaugauauuagacaacuuugacgcaccucaguuuucccaucucuuaaguggguuugauaauaguaucucaagccugauuuggguauagaugaacagaauacauaucuauuaccuagcauccuacuuggcucauuuucaggccucagcaaaguguagguacuaguauuuuucuuucauuuucuuugcucuaccagauaguuacuuuuaaucccauuucauaugugaggagaccaaggcacagacugcauuguuuaaauccguccaguagccucugugccuuuauguguucuagguuuggguuuaguuuuguuuuguuuucagaauucagauagaaguucuuuuugagcaacugauuacauugaucuguaggccagaucccuaaagacauccuuagaguugaaguuuuccuuauaaaauagauugaacagaugcagaacagaaauuagaaauugcaggaaggaggggaagaccagaagagaauucaggaauuaaucaauguaaaaaguuauuugcagaagauaagaugaaggaagaaaguaugcgcccacgaacauuuauaauuguaaugguucugccaggcgugguggcucacaccugugaucccagcauuuugggaggccgaggcggguggaucaccugaggucagaaguucaagaccagccuggucaacauggugaaaccccgucucuacugaauauacaaaaauuagccgggcauggcagcaggcgucuauaaucccagcuacuugggagaauugcauuaaccugggaggcggagguugcagugagccaauaucgugccacugcauuccagccugggcgacagagaaagacugucuaaaaaauaauaauaauaauaauuguaaugguucauuauuuaugugucuaauauuaaacuggcucauuuaauucauuuauucacuccauaagccuuuacagaacugccaacuauaugagagacaguguugcaguuugcugauuuuuuguacacugggauuuaccuuugaucaagaaaauguaccacauaaagguaaucucauucccaaaagcauuuucuaagaauagguaacuuacugguacuugcaggggaaaaaacaaugaagauuaaauuuuaaaauguaugcauuuugcaaaaacugucauucuuaacuuguucuucaccccuagcguacuaguaaugaugcugccucccugcaccauugguccuggggaacuaguuuacauuuuuaggaaaagcacucgaccaggucaggucagcuagauucuugucccaagucagcuacuuacacuuuagccuccugaucuugagcaagauacuuacuuguuaauuuccuucuauguaaagacaaaacauggcacuagaugauuucuaagcugccucccaaguccuacauucauagcauuuauaaacucugugagcauugagucuucuuggcaguggggauaucaaggacgauaaaccugaaauaaagagaccuacuugacagagaaauauaagcagaucccugaaauauaagcagaucacugaaggggcaggucauuuuuaaugggagugggaagguggaaggaaaaagauaggagaggaaacauuucauggagagguuaauuucaguugggcuuugaaguaugaaaaugggcauaccagaaaggcagaggggugcagagguaggugagauuuuguaguguucaggaucauuuauggcaaguaggucuuuguagcuggagcuucagaggucuuggcaggagaugauguuagaaauguagguugagucuauauugaggggacuucagaugccagguaagaggauuuauuauuuauucuguguacaauagggagccaugaaagguuugcuaagaaggggagugaaauauucccaaccucauguuuuugaaauuugaugaaaguguguagaaaguggauuaaagugaguagggaaauccugcuauuuuuuuaauggcuaucuucaucuguuaacuuauacccagguaccuuuuggcauuuauauugauccuuccaggauugcccccauuucuguaaccagcaccgauuucaccaacucaguaaaauccuguuggugcuuaccuucuuugagguggcaccaugaguuuaucucucuuaauugucuccccuaaacacacauuauuuuccccaggcugcaaaguagauauaucauuagcaaaagguaaaaaggcaacgaaauccagccuuaaaagauaaaguuaaugauuuagaaauucacuuuacucagcuguacauccauagauagccuagauaguuaaauaaaucaggaaagauuuuaaccccuuagugguugucacagugaugucugucuuaacuggcaucucaguccccuuaacugcaaagacuaaaagaaaagaguauggcacuuccauuuuucccugcagcaccugcucaguugaaguugcauugcuuucaugcaggacagacacugagauuacucucuggggaucagaacccgagggguugugcuuagacucccugggcaaggccugucaacucuggcuuucauguuucccuuuccuuuugcugcagcuguuucuuccagccuguucagcaagugcaccaagaguuacuguaugguguacaugcauguuucuaccaaacagcuuuaucaucgguguuagaagccucucuguacaaaccuguggcugucauaaggcgauuugauuuaagcuuucugcaugcccaauuaauugagaguugaaagcuauccuucagauugguguggcccuguuacuuaugcuugccaguuaucagccaccuuggugucauauaguggaagcauuuugaauauuuuacaucugaaaauguuuuaagauaauaaauggcagucaucucagaaugccagauguuucuuccuguucucacacaaacauuuauuuaccugauaaucugcagaaucauagauuucagauuaaaaacaaauucuucuaaauuaucugcaguugaugcagucugucuuuuuuaaauuauuauuuaaagaugcucauuuuguccuaauuuucccuguaaauuuuaucagagcagauguggucacugugaugcagcaguggccuaaacuaauuucacugauguaaacauuguuaaacaauuucaaaugcaacuuuggaaacauuguuucugaaccuguuuaauaauguuuaaaaaugcaucaaugaaauuggcuuagccuguggccuuuauuacauuaucuguucucaauuacaaagauucuguguuuuaugucuggacuaguuauaagucacugaaaaaaaaugaugccagcugaagaguguggcuuauaccuaacccguuuaauuugauuuaaaauugaugaaccuuggaaaauacuuccagaaugccauaucagcuaucaaaauaauaggaaauguauucaggucaucauauuggcauuacaauuuuaguuacccuccccccccgccccaccuuuaacuuuuauucccauugcuuuucaccucccauucacccccauuuccauuguugugauuccacuacuaaauuccaagcuaucagcucugaaaugcaacauagaacauuaaauauguuuuuacuaauugugauccgcuaaaauuuaagcucugugccaaagccuuuuuauuuuuauuucagaaguaguauuuaagugaugacaugcaguaauuuguucauucuucugucaguauaauuuacaaggcaauggcagauaaacauagcaauacaagauucauuuacggugacacaauggcagauacacagagcagaacccugccuaugagauaaaguggacugagugacuuaugcaguaauuaggggauaauugucauuaaccucacaaacaguaguuuacccauauuguuuaaaaggcuccaggaugcauaaugacaagguaaucugucaaagcgcuagggggaaauauuaauaagauuugugcaagccuggauagaaaauaugcagaaagcggccacauuaagcuaauugguggaugaauauacacuuguaaaagugcuucuaauggcacguuugcagcucuccaaaugacuaccguuaauguggagaagugggcugcuuagaaagucaggacugcugggacaagaggguauuaaggcacgcagacgccguuauuaccuugugcucuauaauguacgcuuucuccuuuuauccuuuuucauuuugaauuucugagguuuuguuauaguaacauauauugauuguuuacucugauuauucuguauuugaucuauauuucuucagucagccaccaaaccccaaacaccucucuuuuguggcccaauaaaauauauaaucucuacguugauaguggcuuauuaauauacagaaacacaaacuauuaaugcauauguggauuuauaauuauacacacauguguaugugugggugccuuuuauaggaacacauuuaaucugagcaaucaaaggaaaguagauccauuaacagccuuguguauguguuacaaguaauaauguguuguucccugaugaaugcuaaagcaggaaauuaaucuuuguguucuacggcuauucuuauacccagaaaagaacaaaguuaaaucuccuaauacaucuuucuguucagucacacacucaguccucaguguguuuuauggaauacucaauccucacuguuuuauggaauacugcuuacuaaguauuccaucccuuucucgcccugcucccucacauccuaaugaauauguuaaaguuccuugggguuguucaaucagcuucauuuguaaaguaauucaaaguauaauaugugaaggagaaucauccauucaagcuuuggaaguucuauaccaauaucaguaaucuugauugugcagauggaaccuuauggaaccucaaagauaagagguuguagccuugaauuguucaaguuuuggcccuuacuugauguguaaaaucaccaucaucauguaaaaaaauuuuuugcgccuauuuuugcuguuuuucagacauuguggaaaagcauaucuggaaaucccagggacucuggcauuuauguuuagaaauguaaagccucaacuaucuacaaauuuaguaguggaacuuugguuuaugcaaggagagguaagcuagaaaauguagaccucaaagcaaaaaugucagagagggcucuggugaguucuguuuauuguaaagcaagcagauuuauagcuguccuaagaccagggauuuaucuuuaugucugaguggacaagaaaacaaggccgcugcagggacugucccuuucuuuccuccuguuucuaguguuuuccuuaaggaucauaaacgguuccuuugcuguucuaaacuauaaaauaaguacccucuagaaucuccacuaguuaucaucuccauaugaagaacuauuaaaggguuuaauugaggugagggucuucuguacaaauacugcuaguuuuuggagcugcaaagauuuccgaaagacuaccgauauuuguuuacauaguuuuuuugauauauaacauuuauuuuguaccuucaaguugcagaauguucacaaacccuacugguaugauuuggggguuuccaaggccucuuagggagucuuugggcaguuuccuuaguuuacaagcagaauuuuuacuugaacugauugaugauugaauugaccaggagucaaaauuaauccaaaagaauuagugacuguaaucacaucacugacaagcagcaccagacagaaacaucaggggaaacauccagaauauacgauaauacaggaacuuucagauaaaggcauacuuucagucauaaauacacauauucuaaaaauacguugguuacacaaguugguuaaaaguaaaaggguuuuaacauuuuaauuaaagugauucauauguucagauucuaggcauaaauaguagaauaauagaauuguaaagcugaguuuuuaguaaggcuuacaaauuuuaguaugacuccucuuuacaugugaacauuaauuuuauuuuccucugagguugaauuuguguauguuauauuuagccuaaucaagauacaaaaucugcuuuagccuaaagguauagggcuagauauucugugcuuaaguuaaggacucauagguaauuugauuuuaaagauugguauacuaggaauaucaacuggauuuaguauuuucuauuuugaaacuuaaaugauuccuaagauauucuuauuaaauauuaaaaugugucuuuaaaaguuucucagguuugauuuacaaugcagcgagguaacuugaaaaauacuuuggaaucuuugaaguccaauuccagacauugcagaaaguaauuuacuccuuugaauuuuuuuaauauggcaaagcaaggcaccugcuuuauuuauuugcaaacaaaugcccauagaggaaaugcauauggcugguuuuaagcuagacaagcuaaaauuccucaguacaaggaagaaauccugacaggccuguaauagagcuuagcuggagcuucuaugauuaaauauguuguaccccagagugaucuaucauaaucacuguuuuuaaaauaaaaacgcuguauagacuguuacugaagaaaaaaggcauaguacucuaugaauuauacauucuuaucugguccguaaucaagaacauucuguaacaguaaauuuuuuaaaucaaaugucaagcaauauuuuaaaaaucagaagaaccacaugaaacuagugcccuggcauuuugauaauguuauuuugguuagagaggugaucauuuuuggagaguauauuguucaacuugugaauacauuacuucuuuuaaaaauauauccuuuccauugugaaauuuuuuucaaauauggaucagaaaaaaauuauaaauauuuguauacugggaaauauaucaaagccacuacuucaaagucacauaaaauuaucauguugcuucuuccuucuaaaaacuagagucaagggccaugcuccucaaacuuccacuuuaauccaaggagaggcauucuuuugacuauguacuuuuuuuuugcuaguaguuugauauaccucaccucauuauaucaccauucgcuaaguugaagcacuuugaaugcuauaauaagagugauuuauaaugagaguaguauauaauaagagugagccaaggucaguaguuucuguauuccuguguguguuuguguacaugcacauguguguaaugaguaacuccuuuaaaguaucaaucuuuauaugcagucaguguuuacagaaagaagauuuaauguuaauguuagcaugucagcuaacaaagacuaauaaguuauuuaucuugaugggaacuucuuuaauacaaaguuuucugagagccccaacauucuaacuaaugguggauauuccuguagcauucauuuccccuugggcagaggaagaauaggaaagauauuucaaauuaaguccuuuauuaucuggaugaacugaauguagcauuagcuguguaaucacagcaagcugguauacaccuaucucuaauguuugcauacuuacuucaugacaaaggcaguuugggguggaugaggaaagcauauuuguucacauaggucaauguuaacaaguaaaguccagucugaauuuuuauuucgaaaucauucuuucugcccaugccacacccugaagacucucacucauggggcaucccuguccuagagaggagaguagggaugugauuggucagcauuguauuuugaagguaaagggaugcuguugagaaauucugcaaaauacaaauuuccaaaucaugaaaauugaguagggcuuucguuacccaaaacaaauguugauuuaaaaaaaaaaaaguucuaauuugaaccauuugguacauacaaccgugauaugaaugaguauguuucauucugccuacaaauauuacaguuguuccagcuggccuccuagaaacauuagcccgaaguucuggaaaagcacagucacauaaaagagcuuugugugaauagagaaugguguaauuuuguuuacuuacacaagcaaagugcucugauguauauuguguaugcuagcggugcaucuuccuccgucagugcccagcaagaaauauguguuuaauguaaaucugcuaaaacaaauaaacaugccaaguucuuuuuccacgauuuuaaguguuucucagaaauuaucaaaacauugcuugaaaaauuucccuaaaugcuucccagaaucuauuguuuucaaugagaauuuuuuuuguguggccauuuuuauucuucuccccaucuugccugcucauacuuacacacuugcaggcacauagacacacaacauugauccaugcacacuuuggaaagccaagucuuauaaauuagagagauaaacauaaucuaacaaaaaagggaaaaaaugacucugaaauaguagggagcagucagaucaguuaaacuuuuugacugaggguuuaaauacuggcuuuagaaugacaauuuaagguugaaauaucugcuuauuacauauggacccaucucaguuacaaaacagguaaauagcgggagaaugagagagaagaggacugcacauauuauguauaaguguuuucuucagaacuguuuguaaugcucaaagguuucucuuccacagaauaucucccugaaacuccugcuuucagcacucagagccaccucuuuccaacccacaugugggaucuaggaguuuuccauuugcugaccccuagcuagaaguuuguugaaugccccuguucauauuaccugagauaauggucugagccuaucacucacuccugaggugauccagaaguuagaugguauaucuccuaauuucugggucacauucugauacauguccaccuaaccaagaggucagcacaccggcagguguaggcaagcaaaggcggauuaucagugucuugcagagugucugcgaaggugugugugcauagcacauaccugcuauauauugguguuagcucuguagggagguagucuccauaguuuuaugauuacacaccccauuaguaaaaauuugugagcauguacccccauuuauauauauguaaagcuguuucuaaacucuguguguguguguguaugaaugauacuagcaaaaaaucaccuuuagguaaaaauaaauaggaguuuucauguugacucaccaugucacaguggauugucuugcauauuccacuaauaggagcaaaugggagcaugugugccugugauuuggccgugcuguaauacaggaggaaaggaguaagguggcuuauaaacaguggaaagcuguacauguugaguuaugugugugagaguucaagcaauuugcgugauuuaauuuuuugaauuaacuucauugaaguauacuuuccauacaauaaaauccgccaauuuuaaguguacaaucuauguggccauaaaaaccucagcacaaucaugguguacaacauucucaccaccccaaaaguucccuaguguugcuuuacacucagucccuuuccccuggcaacuacuaauccacuuuauguucccauaaucuuaccuuuuccagaauuucauaugcuuggaacaguagcguauguaugucuuugggucuaacgucuuucauucuuagcauaaugcuuuugaagagucguccauguuguagucgguagcuuaguucuuuuuauugugcaguacuauuccauuguauagauaucucacaauuucuuuaccccuaagacuugaacaucuagaaaaccugguaaaauuuaugauuuaaguuuugcauagcauuguuucaucaauuuuuaauucagcaauuacuguuucauuuuaccuaauggaauacuuaagcuagguaggcuugaaauuugguaauuucucuacuuucuauccaaucuguuucucuugcuuugauauuugaauuaacccagaaggaaaaagaauagaaaaguacaauaggaaacugauuaugaaaauaaauugccaaugugguuaugaugaaauaauuucuuaagauagcacacugugccaaucuagacaugaaaaaauaaacauaucucacaaaccucugauuuuguuuuagguagucagcagucccuacaggucagugucauuuaauuaaaagcucuacaguuauaucaagggggaaauacuuuuaguuuuuagcuaaucauuuuaguauuuuccauuaaauuauaccuuaaacuugacugaaaauaaguucauaugauugagucuuuuaaacuguuugcuucuuguuuugcuuuuuuuuuuuuuuuuuuuugacagagucucacucugcaaccuucacuuccuggguucaagugauucucaugccucagccucccgaguagcugggguuagaggugcccucugccacaccuggcuaauuuuuuuguauuuuuaguagagacggguuuucaugguguuggccaggcuggucuugaauuccugaccccaggugauccgccugccucugccucccaaacugcugggauuacaggcaugagucaccgugcccggcugcuuauuucuuaacaauuugacuacuggagcacauaggccuuagauccgugcugcguccaguguuucuuccucacuuccauucuuggacagaaagaaagcaguuguuuuccuguaugcugugaugugaguuguagccugccaugaacacaggugggcuccuuguuggacugagcuugaggucccucgacagucugauuaucccaaagccccuuauuugguuucucuuccaucucuucacaucuguuccuucccuacuaucccucuuucccaauaagggaaaccaaucaaccuuauuuuacuuugauuuuaaaacuauaaaucauugaagugcuuugaugugggaaaggacucagauaaaaccauuuaaaccaugcauuugauccuacaacaaaaaguuuuaaaaagucacuuggcagagccauacaggaacagggugccagauuucuacaagugauaaucaccaguuccaaugaaguaacaaaaggaagucuuuuuauuucaaauguguagguguaaauauuuuaagucuuuuauacuuuuucugaacccaguaaaacugguuuauaagucuauauuauuugguguuacucaucuuuuaauuaacaguauagccaguuauuuucacaggaaaucaacacuuaugauaauaacucgcauuuaacuuaacaggguaaaucuuauuauccucauuuugucaauaacauuuuucaaccugaaggguuaaaagucacuguacucugguuacaaaugggaaaaccuaaaagaauugacuuaccagcuacaaaauugcagggagggccaagaguucaguuauguacucugauguuaacauauuauucaugcauaagaccaguggcccagcaugaguuggucgguaguugggaucuucguccuagccuaacagacugaauuuuuguuuuauuaguguuuauuccacgauaauaccuaauucuuuuuauagcuccaauuuacuuuuguaaaguuuauuugacaauuuauacuguuugcaaggaggacuaguuuuuccaauacuuaaguuaaauacaauaaaaauaaauugacuaaaaaaauguaucaugccuuuaguuguugcagcaguguccacuugucccaaauuuuccaaaugguuacuuuuguuccagaugaguuaaaaaaagaaaagagccauccaacugacauugguccauuuuugaauagcaauauagaccaugcauagaggucguuaccuucacagaagacucuuaaacuagugauucagaaucaaagcaccaaaccauacuuauuucuaucacaaagaucuucagaaaaaaacuuggcauuucuuuuuucccuuugaugcuuucuaacucccuucaacgagguuagucaaagauacaguaaaacugcuagccauucuuagcauccagcuugcacacuuguuagguuguguaagaucaauuuguuucuuguugcagucucuccauuuauaaauguggugaauuagauaaucuugaucaaauugauaaugauuuuuugguuuuugagacagucuugcucuguugcucaggcuggagugcaguggcacuaucauggcucacugcagcuucaaccuccuggauucaagcaguccuuccaccucaaacucccaaguagcuaggacuauaggcacggaccaccacacuuggcuaguuuuuuaauuuuuguagacagggucuugccauguugccuagggcuuaagccaucuuccaccuuggccuuccuaaaugucgggauuauaggcaugagccacaacgcgcagccaaugaugacuucuuuggaaaggacaccuauggcacuaucaaggggacucuaguuugguguuauagagcuaugugucccguucuuaagucuauuuguuugcaaauaugcuuuguuguuuaucuguguaaauauaaauugcugcuucuauuaccacuauaaauaaagcuucucuuuuaugauucaggaacuagcaaaguucuaaaucauacuuaccuggaucucuuucaccagaagcaagugguuuaauguaacagacuccauuuuagcagagacagcaacuaagcgcuagaagacaaucugaaaagcagugguuuuagaaauaguagugggcauuguggugggccaggagaaaccauaugggacugcucuguacuguagggagaaagaagauaaagggugauggaaaugagaugccucaggugggacugaucaguuccuaugguuucugaggugcauuuuaaugccagaggcugccaguuguauaaguauaucacugacauguagauuuagguacaggcuaccuuggaagaaccuggggaagauaugacuguacauugcucagauugaggcucagccugagaaauuaauccguagugaaaggcucuguaaaagaacacucaagagaguagauuugaugguacaagaaagaugguauagaagaggacauuauagcacucuagagaaagacuuccucagaaguccugcucuuuacuaccacagacucaaugggcuuaccuggggaauggcaucauggaaugacagccacugaguacuguggacacacucuaaacuuagagucagaauuuuuguguucaacuccugggccuucaauuaguaucuugacagccuuaacaaccuaucuuagcuuucuucuccccugauuucucaucuguucucugagcucuggaaguuacgauaggggugaaaugagauaauguauuuaaagucacaacuuauuucucuauuuaccuauagcaccaacauucuuccauguuaccccuguuccaaaagcagaaugugaaugauaccaacugcugugagugagguuuugaaaauggcgauggccggacuucaggaucaucugggguugccaugugccugcacccuuaugugacucuucugagcagauaguuguauaagaguauuugaucugaaggccaauucuaucuacaugaugaaggagggacaucuguguuugacaguuuucauaggaauggacacccacaugcacguacucacacauauucuuuauguaaaaugguaggaugcuaggagugagccuuacaaaggggggcacauaacuaucagagcuuuuuuaaaaaaguaauucaaguaaaugccaaauacccacuuaaucaaacuagcugugaugauucagaccauagggcaguguuucagagagaauuuuacauccacagguugaggagagacuuuucccuugcaaaagcaguacagaucccuuaugccucucaucaugcuuccccuaguguaacauccuacauaaagcacaguggcugaaaccggaaaauucagauggguauacuacuacuagcuaaucuagagacuuuauucaaauguugcuaauuuucccacuaaugucuuuuuucuggucuaggaucacacaauuauuuuuuauuaguccccucuaaucuggaaccauucuucauuuuuuauaaaucuuuccugaacuuuacacuuugaagaguacuaucuacuguuuuguagaaugccccucaauuuugguuugccugaugauuucugaugauugaguugagguuguaaaauuuuuacaauguguuuguccauucccauguacuaauaaagacauacccaagacuggguaauuuauaaaggaaagaguuuuaauggacucauaauuccacauggccggggaggccccacaaucauggcagaaggcaaaggaggagcaaagucacaucuuacauggaagcaggcaagagcaugcgcaggggaauuccccuuuauaaaccaucagaucucaugagacuuacucacugucauaggaacaguacgggaaagacucacccccaugauucaacuaacuuccaccggcucccucccaugacauuuggggauuaugggagcuacaauucaagaugagauuuggguggggacacagccaaaccauaucauuagaagaaugccacaaaagugaugucgugcccuucuuaguguguccuaacaagcggaacaugauggcgugauuucuacucacggugguaacgucgaucacccuuuuaagguagggucuguuagguuuuuugcgauaauguuaugauuuucccuuuguaauuaauaaguaucuugucauuuuguuuuuaagaagauucuuugcuuucuuaaauucauggucaggguuagggcaagugucacucacagagggauacaaagugugcugucccaaugggaagaaauggugcccuagaaagugauggagucauuauuuaaguguuugaauagaucucucucaauccaugcugaaauggaucgccugacauuacauugcaggauuuuaaaguccuaccuccaggcaaaucucauaguuacuggcaaaaaugaaagugugaaaugcuuuuuaauguauauuuaacaacacauagucuggugauuacugauguguauucucuguggacucccuuugcuaucagaggaggaugcugagagacaacuuuuuacacauuuauucugucuaaauccaucacauguuuacuuuuuaaauaucuaugacugucauuuauaacaagaucauaaaaagucaaauacauuaagucuaacucaaacuuugaaucauaggauuacaaccaauuuucaggaaaaguacaauuaccuuuuaugagugauguuuuucuuacucuuccuuaugaaauugccugcuauuaaaugauacuaaaauauagccacucaaaaaaaaaagauacaguuuaguaacaagguaugagggguagugcuacuuuauucaucuuuuugauucagaaauucacauaacuccuauuuaaaggaauuuucaucauugaauccagugucaugucugcuuauguugaagaaguaaauuucacaagaaguacuuaauuccuuccuauaguaucacuauuuaauaaggacuaagguaccauuuuuuucauuuauauuggauuucacagcaagaguucacaucuuauacuaauauaugcuaaauaguugcauaguauauagaucauuguuguuaaaaaagcaguacugaaggcauuuuagaucacagagccccaguggucuacauuuuguuugcuuugacauuauuaaacucaaucuguuucucuaacugugacucuaauuacuacauuugcauggcagaaaaguuugcuuuguggguugacuuuuauuaacagugcuugcauguuguuuucugcucuugcucaguguuuuaugagcacacagagcaccuucaguugcauugaauaauuaugcacaaucaauaaguuuuuguguuugucuuuguuguuucuuugauguggccucuaggaugcugcuggcaaggugcuggaccgcugggccaucaugucucgagaagaggaaaucaucacccuucagcaguuucugcgguuuggagaaaccaaauccauuguggagcugauggcaauucaggagaaagaagggcaggccguggcuguaccaucuucaaagacagacucagauauaaggacuuucauugagagcaauaaucgcaccaggagucccagccuccuugcucacuuagagaacagcaauccuuccagcauucaucacuucgaaaacaucccaaacagccuugcauuucugcuuccauuccaguacauaaacccugucucagcaccacugcuaggguugccuccaaaugggcuacuguuagagcaaccaggguugaggcugcgggaacccagccuuucaacucagaaugaauauaaugagagcagcgaauccgaaguuucucccacaccuuauaagaaugaucaaacacccaauagaaaugcccugaccagcauuacuaauguggagcccaaaaccgagccagccugugucucucccauucagaauucugccccagucagugaucuaaccaaaacugaacacccaaaaagcucauuccggauucaucggaugagaaggauggggucagccucuaggaaaggaagaguguucuguaaugcaugugggaagacauucuaugacaaagguacucucaaaauucauuacaaugcuguucaccugaagaucaaacaucgaugcaccauugaagguugcaacauggucuuuagcucccuccgaagucguaaucgccacagugcaaaccccaauccucgccuucacaugccuaugcuaaggaauaaccgagauaaagauuuaauucgggccaccucaggagcugccaccccugucauagcaaguacaaaaucaaaucuggcacucacaagcccuggccgacccccaauggguuuuaccacucccccucuagacccugucuugcaaaauccucucccuagccagcuaguauuuucugggcuaaagacuguacaaccaguuccuccauuuuauagaaguuuacucacuccaggggaaauggugaguccuccaaccucccucccaaccagucccaucauuccaaccagugguaccauagagcagcaccccccgccacccucugagccaguagugccagcagugaugauggccacccaugagcccagugcugaccuggcacccaagaaaaagcccaggaagucaagcaugccugugaagauugagaaggaaauuauugauaccgccgaugaguuugaugaugaagaugaugaccccaaugaugguggagcuguggucaaugacaugagccaugacaaucauugucacucccaagaggagaugagcccaggcaugucugugaaggacuuuucuaagcauaacaggacccggugcauuucaaggacugaaauaaggagggccgacagcaugacuucugaagaccaagaaccugagcgggacuaugagaacgagucugagucuucggagcccaaacugggcgaggaauccauggaaggggaugagcacauucacagcgaagugagugaaaaaguccugaugaauagugagaggccugaugagaaccacagugagcccucucaccaggacgucaucaaggugaaggaagaauuuacagaccccacuuacgacauguuuuacaugagccaguauggacuguacaauggugggggugccagcauggccgccuugcaugagagcuuuacaucgucucugaauuauggcagcccucaaaaguucuccccagaaggugaccuauguucuagcccagaccccaaaaucuguuaugugugcaagaagaguuucaaaagcuccuacagugugaaacuucacuacaggaacguucacuugaaagagaugcacgucugcacaguggcugguugcaaugcugcauuccccucucgccgaagccgagacaggucaguaaaucuccauuggcugcuccugcuggggguggagggugccaguuuucagucauguuggacuucacacuaaaagaaauccaacuuagauguuuuuggugcacuguaaagauuguccacagugaucaugugauaacuaggcugccaugcucaugaaggauuguugcaguuggugcuugugaugauuaagcaugcagaaucaugugccaucuuacccguaaugcacgccauuuuucucugugcucuguguauacguguguguauguguuuucaugcaucuaggugugaauaaguuaacuauguacacgguucccugcuuccccgugaaccuucacuuagaagccacagcuucuguuauauauauauuuauauauuuauauuucugcuuugccauguggcuuuuuaauuaaaucaguauauuaucuucauacacacauauuuauccaauauagaaacagaaauuuacggauggaaagaaccauagguccaggacaucgagacagccugcaucuccguagguauaaccaguaauguuaucauuccuuacaugaguauuuaguguguccuugaauucuuuaagaguugugaaaauaucagaaggaaaugggauagauguaauuguugaugugggaaaaugguauggucguguggguuucuuuaucuuaacuucauaaugucuuugagcacaucucuaaacuauagucuaccaugcggauuaugcacagaaggggaggcaugcauauacuuugaggaucagcacgaauauauuauguccagccuucagaugacaucacacucuugcuauguaguugcagcucugaaacaguugggcuuaagcagaagcagaugguccuaaaccuacaagguucuuuauuaauccucaagaaaaugcaguauaaauggaaugugucaagguggucaguggcaggauagugcgguuauccugcauuuguucagauaagcuugugagcagaucacguacauaauacaccaccagcccaacucgggucacacagcaguuaguuauucccauuauaucagaugcgguuuuugguucuacauugucuucuaaaaauauuuuagagaaaauuuuauaacaugguggaaaucaauggaagaaacacauuaaaauuaacuagaaaguuucuacagagccaccaauaguaagcaguaauucuagugcuugucaauuguguagaguucuuuggcaaaguaacauuaaaaguaccacugaaaaguaguguccugucccuggaauauucaguuuugucuucauauuuggagaucaauccuuuuuaaaauaaaaguuugaagaauauuuuuuuccuuucuacugaaauaaaagggggccaaucuuugaaaagcaaaauauuuaagaaaaauaaguaacuuucuuauacaacccaaaacaugguuugaggagaaaccauuuuuuuaaugauuuucccacccccauuuacuuuguucuguaaacaugguuuauagucacaacguuauuucaguuccaaguuaucauugacagucccagaaugcaucagauaagauagcuauauuuugaauaauaaaauacuguacccaaccuccuccaaguugucaguaauauucauucuuuuaaauuugagauaguacacuacuaauaacgagguuaaugcauuguauuuuuuuaaacaaaaauaaaagacucaugaaaaccugcauaaaauauuuauggaaauggaguguuugaagacaagccaaaauuuaagcuuaauugcaugaauuccugucacaguuuuaguugguuugcugaaaauauugcaagucacagcacuggaauaaauagcugugagaccaaaaggcuacacacccaguguuugaagccuucauuuauguaaaauuccuagaaaacgcaagcgcuuguauauuuaugucuuaacacauagggaggcacuguugagguacugcuuguugguuuaucugaggaaaaacauuuauugauagcaggaaaauauuucagucuucauuuuuauuguagguaucaggauuuuagugagugacuagccauauauacguuuagacccgcgucuaggaugacgaggauauucuaggugggaagaagaguacagaugugcucccaggguguucagucacauagaagauagcaagcuucagaagacaguugauacauuucauuuggcugaaaucacaguaugcccagucuuuuucauuuuggagcuuugucacauaagauaaaugaaaaagcaaauugcaaacauuguagaauaaaaacuuuuuuuauucucacuugaaauuuugcuuuuuaacaauaugcaacucuuuugaucuuagguuagaaacacacaaguucugauacuuuaauuuugacauuauauuuucuuaagaaaaguguucaucuugguugagucuaugacuugaauuaauauaauguuaugaguuuagcuacaccaaauaaccagugaugccauuggggugccugccucuuccugcagcucagcagagugaacugugaaacauaauuguauuccuguuuuagccuuuuauuguuauuuugucaaugaaugucaaccugugauuuaaucucauuauucacaaagccucuuggauuacaucucugaucugucucuuagacuuaccuucuccugucucuucacuuuuacuuuguuagucacgagaaccccaggaauuuuaucuccuugguuuuucccuuuuaauuugcugugaagcuaagacaaguuuucuuaccuuuuucuugagccaacagaccuucucaaacagaaacccuccuuugucuuuaauccugcuguccucaggcccauuucuuuccucuccccagagucucaguuucauccauccuugacuccacaaugucuuccuugugcaaauaaagcauuagaggggauuuugagugggggcugaagugugcagggcuauaggguuucuaggauuccugucauaaagcuaacagaauugcccucuuccuucuguuuacgaaagcagacuucuucaugauucgaacaccuuggaggaguuuuacacaggucugccugggcuucucccaaagugguuauacaugagguaguugcauuuuuggucuccagauaggcauguuaguaagauggaaagcagaaagauguuaaauagugucuuuuagguuuggcaguuaauuagcaaagauuuccaggucuuuguuuaugguccuucuagauuuuauaagaucaaguugaagauuuuucaaaagcaagaaugcucuuuguguaaagugacacagaggaaggggagagacacaugcaagauuuguuagggcugaagauuccaagcaacagugucaaagcuauucuuuucuauauaguuguaaaugaguguguguuuaacaaauucagaagccaagaggaccauuccacacugacaaagagcaagcuaauacacacaaaaucugauucaucuuuguuacuagguagcuguuagaauaauuuuuauucugagugauagaagugaaauguaaagaauuuucucuguaaagaacucugaugcucuaaagcagggguccccaaccccggggcugcagacuaguacugguccauggccuguuaggaaccaggcugcacagcaggaggugaguggugggugggugagcauuacugccugagcuccaccuccugucagugguggcauuagauucucacaggagugcaaacccuauugugaaaugugcaugugagggaucuaggcugcguacuccuuaugagaaucuaaugauaaauguaacgugccugaaucauugaaucaucccaaaacuauacccccuacucacaucuguggaaaaauugucuuccaugaaaguggucccuggugccaaaaagguuggggacugcugcucuaaggugacugcugaagucuucaaguauauccugauagcaagguguaguguuagauuuugaaagucucuaaagacccuuuccuccuucuuguuuaucccuugaucugucugcugcugaggugcuguucuguuaaggaacaggaggcugccccuccauuaugaaguauacauaugaaaucuuuccuaggaagaggaaauucuaaccggccuggaaccugcugucuucauacgggagauucucuugaagagagcgugauagucagaauuagcugguggguguaauuuaccuuucaucauuucucauacucugacuugauuuuugauccccaggagcugaguggcauaggucacccauuuugaagggaagccuauuuauaaguugcauuugguuuuuauucaggaagaaaaauaacaaauacccucuguucuguuuccuaauauuucuuaucauuggcucauauguuaaaaucuauuuauauuugucuuaaugauuggcaguucuaaaauuccaucuaaaaugaagacuuuguacucagaaacuagaugaucuguauaguaagaagucauugucucuuuuucauccuacaugaguuuuacuaucuuuguuccuuucuucuucucagaguaguggccaguaguugucaagguuugucuuaaauuucaucugaaagguaagcauauaugcuugaucuucaaguuguagaaagaugauuuagccauaugaauaaauuuaaagaccaaauuauauuugcugagggugauuuauaaauaaauaugagguaaccauuggugucaagugugaaccuuccauucgauugcuaguuugaucaguccacaucuaaauguggaaaguucuguauuccuauggcggaagacauguguauuugauguauuaaaaccugcugaugucuccagaacuaaauuuguuccuuuguaggccucuggguuagcgguagcuaaaaagcagaaauguauaguauuagcuugucugauuaccugacuuccagcccuguacaggugugcaggaauaaauuaacaugagcuaccucugaugagccacugcauacauuaacgacagaggugaagaugcgaaaacauguuaccugccuccuguuaccaccuucucagcauagcaacaaccauuuuuuccaucauucucuauguuuggaaacuuauacagaacuuuuucuagggagggcuuuucaguaaauacacaugauuucaccaggcaauaccucuaagaaaugagccacuuagcaccaauucaagauaacuauuaguauauuugcccuaauauaauuagcugucaaauacgaugugguaauccccuccaaguaaaagaggagaacauuuuaaagcauuagcuguuucauuucauugccaaucaaacuacaagucuccauuucuaaaauucucuuacaacaugaaguugugcagguccucugacuucuaaauguuaaggaagaguuuuuuuuuuuucccugcuacucuauuugguuucacaauagagcaagaucaauagaccuuuuguacuuaucuuccauuacuuuccaucagaagcaaacacacaaaauacaucccccuccugaguaauugcuaguugugcccuccucaagcaaaacuuugguaguaagauaaacuucagugucauuccugucccugggguucuuuuuagauacugggagaagagcaaugagcaaaacggucuccuuguaucauggggagagacucugucaagccuaaagugagccucggaucuuccuaaugaccuccugcuggcccagcuggaugcaagacaagcucguuuaagccucugcugaccuuucacuccuccacuacaagaacugcaccacucauuuccaccgucuucagaacugugcaccaaauagaccacaaagcuucauggcugacgaaugauuuccuuuucaugaugcaaagagauuuuuacaaauuucuauugaugagaguuaacauuaagucucuuguggcauuauaaccucuguugcacaaauacaaugcuucuauauaacucuuauuuuuaccuuccuuauaaaggaacaaucuacuguucuugccagcauuaucuugaaaauucaggccaaaauaucugagcagaaugcacauacugagugcaccggugguauuuuucaugaagagaccacuuugaaagggucuuccugauuuccaccucccucagaaucuaucugaccuucucacagacuuuauuggugugaaucuuucuuauauuuaaccauuuauuugagaugcucauuuuuguagcccaucuuuucuuuuuaaaaaacaugggcugguuucuacccagaagagggugguaagacuguacauguacguuaacauucacuuguauaacucagguaaguuccguuuugucuuagaugaaaggcugcuaucaacucuuuugcuguaagugaucauucgugguuguacuaagaggaagggauaccuucuuugccuaaaugccauagugaagguuuagccaugaagcauuuuuuuucuuuuuuuaaagccuucucagaaauaaugugcuugccauaagacucccacaagcuucaaauaaaugaauguggcagaauuggaaagaagcuuguccuugccaaaaaauugcaaugucauaaaagagggauuugguaacuuugauucuugagugccaagauauguguaugagggagaggcaggcaagcuaagaccgaggaagaaagaauacuuuuuaggaaaggacaauuuuucuucaguuauuucacauaaaacuacacuuuuaaaauauaccuagauuuuauguccuaaugcaagcugcuugaauuaaaacaggaguuguaaauuccugguaaaaagcuguuacaccuaaaguguuagugauccuaacucuaguacuuuauagaguuuauuacuucuuuuauuaacuagggggaaaaauguuacccacuucuaguuuaauucuuuuuguugcuugcucuaauuuugacuuuaccuuaggaaagaaaaaaaaagacaaguguuucuaacagaauauauguaagcgaugccucgguauugcuauugcauauaucaaucugaauuauuaccagccacucaaaaauugugcuaauguucuaaucuaaauucauccacguaauguauauguguguuuacacauaaacauccacauaaauaagaauaucaaaagacagaucauucuuaauugccagaauagacaucuacaucucggaaagugauguaugaaguaacuuuaucacauugaugggaaauaagauuucguaaguaaaacaagacccauuugggcaccaagaaccacagaccugcagcuggaagcccuguaggucugaugggcaguggaggggagccgcucuaacucugcugccuuuuuagucugcucugucacugagggggcacuggugggucaguucgcucacucguaauuguguuuuacagacuucuaaagcaauuggcucagucagucccaauucaauaaaaguggagagcaagagagagagcacuuuuguucuauuuuuuacuugaaauuauuucauucagcagucugucuuuuuuauuaccaggacuugacauuagcacuccaagcuauauuagcauccauuucagcaguucaguaaugguauuaaaaaaacacuuaacuucaauggugaaugguuguaugacaguaccauaaaaaauccacauuaaaaaaaacuuauguauuugucccagcaaauuauuuuucacuuguuuaaccacuucaaaacuauauucucaugacggguguucacgaggacuuucuuguucucagcaacagcugacaguggugcucgguugauuagggaacugaggaaagaggaaagggaaauccagugaagagaggguagguaaagaugcuguuuacccuguaguuagauuaccuuccauucaucagcagagauggaauuggcaaccucagagcacccaaggugaaauucuuggauccucaugcgugacugggauuugauuuugaacccaacacucuccaaacuugggagcaaagccuaacuacuuuggcacugcaaugugcucauaaaugacuacauuaguuucuaaauuuugauuaaacauucaguaauuaaucaaugguagacacgaagcaguuggcaagguccagagcugcaaaauguuuaagacauaaaacauuacgaaguaauuagaauaugcuccuucaagagaaggauugccuucaauaaagagguaaaugauaguauccuguuuauuguggacguaggcagccaaagcaauaugauaaacugcuggaaacacacauaucaguaaucauccacauuauuagugccauuaaucauaauuccaaaaauaugacagcagcagccaacuuuuugaccaauuuugcuucugccuguuggccauuauaacuucacuaauagacugcagagcuccuaugcguggcaguuugcauugagaauggaagguuaauuauauuugagcugcugauuucuucucuccuuggaaaaggcuuagcacuuugacaaucccaagggcucacuguuguuaaaucaguaaaaguacuuuauugaaauuuucuuuguuggucaggaaugagauguuucaaaugagauauaagcaccaggcuggaacaguugcuaaugcuucuugcuucaaagugauccuugggcagcaagaugaacucagugguuucuuuagaucacuuugcucucucauuucucggguaaaaaguucagugcuauauggugauacaccaggaaaucccacaagauuagugguagucucaacauguaucuguaugacugggauguugggagugguuaauaacaucagagggaauaaguacuucuuuaauacaaaauccugcauuucagacucugccugugcaaauaaaaaguaaaaagaacuucacaaaaaucauccguuucuaaauauuaaaacauuuaguagcaugcaugcauugcugguugguuaaaugaaguuuucauguuuuggcugguaguuuugacauuuaaucaaaguuguaaauuagauuaugcucacucuuuuuguucaggugucuuuauuaguuucauuuucaacacagaauucuagauaaagccauagcuaaauacuaauauugauuguccuacaaaauagugucaccucccuuggggaacucaugcauccugacuguuaccuuuuaagaagaucauaaauuaaccauuuuaggcugggugugguggcucacaccuguaauuccagcacuuugggaggcugaggcaggcagauugcuggaggccaggaguucaagaccagccuggccaacauagcaaaaacccaucuauacugacaaaaaaaaaaaaaaaagcugggcaugguggcacaugccuguaaaaauuagcuccuauuauuuuggaaauauaucuucuaaaaucuuuauaaaguaaggcuauauaaaacaaggaauggaaagcuugaggguuaauuuguccaguguaaauauaaaacucaaagcucagauuuauucucaguaaguccuuaaaagaugccagggcucauggcuuugcuuuuucuuacccaacaauaguaguaaacugagcaccauaugagcugcuugauugagaacacuuccaaaugcugugaaaacauaauccuguucacaguguaacacucaucucacauuacagcgcaacagguaccuauugaauaaucagcacccuugagaagccucgaugucucagauacaacucaaaaguaaaaugguuagggaauggggcugcuggauaucaauucuacacuuaaccugugcauccagcuacacauuuuccaucuaccaaucugccuucccaaaugccaucacuacauuaacauuuuuuaugcauuccacagcaaugacaaauuguuuucuaacuguagggccagauuuaguaugcgaaagacauguuugccucugccaacaaaccaauaauucucacuaacgucuucagaguuacaacauuuauaaaguugcaaaguggaguaaacaaaccaucuguuuggcuuuuccauauaugucaugcuuucuuauuagcauauuacgauucauuuaguaaacaaauuuggugauuucguucacgucaaaguuagaucggaagcuugaagaugauuaacauuccugggacaagcacauuaauacauugcuuccccugcaaaguuaaauggcuucucaggagaaucgccccuuguugacaagaugagacugucaauuuugucugccugccacauuaggggccauacggggauggcaggcucugagagaggggagucguguaggcagcauaauucacugugaauugagaaaagaagucuaauucugauaaauggucgaccccaauacauccuaccuguuauuacaacagacgugccguaucugugcaguaaauuagcuaaaccccuaaagaguuugguaggagcuuaucuucaagugaauaauuugaauguagaggaaacugucugcgugacuaguauggaugauuuguuuuauauugaaagggguugaaaugacugaguuucauacuuuuaauuugcaagaauuugcuuagauuuuguuucuugcauuuaauauguacuuccuuacauuuggggcuuuuugaguguuacccacuagaauuucacauugaauuuucuuccugagcuaggggaugguuuucagaucuuuuggacagaaucuuuaaauaauaaccuguagaacaacuacuaauuuuacagaaagguauagugucaaaaguaucauuuugugcacagagccauaagcauccuaucguuaauaaaugauaauacaaaaauguugagguaaguguaauagauaguguuguagcaauccagauaagaaaaggacuaaugaaggcagaaguuuuaauuuuucauuucuguggauuuugauagcagguuuacauuucuacucaaaaguauuguugacucaguagucuuacaauguacuuaacccuagcaucuagacuuacccagauuggauauaaauuuaucucucucucucccauucuccccauauacauauauguacacacauacauacagacaaauaggcaugcauaugguauguauauguuauuguuacgcuauguauauguuguuaugaucauucuguacaauaucauuugagaauuugugaauguguguguugaacggcagaguugagcuggaaaauaaaggcaaaaacuaauccaaaguggggccucaguuauuuuucccuugaggcauucuaauuaauuauuaaguauuuuguuucaauucaccaaguucagaaugucucaaaucugauuaagaauuaagacacuucaugcaaccuauagcuugguucauuauucagucucugacugccacagucuuacuuucuaauuuggucaugcaacuuguuuuuuuuuuuuuucuuuuucgugucuccccgauaucuuaaagccaaguuuaaaaccucaaaacacuuucuuuagauaguguuuuuguuuuuaguuuuaugggccagacaucacauuaaaucuaacuuaaugugaugagaaaagagaaguccaaggcaagacuugcuuucucucuaaagggcauuugcacuuacuugacuacguuugauggauuucaugucuucugugguugcaugguaaaguuuucaucaaaggaacagaaaaagacugguaguccacuuuaguccaguuagaguacuuccacucagcauuucaaagaagaaggaaguuugguucugcagcacccuccccucaguccaagguuuuguaacuuuuugcuuuuaagggugauauuggucuuuaacaagcuuuugguagauucacaguauagaaagaguacagagguuuaaaggaagcauuuguaguuccaagcauagcccaaguuacagggcuuuuucaagcccuaauuuuguggcauucccuuauaacauacuaugguauuaauagcgucaggaucaccguuuguuuugucgccaccaccuuuccuuggauauucuguuacaugaguccuaccuugggaucauugcuuucuucccuucuacaguguauuuugggaaauacuuuuugaagacucaugcauauuauugauggaagggaaaccaauguacuuuuaaguaccuccucugugcaaaguauucuacuuuacgugcaggacacauaagauugaguaagauuuaguuauguucuugaaagugaacgucuggggcuaagguuuggaccacugccuuaaugauuaccacugcacuucuuaagaccaaguccuuaccccuuauaccuaugaacucauuuucucucugcauuccagucacuuuuuuucuguaagaggaacuuccuuccauauaucuuucuugccuuccaaaucaaagcaaguagaaacaaccuuucuacuguucauguucuuauagaauguaagaaguucuaauacagucuuagauauuuguuauugaguauucuucccucuuuccuagagauaaauauucagaacacuaaaucuguuucuagaaaaaccaucucugucgcuggagagcucaaaauugguuccuuguuggauucuuuguuccaauuguuacauacaacugaguagggcuuccucugccagggagucccccuccuguuuccagcacucucuggccuuccugccauuuuagggucuucucucgacaucugauuaucaguaggugagaguucuuucugugucucucccaacuucucuuuucaccucuucaguuuugcugauccggauaaacuuguaauaguccucaaauugcuauuaacccuaggucuuugugucucaugaggacaguauuuuaugacagcuaauggucuggauugacugauucaagaguccaacaauaggucuuuguuaaaaucaagugcugucuuuugucccuucuuuggagacugaaccguaaccucuuggguaggaucgguacccucuaaagaauuuuagucugcuuuccuucucgugcuuuccuuccuuccaccuuaggaauacugugugaguuugugagaaaaucuucaagcccacuaucaugagagugaacagcagacuuuccucaguccauccuucccaucuccacuucaaguguuuugcauauggcauuuaggaggauuauuaaacaaaaaugaaauagauuaggaauugaacguaaaagaaucaauucucuugaacugugguugcauaauggaaaucgacuaccaugaaugaacccguguacugaaguuaugaagagcagagcuaaugcacugccaugaguucaucuuuauuauugcauuacaccugaaucaauugauaaaguagcuguuuuuuuuaaagugagggauggcacuuaauugaauaaaagucaauguaauuauauuagcagaggccaacaguacugcugacagcggaaaagggacacuguugaacagagugccagagcuggucuacacauuucugcacaucguuugguugacagauauugagggcugguacaucgucuaauuagauuacagauuucuacugcuguaagugagaaaugaagagaaaaucucuuucugguaacauauugguggagauguguaauuucacaagucaucuuagggaagauguguccaucugggugaucaguguguccuuuucucaauguuaauuuauucuuccuuauucagugugucuugaugcaacugcugugugucuggcugcuguuuucucagcagugaaccuaggaagugguaacugcagaugugugagaagcaacagaguucuagauuacagucaucgcaaaaugugugcucgugaaauuaagaaagggggaggguguuaaaaauaauaaacggguaggauuucaugagcugcucauaguuggcagauaguuuuaucaauagaauaauagcgcauagcguaacucuacuuccacauucuuguaauaacuggugguguuguacccacaugucagaguaaagaccucacaguaggcauuuccugcacuuugcuuagcaaccugcacuuggagucaucugccaucugacaccaaggaaacggggaauuacugugucagagcagggaccguggggacaacuucuguuuaucauucacauacccacacacugcaugcaucuguuuagaacucauuuguggaugaugaugcugugaauuugguuuguguuaauucgauuuaugauuuuuggauuauacagcugaucugaaaaucaucaagacagcguaugggaugaucgcuuaugacagaaaauaauuuugugaucagaacguuuuaaaucccuauuuuauuguuuaaguuuuucaaaaccagaugucuagaaugugaauuuguuuucucucucucucuuucucuuucuuucucucucucugucucuuauucuugcuuucuuuugugaucgauuuagcaaaagauuagaaagcugaucuuauugucacaagguaagcucagccuuccuaagugcaguuggagagggcugcugcccucugccccuuaaaacccagagugcuguauauugucuuguguggaaagguggagaagucuuccccaccuuucuugucucugaggcacauaccucucaaccaucucuaggaaauaucacccacguuugucaccaaauggaaugacacauuuuggucuuccauacuuuuaaguauaaucgggaggucuguugaacuuuauaucagccauuuaggucauuucuuuuaucacaauuacuucuccaagcuguagagcuuccaccaguauugagaagcuuuuauguaucuguagauaugucaguuuauuuuuuggaaggguaaccuucaauuuagguacuguugaacaugugagccuuugcagguggagagagguaugugcccaagggcacuuuaaaaauaaugggggauauaaauacaaagacaauguuuccagauagaugauaacauaucaggcuuuguaaaucaugaugucccuauggauucucugggacaaauccugucuuuauauauauauauguaaaaaaauauguauauguguauguauauacauacauacauacaagcaaagcacugagugaguagaauaaaaguuuugcuugucgaagaaguauggguuccaguuguuaaaguaaaggaacccuauguuauuguugugcuugauuuuuuuguacuuacuguguuuuaauuuuuguaccucugaguuuucuuucuguuguucagugugauuuuuuuuaaaaagguggguggguuuuauuuuuuuaaaaaguuucuguuuuuccguuuuugucuuaaagaauuaaauuuuaaaguagaacuacucgaugaaaauauuuuggacacuaaaaugcacauacuucuaaaaaguaaauguauuuuauuauuagauuuaacugggauucccaaaucauucugagaaaaggcauucguguuguuaaaagacagucuguaacccuauuucaaauugcuuaaucuguuaagcuauuguuuuuccuuaaaacuugaaauguggaggguagagacggaagauuucauuauuuuuugaaguuauaucuaaauuaucuaggcuacuuuuuuaaaaaaugaauuuuuucuauaccucaaaauaaagugugugcuguauagaaaagauguuuacuuuuucuuguuuuuagguaaauuuagacuauuccauuuagacaagcagaaaguuucuauucuuuuauccuauuuaauauauauucuaaaaucucugccaugaaauucucugcagcugaugcugcuacauaguaaaacuaacagaguaaucauugagaaaaaggugcacggguuugcauucauccuaccauugacagagucaacucucuuauaaaaauaauguuaauggaaaguuccccugauugcaccucucaccaccaccacuaacucccagauccugaggauauaggggaaugcuugcuuuuauaaugguguaauuagaagugaaugugcuuauuugauaccuagugaaagcugaaucaauuuuaaaaugcuuuccuuuuucucaccuuuccccaccccccauccacguacccccccuucccucuuguuuuccuagacacagugccaacauaaaccuacaucguaaacuguugaccaaagaacucgaugacaugggccuggacucgucgcagcccucccuuagcaaggaccuccgcgaugaauuuuuggugaagauauauggugcccagcaccccauggggcucgaugucagggaagacgccuccucucccgcagggacugaagacucccaccugaacggguaugggagaggcauggcagaggacuacaugguccuugacuugagcaccaccuccagccuccaguccagcagcaguauccauuccuccagagaauccgacgcaggcagcgaugaggggauucuucucgaugacauugacggggcgagugacaguggggagucggcacacaaggccgaggccccugcccucccuggcagccuaggggcugaaguuucaggaucucuuauguucagcagcuugucugggagcaauggugggaucaugugcaacauuugccacaaaauguacagcaacaaggggacccugagagugcacuacaaaacugugcauuugagagaaaugcacaagugcaaagucccagguugcaauaugauguuuuccucuguacgaagccgaaaucggcacagucagaacccuaaucuccacaaaaacauucccuucacuucaguagauuagucucagaauggacacuacaaaugccagcucucaccagauggccuacguguuugaacugccauagucagugugcgcuuauguacuuggggugugugugugugugugugugugugugcauuuauguaugcucuguggcuacauauacacacacguauuuccuugagauaaacaagauaaacacuaggugcuuuugaauuuuuuucacuucccuuuauaguuuugggaaaggagugggaucuuugauuucagggugaaaacagaguaccccuuuaaacacacacacacacacaugcacauacacacacacacacacacacacacacagugugcaacuagccccaguuuugacagaauaauucuuggucuuccccaaagagacaauuuguuguacccaugacuguugccugcaaaaauaaaagggaaaaaaaagaaaaaagaaacaaaaaggaacuucuuauaguugucuuuugugaacuuuaagguuuugaaagaaucuucaauuaaagcauggcagauucaccuguaaauauuuagccuugaggggccauugauguaaaacaauuguauugaugguuguuuaacuuuuuuguuuaauuuuuacaguuacauccagcuguuagauaugcaggaaaagauaguuugcuggcuagcucuauucauuuauguuagcauuaaugcacauuuuuaaaaaaagaaaaaaacauggucuuguuuuuacuaccuguuagauauagugcuaaagaggugcuggcaugcuuuacagcacagaucugauuuuuuaaaauguccuguacuaguacauaaaucccgucaugcacuuuuuuucauacacuacaaggggauguguaauaaccaugcuucuuuuuuauccuuaaacuauugccauacuucaguaagu

SEQ ID NO: 14015 - RNA, 1851 nt, Homo sapiens
caacuggaaaauuguuuuuaucccaugauauuugauuuguguauuugauaaaagaggugggcagauuuuacagagguaauucauuuagaauuuuuuuuuaaacuagaucaguaacuuuuucuucugaugaagcucauuuguuaagaccaucucuuuuuuggaaaaaaacaaaaaaaaauuuuuuuuuaauuccacuguuuccuagguaugugaggugagcauuuggcaagaauaugagacuugaugaauaaaaaauacauuuuauagcuuaacgcacccacagcagcuuucucugugcaaauuauuuucuuuuuuuuucuuugacuuuaaaugaaaggauauaccauuccaacaagcugcaugaauacuagaaucuucauucacuuucaagagaucugaauuaauaccaguguuauuuccuuuggcugaggucugccugcaagaaugcuuguugcacuggaauuuugagaccuuucuuuuauuauguucuguaaaugugauuuccuuuuacugcaugcauuucauucgaggaaaagauaguuuuacauuauuacuuuaauuauuuacuaauuaagccagcuuuuuuccugccuauauuuucuccaaacuccugauuuuuuuuuaauguaaaguaagcagaccuggucuacaucauccagaucaucagucaguagauauuuauuaaaccuaucucauacaugaaggauugugccagguagccuucaguucuuccacggaaaugaugagaaguauaaaguuaauuuaguaucauauaccaaccagcuuuaugguuuaauguacuguaagacuuaauaugcauauaacccauuaauuucaaaccuuuuuuuuuguauucacuggauauaauuuuucuuuuuuuuuucucagcaugguugaauuugaauuuucagcuuguacuugauaugucuuaucagaccagggguauuuauagagaccuucacccaaauagaaaauauagaauuuuugauugaaucugaauaucaauaaacaauaaaugauuuuaaauauaaauauuaccaugcaaauuuaggugagaguccuuuauguuuauuugcuaaaucuggcaagcccauaccuaaaagaaaauccuauucagacucaauuugcauaaauccuaaaucagggcuauuggucauaagcauccuauaaucaaaaagguuuugggccaggcgcgguggcucacgccuguaaucccagcacuuugggaggccgaggcagguggaucaggaggucaggagauugagaccauccuggccaacauggugaaaccccgucucuacuaaaaauacaaaaauuagcugggugugguggugcguaccuguaaucccagcuacucgggaggcugaagcaugagaaucgcuuaaacccaggagguggagguugcagugagccgagauugugccauugcacuccagcauggcgacagagcgagacuccaucucaacaacaacaacaaaaaaagcuguugauuauaucaguccuacauuuagaaucaugagaucucaguauuuuauuuacaaauuccucaaguucguuggaggcaugguaguuuguaaggacuuacaagcaaggcagaucaaaacaaguaauuuuucauuuuguccuaugaaaguucacaugucuuuauuauuugucccagucuauguucuuauaaauugucuaaauaucugugaaagugguuuguucccaacugguaacucucuaauauucucccugacuugaguccaaaaccuagcauaacuaaaguaguccagucuuuuccuugccaaucucuuuucuucccuagucuucucuccuucccacuccgcauagaaauuccuuuaucauaag

SEQ ID NO: 14016 - RNA, 2217 nt, Homo sapiens
ugaugauacugaugagucccacugugcugagguaagaugacugggacggucauuuguugguugcugaagaaguucuuaucagacuuuucauuucaauuuuuccauacuaugucuuagaauacucuucucuaucaaaagguugaacaauaccauguacauagguggcuaguuauguggcagaaaagcaaaacuaggcagcgaauaauuuuaucuaacaaccuaugaguauacauaugccccaagugagauacaacuaaaugagaaacacaggccuugcccucauaauggguacagacuaacaggggauacagccagccaugcuguccuauuuugugccuuuuuaaugcuccuugcagaagagggcuaucucauaggcaguacacucagaguagccaaguccgguuguuguuuaacggcauaaauacagguacuauuggcugggcgcgauggcucacgccuguaaucccaacacuuugggaggccgaggcggguagaucacgaggucaggagaucgagaccauccuggccaacauggugaaacccugucucuacuaaaaauacaaaaaaugagccaggcaugguggcacgugccuguagucccagcuacucgggcagcugaggcaggagaauagcuugaaccugggaggcagagguugccaugagccgagaucaugcuacugcacuccagccugggcaacagaguaagacucugucucaaaaaaaaaaaaaagaaaacauaugggaagacuaucucaggcagccuuggaguggggguaguugagucacauugcuuucuggaagagaugaaugguaagcugagaacuaaugggugaauaaacuaggugaaagggcaauaaggugaccaagguuccagagggaaggcauagcaucuuggcugggugcaauggcucacaccuguaaucucagcauuuugggaggccaaggcaggcagaucacuugagcccaggaauucaggaccagccugggcaacugugaaaccccaucucuacaaaaaauacaaaaauuagcagggugugguggugugcaccuguaguccuaguugcucgagaggcugaggugggaggaucaccuaagcccgagaggucggguccgcagugagccaugauugugccagugcccuccagccugggcaacagacugagacccugucucagaaagaaagaaagaaaagaaaagaaagaaagaagaaagaaagaaaaaggaagggaagcagggaggaaggaagggaaaagaaauauccucuuauaguccuagaaagugguucuuugugucccaaaagcucugaagucaauaugaacuguuuguucaugucuugucauuuuauuugaggagggaauauauacauuacacuacuaacaugaaggauauuuccauucuuuugggucuccccuaccuaauauguuucuucaguuuaagaugaugaacuuuggagacucaggcacuaguucgaaucccuacccagcuguuuuccaguuguuaacugaagccaucuacuuaaacucuaagcuuauauucauaucuaugaaaugugaauaauacugcugcacucggcauuguaaugaggauuuuuaaaagccaaagaauccacauaugugguggacacauaaccagccuacugucaucgaacuaauuuauacauagcacuguuggauccacugcuaauuuuaaguuuuauuuuuagcacauugagucacguacucuugcaauugcccgcaaccugacucagcagcuccagaccacgugccacacccuccuguccaacauccaagguguaccacagaacauccaagaucaagccaagcacaugggggugauggcaggcgacaucuacucaguguuccgcaaugcugccuccuuuaaagaagugucugacagccuccucacuucuagcaaggggcagcugcagaaaaugaaggaaucuuuagaugacgugauggauuaucuuguuaacaacacgccccucaacuggcugguaggucccuuuuauccucagcugacugagucucagaaugcucaggaccaaggugcagagauggacaagagcagccaggagacccagcgaucugagcauaaaacucauuaaaccugccccuaucacuagugcaugcuguggccagacagaugacaccuuuuguuauguugaaauuaacuugcuaggcaacccuaaauugggaagcaaguagcuaguauaaaggc

SEQ ID NO: 14017 - RNA, 933 nt, Homo sapiens
uugggggggcgggucuucgguuugcacagcuagaggccaugcagcagcaaaggaugagcagaaccuuggaaaaagugcugugccugaggaacaauaccacuuuuaagcaaggcuuuucacucuuaaggcuuagaacuucagcagagaagcccaucuauucuguagguggcauucuacuaaguacuagucggcccuacaagacaaagcccacccacgccauuggaaaguacaagcaccuaauuaaagcagaagagcccgagaagaagcaaaaaguggaagugaaacucauuaauuuggggacagaugaugaauaugggguuuuaaacauucaccugccugcauaugacaugacccuggcagagaguuaugcccaguauguucacaacuucugcaacucucucuccauuaaagucgaggaaaguuaugugaugccaaccaaaaccacugaaguguugugguugcaggaccaaggcagcaaaacguuccuggacucagugcuuaccacccaugagcgagugguucacaucagcaguuugagugcuacguuugcagagauuuucuuggaaauaauccaaagcagucuuccugaaggagucagauugucguugaaggagcacacugaagaagacuucaagggaagauucaaagcucgaccagaacuggaagaacgguuggccaaguugaacuagcuacuguagacgcuuucaugccagcacuggucauauugcgugccaaggagaagagcuuacuggguggucagaguucgucaggagaccugacccuuagauuucauaagugcccauucccauacccaguaaugccuucacuccucuguagcauggcuguacuugccauuuguuacugcuuaccuaacccuuguuauccuccaucuaauacaaaucugcugcuaacauguauuuuaaaaaaagaaaa

SEQ ID NO: 14018 - RNA, 4379 nt, Homo sapiens
cggagccuaaggggguggggagacgccggccccuuggcccagcugaaaacggaauucuuugccggcuggcuccccacucugccagagcgaggcggggcagugaggacuccgcgacgcguccgcacccugcggccagagcggcuuugagcucggcugcguccgcgcuaggcgcuuuuucccagaagcaauccaggcgcgcccgcugguucuugagcgccaggaaaagcccggagcuaacgaccggccgcucggccacugcacggggccccaagccgcagaaggacgacgggaggguaaugaagcugagcccaggucuccuaggaaggagagagugcgccggagcagcgugggaaagaagggaagagugucguuaaguuuacggccaacgguggauuauccgggccgcugcgcgucugggggcugcggaaugcgcgaggagaacaagggcaugcccagugggggcggcagcgaugagggucuggccagcgccgcggcgcggggacuaguggagaaggugcgacagcuccuggaagccggcgcggaucccaacggagucaaccguuucgggaggcgcgcgauccagguagcuggggccccagggccucgccggcagggggcgcgcgaacgcggggcgcggccucggcggaucggggcuggaaccuagaucgccgauguagauuuguacaggagucuccguuggccggaggugugcauuccacgcguaaaacaggcuuuuacccagcaaaaauccuaaagagagacauugaaaaacccacuguuuaagcuuuuuuuagugguuuuuguucugccaucucaugaucagagaugcaaggaauagacugaauuggggagaaaaggagaaaaggaaagcuuauuuagggaagaagauuaucuugucugucugcuuucaacgauaaagauaaguaaaguauaaguuacgcauucuagauuggauuuaaggaauucuacaaaaucauaguacauggaaaaaaucaauguaaacuucuaagcuacuauaugaaaucuguuguauuguuuucucauagagguuaauugagaaugagacgggauuccucaaccacaguacuuaguuccuuuuauguuagcagugucuuaugagugaugcauaagagaaaaaauauauaguucuauagguuucucauucuuuaauuaucauacucagugcccagauuacaaaaauauuccugcagcaacuguuagguccuuuuugaauggcaaaggaucuucauaaauaaugcaucuuuaucuucauuguuaaaauacacuuauucaauguuuaaguacgaauccugcuuuaauuaguacugauauuuuuuauuucuuuuacaaucucggacaacucuuuuguacuuuaccguuggcuaguggucauauucaguacucaccucacuaucacccucuaaaacuaagcuaauauuaagggaucuuguuaauaguauagauuuuaaagaaguguucauuucuuuugaauucuuagaauaaugguauaacaaaugagggauuuuuaaaggagcaaaaauauuguaaagugcaucuuaaaaacuuaaaauuuuauuaauaauuauaaaaacaaguuauauauguaauucaccauuuucugaaauacuaacagcagcuauuuuccccuuuuuuucuauguaaaauauccuuacaucacuaguagauauaacuuaucacgguuuuuaagagaugaaaugaacauuucuaauauuaaugaaacaagccaacaaaacaugagaaguauacugccuuucaauuaaaugguauauuuuaaagugcauaaacccauaacaaauaacucgauuuuagacauuuaguuaccaaaaauugucuuauaauugacuuuaaauaugacagcaaauguuuucauaauguucauguacacaaauggcugcuacaggauuacuccugcaaaacaucauuuuuucuaaguuaugcaucauccugauugacugcuaacauccaagcucuauuuauuuauuuauuuauuuuauuuuuuuugagaugaggccucacucugucggacaggcuggagugcaguggcacaaucucagcucacugcaaccucuuccaggaugcaagcgauucuccugccucagccuccugaguugcugggacuacaggcacgccccaccaugcccagcuaauuuuuuauuuuuuguaguagagacgggauuucaccauguuggccaggcuggucucgaacuccugaccucaggugaucugccugcuauggccucccaaagugcugggauuacaggcauaagccacugggccuggcccaagcucuuuuuauauagcaaaauauuuacuguuuaacauuuuuaaaucuuagcuauuauaaaauccuguaguauacaaauauaguuaguuuuauauuacauuaaaaauauuauagucuaaauuuaaaaugaugaacuguuaaggaaaaaucauuuauuauaauuuuauaagauuuugcaugauuuaauuuacuuuucccuucuaaucuccaacuuuggcucaaauuaucacacuacaagccaguuaugagcucagacacaugacaaacaaaagccuuccgcacgggauuugcuaugagaacuaaauaaauuaaaaaaaaaagaaagaaaaaaacuuaguuguuuauuuucuccccuaaaccauuacucccaacuucuaacaaacaguaguugacuaccuaauaaauauuuguagaccuggauuauggaggaggggucagcaaggcaaauaauuuaaaacuuuaaaagccgaauaaauuuaacucugccccuaaaucauuuaacaaaauagauucccauguuccaauggaaaucaagauuuguuuuuccauaaugaugaucaucacuuuaccaucaacuuucuugucucugcacguuuagagaauaaaauggcauuuaauuuguacugaguauaaccugaagguggggugggaaaguggauugcaucagcaaaugaagaaacaccagacaucagagaccugaacaccucugcacugggugaaaacuuugcaauuagguguuucuuuaaauggcuccaccugccuugccccggccggcaucucccauaccugcccccacccuggcucugaccacucugcucucucuggcaggucaugaugaugggcagcgcccgcguggcggagcugcugcugcuccacggcgcggagcccaacugcgcagacccugccacucucacccgaccggugcaugaugcugcccgggagggcuuccuggacacgcugguggugcugcaccgggccggggcgcggcuggacgugcgcgaugccuggggucgucugcccguggacuuggccgaggagcggggccaccgcgacguugcaggguaccugcgcacagccacgggggacugacgccagguuccccagccgcccacaacgacuuuauuuucuuacccaauuucccacccccacccaccuaauucgaugaaggcugccaacggggagcggcggaaagccuguaagccugcaagccugucugagacucacaggaaggaggagccgaccgggaauaaccuuccauacauuuuuuucuuugucuuaucuggcccucgacacucaccaugaagcgaaacacagagaagcggauuuccagggauauuuaggagugugugacauuccaggggucguuugcuuuucaggguuuucugagggaaagugcauaugaaauccuugacuggaccugguggcuacgaaucuuccgauggaugaaucucccacuccagcgcugagugggagaaggcagugauuagcacuugggugacggcagucgaugcguucacuccaaugucugcugaggaguuauggugaacccacaacuuaggcccuagcggcagaaaggaaaaccugaagacugaggacaaaguggaggagggccgaggugggcuucaguaaguccccggcggcgcuuuaguuugagcgcauggcaagucacaugcguaaacgacacucucuggaagcccuggagacccucgcccaacuccaccagauagcagagggguaagagaggaugugcaagcgacgacagaugcuaaaaucccuggaucacgacgcugcagagcaccuuugcacaggaugcuggccuuugcucuuacuacacugaggagagauucccgcggguuccgcaggcagacuacacaggaugaggugguggaguggagugagagcaauuguaacgguuaacuguaacguuuucuuucacacacacacacacacacacacacacacaugcuaggaugcggaaauccccuuaugacuugcuacuuuuugauuuugugauauuuuguacuuuuuaguuguucagcaacugucuuauuuaauggggagauuuuaaguaaca

SEQ ID NO: 14019 - RNA, 456 nt, Homo sapiens
ucuuugcaaggcugcggugucugcugcuacucuccgagcuucgcaaugccgcccaaggacgacgagaagaaggacgcuggaaagucagccaagaaaaacaaagacccagugaacaaauccgggggcaaggccaaaaagaagaagugguccaaaggcaaaguucgggacaagcucaauaacuuagucuuguuugacaaagcuaccuaugacaaacucuguaaggaaguucccaacuauaaacuuauaaccccagcuguggucucugagagacugaagauucgaggcucccuggccagggcagcccuucaggagcuccuuaguaaaggacuuaucaaacugguuucaaagcacagagcucaaguaauuuacaccagaaauaccaaggguggagaugcuccagcugcuggugaagaugcaugaauagguccaaccagcuguacauuuggaaaaauaaaa

SEQ ID NO: 14020 - RNA, 21372 nt, Homo sapiens
uaaaacaacugcuuuguuuuuccaaaacuuggcccauuacagcaugaaauucacauuggcgaagugaaaaggauuaagccuuuuucaguagagcagguaugaggggacuuuuuacuugguaagaaaaacuguuguacaggaaaugaacauaguucacacuccagucacauuuuaugcagucaggaacugggugagcagaguaucaucccaggcauauacagucugaagaucuuuuaagguucuacauaguuuccugugauacagcagauauagucaagaaagauuucccaggacccaguucccuggcuugcuggcagguuucagauaacugugauuggccucauuuggggacuuugagguauauagagacaaauucacguaacuagugcugacagguuauuuuaucuucaauuaggugguggcaugcaccaagaucagauuguucuaccugaguuaaagauguuccuccuguugccuuuugugaagcaggagagaaucagagcaccaguggaacaacagcagugagaagcucaucagcuucacgaacugaccacagaccaaucagugaauuccuguccugcuuucacuuugcuuuccgugcuauguggaaauaagagcucuccucauggguccagugugaggaacagauagcaagcacugauuggguggaaccagccaaagguagcuaugaauaauaguacaaaaauaauuuuuauuagggaaaggugaagccgauuagcccucaaauccuccauuucuaagcauagacucuuguuaaagguuguacccauuaauguuuauccccaccacugauccaccauuguuacccaggguuauucugauuuaggugccgcagaggaacuggaauggauaagucaguucauugagcaaacccaugagacuuaucauaguacccagagcuucaagcugcauguagccugguguuggugguggggaaaagucccugcugugcgucacaugagguggugacuuaacuguuaaccugaaucaccagugugaauacccaguuaaguaguaaggcacagccccugugagaguaaguccucauuucagugaugaguccagagaguaagaauagcauaaagauggcagaggacuucacagugguauaggggagcaagcaucacuuuacugggggaggguacaggggggucuuuaucaucaccagcaucaucuuguucaugcaaaggucauuaucugauaaaguggauggaaguuccaaagaagaggacagggacuguaaacucugggcuauucuuuauucugcaacauugauuaaaaguugcugugacaggcucugcccuagggcuccaggauacagugaauaacacagauguggugccuacccucaugaagguuaccuuccauucagggaagacaggcaugaguaaguaauaaaaauaauuauagauuugauaaggguuuugaagggaacaaaaauaagaggcugagguagagaaucauuggugaagggugagaggaagccauuuuucaaagaauauuagggcaggagauauugaaauugagacuugaaugagaagguaacaacauaguaauaaacauuugugaaaaaggaaacauacaaaggcccuaauguguuugaagaaguuugagaaaaaugaugugacaguucaugguuguguuaggguuacacagagaaauagaaccaauaggagauacauaucuaucuagauauauaccauauauauaaaacauuuuuguguuuuuauguauaaaggacuuuauuauaaggaauugguucacacgauuauggaggugggcaaaucucaagaucugcaaggugagucugcaagcuccagaccccggacagccaaugguguauuaauaauaugaguccaaaggcuugagaagcaugagagcuugagacccagaaggagccaauguucaugucugaagggaggaaaaagucaaugucguaguucaaaggcagucaggcaggcggagucaggcagaaggaguuuucuccuguugacuagagggccaaccuuuguguucuauucagggcuucaacugaugggcucauccacauuagggaguguguauugguuaguuuuaugugucaguugggcuaauguaagagaugcccagauaccuaguuaaacauuauuucuggguguaucugugaggcuguuucuggaagagauugucauuguaauuggacugagagcaaauuacccuccccauuguaggguggguaucauccaacccacugauggccugacuggaacaaaauggcacaagaacauuaaucugacugcuugaguggagacauuagucuucuuuccuuguacugggacuuacagcauuagcaccccuggguuucaggccuucagauugucauuugcaccacuugugggacuuguuagccucuguaaucaugugagcccauuccuuaucucauuacagacauacacauauuuuauauguauaaucuccaucuuacugguucucuuucucuggaaagcccugacuaacacagagggcaaucugcuuuacucagucugcugauucaaauguuagucucauccagaaacacccucauagacacauucagaauaauguuuuaccaaauaucugggcaucucuuaaggcagucaaguugacacauacagugaaccaucacauagagucaaagacaaggagaggauuacaaaguuagagaggcagggccuugcaaggcuuggcacagauuauagaguugauucugauuauauuuggggggugggcuguugacuauugaaggaguuuaaggagugaugauuucucuucaaagcccuucacucugguggguggugacugcuuugaagguaagauuauuguccagaugagguggaggccaugggagagaugaugggagcagagacaaaggaaauggagacaguggaccccauuggaggaauauuuuggaggauuggauuugggaagggaaagggauaaauugaguauaaccgagcuugugaagaaagacucugcacuuugcauuuucugugguaagaugcagaauaugaguugucucauccucucagucaggagucaucaaacuacagacuccuguuuuuauauggccuucgagcuaagaauuaucuuuauguuuuuaaaugguugagaaaaaucaagaguauuuuuugaccugcaaaaauuacaugaaauucaaauuucaguguccauaaauacuuuuaugggaacacagccaugcucauucauuuauguauuuucuauaacugcuuuugcccuagaacagcagaguggaguaguugugacagagaccauauggcccacaaaaccuaaaauauuuaucaucugguccuuuacagagaaaguuugcugaccucugugcuaguuuauuuagcacucuauggaaaaacaugcuaguguuuacauguccagcacaucuaacccuuagauaccucuuggcaaggaugcugucccacgugugaauuuaucugucuuuucucuguagagcgaagaaagccaacuuauuaaacgagcacuuuguuugccagccuuagagccuugaccuugccagcagccaauuaaggcguuuucuaaaauugcagauaguguagaggugaucggcaaugaucaugaacaaagccuccuauuaugcuaggguuuccacagguuuccucugucuuggaagguaccaccugggcccuguuggagggaaaacaaguuugagggcuuguguacccugagaguagaggggcagaguaugagaaggaaguaaggaaagcagugcuggcaguagcucauaccucaccuuuuuuuuuuuauuuaaauucuccagggauugucuccuggcuugauucagcucuucaggcccuggagaugaaguucugugucaggcaccaagcaucuguaugcgguaggcagcuggaggucacucucuugaucaccucuuguguggacaaguuuucuuacaagcagaagcccauccccaggcauccucuagugcugacugacgagauaggagcaaaacucaugcaaccugccuuucagaugcaaauagaacauuccuaaguccuuugaggcacucugccaaugugguaaauauucucuaauagguauaaauuugauacucaauuuuuuguucauuuggggaaaaauucugaacauuuauuguuggauacaauuucccaaaacauacuguagggguuucacuuuguuaggauguauuuacacaaacgugaaaaugaccucaugauuuaagaucacagaagcauagaauggcuuuuagacagggcuucucagccuaacucccuuauuuuuaguaaggauuucaggagucgagagauucugcaaaaaggcacccugguuagugagaaagucagggcaagauacugcugucuguggccaucaucgugcuccacgcugccccggcgcucuccacacccucuucugagaggugccuuucugggcuccaugcaucugcaagcucugcugauucacuuuuagugacaugagagugugagaguccugcugucagagaaaugccauuauagcuuuugauagcugagauaguguaaguaggacccaggcuuucacuuuugaagccagaaaugggagguuucccagugcagcucuugacguuggcgcaugcaaagauucucucuugggcucagugaaauuucuagagcagugucacaucuucaguaaagaguauuuaauguuccuuuuuugucucuguuuacuuucuguuuccaucuucuugaccugagauuccauuuugccuuugcuuauaccucauggaggaaucugaaaauaauaccgagcaggaagcguucuuaaaaaauggaaaaaaaaaaaucugcuguuccagcauuauuuuuucauacuaugcuaaucauuuuugaauacauuguacagaugguagguuguauuuuagcggaggguuuuuuuuucaagccaaguucauagacaugaucuugaauuuguaaugcuguauuccuaagugucuuuuuuggcugucaaaauagugcugucuuuaaaaaguacaauguagcuacucuggguaaggcugauuauuucugcuuucuuucuuuauaaaaauaaguauuuucucuuauuaccaaaguaacauuuacuagagaauauugggggaauaaaagcaaaaagagggacaguaaauugguuuaaguaccacccucaauaucagcuacacccuuuucuuauccccaauccucucuuugcuuuggucauacaaugagcacugugauacaaauucauucaguuucaucuugacugucuuucacugagcccaagagagaaucuuugcaugcgccaacguuaagagcugcacugggaaaccucccauuucuggcuucaaaaguggcuucagaagugaaagccuggguccuacuuacacuaucucagcuaucaaaagcuauaauggcaucagauacacaggggauaacaauaccuagcuuggaggacgaauuaauagagggcuuaacugugugauuuucaugagagacugaaagaucauggguuuuugggacauagugaccuggguuuuaauucuagaauuaaaauucuauguuccauguuacuugcuugcauuuuaacuauaaauuaggauaaugguuauuuggggaaguauaauguaaaaagccucagguaaugccuggccagggagucauauccguugacaugguagcuggcaguguuggcccucacguccugagcaccuaccguguacaggcuuggcuauggcagacuuuauuguaaagggccacauagucaauauuuuaggcuuuguggaguuaaggggcagaaucaaggguaugaaguagguacuuauacgcccauuuaaaacguaaccauuuaagaauguaaacagaaaacuuccuuaggucacaggccauacaagacaugcagugggccagauugggcugacuccuguuguagggugucuugacauuuacuuauaauuuucacaacccuaagaaauagucacacuuuuuuuuuuuuuuuuugaagcagguucucacucuguugcccgcccaggcuggggugcaguggcacaaucuuggcucacugcaacccccgccuccuggggauucaagggauucuccugccucagccucccaaguagcugggacuacaggcaugcgccaccacacccagcuaauuuuuguauuuuuaauagagacaggguuucaccguguuggccaggcuggucucgaacuccuugccucaagugauccaccugccuuggccucacaaagugcugggauuacagaugugagccacugugccuggccuugucacgcuucuuauaaauggcaaaucccagauucaaacugaggcagccagagccaggagccgccucaguuggaaccacugcacucuccugcugaaggucuguuuuacaacuaaccgcuaggacccuguuucccucguccugcaccuucagcuuuccccuucuuugcugcccccacccccucaacccugcccuuaggcuggagcuuguggagcucucacuccucagggccuuuuccugugccgaucugucuuuguagaauaccguucuccugguugcuuggcuaacuccuucuucaggucucaguccaaaucuuaacgucauuuggagaguccuuccuaacauauuuguccuugggcccuagguguucugucacaucauccuuuauucuccagaugcuuugccugcuucccucccuggcagcauuuaucagguucugcaacuguauugugcuuucucuuuguuuauguguuugucugcuucugcccaguggaauauaaacuccucaaggguaggaucagggcuuuguccuuuucauugauacauuccuagguccagaacagcgucuggaacauaguaagugcuuaguaaauauuugacaaacgccuuaauuugcuugccaacugucguuguuuuucagaaaucagcuuaaauuuuucagcguuggcuuuccugaucccaaauccagguagauuuauuauaguacccccauuauuuuccuugguaccuauaaaagccaccuaaaauuugguaaacucagcaccugagaagcaagucagcaccgcuugcauggagggggagauacgaggcgugaaucuuaguaaccuauagcagccaacauuccugcgugaggcaaaaucucaucuacagcaagagaugagaagucacgcagggagaaacaugccuggcaaagucauuaccugacuccagaugugguaggagcugaggguccugcuucucaaaccuucaugugcucaagggauaccugggaucuuaugcacauucugauuuaaauuaucugggguagggccacaauucugaauuuuugaucuacuuuaagaugcugcuaaaagcugcuguuucgacagaccacacuuauaguaacacucagaucaagguuucucaaccucggcaauguugacauuuugagccaaacuauucuuuguugucagggguugucaugggcauuguaggguaucuaacacuauaccuggccuuuaccacuagacgccacuagcucucccccaguagugacaaccagaauugucuucagacauuaccaaguauccccugcggggcaaaaaucaucuuaacuugagaaccacuggccuagaugcuucucuguucccaguuugcuauaacacuugcuuggaaucucugagccaaugaguuucccuuuugccugagcuaguuuaguuagauuguuacgagcuuguaguugaauccugcagcuuacauacuugacaguauauaguuauuugugugcuuuuauauauauugaccgucuacucugccgagcucuguaacuguacgcuuuauguaucuucauuucaguacuuaguguggaguccagucugugagagguaguugauacaugcugccuauugaaauucuauaagggaugagguaauacaugcuuuuuaaaaaaauguuauugaagcacaguauacauauauaccccaaaaacccagaaaagugcacauaaguguauauagcuugaugaguuuucacacuggaaauucccaugucccgggccuccagaucaggaacagaguaagaccagcaucccagaagcuuuccuccauuaacucacucuguaauuuuuuaaauuucuuacagauacaagaauauugacauugguggacagauagggccuuuaaaauaaagguaguagaagcguguucuaaaacuuuaaguuucucaaagacaacaaaagguuuuauugaaugacuaaauccauacucucuaggucaggaggcagcaacccuuuucugucuaaagagccagauuguaaauuccuugggcuuugcaagccauuggccucuguuguaacuacucagcucucuuauagugcugaaacagacagauaauacauaaacaaguggguguggcagugcuccagaaaaacuucauuuacaauuagcagccagauuuggacugacacccugguuugccaaugccuacucuauuauuguugaaaauguggccuguguauugaaaugugaauauucacaauaauugcacaguucagaguaugggaugugguauuaacuuuuagcuguuuuucacaaaggaucuggugggguacaccauucccuucaggccagucuacuugccccuuugauguucugcugauugucccguguguccugaacuauuuuguuccuccccucaagucuguccuggaaucuguuaccuucuuugcauggguuucucagucucuucuaaugaaaguggccaaaauuuucuucaaguacagagucuguuuaguugcucacuagugauuugcauccaguuuucuucacaaaugcaugcaccucaucacugauugucagcaaauugcugucuugguguuguaucgcagcucugccugcccucugcucugauuuccuguccaugcuucagccucccuacaguagugugagaaguuauauucuacucucucagguaguaagagucccugccuaaaugaaguucaaacuaaaagcuguugccuggaugcagaugcccuuuaacuucuaaauaauuacuaucuaaaagcccuaucuuuaucuuccaaagcccaagguuuuacuucuuauuucuuaaaacuaccaugucuaauguuacauggcuacacuuauaggagcauugcugaugcuuauuuguucuguucuugaugaaggauuuggagaucaaaagugacauuccuucauuaaaguaauugaaauuauuuccagaucaggaugucauggcugagauaggcuaaguuauaguaacaaacaaacaaaaacccaaaccucauuggcuuaaaauggcauucauccgauucauuagagaugaaagugagcuauuuagauuguuacucuguuuucuaguaaguuauauauaauucguuccauauuuaugauauuaagucaucaguacuuugucauuuugcaaagccagguuuucugaaagucuaccagaaaaaaauaccaugccuccuaugcccaaaguacccugccuugcugugucuucacucugggaugcauccaggcugacagagcagccucgacuucuaggugcuucuuuucucuccagauagauauauuuaaugaguuaccauguaccuuucuauggugaguguuuuuuccccuuucuuauuaacagucagucacuaccugacuuuaagacuuauuguaaaacugcaguaauuaagacagcaugguauuggugaaagaacagacaaauagaguaguggagcagaauagagacacuagagacccacacaaauauugucaacugaucuuugacaaaagagcaaaggcaauuuauuggagaagggacagucuugcuaacagaugguucuggaacaacugaauauuuuugcaaaauagugacucuagauacagaccuuauaccuuucacaaaaauuagcucaaaguagauuauagcccuaaauguaaaaccuaaacuuauaaagccccuagaagauaaccuaggauaaaauauaggcaauccuggguuuggugaugacuuuuuagauacaacaacaaaaagcaugauccaugggaaaaagaaguugauaaacuggauauuauuaaaauuuaaaacuuuuguucugcaaaagacgccguuagagaaugagaagaaaagccacagacuuggagaaaaucuuuacaaaaccccauuaucugauaaagggcuauuaagcaaaauguauuuaaaaaccuguuaaaauucaacaauaagaaaacccaauuaaaaugggcaaaagaucugaauaccaaaugauauaugcaaaugaaaauaauuauaugaaaagaugcuugagauauguuagggaacuguaaauuaaaacaacagugaaauaccacuagacaucuauuagaaugacuaaaauucacacgcucaucauaccaaaugcgggugagaauguaaagcaauggaaacucucauucauugcugguaggaacguaaaaugcuacagccacuuuggaagacaguucggcgguuucuuuagaaagcuaaacaugcaacccagcaaucaagcuuuuaguuauuuaccaaaaugaaaacuuacauccacgcaaaaaccugcaugugaauguuauagcagcuuuauucaucaucggccaaaauuggaagcaaucacgauguccuuuaauaguugaauggggacacuaugguacauccaugcaauagaguacucuucgugguaagaaacgagccauccagucaugagaagacauggaacuggcauacuacuaagugaaagaaaccauugugaaaaggcuauaugcuauaugauuccaucuauaugacauucuggaaacggcaaaacuauauagagacaauaaaaacaucagugauuuccagaguggcagggggugagaggaacagagagaugaauugguagucaagggauuuuuagggugguggaacuguucuguaugacauuaaagguagcuacaugacauuaugcauuugucaaaacccguagcaugugcaacacaguuaauccuaauguaaacaauggacuuaaguuaaucauauauccauagucguacacgaauuuucaaaauauaccacauuaaugcaagagguuaauaguagggaaaacugcauauaucagggugggaaggaggaguauauauacuuucuacacauuuucgcuguaaaccuaaaacugcucuaaaaaagucuuaauuuuuuaaaaaccuggauacuuaccuuuucuauacagcuuuaucaaaauaagguuuugagggauuuucacaugauuuugacuaucaaaauaagguuuugagagcuuuuccuaugggaaaauugccacaucuuuagucacuagccagugugacaacugucuucaccugucagagaccuuuucacuuuuuggaugguucuccugcguaucguugcuugacagcuaagcucuggauagaugcgauauuaacucuguauuuguuguccuuucuguucguuuuuucuucucuccuucaauaugaauuuaaaaagagacaugagauagaaauacucugugauuaaugucuaauagggauguauaaaaagugaugaagugucuagauuuguaaaggaguaauuugccuaacugaauaugucguuuuuggaaacgauuacccuggguauauuuuagaagguggguuaaaagucaucuguacaaaaccuuggauuugagauguaauaauccaguaacuuguaaacuuaaucuaccuauuacugguucuuugccuuccuuaacuaccacaucccuuaaggggaaaaguguauucucuaccugguacguggauguuuuucucaaaucacaguuuuaacucugucugugccuaccagacugugauuuuccauucaggaaaugccuucggaauaaaguccagucuccccagcaaagguacuaacauuguugggcagugguauuaacauuauugggcagugguacuagugugugaaggguguugcugagaguaccaagccugcaguuacggcuccccugccuguacauggagccccgucccuuacuucuugccaccacugcauccccacagggcccacaaucaucggacaccuugcggcuuuugcgugagcuuauuccuguguuuggaaacgccccugccuugucuguacuucaagaaucaacuuaagcuagcuucauucucccauuuccacaaaaacuuccagaacucuguacacauuucauucguaggacucaggacugugcaucauuggauuuuugucuaguuacauuguuuccuuuacuugcugaauuuucagggugagucacuuguuuguuuucugucauguuuugaguacccaauguguuuuuguuuuaacugaaucaauacauaaguuaacaaauaaagcaaaaccaauguauaguaaagcuaaugcuagcuacugcaagaaaucagugccaaucaaauauauuuauuccuccaggcuccuuccauuuuguggcucugccggucuucuugaacacauggcuccugaggcugggguagagaaagguaaggaauguggagaauuguuucuuugggggcauaugggccagaccaggaaacaaugcacauuauuauacuugcauuugauuggccacagucuuaguucaacgcuaacuguaagugaggcugggaaaucuagucuagcugugcacccaugaauaagacaaaacggguuuugaacagcuagcaagucucugccacaaccuuuauuugaaauuaaucgacauugagauuugaauucccauuacuuuacacugagauaguaauauacuuuuuaauuuaauuuuuuuuuuuguuagaugugugcucuugcucugucacccaggcuggagugcaguggcacgaucauacugcagccuugaccuccugggcuuaagcagucccccugccucagccucccaaguaguugggaccacaaguacaugccaccaugccuggcuaauuuuuaaauuuuuuauagaaacggggucuccccgguggcucacgccuguaaucccagcacuuugggaggccgaggugggcggaucacgaggucaggagaucgagaccauccuggcuaacacagugaaaccccgucucuacuaaaaauacaaaaaaaauuagccaggugugguggcagacgccuguagucccagcugcuggggaggcugaggcaggagaauggcgugaacccgggagguggagcuugcagugagccgagauugccccacugcacuccaaugcaacuccagccugggcaacagagcgagacucccucucaaaaaaagcagcagggucucccuguguuguccaggcuggucucaaacuccuggguucaagugauguaagccacuuuuauguagagcgugguauagagugagguauuaggaaagggaauuaagucccucuugaagaaacgugaguuauuuagauuguuacucuguuuucuaguaaguuauauauaauucguuccauauuuaugauauuaagccaucaauacuuugucauuuugcuacgccagguuuucuggaagacuaccagaaaaaaauaccaugccuccuaugcccaagguauucuuuggcauagaacuacuaauuuuaucacuauaugacaauaacacugccucguugaauuaaaugaugcauguguuacauuauuuuuggaggauuaaggaguucuauaaguguguuucucaguggcacuaguguuugaaggaaaugguuuuuuagauuucaacauuguaagagaauuagaauucaaucaguaugauaaaucauugaacuugcuguugaaggaccuaaauuuaaauuaaaccuuuaaaugcaauaacuucuuuucaauucugguacuacuuggagaucauggagcucuuaaguggaaugaauuugauucacaaguacagcaauuguuccuucaauugccgauguuucccacaguauauguuuuauucuuucaaaguuuaaucaauaagcuuagugaguugccucuuucucaccuguuucuuauauacaacguucucuaguuucuagauuuguggggcuuuuuguuugacaucaggauuguagguguggacauaauugugucagaugcauauuuuauuaauuuccuagcaagagagaugauuuuaaacaucaagcuaagaaucucaggaaaugauguguuuaauaauaaacggacauuaucccagguauucacgugaccagauucacgucugucagauuuaguuaacacacuucaacagugcgacuaaaaggaacugcacccagagcuugcaagccagugcccugcucaucccugcaccaggguggaggaauagucaccaaagguggggauugucuucaagauccaaucagccagaaggucugucuccccagccuugcagaagucaagaccacuugccuacuugcgacugggguauugcauugguuuucuauggcuucuguaacaaauuaccacaaacuugguggcuuaaaacaacugaaauuaauucccucacaguucuggaggccagaauugugaagugguuccacugggcuaaaaucagugcuuucacagaaccacaccucccccuggaagccauucuucucacagucucuaagggagaaucuguuccuucccucuuccagcuucugguggcugcccaaguucuuggcuuguggcugcaucacuccagucucugugaccacaggccuucucuugugucaccacguugccuucugcuucccuauuauaagaacacaccugacuauaucuagaguucacccagauaauccaagauaaucuccccaucucaugauccuuaaucguaucuucagaauccuuuuuaacauauaagguaagauucacugacuccagaaauuaagacauggauaucguguguguguguguguguguguguguguguguguguguguguguguuuuggggccagggauggggaggggggguuguuguaauuguuauccagccuaccacagauauuagaaacuguuccauaaaugacuguucugaaaguaaauuauuggcuauaaugcuaaugguuuucuuuuuuuuccucauccaaguucuaguuaggugaaaacauagcucucuaguaguuugcugcacauuuccugugaaagugaagauucuccuuucuuaaugaagagcagcucauauaugaugacaaaacagaggcaagguuagcacuuuugggacauguuucauauuuuaguuuuaauuucugaucuagguuuucuguauucucugguugguuaugacgauaaaaaucauggcauuguaacuauuuauguuaugaaauauccccuaagaaaauauauuagacuaccuuuuaaaaugauacuuauauuuauuuucugauuagaaaaguuauagcucauuucagggaauuuacaaaaugcagaacagcgugaagaagaaagaacucauaaucuuaaccuagaaaggacuaguguugauauuuuggguucuuuuaucauacgacauuuguugucucccuagaguguuaagcuauuguuauaccauuuguccagacggauuugaaacaccaucaucauuauuauagggaaacaaguuuuuucaaaugcaguaaaacugaagaagcagagucguuguuaaggcuuagacucuacuuucuuccucgguugaagacauagccuuacugaccugaauuuacaaacagagcguaauauuuacagaugcuucuuuuaauggaaguccaucaacuguuaguguaaauucuuccugaauacaucuuuaagcuauuuucuugcauguuugaauagaacuuaaauauugagagauguacugaacagggaacaaaaguugaugaacaaauaaguuugggaaauagugaauacacacagucacacacacauuuuaauaaaagucgcagcacguaucagcguauuaaaauaucagagacuuuccaaaauaauggagcuucuuaaaucuagaguuccccccagcugauugauuuuuuuuuccuaaucccuauaacaagaaacuguggaacaaaauuugugaaguaaaauaauaauuuagauaaggguuauccaaauguuuuugguaagaaaagaguuugguuggucaaaaaaggauguguguguguggauggaugaguaaauagagguguguguggauguaugucucuauauaaauauuuuuauugccacccuugccaaaauaaguuuuuaaacaguggcuuauuugaaucugguaucaugaaaaccuuauuaaagauaucuuacauucuaacacauuagauggcuuuucucugcccuugggagaauuuggaauuaaaaucuaggaauaguaucaagcagagugaaaguucaagggaagagugaaagagauuuguauuuuuuuuuuuuaaaugugugaaagccucccgaccucucccaccaagugucauuauggccugaagcugaauuacuucucaucugauuaaaucagaaccagauucugauacuuccuaacugcugugaagugcagauuuuuaaaauguguuaaaaaaaaaaaaaaaaagcaagaauguaauccuaguaggaaacaacucucuuagauaaauuagcauuuuuaauaucauuuuacaacuuugcaacauacaaaauuauucacccccuuuauguaacauguaauuauuaaccgccuggucagaauaugagcauuaauuuugaaauugagguuucuacguuucuauccaugaagguuugagaaaucguaggcauagguggaaaaccauacuaaccuuguuuuagugucgguggucugucgaaucugagauuuggugacuucaguaaugucauuaaacuuuugguuuuuauacuuacggaauagaaaaggggcucaguugauagaaacaaggggguaauccagaaauuggguaaucgaauuuaggaagcagccacagguaugcauuuuaacauucucuuuucaagaauauucucucaaauauuuggggagugaaaagugugguuucucugauggguuaaaaauguaaaagccugaggccgggcgugguggcucacaccuguaaucccagucaccccuguaaucccagcacuuugggaggccaaggcggguggauuaccugaggucaggaguuccggaccagcuuggccaacacggugaaaccccaucucuacuaaaaaauacaaaaauuagcccgcguucuagugagccgagaucacgucauugcacuccagccugggcgacaagagugaaacugucuccaaaaaaaaaaaguaauagccugaaaagaggaguagaagaggccauuauaauuuaaaagcccauugcuacuagaugauuuuacuuggcuuggcuuauguaucuucaucgcuguccuguagggcaguggcuuucaggaauaccaggacuucagcagcaccugaugugguguucaauuuugggugucaauuggacugggccauuaugcccacuuguuuacucaaacaccagucuagauguugcuauggaguuauuuuuuagaugucauugauauuuaaaucaguagacuucgaguaaagcagauuacucuccauaauucuggugggccugauccaaucagcugaaagccuuaggagaaaagauugagaaacccagaagagaggaauuccguuccaguuuaccuucagacugaagacuggaacagugacuccuacuggaauuccacccuacuggccugcccugcaaaauguuaaacuugcgaggcccacaguugugggagccaacuccuugaaaucagucaaucucucccuucucucccuuuuucucuuuacacacacacacacacacacaaacacgcacacacacacacaccccuauccacccacccacccaguugguucucuuucucuggagaaaccuguuaaacuugagugcuuauuagaaaugcaaauucuuagaccccacuccagaccuggugaauggaaguggggugggccccagcggucuucuuuaacaagcacuccugcuagugcugguggcccccaagccugagggccaccguaggcaaaugaaagaagcccccuuauaccauugaggaaauuuagguucugaaagauuuaaauaacaugcccaaagucauccaauugguuaauagcgucagccagaucuauucuuggugcuuucagaaagauaaaauaauauccauugauaccuuaguaauuuuugaaucugcuuuuauauaaucguucauuguuaugaugcccauuuuccuuaaggaaaaaaauaacaugaagggacccaacuauaucgauaugguaugugagagcagugauuccaaaucuuuguaccaccagguaucacuucuauuauuucauguaaugagagauuuuuguugacuaaacaagcugcauuuuacagggauauuuauuuggccauacugcagcuccaggcuccugacuggcacgaguuggccagugcugcuagcucaagugaugcaucgcagccaaaagcagagaggcuugauguuuuaauuagccuggaaaccuaaauguagaauuuucuuuaggcauuuugaauauugaacauagcuacggacuuuucauuacuauauuauaguuuuccaaaacaccuggagacccuugugggguaucuuugcucuaaagaauauuuucagguauagaugcuuagugcugccauauguacagcuaggauguauuauaagggcauaaaagauaaauucccaaaucuuaguaguacaccacuuuuucauucaccaguucugguuuagguggcagcucuccugcaagcaguagaucagagacucauggucggucuuucugucuugaggcuccauggccaucagcauguaauuuccaagguugcugggcaagcaggagaguguggcaguguuuccuggucaggcuggcacgugguguucaucauuuccauccauauucuguuggcuggaacucagucacauggacucauccaacugcuagagaggcuggggaaugucgucugaucgugugcccaggaacaggaagaaaucaguuugaugaucaacuggcaguuucugccaccugcggcuucagugcucugauuguugguaguuuuguguuucugcccaugauggauuuaugucccuuccugauaaccacaguguggcggauaugaguggugguaauagacuuaggcguuauuaaugccaccugacucuuucugaguccuuccuagcuugugcaaacagagccacagaaacuauaacucagauuguacuggcucuugcccacaccuucagcugggaucuucuaccauuccuagguuuucaucucuuuauaucuuauggacuaguuuauuggcaauacuuaccauauggccucuaucaucauuuugcucucccacuucaugugcacuccuacuucucuugccaccauuuaaauucacugccuguuuagucaucucaggguaccccaguacuaccacugugccaagagaguacugucuuuugggauccauagccacugucccccuagaggcuugagugguacuguauuaagagcagaaguaaggagaauacccuuugucuuaguuaucuguugcuaugaaacaaauuauuacagagaacuauaauuuauuuuuccucccaagucuggguugaucagggugacugagcacuuauucuguuccauguacuuuuggcuuagucacucagguggcauucagcuggaaacuuggcuggagcagauaagucccagauggccacauccuucagggcuucucuccaugugaccacucauccuucaguagucugcccuggcuuuccuuugagcuuggcugcagggcucuaagaaagaggcagccgccagguuucuuaaccucuugaaagucuuucaucacuuccacugcauuuuuguuggucaaaacaagucacaaagccagcccagagucuaagagaaaggaaaaaggucuuguguguucagggaugggaggaauuguuggcgacuaucaccaugucuugucagccugucuacuuugcagcuuguaccucagggcugugcuaccuguauugcaguaugucagucacucauugaaugauuccuucuaccaccaguuuaaccauucuccggaggguucaggcuacugccaucaucuugauagccucaauucugggaaugugagguaugcggaggaaauaaugaaugaaacaguuuggcuggugcugagaguuuguguuaugaggguagugagcuugaagaauuaagcaguuccugaauucuaggcuaacgggcuggggagcuugaaaccaguggugguaaauuggagaauagucuuuaaggaacaugaaucccacaacgauguauaaagaagauugauuugugacuuaaauaaucguaaauuucaaaauugcugaaaaagaguaggucuuaaauauuuuagcacaaaaaauaagugugugaggugauggauuuauuaauuaguuugauuuaaucauucuauaauguaaacauguaucaagacaucacaguguacccauauaauacauacauauaguuuauguauacauaaauacaauuauuuguuaauuaaaaauuaaauuuuaaaaagcauauauuaaaaauaacauuuuaaagauaaguaaauauuaaaaagaggguugaaggguaauaucauuggccauagccaccauaugcagacauggaaugagcagucguccauggacuacagggagaauaggaaggccuaaaagaaacagucaugaaaggcaaaggaauaaucacugugacucugagaugaugugggcaggcagaaagaaagcaggggaggcugggagcaaugaacucucccauaaauaccaguuaaaaaauauugguagcagagaggucugaaguuaauauggaacaccagcacuaauuggaaauaacugagggacuguuauaauuauuuaaauccuaguuuggucuugugggggguggugguagauuugcuuuauuagucagcuuagaauguguuaucccaugguaacaaacagccccauaucucaguggcuuauggcaacgcaagauaacuuucuuaccuguauuuuggcuacggcagguuagcucgaaucugcuucacaucuuuuugcuguccaggcucaagaagcaucuccuauccagagcaugccugucucaggguggaggaaaaaaaaaauugauggaagcacaugauaagucucaagguuuuuguugggaguuguacgugucccuuucgcucauauuuuauuuuuauuucaugagucaaaguacgucacaucauuaagccugaugucuauggggacaaaaauuauacuccucccauaaaaagaggcaccaggaaagggucacuaagaaggggcaguggauauuuuugaauaaauaguguaaucagccacaguugcauuuuuucuauuuauauuacaca

SEQ ID NO: 14021 - RNA, 161728 nt, Homo sapiens
ugggaacuggguucuugggaccauuaacaaaacugaaaggggguaaaaauaucaaugggauggugucaguggugugguagugaaacaaagauccaaggcuccccuuaaagggggagaaaggagagauauuuucuuuucuuuuuuugccucccuggggcagccuggccagcacaggcaagacucagaguggagugagaagugaagaggaugaagggucgggagagaaagggaagagagagaggcgggggcuaguccccaacguggugacuucgcugcgcaccuguggggccgacgcucugaagcgggacggggguguuggucggagggggguacccaauggccaggggcaggagcccucgcccgacuugggagucucggacccugacacucgcuccagcauccuggcagcccucccgagagggucggacuuucuuucggucagguugcagaguucuuccccgacuggcugcgcgcugccucggugcagaaguuacuccugcagucucaaccccagccagggccucucgggcugguuuuauuuugcccuucucgccgugcagcccgcccccgacaccgucccgggcacugggaggagcgcggcucacguggaggcggcgucccgcgccuccggagcagcgcugaguaggcugcgcguguugaccggcaguugcaaacuauuggccaguuaacgucccacucgcuccgccacccaacuccaccccguucuucucgccccuuccgccuucguuuuucgauuuuaggauccucuccuugcuuaaguguuuggauaaauucgccguccguaaucgguucaguuggaaauuacccgaugguuuucguacuuuuuuugaacgcugacugcagaaaauggcauagggaggugggggaagagggaggaaagugugugugcgugugugugugugugcgcgcgagugacaggggacagagacgagagauaggagagagagggagaggaagagagggagagagagagagagagagagagagagagagcgagagagagagagagagagagaaagcgagcccaagaccugaggggagggcagggggcuucccuccccucuccuggaggacggacagaaugauacauacugucauuaacaguguugacccacccagaccccacccuucgguugcauccaucauacagucauuacaaagagguagcgcugucacacggcuugcccugcuccuggggcucucggcuggcuuaaugaggugcacccagccggggcuauugugcagcucgaaagaggcaggaacgagacggcaaggauccuagcagcugcucgcgggagccucggcugcagcagccucgcagcagcagccaaccccagaccucaaguggaugaaugccucuggaaguguuuuccugaaggaacccaucaggcaguggaagacuguggcagggcuagugaacuuagauggggcuuuccucuccugcaguugagcuggcuggaggcaagugcagucacucggguaaucgcgggggugcugggggcggggggggugguggugguggugguuuuaagccaguccacggucaaaaggcggcuuggaucaauuuccccuccaaccacucaacucuccccuuuaccuuuuguuuuguuaguuuggcuuuuuccacccccacccccuccccgguauguucugaaccgugcgucuugcucugggguuugauuguauauuuaaauguaauucugauuggugaauguucucuccuuuuuguugugauuacuagagauacuuuagcccugccuucccaguucugcgcccagcacaagcaguuuugaaaauuuaagugcaaaaagcaugacaaagcaauaugagguugccgugguaagugaacuuuuaaaccgaaaauuaccauuucuucucgucugcucggucugugggugguuugaaggggaauccucacacacaaaggguugggggcugggaggagggggucguuaaacaacaacaaaaagaaacccguacaaaccaguagugcuaauuuuguuuuucucucuacuauggucaguggacaaguucuguauuuauauguuugauacucuugggaugguaauaggcuugaugcauuuaaagugggugggaguuggcaguaagcaggggagaggugcagggaagggaggcgaagggaacuacguuauugucugguuucaaaagaaccuugcagcucugacuuccugaacucggcacauuagccgggucacuccugaucaaaauccugaagaagaaaagaaacaauggggucauccucagcuacuacaacuaucucuguguccucuccugcaguuagaccauucuuccucacacuuccucagguagcaacauuugaagccaucauucuuagacaaauuuuaaauacuaaaugaugaugaaauaauacauuugcaaaguuguggucuuaaaagguuugaggcuggagaaaggaauugcuuauuaacccuccuucccacugcccucuccucuccucccucuucccauucaucccacuuuuuaaaguguuacagauucauucauuuaagaguccuucuucagcauccuuuccuaaucccuuuuguuuuuaaauaggagguauauuccauggauggacuuccggguuuugccccuuuuucucauucauuuuccaagaauagguaucaacacaguauuugugacaauguaaacaguucuaaguuugguaaaagacagccuuugcucuggagaauucuacauuguuuggccuguuuugcacuuuuaaaaaaaggauuaauagugcucaguagucuuaaaaacuuucaguugccuuuuagcuuauccagggcuguugccauggagagaacugggaugcccuaaauuggaauggaccugcccauuuucugaugaggcaaggccaucuaaguuuucucauuugaagguugggauggaaacagaaauacccacugaaaggaauuguuuuguugaguccauucuuaauuuucauuuauauguguguagauauaauugcaugugccuacauuucucaagaccuauucugaaauaaagauuuuuaaauuauaaacuuccugugaucauaggaaacacagaaaauaacuuaaaaaaugauuguauugcaauaaagcuuaauguauuuuagcgggcauauauuuuaauaacuuauuuuuaacaacugacuuauuuuuugccuauucuacaugaaguuacuguaguucaacaguaacuaccacaggaaagugauaccuuaugcagucagcuuccaaagucaucaauauugauuuuagucuagcuguuugcaauaaccauccuuaaaacaguuuucauuugagagcuaaaacaccaaaaugguuaaacuacuaauuuguugguacaagaggaaucaauuuaguaacauuugugaaaaaagaagaguuuagauuagaauauaguauuuuaugucuuuguauuagcaagaauuucaguugagaaaucuccuucuucuacccacuaauauccauagaccacagguaguaagcuagcaauguucuuaacuauauaauuaauuuuagaucauauuacucaacuaucauaggauuuaaauuuauaauuaauccugaacuauacuaacacuaccugggguuuuaaaauaaacacuuugaacuauauguauacagugcuaaacaaagaaauaauucauuaucuacuacugagguauagauauuuauaaauaaauauauguccuguauauauguaaaauuaaauuacuuugacauguggagaaaaacaacuuuauucagaguuauuuuaaucauagucauaaucucaaagaagccaucagauuuacuuaguuuuuaccuaaacacugaaaauacuguuuuaguugaaguaauucauuaaaaauuauuauuuaaaauaagcuggguaauugaaaauuaucuucuaaaugauaauuaauagugcauguaguuuaacugccuuuaaaauauuuaaacucuuuaaugcuauauauuuaaugcuauauauuccucauacuuucccucaccauaauucugugccaauuuuagguuugcuaaauauucuuaaugugcaaauuuaaaauguaaaaguacacuuaccaauuuuuuucuacaaaauacaaacauuuuuauuuucaguauaauugccuuuauaccaaaauuauaaguguucuauuuauguuauuggcacauuggaaauacaguggucauguuccgauauuuuucuugaaccucaguuuauuagaauaaguuuuacaaauagcagaaagcuuauaauguucauaagcacaaaauucuuaaguuuugugaacuaagcaauacucucauagaaagucauugauuccaaugacagugacucacuuuaagugaaaaaguauucaugcauaaaagagaaaagugagauguaggaaguggcgguggauggcagccagguuaucuaauggguacauugcagguuuuguccuuuguaccauauccagggcaugcaauguaccugcaagcauaaaggcaaaaaagaauggcugaagugacauuagaguuuuaaaaaugcaaaaauaaucuucauuuauuguuucuaauugguauuaaauguaguauguauccuaugucaaauauacaaucuaaaaucucaaagaaguuaacuuuuaauaguuaacauguauugucuaccugcuaugacucagucauggauuuaaucauauauguaagugccuuauaugcaguaucucaguuaaucuucaaaacacuuuaggugguagcuuuuauuucaccuagaaacugaguaccuaaggcaagacagcuuaugaaccauaaagugaggaugugaaucaaaaaucuaucugacuccaaaauuggauccaaaaucaaacaaaaugacaaucaaauaauagaaagauacuagauuuuaaaaggccuucauauaaagcucauguaauugccacauauucugaggguagggauugccugucaaucuuggcacuuuugcaauacaacauuuuugaagaaaaaaguuucacugaaauauuuuuaacuguacccacauuggguuuggauacauuagccugguuugucugguuauuucucuuuugggauauuaauuauggagaauuuauuauauucucaauucuguuccaaaaacaaaaggagagaaaaauuaacucaguuauagugacaaaaguauuuuaaaauaaauagcaaaaauaccuacuaaauaagaggaagaccuaacuguacccaauuuuccuuaaaagggaacuuaaauaagcagagugauuuuaaaaaucuuaaugacuaaaaugggauuuaauuuuucauuuucaagacuuuuaaaauuuugauuacacuuacauuugguaaugucauaaaauguuauaugauuuuuauagguagcaaaucauuugauuuuuuuacgauaauauguauuuucuaagcuagaguuuacuuugauauacuuaaucaauuaacuucuaaucacagugauuaagggggauuuuuuaaacugcccucauuuugugaacuaaagaaaccuguaagugauauagaaaauuaaaaguuuuaaauagggcccuacuauaugauuccuuuugaaguauuaaagaugauagacucucuaauaaaugcagagaaaacauccuuucccaucaaaaugcucuaauuuugaucuuuuuuguuuauaaaaucuuuggacuugagagauugggacauaaauauugccuauucuuggguuuauuagcuuagauguggaguagagauguuaagauuuuaucaagguaauucauucaagccucuuuaaguaacaaugaaaaaauguuuaaggacaucauugacauucaacagaaaacugcucaauauuucacuuuucaccugagaagaaaugauagcacucagaauaacucuaucugcacuuuaugcaauaaauggucuccugaguuguuuuguguaaaucuuuuuuuuaaaaaauugccuuacuuuuuuuuuaaaugcagagagcucacacauuaaaauaguauuugaauuaaugaucuuguuaagugaauaacuuaaaaaaauugauacauccauuuuguaaguuucaauuuuuuauaaagugaaaccaucgaaauuaaucauguuuaaaccucauuacuaugagaguacuaguagauuuuuuuuuuaagucagauaauuuuggaauuuuaagaaccagguuauuaaggggagaauuaugaggcuugagcauuucaacccacaguauucuagcauucaaccacucaacucuguuucacuuugauuuuggaaaaaccccugaauuuuuaccccucucaaaacuaauuuuaguuacuggucuaauuuuaaauaaaauucaggccaaguuuuuuuaguagcuaauaaaauguuuauauaauuuucuguuucaucccuugauguggaaauuuauauuacaugauuauguacuaaaaucauacaaccgucuauacaauuuuucuuuccauucaaauucauugaagugcacaaaucugucuauauaaauaaugaauauauguaauuauacauauaaaaguuaugguuauagcaauaugaagcuaaaagggaaaguuauuaguuguuucaguuuuaaauuuaugguauaauuaacuccucaaaacauaauuuuaucuaaugauaauaauauuaacuauuacuaacuaaaaauccaggaguauuuuaggauaaauucuggagucuauuuucuuuuaccucuccauuauuguuuugucauaacuguacaaaaugaucauuucacuuggaaaacugguaggaaaaaugugaacuauguuuaaaguaagaaaaaaacaaaggaucuuaagaaaguuccugcauagguccuggaauccuucaagcuaugcaccacaauuaucccuguaaauccuuuugaauaugaagucaucacauuuuguguucaaaguaaaguuaucuguuguagauuuucaaagccucucagagcauuauagaaagggcagaguaauauaagcuacauaccgccucgcuugacagacauugacaaaggcugagaaggcaauguuaaugcuuuuaauuuuuuaaaaauagagauuauaaaguuaaugaaaccugaggucauuaccauuaagaacuaagaacucagcuuuuuagguguuuucaguaaaaauaauuaacuaugggauagguaguuuaaagagcugauuaacauuauaaauauuuaacaaaaucuaaaauacuaccacgauccuuuguuaaagauaauuagagcuaagauugcuacagaaaucuagacuuuugaauuucuaauuucuuagugcuuaauuuaucauuaaaucugauauuguugcagagaugauauuaauauauguuugauuccuaccaugaauaccacaacauuuugaugucuuagaaugcagugaaugauacacuucacucaacagacaucauuacaugcuuacuggguuaggcaccgugcuagaaccugauaauacuuggcuggaaaaaauggcugugcugucaaguaaugcauacucuguguaagagauagagaugucaacagaugguuauaacguagugagauaauugguaucagagauauguaaaaaguacuuuuaggagcacagaggaagcuaucgcuaauaugccugugguugacuuuagugugguauucaggaaggcuucucaguggagguggaauuuugcuuacugacuuuuuuuccauuuuaaagaaauguaacaguggcuuuucaaauaauauauagaaagaugaaguauauauuuuucuugucuuuacauauugauauguacuuaugaugagagagaacaaguuuucuguguaggaugcugaguuguucaagauucauuaguguaauuucucagauacacugccuuugacaaaugugcacagccgggaaagccuuuaauauauugauuauguuaguguuuuguugcuaguagcauaauggauaaagcaaaggccccauuuucauucuucugugcucuaccaaaaaagaaaaaaaaguaucuuguaaacugugaaaggcacacaaaagcagaaguaauuaaauaauguaaaugaugagggagauugccugugaucugggcuacaauuagaaagggggguguaagaaagagauuguuugagaggaaaugauaugaaaauauuuuaaaauaggaaacagaguucuguuuuauaauaauagauuaucaauuuaagcaauuucacuuuccuuuguauuacuuucacauuugcaauggaggagaagggaaguacuauuaaucugaaauuuuccuuauuaguaaguaguaccagugaucagaacaaaauuuguuucuuaaacuccuaaauguguguaguuuuacuguaaaaagucuucacuucagagugauuaguacuuugugugaauaucauuaugcauuuugcucugugauaucuugacaauacaguuuagcuuauucccucugggauucucuccuggcaacaauuuuuuauuucccuguguucauuuuuaggaaaauccucucaacauuguuauaaguauuauuuuauaggaaggaaguauguaaaauacucuugaacucauuuuacuugugaguuugaauagcauucagauuagaaugauuuccccagaauuuuguaggcuugcccaauccagcuguauauuuuauaugcuaauguaaauucuauuuuuguuccccuuggggguuuaagugauuauaauuguugcucuucaaaagccaaacagaugaugauugcugcuucaggaguauaccaaaagaaacuggcuuucauuaaaccugcucauccacuuccuaauuaucuccauuuuaucuagcuaagaagcaggaaaaaauggcaaguacaguucauugaagccaguucaguuauuuaaacaucgcuuuauugaacuagcaggagguguuaaaguagggggaauguuuucauucuaacacugauauguagccaguggcccaacucaagagucaguugagcaucaaaugccagaggccauagagaaugagaagggagagauuuugaguuauucugagaggaguccucuaguggauacaauaaauagugcugcagugacagcuauucugaaauauucuuuuuguuuguuuuucuuccuauaaaaucaaaauggaguuagcuauuuaguauccacuaagaagcacucagaaaugcacuuugagugaaaaggaaauuuccuauauauaugaaaaaaagagauauauauugauaaauucuaaaaggacaccaaauuccuaagacuggccaguaucaagggugcuucaggucacuuaagccuugagaucuggccaugagucagaaaguagauucucagggaggcugguuuucugcaacagggagacuaucucuaccauuugggcaacaguggcucugaguuaucuguucuccaguccucuaggguggccuuggaguugaguugcacuggaacauguuucugaccccuuuacuggcuguccuccugauggcagagaggguccuugaacucucacucaggggaacagaaaaaugucagagucaacagcuguucagcuuccagcugugagaaugcaauucucugcugguuaaacgaaaaacucugaaggggcucucuccucucugaaauuucaaagagccacguuuuggaaaccaauugucuaaggugagacuuagauaaaacauuauauucauaaacaaaaaacgaaauggaagguucugcauuuucuguagauuuucauuuucauguuccaugauauuucagcaagugucaggcaauuucacuuuuugaaguuuuaacauagaguuguuaucugaugaguugauuuugaaacuuucgagaaucauauugaaaaagaaaaaguuuacuuaauuuuaaaaaaggaaauauguuccugacaggcauuuguauaauuuacuagaaaguuaaauacauuaaaaauuauuuuccucuaguuucucaugccaauagaaaauuuuccaguguucauagauuuacuuuucuuuuagcuuuacaauaacccuacaaaguaaaacaagcaaacacuaucauucacuuuauacauagauacauagugauucucaaaaaguuuaaaaacuagaaucugggcauuccaacucucucauugacaucuugaucaacaucuccuugaucuaccaacagcuugccaauacaugauguugaauuauauuuacauugcagagucauuucuaaaccccgaggguagggaguccucagagaguaaguauugucucaaugagcccuuagguaaucuaugcgguuugcauucuuaaaccuagagagaggguauaacaauucuuaaaccuagagagagaguuucucuagaaacucuaaaguaaaaacucugucuggugguguagcagcauuggaauuucucugaauuccuguauagagauaugccaggguauaaaucacucugguuuccuaccaagaaggccuauaaaagcuguaagucugagaauguaccagcugcacccagacuugcccuaggcacaaaugguggaaacuaucuugauugguuuccucaccuccucaucaucuucucuugauacuuuuaggaccuggcuguccuuuguuccccuaggcuuacgcugccaccucuacugacauugcuaauaccccagaucuacuaggacauaucucuuucccuuucaagguaacagguuguucaucuaauaaauuaaucuccacuaaugggaagauauuaaggagaguccugauuucuguuaauauuuaaaauugacucucagggaaaaugcacguguuucuguuagacaaucauggugaguaacuugugggguggucaugucaguccaacguguauauuuuucugauaguuuuuuuucuuaacagcauggcaccaccugaucucugucauugaggagagugcauacuugaaguaggacaguuagaaaugaacuaacucaaaaggaaaauauaacucugaaaaaacugauuaaguaauuuuggcuuauuugccuauguuuauuaaauagaaguaacaaacauaacaaacacuaaaauauaucuaugccaguggaaugacugcaauuucccgggguuaucucacauguuguuucauuuuacuaacgggaaguuguagaaaaucacacuuauucugugaccucauagcaauaugaauguaaguaaaaucuuuuaaagauauccuaguuaaaucuuuuucaguauaacacaaaguauaaaauuggcaauuaguccaauuaaucugcucagcagagauaacggaaccaaaauagcucaagccacuguuuaacuccauguuaacugcaccacugaaaaaccuguacugauuuuugcucuaaaucaguuguucaucagaaucaccuguggagcuuuucauacacauaugugcuuagauuacaccucagaauuacagugaaaucucuugagguaaaggggaggcaucuguacuugaaaagaaaaaaaccucacagguagauuguguugcacagccaugugugagaaucacugggcuuuccuuuauccaguucugucgucuaaugaagauugacucugugccaggcacuugacaaauacuuuagucacuuaaugcucacaacagcccuaaaagguagguuauuuuuaaugcccauuuuaagaaugagaaaguugaggcuuagagagguugggcaacuugcccaaagucauauaccaaggacacaggagaggcagaaccagaauucaggucugcgugaauacuuuuaaccaagacaacccugaacuugaaaggccuuuuuaauauacagauugaaaauguauagcuguauuuuauagcuguaauuuccaaccuagaagcuucaauuuugcugcuuugauuacccuaagaauaucuggagcauacagggauuguuucauuuuauggccuuaaaagagagccacuauauucaugugaaagaagacauggucuaauagguaaaagauacuuuaaaauuauagguaaaauguuuugcuuucuuuauauaaaggucacagaugacuuucuaccucaguuuuuaauucagaaacucaaggagcugcuauaaacuaccuauuaauuucauugcaaaaaugauucagauaugagacagaagagcaugauuuuccuuucaggucaguuucuuauaaaaaauuaauaauuguguaaaaucauugcugauaaaugcaguuuccaguguggacugugcaauuuuaggauuuguucuuguugauuugggacugacaccaauauuuagaauagugaugacucaugucuaggacugaaauuuguuuuucauggguuuauacaguuuuccucuugaauugcaccaaaaaugguuuuuuaauuggcuuuaacucaugcccaauaaauuggacgaaaauugauugccgcagucauguuugguuuaaaauuauucaggacugcgccaugagucaaaugagugcaugagugagggcagcggcacuuuauguccucuauauaugacaaauaaguuuuuuuuuuucaaaacagucgucauucauaucugaaaauuaauauaugucugugguuuauaaaacuuaaaagauaacagaacacauuaaaauacaucauauuaaaaaauaaguuucuguuauuuugguauuuuuucuuaguaccuucuuuuccaguucuaccaaugucauaaaucuaauaagauaaauaauacuuguuagauagcucuuguuagauucuuggucaugguauuagacuauuucuaaauagcaaaacaaaauaaguaagaauguucagagacugccaucagucacaguugagacauugagccaguuuuccauucucugaauagugauuuuaaagacaaaaauuaaagaauaugaaaauugaauuaacucaggugacuguuuaggacacugaaauagcaauucacuaaugguaccuguccggaagccaguuuuuguucaaucucauuauaauuauuuacuguauuaugguuuucacuuacuuauaugccauagaaauauaagcaaaucacuuuaaggguuuugcuggcugggaaugaagauucauuuuaugagauucuugagcaauuugagaaaggauuuaauagggaaaaagaaaugauuaauucaucgaaaagaagaacauuccuuggccauaauacagauagucaguaagggaaggaaacacuuuauguuauuguauauaauuaauauuaggcaauuuuaauuggacaggauaguuauaccugauauuguugucuaaaaaaaugguagagcaauuucugagauuuuugucauaucuauuuuucauguguauuaaaucucaauuuuuuagaagugaauauuauuuuguuuauaaacugaaaagcucaagggguauuauucugaccucucucuuuaucuaaguugucuuuuaagaggucacugguccuuaccauccagcaucuagcaccuguucccaccugguggcuauaggcccucaagcuugagcuguagaguuuuuucuuucugaaacaauaaacuaccuguuuuucugacuuaugaaaaagaaugcgugcucaaaauuuuuacaaacccaauaaugcagaaaauguaaaaaaaaaaguaacuauaaauccaacucccauuaccucaaaauagccauuguuuaauguucuaguaaacauccuuuaugugauguuuaauaugcuuaauaauauuucauaaauaucuucacauuucauuaaauaauaaacacuauuuuuaauggcuuuauaacuguuuacuauauguuuauggaggagacugcuuaaaauauguaaaagcuaaauaauuaaacugcaaaacaauguuacccgcugguuggaacagccaaggacaucuuauauaaaauauuucucaaaauccuauuauauuugaccugaaucuuuuuaaaggaauaaaucauccaacuauaaauuuucucucucuucuauuugucagcaguagagagcacggcaagguauaagaguaugauuauuucugaaaugaaaaguagagcuuuaucuguuuauguucaucguaauaucuguuuucuagaggcuuuuguucucuugcaaguguuaugucaucuguaauuucuguuguauuucuuuaaaauuacaaaauuguacaucuggaaguaccuuaaagguacuccaauaaauaguggcuaaggacuugggcucuagaaacagccuauuuagggcgaaaucccagcucuuuuaauuucuagcuguguuaucuugggcaaauuacuuaacuuccucaguuuccuuaucuguaaaaugaugagauucuugugagaguuaacugauuuaaugcauguagaggauuagaaugccaccuagcauacacuauuauuacuaaucuagucuucuccugggaaucaugaaguuuagucagagugacuuucugaagagaaucagcuaguuagcgggauaaauaauacuaggacucaugccuccuugcuccacaucuagagaucuuugcuuagugccacagugcguacuuucccagcaguguuuuuaaagcccucccuuaggcacaaagguaucuuagaggcguccugggcuacgcagagcagcagccugacaggcucuugucucugguuucucucccucacagcuuccgugggcucauuggcucagaaacauuauaugcugagagcccuaucucuuucccagugcugauggaaauauuuuggccaucaaaacacuuucauuauugucagugucaugaacucuucuucuauaccugucagucuuguccucauauauauuauagucugacccugccuccucauugcaaggagucuugaauuuucgacgaaagcuucuuaacccugcuuauguguugguucuaauuccucuaccuuuggguaucuuucugucuggcauuuucuaaaauucacaguugucaauagguguauccuguuucuaauaguuguauaucuguacuucccucuacuggcuuucaaagccagcauaaugugguaccacaauacccaaccaaccugauuuccuaugcuuuguagcccacuuccucuauuauagacaggcugguauacuccaacaaauuccuguaauuuucaccucucaaccuccuuuuauuugcucuaaaccacacccacacaaacacacacacacacaugcaugcacacacacccaauugagauuuauauaaagaucuuuuaaaagcgaggacugaacacuguaauauauaugaauauuuuccucuuuuauacaaaccuuacaaagaggcucaaacuuucauguauccuuuugauaugacuaauauggagacacauguaucuucacauucauuuuauaucuagaaauauuaguauucuagaauacaucaguacucuauaaguuaaauaauaagcacugacauaaaagaaaguuuuuuauuguuugcacaaggaaccuagaaauaucaucuacaggaaaaaauucacaguaaauugugugaaaauaauucaaggaaaugucuauuuguuacucauacagcuuaaacagucuguaaugccauucauuuaugugacaucuuccaacucauguuuacaaaaacugacauuucaagcaaccauauucucuaauuucucauacuagaaugacaaugaccaaagguauaaaauauuauuucuauuacgacaguaucuucagccuuaaaauacacauacauaaugcuccaucagagaaauggauuuuguauuuaaucacaucaacaugaagaguuaagagggguuagugugaaauggcaauaaacagcagcacuggcuguucuguguuuaugcauauguguuucuucuuggugcuaauuacacuugcucauagaagucuggcagucagaugacugggcuugaccuugagugggucaauuuuaucaaauuauaugauacauuuaagaugcagacagacgccuauugaagcuugaaauaaaaacauuaagucuguuuucuauuguuaccuacaaugaauuuagaucucuaaaaguuuaagguucauucuuuuaucagacugcaaaauguuguuuccuuccauuucacuuacucacugaaagaccacagcuauagcuccaucuauaugaauucauagcaauguaagcccaggagggaacugcaaaacuauaaaccauaagcaaguuuuaguguucuucugauauucuauguuuuauaaugucaaguagacauuaguuauacauuuuguuuuauucaaaacaauacauuauaaaaagcccuuuauauagucuaccucuauauuccuuuagauauuuauuuugauagauuuuucaagcacaaucuaaauagaaaacuagagcagaaaauacuguuagccuauguaaauggaauaaagauaauagccuauaaaaauauaaguggagauggaagaaugagccuagggagaggugagugauaaguagauuggaacugguuccuuucaaggccauaaaugaguaauaaccuuuaaaaucuucccuuagaaauuaacacagaaugauaaauaagaauaauguaugcauauauaaaauugaauaauaaaagugucucaacauaaaaucaaaauauuuucauuugauuagacugugaugguauauauuugacucauugauuucaucaagugauuaacugaauuauaagcuauacuuaaugccaaacacuaauguuugagccuaacuaaaguaacaauagccauaauuaaugccagagagaguaacagauugcagaaagacugacauccgggaaaacuaucucuaugaaccuuagaaauguuaccuaaauuccuaaugccucuguuaugcccccugaaaaugagaaauacuuuauguccuucuauaccuccugggguuacaaugauaaauauguaaaaguacauugagcuuuuugugauaaaagguacuauaaaaaucuaagguguuuuuauuauuauaucagucaaaugggaucucagacucaguuccauuuugaagacccacaacuuuuuaugggugaaucaugaaauuguauugggaaauauauugaagucacauaacagggcagauagaugauuuuaugccuuuuggcgccuuuuaaacuugguugcaauuagaaaugugagagaauauuuaucaugaaauaugucaguugggacauuaaugagagcuaaugaaaauauuuaagagacaguaugcaaaggcaggaauucuaauucuggcuccaucaaauaaaugugauagguuaccauuuuuguucucauaauuguaguuaccaucuauugacugcuuccuccaugucaggaaguuuugaguauuuuauacuuaugauuacaucuaaccucacagugauucuaaauuaggcauuauuaucacaauuuuauagauuagaaaaucaagguuuagaagcaauaaaguaacuuguccaaggacccgugaaaucagguucaaauccaugugucugaagucaaaacccaagccauuaacaauuugcaaaacuguagcuccuagaaggauaauaucccuucuaugauguuccuauauaaaggaguaauuuuuugacaaguuauauuauuuuaaaaagugauauuguacaaaaauuuauaaggauaaacaauaacaacaacauaaaccagacacauugugaauauguauuaugcaacauauuaacugaguuauuuaaaccccucaaguuuuccauuuacuaucauuucguaaaauauaaucugauuuccuucaagcauuuauugucucuaaucuaauuuuguuauucuggcacaugcuaggcacucaaaggaugcugaaccaaauugaaaugggccuuuugucaaagauuaggaaaaauauuuagaaauaggaagugauuauguauugcucauuucacucuuaccugaugauaaauguuauaucuggaaggacauaauuaguuaugugugauauuuuugguaauagaauuauaaucagucauuaaacaaaaacaugaagacuuuuggauauuucaaaagcuuccaacauuuuugccuuaauacaucauaggaagauuguuugcuuuaaaaauauaauaugccauuucucacagagggggauuaauaauugaaaaucauuuaaaaaacuaacuucacauuuuugguuauuuuuuauuuuucaucauuuauaaugaauugcuaugccuuuagaaaccauauguagcauucauuuugugacaaaaauuuauaaaaaaacaagauuauuuuuauacuaauuucaugcuaaaagauuuuauguucauaaugaaaaugucacuucuuaaaauuaucuuaguuuugaaaugcuauaauuuaaauuuauaaaauaucuuuuuucacauuucaaacuuggugacaguguaucuuuucaucuguaugcaaauuaacaucuuaaaaaagucuuaucuguauuaaagaacaguuuaagcuguccauugugugcauauuuucaauuugauuaagaaaaaaauaaaaaucauagcuuaaggggcuuauuaaagcugguaauucaaacuuguuuucuaacaagcagaaaaauaucuuguuaugggauuauuggagauaauauaauacugccuaaaaugcuggaauucauuaaaauaauauuucuuaauauacauauauaguagccauuauuuaaaccaauauaacuuuauggaaaauaaugguauggaaaggaaaaguuagcuuacauaaccauaaauuucucucucauuaaaggauacacaaagcacuaauucauccauacacuuaaauuuaaaagaauaaaaaaaacgcaaacaccucuuuuuuuguuagauaugaaggauuuuugcauguaacaauucaacagaaaugucuuugagauuucaugaccuauauuuauuugcuuacuaaccuaugaauaaucaaauaacaauuuccaaguuuauaauuguuuuuaauucaaguaguuuaauaguugcuaaaauuuaugauagcauguuaaaauuuuucucacuuuuuccaacaaguucauuuuuuauuuuugcuuauccuaaagugauauaagccuuuauauugucaguuaaaugcauucugagaucgaucacauuuuugaaguuaaacaaaauaaaaauugauucauuuucuaaagcuguauuaacuauguguugucggcugaagguaacuuuuuauaaauguuucuaagacuuaaaauguaaaugcccuuguggaaaaugccauguaucuucucauacuugcuauccaccucauaaauggacaccaacgaacuugcaauucacuuaagacacaaagaacaagguacaacacuaagacauuagugaaucaagaugacagugucacuggcuauaugcuggucauuacauauauuaaauauuugugaaaaaaaucuauuuaaauaaugcauaaaauuucaaaccucauauccaaaagagcagacagaaaaauguagauauaaagugugcgguaagaaucagguauguguuagaguacauaccugggauuuuuuuuuguuuccuguauuauccuauaguaauuaccuggguaaagggaggagggaguugaaaaauaacuguuauuccuguaaguagcuauguagauucuuuccuguggaugacaacuucuuaggcuauucuaaaaaucauucuggaaucucucccguggcccuaucacuucagccaaaaggccagguuaacuucaauuuaugguaacuccucuguauccgguugaucugcuuuucuuacaaugaaaggaaaacuuuacaguccauuugauauccacuuccucucaccccugcucagauaaagacggaauucccuuuuauaccagauugguuuaaauuguuccuugaucucuuaucacaccaaacuuuacacaacuccauacuguacuuuucaaauuguuuauucauaguagcuaugauuaggaaucauggccagaugcugugucccuuuuccacuucuccucacagcuucccuuccccaaauaauuuuuaagccccgugggcuuuuucuucucucucacugcccccucccacuacauuuuuuuuuuuuaaacaauauuccauuccaggcgcccccucugccugccgaaagcauuuuaaugcaguuuacuucagcggucuaucagcagacugcugccucugccaccugaauuucaauuucuuaauuuacagcccagauagaauggagcaggaucugggcuucucucuacauuggguuggccuuaucaagcgugaaguuuggcgcauugcaaaccuauucaagugauuaucuguugaggaccucucaagccaucuccaucucugcagcgggcugauaagacagcuguuucucuagccgcugugucuccccgggccucagucuucuucugauacaaacuccgccuuugucaccguggcccggugccggcacuugcucugugggacaaggguuugaucugaacacacguggggguaaaagugugagcgcgugugagagccgaggagggaggaaggaagacggggagggccaggagagugagagggggaggaggagggaaagaguuagagaccggagggagguggggggcagggcggcgugcggagcgcccuggauggcucugauugacugguugcucagcccgguuuuauuauuucaaauuagacgugcaucgcacacaaguggaaacauaaaucuucaauauaagaaagagccuccgagcaucggaagcauaaaaaccguuucuucccaggucccgguaaaggggccagagaaaagacugauuacuaucagcugagacagaugguuuccuuuaacuuuggaaacuguuauuuuuaauugcuuguauuaauuuugcaugagauguaucggcuccagggggaagcuuaaagaaggcuguuaguaucccugaaagaaacggacauaagucucugauuugcccuuuuucaccuccggguuuuuugggguuuuuuuuccuucacccucgccuagucgccuagauuuucccuuuuuaugcucaggaaaaacgugaguuuauccuccuaaaaguugcuauugaguaaaagaggggaaggaaaucuggggacauuugugggagcgucuacauaaaauaaucgucgaucugaggcugcaaauauauuuuccuagacacucugggacaugugcaacagaucuuagucugaauaucugcaggcaaaucaucuaaaggagaaugaaccucauacauugguccaggaaaaaaaaaaaaaagguguguguguguguguguguguguaaguggggggcugggaagggagaaccaaccuaggcuggucucaaagauuuaccgcgacacuaguuacauuuuuuaaaagaacauuuaaaugaacaauucaugugucuuuaaguguaaacagcaaccucaggauucggggggaauauuccuugagugugcucucuuacuuuacagucuuucccccuugaacaggaguuuacagacacaauguaaagagaaaguaaaggauguuugagaucccgcucacugccgccccuggcacugucccuaacgaaaguguuugcaauguaaagaaucuuucgcaaaauagucuugggagucacucaccuuccaguaaaaggcuuuaccccuuugcuaggggguggagggagcagggagaagaacggggggagggagcaagggugagcaggcaggcauuuuugcugcaauuccagcugggauauucgaggauuaaaaacucuggagcagguuuaccagacuuuucgaagacuaccuggauuugcauuuauuuuucaugaacacucugaagaaaggcgagcucacgccggcaagggaguguauguaaaacaggacaguggaaggugcacagcgaguucggggcucuaagucuccugacaguuugucaugauggcugaguccuaagaaaugccagccuaauucaaaauaaaugaguuucuguggaguaggacagucuuuuccgcaaagucccguggaauaaaacauucccaagacacgcaguuuccgugucucacagaaagggacagaaaacaccgucucaagcuuugcaaaucuuaauuugagggcugcucgucucuguccauggugcuaauuccugccucuuucucuugcgugguugccacgguauaaauucacacuggugucaauuuucacaacuuuuccccccuuucggugaaaggcaaguccacauacuacuuuaggaagaauaaauaaaagaguaaucagcaagauauaugauaucuguauuucucaugcagacauuaaacuaucauauuuccaauaguaugaaccauaacccccuacuccaccauacuaacacauaacauuuuuauucaucuaagaagguuuacuguuggaaauuacugccuuaagccaaacauuguaaacuaauuuuaauaguuuaacuucuuuauuuacuuacaaaacguuacaaguaguuuacaguaacuuuuauuacaaaauguaaaaucacuccuucccuugcucccaggaccucuaguguaagggaguuauuuauccuaaaagacauuuuccacaacagcuuugcauauucuuaugaauaaauguucucuuauauagaaacuucaguaaaauaauuaaauucaugacuuuuucgguuuugagaacuauucuuuugcaacuuuauccaccucacacuuuugcuccaaguucgcagucauucccuucaucucucccuuuucugcugcaauucaaaauaaugccaggaacuuggaagauaugucagaguucauauaacuuaaucauauucaaaugucuuuuaaauacuuucuaaugcaaauucagauguuguggauaauucuuuuaccaaacuaugagugaaaagggguugauugcauuuuuugcuuauucuuaagugagauguuugcacauaggcuucauuaauuaaucauaggauaguauguauuuguuaauguuucaagcuaugagacaugaauuucaaagugaaaucuacauccagauaucacuuguuuuaaagaggcuguaaucaauauuuuuuauuuuuaaaaguugaaaaaguacauguugcuuauaauacaucuauccauuuaaaaguuuuaaaauguaaaaacaucuguuuuaaugaggaaguaaaauaauauuuuaagauacuuucacuuuuuaaauaauuuaaguccaucucaccuacauaaaaagacaacauguuagggaugacaauacuuugaauaauauuuugucacuaugcccaagcugaaaaaaaaccauaaauacugaaucuacagaauuuagcauuuuucauuugaaugaacaaguuuacuauuuuccauguaauuucuuuacauaauacacaugcuagauuuuuauuacuccauaucacucccagcuuuucacaccugucccuaucauuuuggguuaucuacagauaucacaguuaucuacaagucuuuuuuuguggauauaaacaugcaccaaaaaaaguauuaguuuccaccuaguuagaaggcacuuauauaauuauaaugguaaagauuuacuucaauguacugaaauuauaugggcauaugcaacuaauucaauauuaaccuacgagcaugguaaaaaggaggaaagacaauucacugccuagguaagucugaugaaaucaaacaguauuauacuuuccccaaauuguauucauuuaaagguuauuucucuguauggagcuggggacaaggggagggguugaaggaagaugacuacaaacccaaucuucuguuauucauacaucuagucuagaugggguggagucuuccuuuucccccuugacuccauuucuucaaagugcuuuucuuucuucuugcugugaguuucacccaggucuagagaauaguuuuaaguugaaauuaagacuccagagguuguuauacaaaaacuggggguggagguuaaggcaugauuuuauaaacacuaauuauaagauaacauagauucaggccuucuuucucaagccccagguauugucaugcaaaguaacagaacucguauauuguuauacaggcuacacgggagauaaacaggucuguuuuucaccauuaaucauuuaucaacacucaaggacacucucaaagaacacugauuuacuguauuccucacuucaaagucauuuugcuuugggaucuucugucccauuccccuccaugacacccuacccuuuugcaaucucuaacucuuaccugugucuucuuuuuccggcauucucaaagauagcgacuaguuguaaauauguaaaggaaucccuuucaaaaaggcaugugccucugguuaagacacauuacauguguaauguaauguguacauuacauuuacacauucugguaagaaugguaaaaacugucuaggaaguuggugcuaucuuucaagauugaaaagagaaaugcuggcuggaaaagaacguaggucaaaugaauauugugucuacuuauacauccagacgauccugaggaccucacuuucacuuagaggaagaaacaauuaucaugcauaaaacuguauuuuggucuccugaaugcuguuaaaauaugggguuguaauaaaguagucuuccucuaugaagcagaagcauugauagcacuuggucuucugguuaaacuucuuaaauccucacagaaagagcccugauaaagguucaacuaucuuugcugucagcaauacaugugugguccaaggacuguaccugucugcaaaugcagaggaguggcuuguuccaguuuuauauacagcugcucuuuuugagaaucauuagacaccucgaagugaaggaccuuagcucuacucaauaccucuuuuucuggauaggauauuuauccuacacuuuucuauucuaacaugaagugaaagccaauucaaaccgugcagcuuuauuugagagcauuucugacuucaucuuuaucuuaaaaggaugcuuuaaaaagggguucauggggacacauaaaucugaaauaugcguauauuaaaauaaagacauacaauuaccuaacaucuaauacaaaauacaguacugaacacaaaucgaaaaaaggcaugcgggcaaauaauggauguacauucaucccuuucacucagaucaaagagagggagcucucaaugacucauacauaccggacagaguuaaauguuauaaagaaauaugccacagaugcagcagugauggcaaaggaaaugaaucuuucugaagcagaaagauuuaagaggaaaggagaucgugccauaucgcaaacucugauaguacaguuccaacccucccacguugcucucuccacauuucuuuuugcuucuugcauuucccuucgccgccaguguuaagaguguaccuccccgcacaacuuaccuugaaacgggacuccauugagcucucgagagugacacaagcccauagccaaucgucucacgcggccccgccugggcggccucaauggaagcguguggaccaaucaggauccuggggcgaugagcaaguuacguuguggcgcgauucggcguauacuuccgcgcgugcugcccgggauaggagccuggcagagcagcugcacacacggcagugcggaggcagagaagggguuggugauacggugcuauaaaucugugguccaguccaccucccuuuuaagacguccuccccccuauuucuguucuuaguuagagaugcagcagcuuacuccuguagcgaccuacuaaaaagcaacaaggagaaagacaucgucuuuuugaaaaaacguucuuucgucucuuuucuuuguuccuugguuuguuuuucuugccccuuuuuguuuaguugaacggcaauaggaggguagucucuccgucuuuuuaaacucuuuuuuaaguuuccccuccccuuucauauuuuuuuucgccauuucuuuuagcauuggacuuuggggucgaaagcguuucuuuuuauuugcuucuuuuaagccgagcacaguuuagguuucgugcugucuuaagagaacuauccagcagcuucuugcucauccuuauugggagaacugcaccguuacuuuaaaaacacacauacacaaaaaccuuaagggagaaagguaaguuucgguuugguuucuuuaaucauuaguugcagcgaugcgcuggcaaacccagaaaaccuguaagugagcggaauacagaauaugaaguuaauugcacauguuugucucauuucaaagcuacuguucugcuuuuuuaauuuuaaagagcuagacuaaaagacgguggacgcaugcuuagcguacugaauauucguaaauguccauggcagaaacuuaagugguaaauguggccaggggggaguagggguacaaugggagguuagauguggagugagcuucaagauugagaucggaaguucauuucguggggagagagugauaacuuggguguuggggaugcaugccucuacuuuggcucagcaacggaaggacgggagaggcuuuacaaucauuaaggggaaucagaagccuggacuggcagauuagaccagcgaaaaccacaggcuuaauugcauuaaccagauagcaugugcuggggagaugggauugccagauggaauuuagaugcugcaccaggcagcgaguuguaguugacugaaaaaaguacaugccgccugagggcuggggcuggggcugggcugaggcuaggguuguuagaagcugucagaacucaucauuguaugcgggcucugauucacggacuccaauuaucauaauucaguuuuaaaagaagauagccaauuuggggcugaauucuuaagccuguaccggauaugagauucccuuuguucagaaaagcguaaauaagauccuuggagcugugucuaugaagugccggcugcuugggagccucgcugugcugggcgcugggaaguggauuccaagcccuguccuugguccuacgcggcugacuucgccuucggggagagggggaaccccucugcagccgcgaggcuucgcagccaccccaggagccaacucggccacguagcccucacccccuccuuaccgcccccacuuccucgaauagcuauuguuaaauugacgccaggagaaagaugguuggggaugacaagcugggcagauaggcacacgcuucauuuuaacuuuugugauuucucaggguuuaggagaaaucauuuggcuuucuacugccaaagagaggauccaggguagaugugggaaagggggaggauguucgugggccggggagggcggaaggggugguggugguggaacaagcugcuggcuuuccuaagagaaguuuaaauuauuggcacgagggggugugggugagugugugcgugagagcgcucauguggugcucgagaggcagaggaugggaaaaagcuacaaagccggcugggguuaacgucucguugcuccucaccccacccacucuaccggcugggaaagccagcgcaccgucagccucccggacuggacucugcgaagggcggugggggcuagggauggcaagguggcagugcccaccacuggagcuccgcggcggacgagaccucgcguggccauuguugcuuaauuuaugcccagcacguugcuacguacccaccuauuucacgucuguacagaauuaauacgaaagcuauacaacugugacaaauuggagguuggauaaguuccccguuucccauuuucaaguaccgguuagcaaaacugauggcgagacuggguauuuucucguaauuaccggcugcaggucugguuuuauuauggcgagggugagagaaauagccaaccauuuaguauuuacuguuaacacugcuggacagggauggaggucucuguacuuucuccccgaaaugcacggauucugucccuucccccucucauguacaaacacuccaguugguuaagauucuaaaccuucagccguucuccgcaccccuauuuauuauacccauccucugggggugggagggagauuaauguuuuauuucccaggccuacacuauuaacugcaaccuauaaaacguagacuuacaaugaaaauuuuuagaaaguacacagcagacaauaguaacuaaagaaauuauuuuccaaauugaaaaucaguuucuaaaggucagaaaaaggguguucguguuuuggggaacagaaggguaggaaauguguuugggccuuaagacuuccuuguaaaauggcuucuuaaaugggacaucugaaagauuugucagacuaugaacagauaagcccgcaaaaaaauauguugagaguuucgaaguuguuaugggguuaacauuuuauuuuuuaacucucgcccuuacuuauugcugucauugccugaaugugucuuacagcaggcacuucuuccccguucccucuuuuaaccaagugcuugggcaccccgcuucauaaagcuaaccuguucuggagcucuucacaaaaaacgcuacgguuguaggaagaagugguuuggaagacuuggggaacucuucugagagcucucccauaauuuagucagcgucaggaaguagggcguagggcauucuaagaguuuuagguuuggauugacaaauuaaguaggcccauuuucgccuaacguuuuggaaauaggcauuuuuagcaaucccgcgugccugggaugagaauauuauaauuaacuauuuacugagaggucaaagaggcgcaggcgcuuugagcaguuuucccaggaacccacacaaagucaauuaaggucauuuaauugcaaaucggauuuggggugacacggaaaugcugauauagaaucaguuagcuguauccgguguccccagacugggucgcacaaauuaagggauggccuaucucgcuuuugaccuugguugagcccccuacuucacuaugcugauuagacuucgcccaagagggcaaauuugccucucccacacccgcccuggguuagacgaguccccucccuuccccccaaccccgcuccgcccgucgcaugggggcggggagcgcuggacgcccuuagcggaccuugcugcaucaaaccugcaucaugcccuugaagcuguaaccucggucacguucuugcggcgacugggucgcccacugcucgguuccuuucucuuaccuccuacaauuucagguagguaugacaggugauuuuuuaaauguaguauuuuaggagaagggcuaaaaucgaugccuuugcaaugaaaaaaaucccaacuacaggugcucucguaauuaagcggccgagcagguguaaaaacgugcuccagccgcguggcuccgggguggguuuugacuuccagccguggggccgggucugaggacaggcacagguuuuucuggggaaaagggauugagcuuggcgaaggggcgggccaaggcaaggcagcgaugggacgcccccucggugaagaguuggccauuucgggucuugaguuggggggcgauagaaggaugcggcuagcggcaagcguuugcauagucgagugcaggauuuccuacuuugcguuugaagcagaguacagcaccccgcacagguacucugggcuuauuuaaacgucagguucucucuagagaggcagggaggggcagcagggggcuaagccuuuauuuucuguccagggacaggaccccuuggcugcgaaguagggggaaaaagagaauuuuuaaaagagacacacauauguguguauacuuauauauauuuauaaauacauuuaugaacacauaaaguaacccccacguuagcugcucugacuccccguuagcgccccgggccucgggauuugcaaacuugcaccuggaaucagccuccucugggcgcucaacgcucuccaccgaguccagagaaaccuugucggggaagccuggugagacucggaaguccggagggacggagcugagcugcugaagcccggcaucucccugccggcacggacccgaagggcggucgggcagggcacgcgccggcggcggccgcggcgccgcgaacucgccgccggccccgccuccuggcgcucuuccaagcaagccccuccuucccgccccgcuacaaacggcgggaccgcggcgccugggcgucacugaggcaguagccggccgggugaggagggcgguugccggcgcggcgcggcgcggcgcggguggggcggggguuccgccggcuuccaguccccuuucccgccgccgccgccgccaccgccucuccgcggagcucgccccgagcgacuccuccgcggcagugcugacggccagcggcacgagccguaguagcugcagcuucgagucacagcaggcaagugcugggggcgugggggcggggacggcguccgcgccuugccccugguccauuuuggacgccgaggcuaaggucugugcgcgcccccgcugcgucuagcaggguagggguggugcgcccuaguccgaacucugggcgggaacacuggugggggcggcggagguugugcccgcgaaguuccuagagcucagcccguugcggcgggaguagagagaauugggcgccucgggagguggcaccgccccucccgugggcacaagcagguugggggcggcgggagccgagcggggacagucgcgccuggcagcgugcacgggcguggacgugcccgggugcggccgcguguagcgcaagaaggaaacuguugagacgcaggugaguguauuggagggaaagugggggagggggcuuuucuagaaaaagggcaggauuccuguguugcacuggcaaccccgccuugcgggaggaugugugcacuggcuucucccgcggaacacgccgggguggugucuggugugugcccacuugcuacggcgccuucgcgcgcgcgguccuuggagcucucggggcguuuggagacuuaacaccggccgcguugugugcggaggugguguagggccgcgggcgcccagggcaggagcaaugaugauccccucgugcgcguuaggugaggcccgucgcagccgcgcgaggucgcagcucgcggucacaucucggguuugcgcgcgaggcgugcgcugcgcgggaagcgcgggcgcucugccgggcgaggccggcucugggauuucaguucgcuugccgugguugcggcagcugcuccuccagcuuggcugguagggccugccagcggcggccggggugcacggacuagugugcgugcacuggugagacugggggagccagcgucgguucacuggcaggugcuccuccaguggccgugacaaugcuuagccagcagucuuucucacggcauuuccuuaaaagccuccuuguuauccuucagggccagagcguaaaaccaugccucuagaugcgagcuaugagcaugcaguuguagcugcccagauggucauuuagaauugugugcauuuuuaaagaccaucuuuaugacaaagauuuucaaguccuaucgucucuacauuuucugaaaacaugggaaaaggauuugcuacgaguuguccacucuccuuuauucccucccucaaagaacgguucuuagaagugccaaaauguaauaccuucggcaaggacaaaagcgcuuuuaaaacuuaauuuucuaguggcccuauuccuaauaauucuucauaaaaauuuagcucagccucaaaacuuacggcgaaucaguccauuuaaaaccauucgaauaucaauugcuguguaauguccccauucccucaaguaaaaucuguuuguuugaaauauuguuuuguugcccuugaagaguuuucucaagaaucguuucgccagagucgcuugaauuucccauuucuuguggaagcugaccuggaguuuccauuuuggugagcggguggaaaagcuguccugcaucuaccuugucuuaguaaccuuuggguauauauaaauggugacuguauugcugaguggacccgaauguuacugcauuugugguaggggccuucuuuauaggagguuuguagggaugcuaagguaacaacacuuaagguuguggggaggauauacuuacgggaaguucgcuugcaaacuauggggagagaaagaagaggaagaaaacaucuggaagauaaaggccagaaugggguaggaaaaauuagaauaugaagaaacauguuacauuaaauuuucugugauuccuccuuuguaauuuuccuuuuugagagaguauuuuuauuuuugugugguuaaaaccagccccuuguugccuguuauuuggguaacuuugugcugccaccuuucagggaguuaguuguuuuuuucuuccuuugaaagacaacuuuagguguuaagccccucccucuuccuuaucuguagguguuuccuucauuguguagugucuucuuucaggaacaaucaagucagcuauauucagugcucacacacuuucccugugguucaagauaauuuuaguuauaggauaugcuucuuguuuagagcaaguacccacugcuggucagugucuaccacucuuuugacacucagugucaaaagguuacuauggaaccuuuuuucuuuucuaggccuaagauguguuuuuauagauccucucugauuuaguuuuuuugguugauuuguucugguuaccgccucuucacaagagaaaaacaaagccuuucugucccaguuucagugguuuuaguuaagacucagcuccugguagguuaagggagaaugaugcugugagugucauauaccaucauuccuugaaucaaccuuuugauuauuuauacacagacagaugcugcuagcugaauccuuguaaccaaccgcucuuggcucuuccagccuucccugcuuaucuuuuaaaaauaaugugccuccccuccugccaccccacuucuauucuagaagcaagucuuagguucucuuuaaggacacagcaaagccuuccagaauauccugacuuuuaagcugggaucaaccuuuuccucuuucuuugcugaaagacauuuuuuuaaaaaaccugugacgcuuuucaggcauuauuggcauugcacaagagcaccacaguggcaaauuagccuucauguucuuuuuccccaaaggacuagauacucugaaauagcuucuuaagcuucuuaucaagacugacuuuaccauuccccuuuuugaugacuugucugcaugguagcaucaguauuuucgcucccauuugaugucuuauuaaaucuaucacaucgucacauucuuauugccacuuuuaucacucauaauguuuauuuggaauugagagaggcuagaaucugugguacuuagcuugguuugguuacuuuuuuguugacauuuuaagggggcuagauggugugccacccuguggaaaaccugcccaucucagucuacccccagcucuuuguuucuuggcuacucagcuggacaggucaaaaaugauaguaagcuaccacauuugaguguguguggggggagguuaauuuuauuuuuggcgugaguacuuaguuaugggcaggacugcuuuuccagcuuguaaccgguaugguugcacauccuacccaaucuugaaauucuuaagaauuuuuggacaagguuacccugcauuuucaucuugcacugggacccacagauuacguagcuuuuccugguuaguugccuucccacuuguuaguauuuagcugucaguauugcugcuuuguugauauauuauagaacuguuugaaggcuuuaugucuagugaugccacaccugacuaucaaauucacuauggaggacauaaaaugcauaaaauuuuuucuugcuuuggccauuuucauuuuacagguguagaagucuucaccgguucugguuacgcacagagcccacauauuguaguucagugccaaauccacacuuuuguauguucuaauuugggaagaacauuuauuguauauuuauuugguucgagauacuagacgguuuauagugcuaguuaauuauuuaaggauuucacauaacguaaauuugccaaguggaaacagaagacacuuaagcuugaaaggcagugcuuauuuuaaggcuuuuacauauuaaaagauaaguguuuuauuaugauuuaaaugauaacuuuuggagucugaauuaaaagucaaaguuugcguaauaaaaucuuagauuuuugugggguacuuaggacauuuuucacuaguaaauuuaacagauuuggcuuucagcuugugugauguguaucauauguuucauuuuaguaaggcuagaagaauuuuuuauuucaagggaagaauuuuuuuuaucucuaagcuuguauuccauugugcaaaacaaaacaaaagguaacucuugugugagcaacgcugugcuaaaugcauucucauagacaucuucaucuuuaauaucaauguuaaguuucuagagauuggucuuaauaaaaauaacuauuuuugcaacgagcauucuuuucucagagcuuugaguuaggcucucaaugcgugaacugaauugauaugcuuaaugacaugguaccuuuuugaauauugcugaauaguucugugugacaacagauacagguuuucguuguaagaaaucuuuaugaagagaaggaugggggcuuugaggaguaaaauagguaaaauaacccagaaagucauaagaauagguggaauggggauaaaacuaaaccaguuuauagaaugccuuacagugucuuuuuuuuaaauaaacuugcaguuucuuaguauauauuuauauuacugauaucuauuacaucaguuucugacugaaaaugaauaggagauaaggucugacaugcaaaauccccuuucccacuuuuaaaaauguauuuuaaaaaacuugacaaauuuaaaauuauacuuacuguaagacaguaacaguaaaaugauagguuuuuuuuuuuaagacacagugaagguuuugcuuuagcacugguauauuuugaaccagguauguuaucuacaguuugauguaccuguauauuuuuccguuggccaaucuaauacagaugcuccugauaaacccauugcaaguugaaaauggcauuaaguuaaaaauguauuuaauacgccuaaccuacugaauaucagagcuuagucuagccuaccuuaaacaugcucagaacauuuauguuauaguugggcaaaaucaucuggcaacacagaguauccauuuuucacucucaugauccauugccugagugggagcuguggcuugcuaccauugcccuauaucgagagagucucuuaccauagacugcuagcccgggaaaggaucaaaauucaaaauauaguuucuccuaaacguguguuacuuuuauaucaccauacaguugaaaaaucguaaguuugaaccaucauaaauuggggaccaucuguagugauagauuuaauccuuggguuuuuccuuugacuuaaaaaguuuaucaugaaagggaaauuuauauucuaaauguucuuuucuuccagcauuuuguuuuuguggguuguucauuauuggagauuauuucagcaacuuuaaagacuauguuaauaggauaucacaaaaaucuuuuauaaauaucaaagcaauaaacuauuccuucaagauggauuuuuauccccuuuuuuuuuuuuuuuuuuuuuuuuuuuuuacugaaagcuuuuaguacacacuuucuugacuaauuucaucucuuuaugggacuagggaaugauaguuguuuugagauucuuagcuuuccugcauuucuuuagagucauuguaaaauuggaaguucuuguuaauauugaggggcuagaaucucuuuaagcauuugaagaaagcuguagcugucucuuccuagagaaauauauacaaauaagaaauuuccauacaguuuuuaguauuuugcacuuuggaagaaagcguguuaaaaugagguuccauuugggaaauaggacuuuggcaauuagaguugucuucuuauacuagugagaacugggugaagucauucagagguucuugucugcuguugaguuagugaugugggccuuuagcauucuuugaaggaugacugacucuaagcuuuccugucucauaguuuguuuuaaaauccauucuguuuuuguaaacaaauaaucacacacauaaggucuugugaucaccgugcccgugcggccaauuugcugaguugucucaguagguuuugucacuuagguugaaauucuuaauuuagcacagccagguggaaaauaguaggcuagaagucugaaguuuucagcaucugguuugguuuaauuacuuauauccuugguuucuuaaccuuugauuguguauaaaaucuuacccuccccaucucaaggaccacguaaagaugagcauauugaaguacaagauuuuuugacaaugaaaugacauugacugaauuggaaaggugguaguaggugguuacugcuugauuaguuuuauauuuuuggcuuucaauguguuaugaaccauuuuuagugauuuuguuuuuuuauaauacaccaucauauguuuauuucugccaugaaguaaaagaaaaaucccagacugcagggaggauuugggagaauugugacuuuggacauuucaguauggaaauagacauauuuauaccuaugaugaugggacuuggaaaguuuaaaaugcauuuuccuugaaaauauaaauaaugcuaaaagauuacauaugagacugagaauuuagccagcuaacauuccaggaauauaaauuucuuaauuuaaauuucucauauuuuuuucagugaaaaaucaaaauuuuaaauuuaaccauuuauauuaaaauaguccgcguuuucucugauuugaauuuuauuuaaccucuuaucaaggauccauuccuauacaucacaaaauggaguuuacauagaaauacauuuuuuuccccucauugcugauggugugaacaucauugauggaugcccugucaaguaaguuauuggaaauugcucacuuguucagcuuuuaaaggauguuuagcacuuuuuuuauucuuuaggcaucauuuguguauaucagaauaaagcaaaucacaguguaucugaaaauaaauucagugaauuggguaaggaugggaaaauauuucuggagcacuugaucuuguuuucucugagcugcuuuucaaaaguaagaauuucuuguuauacugauauugcuuuauuggaggugauauggcaggugagggggucauccaccuuuauugcagagguauccagaauguguuaaauauacaacauuuauuauagagggagcaagauuuuauaaccuguucccagguaaggccuauuucuauuugaguuuauucaacaccacuuuugaucuccccaggugcuauuuacugauugcuggcuuauuuuguuuaaaaacccuuggggucuuuucuguccugugccucugaaugacccauggacuuuucccaaauacgaggucaucagugcuuuugacuuucaucucuucccuucuccauagucuccgcaaggaauuugaacuacccacagccuuccuccccucuuugggaugcgucuguacuugcccucugucccuuguuuauccuuuuagccuugugcuuaguuccagguccugguaauuuggggucaggugcaaccugcucacuugucccuuuauuuucuuauccugcuugggcuuuugcauuggcucuuaugcacuuuguuacauuuuacuuacugaagaauaucuucugugaccaagugaaucacugauaccagaaggagcaguugguaucaguggacaaauuauuugugccacagguccugaagggugauccgugagcuucauauggccuauagguguuuugauugcccugaacuguguuuuaaauaguugugaguuguugauuuacgguuugguaauauauaaagaucuggagccaaauguauugcuucuugaaaacuuggaaggauggagcaacaacaauggaguccacauuuaucgacugcgccuuaaggaugaagcauggcuuguuucacuuugaccuugguuuguuugccuggccuuggugucucuaaugcuauacuuccuaaagccacgugaauuaaaaaguuaaguguaaagacaaaggcaguaguucuaaagguuuuauauucguuugaucucuuguauuuacagauaauguuugaaucauguuaaacugcuccuuacauauuuagaucuuauagucuccuuuacuucagagaagauuugucuugggucucuccuuccuuaacccgugguugaaaaacaguuucuccuuuuauaaaaugagcuucucucagcuuaacuuaccuuuucucuccucccccccugggauuuuagaacuguccccauugggaguagggauuucucccugccaguugccugcuucuauuuauucagaugcuuuggggucaacauugcuacuugaugcuguaaaaacugauaggauguuaugagcuguuuaaaagaggccuguggcccaccugcuaaccucauugcugauguugugagcuuauaaaugacaacagauuuauaagauuguuguaaaaaaaaaaaaaaaaagccgauaugagacuuccaggugugugguuuauguguguguguuauuucucucccuuuccccuuuauuuuuuucagucuucagccuuuucucccccacuccagaagcagcagggcagccuuagcaaggcccucuccuaugugugccguagagcagacugaugcaccagcagaaguagaaagaggcuccacaugucauguuuggaccaaugcuguaauuuuauuuuacaauaaggaagguggauaauauuaaucuacuccugagcauaauagcacaauuugaauagcagagagcaacuuugguguguguuaaugucuagugagaugaauauaguugaaugcuaaguagguagaaaaugucaguguggagccuuccuuuuggugacuuuaagcacuuacauuucuaguuaacuuuuguucagccugguaaauagauaugaagaucuguuguaucaacccagcauuaauguagcuucuuaggauggaacaaugcccauaaaacccugcucuccuggcagccacuucagcuaggccaguuauaacgaugaaucagaaugugccccuguauugaacaucuuagcaaaacccuucagaauaauagcuuaauguuggcaguuuuaagcauuggcuuacucuacaacccagccaauuuuuuuuuuuuuuuugauauuuggaguguuaguauaaguguaugcucacuuaaaaacuuaauuuugaauuaacuguguaugauuuuaaaaaaucauuguagguacauuuggaacuuauuuuucagaggcacuuaaaaauucuugguaccaagcaucuucuauucuaugauuauaugauucuuuuaggugaacguguugcuuguuuuugaugcucccugcagcaucucauugcggcaccucaggguggcuuaguuacuggguugggguggggaauugaauaucaguaaaaacaagcauguuuuaucccccuaaagauugggagucauucccguggagcuucuacugugcaauaagaaugacuuugauauaugugggcugcuaguuaacuugaagcuuagggcuuuuccaaauuaaucuaauuuuguuuuugaguuuguugaaggaucaauaaaaauauucuucuagguuuuguguugagauuauguucagaagccaggaagauuguguaauacuuauuguuucaucacaaauuacugagugcuggauacugagaacguugagacuuguauaaagugcccuuuaccucauauuccuuggucucuaccuaaggagaugaggcagaaaaugauaacuuaaaaaaaaaucacacacuccccacucuugcauuuaauaguagaaacugagugcuugaggaauuaagcaaagagauauaucccuguugucugggaaucaagggaucaggccagguuguugcuuauugcuuuagggacaggacugugucuuuucuugguccauuuugucuauuuuuugcuuuuuaugucuuauuucccucccccguuccucccauauuguuuuuguuaccuuugauuuucuuuuaugguaugaguaacuauuuccuaguuugccaggagcucagucacaggugaaaaguauuucugcaaaaccuacucaaguuugaggguguggcuagagagagacaagcugugacugucuuaauuccacuguugucccagaagaguagaucugaggcacguuguguuucaaacuacaugaagcuggguguuucccccagaguuuuauucuguugacaacauuaugugccagcagccuccucuggguauaacauuuauuuuucaaaacaccuaggaaaaagucaaaauaauuacaacuuuuuugacuuccucccuuuugggaauauaguugcaggagcaagaagcaaguaacaggacagaagcuggggugcuuuucagagcauugaucuaugccuucuccuugcgucaucuucauggcuaaggccaugucuuccaggagcauguguugucugggcugcugacuauggcuuucucaugccagugcuugguguucugaggccuggccacugcuuuucucccuuaauggcauuugcauuacuguuucguggguuuuuuuuuuuuuccuugaaaggugaucgaacagcuuguacgcugcguuaccuuuuugauuuaguggagaggcucauuccuucaguuggaacuggcuguucggggaauaauuuguguucuuguuucuuggacuuuuugaaaaaauuuuuucccaaacaguuuggcugacuuauaaacauuguuuuguggaugguagggugaaaucuuugguuuuagagugaauaauaguuugugaccuagacaggaagagugaagacaucuguuuugguuuuccuuuuguacaacuucuaugguaacuuccaaaugacucucccuugagaaugcaacaguaagaaauuuuguguuggacagucaaguuagcaguggauugggauggggcagcagggaucugccacuuuuuaguuguugacuuaccauuaggaagauagaaaaauacguggaguuggcaauugaagauggugaacuaccacaaggugauggaaccaggagacacggagcauuuccucuaguaauggugauuaacaccaaguuuuucuguccuuauagaaacuugccacagcucccugggaaugauguuuuauaggugaggaaaaugaagcucagaggucaggugguuugcccaaggauacaaccaaguggggaaguaggaucaggucagacuccuaguucuguaccucuuuccauggaucccagaaugauguucuuucuacuuuugguaguucugcuggcuguaguuuaagguggcugaaaucagauccaagaagcaacucaguuuucauguuugagaauguauugcuucucuuagggguguuuugaaauaaaauggugugacuccagcagcaauuguaucucaccuccauauuaaauugcuuuagaggcuguuugguuccccaguggugggguuguuguaccaggauuauuuuuuauuuuuauaauuuuuuuuaaagcuucacuguggucccuguagcacuccuagcaguaugcccacaacuuguuccucagggccaggauucugaccuuggauuauuuuagguccaugacugggugacuucuggaggcauuuccaucacaggcuggugacuuucugaugccagcuggcauccuugacuugcaggauuacuuuuuggaaccauacaaaguauggauugguuauuuucuguaagcaaggaaaugaagacacugucuucaggcuuuuuuuaggaugcuguuaaaaucaagaaaaaggugaaagugacauugagauaacccuggcucauuguaguagauaaucuguaagggcuguuuuuugaacuuguuaaguuuaugaaaaaaaauguguucccaaucaggcaggauuuuagaaauacuacuuuuuguucugagaaaaaaauggcaggucaaguguucaauaggauguuugauauccaaauuggaauaaacaaaauauucacccaguaaagauuguucuugauucaccuuucuccaguaaguuuucaguauuucuccaacuuuacuguuucuccaacuuuacugucagaaaaauugguugggaguggaugacaaagaauuacagauucaaaaugaccuuuuugcucuucccuagaaagaggccaugugcucuuuuucauuacuugaucucucacauaguguguuuuuaggagaaauucaggaaaauuuguggaggucacuggaacagcagaacucaaaagucuggaauagagauaauaauuuaaagaaagaauauaguacaugagacugauaaucaauugaaaauuauuugcauauguaaguaaaucaugaaugauagguaaucuuacuagaauuucaaucucuacagggaaauuuuugcaaaaacugccuuaacuaaucccauguuuucucaugucuuagauaugcaauuuuuauauuacuuuugagucucuuaaguuuacuuaauguccugauucuaugucccccaaagcugugagguuagugggugcaucuuucaguccaaaugucuuagaauugagaagcugaaauagcuucaugccaacauguucucugauuucuuaucucugcaaauauuuuacucuuccuagaguauaaauauuguccuugugcuauggaaagcugguguaaacgugagaaaauaaggucaucagauugucucuacauauuucaagcaggugccucugguauaaaauuggccaacaggcuaugcacaaagcagucaggugggauccugacaaggcugcuccguacugguuagcuguaauuuagaauaucacaggaugaagcagaaguuaauuguugagggugaaagcucaauagcauuuuacucaucaucacauuuuauaggacauaguaaccuuaaacuuugaccuuaauacguaucauuucucuuuaauuuuuguuguguuuccuuaaauuuggcgaagacuaccagagauuuuguuggguaaaaugcuuuguagcuccccaguucccuauggaauucagaagcauuaagagauccagggacuuuguuaaguuuuggguguuauaguucagacuccuuaaggaauuuucuggaacuuuacccauaaggaauuuuucauuauggcuaacauuucuuucucucucucauucccugugauuauucucuguuaucgucucaaagaaauguggcaauuugaugacaguuuauuaaauagccuaugaauauuugaaauguuuacaucuaaaguuuuuauuaguagccacuuuaaaacuuuaaacuuaucucucuuuuccuagcauuuaacauuuuauuauuuuauugugucuggccuccugacaugaauggcauuuugcucuuuuugauuguccuucuauucaguuuuugauuugcugauccagccuuuucugccccccaguacuuuaaaagcaauuauuuugccaguuuacaugugaacauuucuugguuuccugugcagauuuucauuuguuuaguaaauauuugugaucuugcuauaugccacauauacuaccuuagguauuaagacuauaguagugaauacaguauacucccugcugauaugaaacuuagaguuuauuggaggagauauuauguuaaaguucuacaaauuauuacauauaauugugauuugugcugugaaggaaaauaaccuuuaaggcuuauaacacagugugggaggugauuagugaagaucauuuguugauuuccuuccuagcuaccuuauuuuuacuguacauaaaaacagacuaguuuuuaauuuuauaggcauaaggauagacagagguccuaaaauuaaacucuauucuccuugauaaauugauggugaacuuugaguccuagagcugauuccugccacccagcuucuaucccaccauggaucuggcuuuuuauauuuuuuacgagaaaccgauuuuaauguucuuugcaggacaacguaauuuggcaacuuuuacucugaaagcuauguggugaaugcaaagcccagcagugagaucugcauugucuaaauccuuuauucucuuuacccauggcuuugaaaauguguuggauuuugaaauauuaucaguauuuguuuaaauaacacuuucuaauguauuaauugaugcaguaagaacuuaggaauauuuguuaggcuuuuugcuuggcggaaauuagaauuucacuaauucauccacaguuguguuuugucauugauuggauuauuugguuuguuuaugaaugaccuuuuagauaaucccuuugacagaucaccccauugcuuuaccauauuguguuccuuccaguauucauuuaaauuauaacuaaaaggaaauaccauauuaauuggaauuguuuuuaaaauauuuguuggaguggaagagacuuaggcaguuuuuuuuuuguagaaacuuuggaagacauuuguuguuuaagagugucgaaaaauacuuuuuaaaaaaaugucaguggcuucuguggaguuccuuaauccuaaagggcuagguauguucguaagagauggguagaauaugggaaauuacucuaagcaauuggaaaagacacggaaaaaagguuaaggaaaaugaggaagugaauuuuccaucuggcuaguuuccucauucacacagaucaccagaccuaaacaguacagugaaugcauggcaaggauaugauauuuuaaaauagugucuuucugaccaccuuauuagauuauuaagcuuacuugacuaggcucuuaguuuccucagagagguggacucuggcaaacaguuuuauuuuuaauauaagcuggucuuuaggaagauaauaaaaacuuugcaugccuuuuagcuuauaccauuuauaauuguuugauuuaacauggauauagcauuuuuuuguagguggauauuauuucaucacagcuuuuagauuucagccccuuuuccuuaggugcagaaggaagcuacugaaaauauagacaguaaccucuacucuugauggaauuuggagagaaguaaaccaaguuuuaguucaggagaggagaauuuuaauuuuacuucuggcauuacagggacagcagguaugagaguuaaggagcuguuacggaaugggcacuugggguaacaacuucccauugccuuuggugucuggucucuccuuaauagcuuuuuauauugguuuaaauuuucagggcacaacuuaaauguuacuuucaacuacauuggaagcucuuugaugucagugauucuuauaacuuuguuuucugaauauagugggucuuauugucuuauuacugauuuuuuuuuuuaagagauuuagucucacugcaguggcaugaucauaguuaacuguaacuuugaauuccugggcuuuuagggauccuccagcaucagccuccugaguaguugggucuauaggcaugcuuuacugcaacuggcuaauuuuuaaauuuuuuuguagagauggggucucaccaucuuacccaggcuugucuugaaauccugggcucaagggauccuucugcuuuggacuuccaaagugcugggauuacagaccugagccaccucaccuggcuagucugauuucuugaaucuaauagguccuaugucuuuaaaaugaagauuaaaauuauauaugcugaagguaaauguuacaugcaaguuuuuuucuuuuaauuguguauucggccuugguauuuugguugcuaugaaguuguauaacuuacauauuuaaccaauuggaguuaauaaaaauuguuaauauuuaaacuauagcaaacauuucuauguuuuuuagauaucacuacuauaugaugguaauuaagugcuggauacugaauaauauuuuaagaugacuuuauuaaagugcuauuucuuuucauccauaccugugaauaauuaagaauuuaugguaucuguuugcagucuaguuggugaguuuaauuuacuuggaccacccagaaaaaaauauacaaugaugcuucuguaaccacuuugacuaagcugaaacuaugcuuuuuacauguauuuaugaccuguuaauaccgcuucaaagugugcuguauugaaaagauauuggcugcuucaagguuggacugaaaugacuguguuugccaggaauaaggaggggucuccauggaugaccacugggccagucauuuaauagccauguggaacccucuucggcuaucagaagaauguuuucugcucuacacugaguaucuuuggaagcagauagagaaguugaggucuaagguagaugcucuaaucauggauggcuaacuuuaagaagcguuauugggccagguucuccugugguauaugccaagcucaugcucgugcauggguacacacacaagcccaagguacaguagcagcuccaucuguuuuguauguuguaggccugccuugacauagaacuguucguucuaaagcaacucauuuuaaagcugcaguauguuaaaugggcaacccuucauugaagaccuuggguauguuggcaguuuaucagcagcaggguugugauccugucacuucuuguuaaugaaggcuuuuauuuagcuuagcaaaucauaucucuuguuaguauccacucucucaaaugguagacuugaaagggauguuuguaccguuuuauuuauuaguagccaugagggugcuuuggcccuuacuuguuauagccauuuagccauauuucuuuuacggagaugugguuuguuuuaaacuaggaaaauccccaaaugauuaacgucuuucuuuuguuuaucauuuuugaaauggcuuuuuauauuuccuauuagguggucuuuuucuucagucucaauuucacuuccauuuugaaauuccuagcagggguuugucagagcauuuauguucccaguguugcagcugacuuucccagcauuuauuuguuguccuuggguaguccaagaggauaagcauucugucuucauauuuaauguacauuucuuauauauaacaaguucaaggacaucagagaauguuagagcuggaaaggcccuacccauaguguugaacagcagucucauuucauauacauucagaacugaugcuaagauguauugucuaaagucuuagguauaaugauugugguuggugacugugaccuuguggcugguucccgacuugccuuuacuucccccagugcccucucuacacugcugcauuauuuccuuuuuaaaaauguagguuaugcuuuggugggacugcaaacugauaaguuuucagaaguuuuuuuuggcagugacuagcguaauuaaaaaugcaaauagacuacaaaccagcaauuucuaucuuuaaauuuacauuuuugcuuuacuguauaagguaucuauuguaagcacuguuugaaauagcaaaaccuuggaauguucaucaguaggggauugguuaaauuaaucaggguauauaucucuauuauauaguaucuguaaauaaagaguaugugcugaucuugaaauguaaaaagcaagguucagagagcauucaaaaagaucuauguauuaaguauuuacuuuuccucaccugugccauuacauguuuguauuuucuuugaaaguguucaaaguguucaugaaauuguuaaccucucagguguagauuugaagaaauuaaauauuucugucuuuuauugcuugaacccaggagguggagguugcugugagccgagaucaugccauugcacuccugccugggcgacagagcgagacgccgucucaaaaaaaaaauaaauaaauaaauaaauaauaaauccaucuuuuaaacaguucugugguuaucuuuuugcaucaaauauauauuuuuuaauuugcacaaauuauuauaauagaauuacuaauuacuucaaaagcugaucccccuugggcuuuucagagcauuuuaauagauuugcacuuuuccuacauaugagcuguuuguuagcauucagugccugccuugagcugagcguugugcauggucguugggugcucagaaacacuaggauguggaugccacucucaaguucuccaagucugguugacaguccagaggaagaaaacgugaguuuaugggaguuuggugaggucugcugcaaacauugggaaaagguuccugaaaccagguagauguaguagcacuugugaagcucuuuuauacagauagggggacuuguccccccaccccacccgcaaccccccaggagaagaggauuaagugugguguacuccuagcauguaaggaaaaaguuuugauuauuggaacauggguggguuucuagaggacacugaaauccauacaggaacauuucucuuauuuuguuugagagagccagccuugggacaauuuuacaggauggcuuagugugaggaaaacugaagcaaaagacaugggcugauguggcuaaaggggccuugaggaggaacgcaccagggcuuugagaggaagauggagcaugcauggcuuccugacuaggguguaaacccccaaaugaaagugaaaaacugcuucuggcaugcuuuguauuguguaggagagacucauaagauacucaagcauuuuucuaaaccaguguaaguaugcaacaugaaacauguaauagcuuguuaugcuuuauaaagcaucuuuucugagaaccagaauauacaguuauauucauguuuccccgacaauguuuauguaaaaauuuuacauuaaaggcaguugagaugauucacguuuuuuucuuauaaaucaggguaguacugggcaugagaaguaguuuacauagucccagagcuggaggaacaucccuuugaagguaaggagaguaguuggaagcuguucuaagguuuaucuauaugggcuaaagggauucaccauaaaggcaugcuuauguagcagugaauuagaccaguaauucucaaaguucuugaucagaggaucccuuuguacacuuaaauuauugaggaccccaggaccuuuuguuuguuauguguauaaauauuuacuguauaagaaauuaagaugagaaaguuuaaaaaccuguuuaaauagcaaacccauuacauauuaaaaaauauuuuuaaagugaggaauauguauauuuuuaaaaaguaaggcuggcauaguuuuacauuuuacauuucuuuaacgucuggcuuaauagaucuagucaacuguauucucauugcaacagacugaaugcagaagcaagugucacauauaaccuuuagaaagcucuacuguacauuuaugagaggaaaaggcauucucuugacuucccggauguaugaggaagucucagaggacucuuagguucccaggcuaugcuuugagaaccacuggauuagccuaauggauucuuggaaggcagggcuaggcccaucugagucuuaaaacuuggaaucuguauuguagggaggagugggcagucaucuuucuaggggagggguaaauuuaagaauaaagcuguggaauuggaguacuuuggagguaagauugucuucaggaguugaaaacuugaaugcuaugaccagauucuaucacuagcaaauucuaucacuagaaaguuuggccaagucuuggggcuugcuuucucugucuaaaaauugaggcugugggcuagcguuuggaagucccuuguagcacuaacauuauuaauguauuuuuuauagcgcucuugacccuuucuauaaauacaugcccacacaucuacauacaacauacuuggagcacguuggaaggucacaugagcuaaaaaugcaccucggaguaguucaccugcuccaugcauuuucuucuuccuguauugguuucauuguccuaguuuguugcucaaguagacauugacuaaaugguacccaggauguguauagaaucuuaaccucuuucuucaauuguggaacacaucugcacuuaaaaaaacaaaacgaaacagauaaacaaucuuccacuguauuuauuucagcuucccgcauuagucgugagauuagguggguaaggaggagggaggugaggugucaucuaaaaccaccauugucaaucagggcuccaccugucaauuccuauuugcagcgcuuguuagaagaaaacucugugggagucccuucccccuuuaaaaugcaaaaugggguguugguagugaagggugcccauuuauuuuucuguguaugauuccacauuuaauauuguaauagaauuaauuucuuucuaguuucaaaugugcugauuuagacauuuucugcauuuuaguuuggauaacuaaugcgugaacauucuguugucagauguugaccuuuauacacccuaacuggaucaagaaaugucaguaacagugacaucuagcauucuuaaugauguugauuucuguuuaaaacuaaagucccuuagcuaggacacuucuguuggugagaucauugauacucugggauuucugcuugcaagaaauuuacuugucugaaaacugaguagcccuugaaggcaaagacacacuuuauauuccaauagcuccuguacguagagcuuaauauuuauugaaugaaugacaguauaacuuuuccuuucaagcacaacauucaagagaagaaauauuaguuuuucauuuugaaaucccuuguagcuuuaaaaaaucuucuaccugagaaaauuucuuugaguuuaaaagaaauaaagcagcaguuaaguuuuaaauguuauuuuaaaacauauugagccuauuuccaguaauguuuuuguauuuuguucuaggcucuuaauauuuauuucauacuucaguauuccugggugcguguaccuacuuccaaacagaaaguuuugagaaauagucuggagggcuucugugucuguuagguagcuccaaauugaaauaaaauauaaaaauggaagacgaaggacaguugcuguacaguucacaauuagccuuaauuuguagaucucugcugggcccagcuguaaaguuuauugguauaaaauguguucuugaucuggaaagcccucaaauaaggugccuugcuuuccaacaagcaggaaggaaauguuaaugccaguuuuccuguggcuucuguuuaaugugaauaggauccucugaggagauuuaaaaagcggcucauugcccuugaaggcacccguaucagaugaagauagaucuaaauucguauuugaauaaaaaauuucauacgucaucuguuuucccaaacuaaauuuaaaguuuaguuuuaaacuuuuacuguaaguuauuuuaaguaagucaaauuuucuaauuuuguagauucauuugcuugagaagcauucuauacugauucucuacuccccaaaaccaaguaaucugaaguaguuuuccaaaguuggggauaaugaccuauguucuuugaaagaauucuuaaaauuuccaucugauaucuuaagcauauagggcuguagugcauuucacuucauccuugaauaagagggaagggggcuaggcuggacauguucugcagcuugugagguccuucuccucauguaagcauggugccauuugcucauucuggcuuaguagagcugcucuugggcacuaccaucccggguugugaagggugcacuuaggccccugcaugagcagauacccuggguuacacauuugguguuaaaauaagcugagaagaggaauaggaacucuacuguuuuaggacuugauuguuacaccuccaguucagaauuuggggucccuauucaaagucacuccaccuauccaagccuucgaugucugaccuacagaaugggaauaaugaaagguugauugugaugcuuuauggugaagcccucauuauuagcuacuuucuuuucucauuuuugaauugggauucuuuggaagaccaaagaaaacuugccuuaaugagguuauuuuaggagaaauauuggacuuuaaggcuuuuguuucuuuaaugcuuuguuucucuaauacucuucaaaucuugcauagggaaagauuaggucuguccccugcacccacccacagaguccuuggacagcuguguuuaaaagugagggcuugguuuagguuugcugggagaccucuuaaagcuuuugggaaaggaaagagaaugggaaacuacaaagggcuuaagauuuuucuuuucagugguaaauagagcccuuucaggguuuucuaauucuuaauagauuucuugcccaacuguggucucuuauuugguguguuaggucuguaaagaagcuuagucuagcaggaagcaccuugggugugguaaggcaauuaggggcucucaauagaagaugcacuggugaccugcaugucuuucaaacuaggguguuggcugcugggaguagcaagaguuacuauugagcaucagugacaaagaauuaaucuuauuaaguuggaaauggggcuggauauuguaauuagaugugagagacccagugaucagacuugaggauuguaggcccucaaaacucugcuuuuccccacucacguggugggguggaguaagaguacaaaaucuuguuuuuuauggagggacaucuagguucuaguccagguuucacccugagugccuuaggaaaauacucacuuuucagguccuggguuucuuaucucuuaaaaugcgggaugggaaacaagguaacagauaggauugcuuuucuccucuaaagaucugacuaggugauguuagaaccaggggaagguuuggugcuacuccugacuucgcuuguuaagaagucauaggcgagagguacuccuuuguauuuuggguuuuuugguagguaguuuggagauagagauggaaaaaaauuuuaaaaagcuucugugagauugcauuagauuuucuuaggcuuucuagucauauuaugucugucuuaauuguguaauaauuagcacuuuaggaaggccauuaugauaaggguuuuaauaguucuuccauccuucacuuuacaugaccaccaccugggagaaaauuuuguacacauaucaaggaagaaaaugaucaaguuuuggauuuaagaaccuaauuguuaagucuugauuaaaugaugccuauuagguuguaauuauaucuaucuauaaaaaacagaugguggcagauuugauugcugcauuuccugaagcaguuuuuuaagauaaugaauuuaauuacacgugugccugggaaccauuuuaaaccaucgagaagggaaaaauggacaaggccuauuggaaauggaaaguguucaccuagguguauagcuuuuagcuugugguuuugaaggauaggaacagaaaaaucugacuccucccucgucucccuucccacacacacccccuacaaaggcagaauccauauucugauacuuuauaugaaauguuacaguaacauuuaucagaugucaaaggguauggcauagaagugguugugucagcauaauuugaaggcugcuucucugugccaggcacuguucucagcagucuacauggauucacucacuugaguucuuacaaaacucugagauguaggugguauaauuaucuccccacccccgccauuuuauagguaaggaaauggcacguagagugauuuaaguuacaggcccaaagaugcaguaaaugacagagcuggaauuagaacucacgcagucuggcuucagagugcacaguaacaucuauacuggaauucucucugcccagguguuagaacuaaauuauuuaaucaaauaaaggguccuguuuugcuguugcgaccuuuuugcacuaauauuaugaacugucuccucagauaaauaaccuugcagaauuuaggcacauuugaguuagaaucuuguaagagacaguuaaaggacagcuuuggcucugucauccugccugaagguuucaguggcucccuauugcuuacagaacagauuucaaacacuuucaggcauucagaguucucccuucuuugccggaugcaauguuuacuucaugaacuagccaaauaacuuuuucucuugaucaugacccaugaauucuuaucccauacuuuuuuuuucuuuucuuuucuuuuuuuuucuuuugagacagaguuucacucuuguugcgcaagcuggagugcaauggcgugauuucagcuuaccgcaaccuccgcuucccagguucaagagauucuccugccucagccacccgaguagcucggauuacaggcaugcgccaccacgcccaccuaauuuuguauuuuuagcagaggcgggguuuucuccauguuggucagauuggucucaaacuccagaccucagaugauccaccugccucagccucccaaaguacugggauuacaggcguaagccaccacgcccgcaucccauacuuuuuauucacucaaguauaucauuauggcaaaccuaaaucguacaccugguguccuuuaaaaaaucuccucucagucccuaccuuuaauuauuucugucauuaucuaccacccaugccccuccugcuaccaagcacccuuucuguuuuaaauucccaauagcuggccuuugggauuuuauugaaguguaucauacaugagauuuaccagauaacaugaagaugacuuacacauuucuucauuuaguuuguguuuauauuuacacuguuccugugaugugcuagggacuuagcaugcauuacaauuuaagaucaguuuaaugauauuuagaaagccgugcuguuuuuguagugccuuuacugguuguauuuuuuugaaaacgccuguguuuuucuuuuaaacagaggauagagguucacuuuugggcuuaaguagaauuaguaggauucauucuggauuuugguucauuuuugucucgaaucuuaaacucuucaaauccuguuguuagcugcucaggacucagcugggcagaugguagcuauuguacaaauuaggacauugaagcauaaaggucagguuaauucaaccuguguccauuuagcuaaauuggcuaccaugucaugcuugugaguuggacucugcaucaaccagcuuugcaguccauugucccuguccucauucuuuauaguuagcuaucucucaaaugcauccuuacuauuuggaaugaggaaaaugggguuaaaaugaagagauaagcaagucagaaucuauuuucucuaguauauuccaugacugauauugaaucaguagaauaaccuauacaaaggacgaagggcaagggcaauuguucucaggauaucuuuuacauauuugggauauuacucuguuuugaaaaaaaauuauagagcuauaauuaaauaucuucuugugcagggaacuaacucuacguauagauuuggcaauaauagugucaaggcucuccguaaggaugguguaaacucuagauaucuuacuuauagacagccauugcccuagugaggcaagucaugcaucuuuggaucauaaugacuaagcagcagaauuuuaaucuggcaauuuuguggguuuaccguuagagugugaagcuguuuuugccuuuuggcaguauuuugcuuuccucgagaugaucucagcuuucauuaagauuucaucugacugaaaagauugauuuuugaguaggugagaguccuuuuaugugaugucucaaaggacagaguaugggucaaaucgcucuucaaauggacaguaauugugaggaagaggcuuuuuaaauggagauugcaaguuacccaaagguuauuagaaguaagagcuuuuauauguaauaagcuuccacauuuguaaauaacaagaacuguaauaacccagugaaagccccauaaccagggcuugaaccagaguuguauguuaacaaugaucacccuucuaacucuaguguuuuauaguaggaccuagaaaguucaucauuugucuuuugguuuaauucuucuuuggauugcagaaguauauuacuguucaaauuuuuguuucucauaaaaauuaagaaacaauugaagguccaaggaccaaaauggguacacuucguuuucauaauauuccaaaaucuggugggaaacaauauugaucaagaaaguaauuuaaacauccacuuaugcauuuuucccccgguuuguaagaaggugguggugcugcagagcgggcugugaagaggagucaauauuaaaaaugauuguuuagcucuuagaaauuauuuccuggaaaugcuaaauagcaauaaaaucaacuuucagggaggagacacauugccauuaaaugucuuguuuuugucucagcuuugugaugaacaaaggaauauucguucuuaaauauguggaaucuugagauuuuaaauuccauuuuaauaguggcaacuuaaaauuucuucucuguaagagguucuguauuuuaugacaguccuauuuuuugagacauuuuauauaucaaugacuauggacguaguauuuuccaguacuuacaauguuguuuuccccauuuauuuuuuauuuuuauuuuuuugagauggagucuugcucugucucgcucaggcuggacagcaguggcgugaucucggcucacugcagccuccgccucccagguucaagcgauucuccugucacagccucgcgaguagcugggacuacagccauguaccaccacacgaagcuaauuuuguauuuuuaguagagaugggauuuuaccauguuggccacgcuguucucgaacuccugaccucaggugacccacccaccucagccucccaaagugcugggauuacaggcaugagccaccacgcccaacauuuucuccauuucuuaaauagacacuggcaggaucuuagguucuuagggaaucuuauauaaaauauaaacaaacuacccacuuaauuauaaugagccuguggucuauaaagauaaggacuuaauuuuucaaaguuguugacuuugaaaauauugcuuagaaauguguuuuuuaaugucugaagagcaguaauauuauuuuacuccuuuaguuuguuuugauagcaguugaucaaaagcuauuauaaggcauguauacagauguuuuguaggugugcauaagauaaaauaaggugggaaauuugguuaaagaaguguucaucuucuuuagcuuuaguuaaauuuuauuuuucuaggagcuguauauaccuaauuuguaugguccuggcucucuacuuauuauuaaaacaagagaagauggaaggauuaaugcauacucugccauauuuuaucuguauuccauuggucaggaaaucuucccagauuguagggagcauugccaagugguugguguacuggaucugaaaagauuagacugguuuccccacacaaauuuuuucaugauuuuccuaaacauuaaggauugauuuguacaagcuuuguguaauuuuaauaauuagucugguuugacuaauguaguuauuugauguaaaaaugguugauacuuuggaauucucaaauucuaggaauguuuaaaacugaauguaucuuauucagccuugaauuugaaaaaugggggcugucuauccaguauggauuaggguauauauuuucacucccuaagaaaaauuguuguccucagaagcuuuuaggaacucuggcaggacagcuugccuuuucuccugcaagaggccugcuguacguguguuuaacagucaaucuguuguagaaagugggugguucuuuuccccucuuuaggggaagcugauggcccagcccuuuugggcacucaguguucuaggaaagugucacugaagucccugaauguuacacuaucaguuugcuuuugauuccaggcccugauuguagaugucauuggugucauuucuuugcccuaccaacccugaaguuagaaggggaaagauaagcucaugaagcagcuugaaugcuguugguaugcuagucagugacauuggaguaucucugggugcugcugacugcagugcccuuugauuuagaucacaaugaugaaagaacuaaagcucuucuagaauuuuaugucuccauucugguuggguuucuauauaaagaugaccacauacagguggagucauugauggggccuuacaaauggcuguaugauauagugcaugcuaaguuaccaggaaagagcucuuggaggacuguuuuuaaagggguaagcaaaauuuauuagagaagaucagcaaagcuuauaaugaagagcaugcguguaaauuggaaccaguagggagaagaucaugaguggagaaaauaguuauaaaaguuuggagguggaaaguccacugagugggacagaggcuauuuugggggcauguaaaaaucaagagccagguauucagguuguuggaaaucuuaguauauuacuguguuuugucacucacaugaugaaaaucaauaaggauccaguauagguuacgaagcucaggcucucauaaagagaguguugaagaggcuuguuaugauguucuuuggaggaaugauaggggaggggaucguugaaaauugggaaaaucugagagacucuauuaguuuuguugcugggauuuaggugauagcuuuagaaaaaaaguugaggguuugagagaagaacugauugagcucagaucaaaucuauaugugugucucauggucucuagaccuuacuuaggaugauaauacuuagggggagaugagagccucugaaaacucugaauuucauuugugucagaucuucccauuuucuauuuauguggagcugaaauugguaccaucuuucagauauuguguaaguaccuggcaugauuugguggagguaaaagccuauuugaauaaaaucaguauguggcagagcagcaguugaggguagaagguuuugccauaacaagccccuugugauuguguaauguucuucagaacuucuuucuuccagcugccauuuagaaaggaaauaagcagagaggacauuccaaauugucacaacaauaggaauaaaagcaaggaaacaggccaggcaguggugccucacuccuguaaucccagcacuuugggaggccuugcggggagggauugcuugaggccaggaguucaagaccagucucaacaacauagugaggacccugugucuacaaaaaguaaaaaauaaaaaauaacuggguguggugaugcaugccuguagucccagauacuuggaaggccgacgggggaggauagcaugauucuaggaguuggaggccaccgugagcugugaccacaccgcuguacuccauccugggcgacagaguaagaacuugugucuaaaaaauaaaagaaaaauaugaaaaaaggaaguaaauaaaauaaugcaacagauucagaggaugguuaugggucauuuugaccuuaugcaggguuuuggcuugagaaguugggagaaaacauuagggauggauuagaaaguuaaaaaggcccuuaaaugaaggucuguauguauacaauugaugguauuugagcaagugauagcaugagauguuuuugggaaguugaagcuagccauuauauaaagaugagcauguuggaggaggagacagauuugaagcaguguauaugaugauaaaggcuugcccuggucucaugggaauuggaggaugagggguagauauugguagacacucauuuuagugaagguaaauuagcaguuauggauagaugacaguguugauucaaaagcgagggggcaugguucaguggcuacaagaaggugcucugacuuaugauggggcuuauguccugauaaacccaucuuuaaguuaaguugaagaugucauaaguagaaaauacauuuaacauacuuaaccugcuuaacaucauagcuuucgccuagccugccuuaaaucugcuuagaacacuugcauuagccuauaauugggcaaaaccaucuaacacaaagccuguuuuauaauaaaaguguugaauguuucauguaauuuacugaauacugacagugaaaaauagaaugaugguguaguuacuugaagugcuguuucuacugaauguguaucgaucuugcaccauuacaaaguuuagaaacuguuaagucaaaccauguaaguuggggacuauuugcauaccuaagguucagauuccaggaaaagauuggguggcagcaaugagaggaaaagacaacugagagauuaagaauugguguggggguuguauuaguuugcuuaggcugccauaacagaauaccauagccuggguagcaaaaacaauagaaauuuauuuucucaugguucuggaggcuggaagaccaagaucaagguuuugguaguguugguuucuggcaagaccacuguuucaggcuugcagaaggccaccuucucacuguguccucacuuagcuuuuacucuggguauguaaagaaggagaaaucauuggugucucuuccuuuucuuauauggacaccaauccuauuggauuagggccccauacuugugaccucauuuauucuuaauuauuuacacuuaugaccucauuuagccuuauuuccugaaauaauuaaggaaauagagugaaaaacagagugguuguguaguuacuugaaguaccguuucuacugaaacuacugaacuacacaacccuguuuucaaauauagucacguuggagauuaugguuucaacauguuaauuuugggagauacacuucaguucucuaacagggguaaggguauuuaauuucucgaggcaugaacagaaaugauucuuuuccccugaauuucugaucuacaguuuuaguuuuucauuccagaagggaaaugcuuucucaucuuuacgauuggucaagacuccuugcucccaccccugcgauuagcauuugccguuuucaaccuggagauuucuuuuccauuuacccugucuguacaguaguuugugaccaccucugccuuuuaaaguugaguuuugacaauugauauacaauugauuucuucucuaaccucuucaguuuuauaguuugaccucuuguuacaaacugcuuuuaaaggcaccaugcuuaugcuuuaaaagccacuuaaacagaacauauauuuagaagacaggauguuuuugccacagaugucaagagggucuuggcaguguuuucacagaaugucugcuggugucugugcagcucugagacucuaggcacucuguacuuagagaacauguagagguuaaguguucaucaggagaccugcgauguuuguguuggaaauacuaagagaugugagguuuaggauguuuuguguuguguugcucugugugcucguccagagcagacauccucaagucagaacuuaaugagguaugcggaaaaucaccaggggaaccguaauauauaaaacauaaaauuaaagcucugggaugaauggcuaaugccuaguuacauuagauagucaguuuauaguuauuugcuccagccuaauuuggcugucuauucaagguaaucagcagagagucaaaccuuuaacuuuuucuugagggacugcagugagccuuuuagcuuucuuuacguugagcuuuauggugacagaugagaugaaggauacuauuucacuuccuucaaguuuuuaguguggccucauuauauuugaaagugaauucccagagcagccgauaugccuguaacuaauccuaaguagaaaaucuauuccaaagcagaaaauauauuuuggcuuuaccugugcagucacagacugggaaagcggguauuggggugucuaauaauguggauuuaaaugguuugguuagaauaucuacucuccuuucauccaaccaggcauuuccauauauuuuuguauucccucucuuuuuuucuaccacagaaguuuaauuucaagauuuucugucucaucucucucugguauucauuacaccuguuacaucuguuuuguuuccaguacaaaacagcacucggaccugccucuuuuacauugguccucuaaccaaagaaugauuuaggagaaaauuugucauuuguugaaagguuguuuuuuuuuuuuccccuuuuuuaccaucaaccugucauuuuguguaucuuaauggauuauucaagcauuuauagcccuuugaaaacuuugguuucaggcauuagaaauuaauguaauuuaggaacaugguuaccccuuaccuuaccucugaguguccuaccuguauacauucaggaaaggguuuaaaaagcauagaacacuuaaaaacuucaaauauguuuucucauuuauaagugacauuuaguaaagucuugaaagauauaagaagcuaacuguuuugcaaccauacuguuuuccucugggcugucuuuaagaauguuuauuuacuuuucuggggaagggagauaugugauagcuuguauaauacgauacauuauuuaggaagcaauuucuugccauucagauuguggguuucggaucauuuagcuaaaagauuacccugcugagugcguggaaaucaucuuaagacaaaauaagguuugugaaaaugaaaguugaauaggaaguugugcagaugaccaagcuuuaucauucagcaggugucagauuuuaaguuguguggauucuuuugagaaauaauuaaaaguuuuaccgaauuguauuacuauuuugaacuguuuccucaauacuaugccucaagaauucaguugaggacacauaugcauuuuaauacguaauuuuguauguagcauaaauuuaauaaaucacuuaauauauaaauucacuauuugugaaaugacggucacuucaguaggguuaggggacauacauuccaccuuaccauuuaggaaaacuugcauuucuuguggcugcgucuagugucugggcacuggccuagacugauauagagggucacugacccucuguauagggacugaauaagcagucccucuauauagggacuaauaggaacugaauaagcaggccaaacuucuauuccccauuuacugagucuuuaacaaggccaucuaaaguuguaaugguaagaaggaaaaaauugggggacuauauucuuacacugcccucuauaagaauacagaagccguuggucucuuuucuuuugcuuggauggcaguaguuccuccuuacccacaguuucgcuuuccaugauuuccguuaccugcagucaacugugguucacaaauauuaaauggaaaauuccaggcauaaacaauucacaaguuuuacacugcguguacuucugaauagugugauguacccucaugcugaccagucaggaugugaauccucccuuugucuaguguauccaugcuguuagucccuuaguauagccaucucaguuauaagauugacuuucgagguauugcacugcucguguucaaguagcccuucuuuuacuuucagcggccccaaagcacaagaguagugaugcuggcaguucugacaugccaaagagaggauguuaaagugcuccauguucccuuuaaguaaaaaggugaaaguucucgacuuaaagaaaacuaaauacgcugagagaucacauauacauaacuuuuauuacaguguacuguuacagcaguucuuaguuauuguuaaugucuuacugggcccaguuuagaaauuaaauuuuaucauagguauguguaggaaaaaacaugguaggggucaguucuaucugaaguuucaggcaucuauuggggcuuuugagugccugguaaaaaggggacugccauaucucauauauuuauuccaauaacugaaugagaugauaggauuauuuucuccauuuccuaaaugaggaaaucaagacuuaggauggcaaaugcuagaagggaucaccguagaguuaacaguuguaacuacuaggcuauauccgauugcucagcaagcucuguuuauugucacucacuuguuauauuuuauauccugguccauuggcuuuagguuagucaacuguuauuuuuuccuuauuuuccuaaaauucauacccauugguuacauuagcuguaaaagucauuuugugcucccuucuuaccuacagucuuaaaaguaaaaauuuucuaaccuguaguucauucucucagcaaaaugauuccaaccugguuuuuugcgccuuuuuaaucacugcuuggacuaaagccuguguucagacuuucccugaaguuagucuggaucagcucugccucagcaccuccacuguuuuugaacuucuguuugcccucuaaaagcuggaugaauuccccagucucugauuauuugacucuuguuuguuuggcacuaccuagcugauaguccacuugucuuacaaaagucuuuuacagugguucucauccuugcuugcagauuagaaucaaaucgggugcugauaaaaaugccaguaucugggcccuuaggagagauucuuauuuaauuggucuggggugaagcaagauauugguuauuuuagcugcuucauugauguguggugcaaagagcaugggcucuggaguuuguuagacccacauuggcagguuuugugaguucuggaaaaguuaaucuuuuuuuuuuguuuuuuuaagccuauuuccucauuugaaaaauagggaugaggccaggcgugguggcucaugccuguaaucccagcacuuuaggaggcugaggcgguuggaucaccugagguuaggaguucgagaccagccuggccaacaugguggaaacccaucucuauuaaaaauagaaaaauuagcugggcaugguggcgggugccuguaauccuagcuacucuggaggcugaggcaguuugcagugagcuaagaucaugccauugcacuccagccugggagacaagagcgaaacuccgucucaaaaaaaaaaaaaauggggaugaaaugacccauuuuauuaaguuauuaggaucacagggggguaaugcccuuuaaaacggcuuagagcauggccuagcauauccuaaauuaaauuaauagcugucauccuacccuguccaacaauguugucuuccuuuuccaaaugcucauauucuuucucacauuugccguauauauaucuguugcccuuuccucauguuugaauucuugucuuucccauuaaaauuuauuuacagguccaaguuccucagugauguuuuauuccauugugugcuuaaauaaaaguguaccuuuuaucuuuugcaauauauuggacaugaaaaacuuccaaagagaaauagagaaacagcaucagaacuucuuugaauagaaaaguaaacugggucaugugggugucacuuuaaaauuccaguggcuuagauuuuuaaaaggcuuuccuuucucucucucucuuuuuuuuuuuuuuuuuuuuuugccacuaaaaucuguuacugagacuacugcagguuuccugcuuauauacuuuuugaacauuaaugucuucguuuucugucuuaacaggcuccugguccuaucuguaccuugaaguuuaauauuuuccuccaagcuucuuauagcuucaggguaacuuucugagugauacagucuaucuccaguaauaaagggcagaucaacaccaguugaaagggauaacugucuuucuauuuuuaauagguacauuuuuauugagcugcauuuuuuuuuuaaagugugaaagagacucucgcccucaaguuucauuguuauucuucugauaugucaguaaucaccuuuggguuguugucauuucaguagcucagggucaauauauauugcuaagucauucauguccuguaaauuucaguaugaaauaagcauuuacugguuccuugccugaauagucugagccuauauaguuuaucucaauauaaauuagaucuuuguugcuuacaucauuuugaugaaauuagguauuaugguuauaauuuuuuuaaaguucuccuugacuuuccugguauguuaaacagcuuuucuauguuacuuuuuaaaaaauagugcacacgaugugggcuuucacagcaauucuucuggaaggugacuuuucuucauuguuaacagagauaaauacucugcauuuaucacaaauguuucaaauguccuuggauagacuuagaagucucucaaguucagcuagcuugagacagaguacaaaauagaauguagcaucagugaagaccagucaggcuguucuugcaguagaucacuaugccaggugaccucauagugaccuucaaguaccgaaaagucugggauucuuacuuauuuuacaaucuauucuuugggaauguaaauucagugaaaaaguugagauacuuuauuuuugagugggacccagugucucuuccucuaucaaaccgaucaacuacuuuucccauuguguguccucuccaguuuugaucuguuauucugcucagacuggagcuggucauaugcuuuggaaauaccuguuuacagauugaugcagaccuggagcagcugcucauugacagaauaggucuagauuucuaugucgugacugauucguacucauacugggaguuuuggguuaacagacgugagacagugaggauugagcuauaguggcuucaauuugaaggggauuguuuccucccuuguuauuuuuguuuucacacuauccuuaaaguaaugcaaaauuugggagauaucugauuaaaaauguuucauuuugccuauauuugacuuguaggugcagcugugauaacuaaaagauccuaaguccuuuuuuguccuccaggacacuaaguuaaauucaucaaaauucucauuuuauaauaugcuuuggucuaugugugggcucuuacuuggcugcugaagaacauugaauugugugaacuuguaugacuuuaucuucauaucuuucuuguucaucuuccuugauaaacacuuuguuuucauuucuugugcuuugaugaacagugcugcugugaacucugggaguggcucccucuacugccucaacccucauugugacaguuguuccuugauauauguacuucucagggaaguacaauaagaaguaaaacuguacauugugggaggggaauaauagguuugucaacucuguuuugccaaggaaaggcauuuaagaccaucugacacauuaucuauuaucacugucauuuccugguuugcuuagaugccccaaaguaggaugcacguaacuucacaagagaaauugaauauauuucacuuuacaaaaaacucauuacauuucuuauuuugccuggaaccaaauaagauuuuucccacaaugucuagugaaguacuuggcauuuaggcccaagucuacuuauuuuucccuacggauauuaaguguuucuuguacaugaucaauuuacugaauucugacauuccacauaaauucugauuaaaaaguuaauuggcagugugauguaaugggaguuacagguugugccccaccucugcaccuaccuaguucagaaacacugagccagccucuggguuucauuuccuucauuugauaaaaaggaaugguugaggauagauggguuucaagaucucuguagcuuaaguuuuauccauaauuguaaaacucugccugcuggguuccacauauuggauguaauugcaucccuaggaugacauuccucaggguacaaauuaugucuuauucaccagucccacugcccccaacacuaccuaguauguguguggcaccauccuuuaccuuccaaagaccaaguauuacauauauguagucauguuuaucuuuagaucucagcuuaaaugucacuuaaucugcagaaggcuuuucuucugaucacugucccaguuuuauucccacagcauccuuuuuuccuucauggcaugaacugcaauucuaaacauuagcuuuauucuuuggcuuguuuaauaugucucucccacuaaguucccuuaguaccugucuuguuuaugcuauagucucugugcccagcauuuuuguuuuuguuuuuugagacggagucuugcucuguggccccaggcuggagugucguggcgcaaucucggcucacagcaagcucugccucccagguucacgccauucuccugucucagccuccucaguagcugggauuacaggcgcccgccaccaugcccggcuaauuuuuuuguauuuuuuuuaguagagacgggguuucaccguguuagccaggauggucucgaucuccugaccucgugauccacgcgccucagccucccaaagugcugggauuacaggugugagccaccgcgcccggccugugcccagcauuuuaaaaaugauugcaacuauguguacuuugcccuuuauuugaaccuaugacaacagagagccuagugcacauggcuuuucucuguucugagccugauuuuuuuuuuucaucugucauccagauacaaucucuccuucucacacuuaccagauugcguccuguguugugguucugcauguguucccuucuuugcuuagacaguaagugggaacuccuuaucugagucaucuugguuauccagcacagugcccugcacauaggauuugcauguuagaaugaaugcagaugucuguccuucaaauguguugauauuugaggcauaucuguuuucuucuguguccuuuuaguggugacuaaagccuuauuugaaagcuccaucuccaagaauuccugaugccuuuauucaauaaugaaccucguuguuuucagguuagugcauggccacuuuguaguugugcagaauuguaccaguuuuucaugcucucugaaguuacauguuuuucuucaguuuaacuuucgguuuuccuuggaguuacuccauuuaaguggcuucagacugugagcugagugagaucuugcugucuuccagucuuggcaccuugaauauuuacuuuuguuuacaagcuaguuucucuuuggcuguuuuuaauuuggaggacuaaaguguaacaaaugagguaaggauaauucugcuuauuaaugucuuaucuggaaguaugaugacuucacgccuccggagaguagaguuuggcuaccuuucacagguauuggaguaaauuccagguaugcuuauugcccuuuugagauaagaguuuguuggaugcauagaaaaugaagugggcucucacucuagccaaauaguuaccaguuaguaucuugggauaucugcagacucagcugagcucucaaaugggagaggggaugaaggcacaaugagcaacugagaugggaagcugggauuggaaagagaagaggcuaucaaagaaauuugucuuccuuccugguuucacuucagcucacuucuugugccccggggucuccauccuuagcuaugcuuccacaucgggcccaagucuguuuaccaaaccuugguggucaagcaggcugguaaauaguuuauuaauaaauucagguagaaucgccucauuggcagaauauaccaagaaguauuugagcauauaaagugguuuucuugguaugggauggaacguacgcuaauugucuucaggcuaaaucuuaguucaugguugcagcucuuuaaaauggcuuaagcucuugcaugguuuuuuguuuugguuugguuucuuuucguuuguuuguuuguuuuuuggagacagucuugcucugucacccagucuggagugugguggcaggaucuuggcucauugcaaccucugccucccagauucaagugauucuccugccucagccuccugaguagcugggauuacaggugugcacuaccacacgccuguaauuuuuuuuuuuguauuuuuaauuuuuuguauuuuuaauuuuuguauuuuuaguagagcugggguuucaccauguuggccaggcuggucuugcauguuuuugagaaugcuaagacucugcguuaagcacuaugcuagccucugagcaaaugcuuacgauguacuuugauuuugaauuuuucaggaauagcuauagcgugugauucuuaaauugccaacuaaaacaucaccgucugcuguucaguaauaaaaguguuuugacuugguuaucugcuuggacauuuuuauguuaaagaaacuucuuggucgggcaugguggcucacgccuguaauucuagcacuuugagaggcugaggugggaggauccuuugaaccuaggaguuugagaccagccugagcaacauggcaaaaccucgucuccacaaaagauuuuaaaaaauuagccaggcgcgguggcucacgccuguaaucccagcacuuugggaggccgaggcgggcggcucacgaggucaggagaucgagaccauccugacuaacacgcugaaaccccgucucuacuaaaaauacaaaaaauuagccgggcgugguggcgguugccggcuacucaggaggcugaggcaggagaauggugugaacccgggaggcagaguuugcggugagcagagaaucccgccacugcacuccagccuggguugcagagcaagacuccaucucaaaaaacaaacaaaaaaagauuuaaaaaauuagcgggguguggugguguguaccuguggucccagcuacucaagaggcugagguaggaggaucccuugagcccaggaggcugcagugagcugugaucacaccacuguacuccagccugguuggugacagaauuagaaccuaucuucaaaaaaaaaaaaaaaaggaaagaaaaaaaagaaacuuuucuuaaauaugcuauucugcuguauguuuugguggcuuaaauauuugguacuuggaacguaguauauuguagaauuccugaucuguuuggugaaaacaugaccuuuugagggaaagaagaaagcaaagccuggaguguguguguuuauguguaucuuugaccauuaauuugaauuucucagguugcagugauaauggcaguuugaccuuaccauaaauuaaagauguguuuuuaggagagcaugaaagcagaaaacaauucucaagaagguuagugccuugagaacaauacccuacuuuguauagugccugaaauuuuuuauaagccauucuuuuaucuguaauuuguuauaacuuauuucuuuuaauaacccuguucgcuagcagagugagaaaaaucuguucuuaauagaugagggaaguuaugaacauaacaaacuuguugagggucacagaaucauuaagaaauagauuuaggaccagcagugauugucuuuggacuuuauguaggcuuuuaccuucguucuagucuuuuuuuccauaucccuguuaguuuguuagccugggacuugggaaugagauaauugcuucucugaggccacuccuaacccugacuguuuuaugugaaagcuuaaauuugcuccaaauuuccugaaugcuacauaguguugugacuugcccuuuuuuggccuuaauuuaccuggccaugucuuaacucuccugaagagcugaacuaaaaucuucauuuugguauaaauggaugccuuagguucugauguuuuaguuauggaaaauagugcuuauguuuugggugcugcuguguguuacacaugaucauuugauuugaguuuagaccaaauacucuuauuucuuuaaccuugaccauuaaugaagaauauaagaagaauguugguauaagccaacauaguuauggaugugagcuaagagguguguuuaaguuuuacgaaggucacaggaaauugaccacaaauuuucuaagaaaauaauuauaaaaagacucauaggauucaauauuauaaacuuucaacaaauugaaaauaugcuuaaaaagccauuuuccaaguuuauuaaguuggaaauuuaucuuaagaguuaauaacaauugaauguccagggggaacccuaaacacuuuuuaguguuuauauuugaauaaaugugagagcuucacauucuguuuagaaaauucucuguuguuagacugcuuucuuauuuuugaaucucaugcaugagauuaggaaacaaguguaaaaugauuauuauaauuuacuauuaauaccaacuguugaucuguucucaguucaaaauguuuuauaauacaguccuggaaaagagaaucaaccuaaguuaugugugagguuuuguagaauagaugauauucucugcagauuuaggaacccauacuuuacuuugcaauagagauuggacuuggaaguucaugaaguuuuuuuuuuuuuuuuuuuuuuuuuuuuuuuuuuuuuuuuuuuuuuuuuuuuuuuaaggaacacuaucaccgauucuggggaaaaaaaagaaaaagccaauagcauuaacauaauacucugcaaccuuaaagguuugcaguugauaaggaauaauuuaaugugcccuauaaaacccacaguuuuggaauugcuccagcuuuuuauuuuuagcuguggcuuuuaguuaaugagaagaggugaaaaguauaguuucuccuggucucugcuugaaaucacagaaacuuuccgcgcugugaaaguucaggggauuuugggagaccauccuuaugaauuggaugguggugucuccuccucuuuguucaggccucuuuuucuagagaauagcaaagaauggugaguugauuaccuucagauuuuaaccaaacuguaauugcucugauauugucaaaugcaccuagggacaguguugcaguauuuugaaaccuuacacaggaaacaaaauagcagcuuuggaggcagggaagaaugcauuaguuucugagucuaaggaagccagaaggaagcccgcccacccacucucuagcuuucauauucccucagccaccucccagaucuuccauugcugugcuauaaauagccaguguuuaggcagggcguugcuuucuucccuugccuuugaagacuuucugcaggcccuggaauugccuuuguuccucugucugcccacuuugccagugugaagcagguuuucaugggauucuacugggguaaaccaaaagcagcagaaaaagugugaaguaagaccucuuauuuacccuucaguuccuuccccacuuaccuccuguuuuaccuccaaaauacaauuugugguuugucaugagacaguuuuuagagcguuaaccuggaaauuuaauguuaauucaagggcuucugguguagugccaggugauuuuuaucuuuuuugugugcugcccuacucacugccucauccuggggauaaagcacuucauuggccccuccucuucuuucucauagcaaaauauuugauuagguuugaauuaacugucucaaacucagcccccagaagggacaggauauaccuaauucuuuguggacaggaugacuuucuaauccaaauccauaguaguauaaacaggccaaaaugaguuauuuagagugcuuugaaugucuguggcagucauauuaggauguuuagugacacagacuugaugcuuuuuugccucauuuuuuguuaugcauauucauuagaauauuuucacagaugauuaggucuacaauuaaagauccucaguuuagaugaccuuggaaaacccccucccucccccaguacucugacauucugaaccucuccaucaugguagaaaagcauauacucuuuagcacauuugacauuuaggcuaugauacucuuuuacuuaaaauccagcccuugcaggggccggaacauuaaggcuguauugggagagcuggaaagaaggcaccccauuuauagggcaaccugcuggcuaguagcucugggaauauggacucuugccaaacuuuauuuauuaagcgaaaucagaaauauaguuuuaugaaugugaaauuguuacauuggugaaauuuuaaauguugaacacuacuguuuuuguuuguguuuuguuuuguuuuuaaggacguuggagaaaccacguaacauguuuucaggcuaaaucuacccgcuagcugccaguccgaacuuuggccuggagguugaggagaguuacagaaucugcuuguuuuugucuaucccuugccacuuuuccuuuguccuucuuuucaaccucgcacgugauuuauuuaagcagaguccauuguuggcuuuuuauuuuuuguuuuugcaagcuggcccucggauucugccauuuauuugaaugcuuaauacuuuaaguagacuuuugacucccauccccucaauguuuucuuccugcuggucauagccacucugggggguuuuguucaccaugcccuuagguauaugauguacuuuguaucaggaagaauguucagaguaggccaccuggcugcugcuguuuauguuggccauguuuauuagaauaggucuuaguuaauguguagucaaccuugguggauaaaaaagauucacuuguuuccauuuugguuauuuguaauguaggaggccagcugucuuuauucuuggcaaguaaaaguaugggucauuuuccaguuagagcaagaaguuacuuaagagaacuaacugcugucuugguagccagcgaugcagagcaguuguucuuccuuaauugauggcaggcaaauuuggucuaauuacuguuccagugcaguggaaguuuucuucaguuuuaauuuaccguucuugcuucuaccucaugauaccccccguuucccacuuuugcucuuuagaaauggagaauaaagaauaguguccugaugacucaacucaauuccaaggccugcagucuccagaucuuuguugugaauccuggguuuuagccugacaaaggauggauguaaaaagcaugcuuggguggggcagaaggguauagaaagggcacguuucuaaaccaucuauuucccuuauagugauucucaacuagagacuggcacucagaaucgucaaggaacucuuuaaaauagucuaagauagagcgauagaguggcauuugaguagaucuacacucuucacagaagaauugaaaaauuuggguucagggucaugguucccuuuagaagagugguuuaaggaucuuuuuguucauacccaucucagauuaaaguaguggaugauagcgagaauuucuuuuuagcucgaucugaaagagauugcaguccuaacugcuguagacuauauugccugguacuuaguagguacuuccugaaaguuuuaucaacaguuaaagacuauuuacugcuaagcaauuuacauguuaaaucuacucuacugagaguucuuuuaaagaaacuuguacuuuacauaggaugaaguuguaacaggaaauggguaccuggaaaacucucugagcaauucuaaaucaggaaaacuucagccugcucuucuuuauaauuuaaaauuuucuuagugaggcagaaguccacuuuaauguucaguaucaaugcugugcacagucuccuguuguuuagcacuuuaaacacugggaagcaaaaugccucauuucuucucaaauacguguccacacucaaauauugaaguuagaagugguaguuuccauagcagcagugauuuugccaucuuuuuuuuuuuuuuuuuuuuuuugauagcaaacuauuuagcauaggucagguagagaagggauuauuucuggcugcggguucuuaaagguuuccuugugugcguuugacuucuuuggacaccuucuuaggacacagguguguuuuggagaaguuccgugagggguggaaugagugggguuuuguacaucuuuguuuucccagcaucugagcacagcgcuugguacaugcaguagaucaggaauguugcuuuucuagccuuggggaguuucuuuacuccucuuuuugguauucuacacaccagaccuuggcuguguuggggagagaguauaaacuucagguuuccucuugauuuuacacauuggugaugagauuggcuuauuuugaacugugagauggugacaauggaacacaccugucccugguuccucccugagguuuauauuguuuuaacaaaggcuuguagcuaggaauuaaaaaaugcugauuccacuugaaguuugagcuuacaauauggaauuaguagcuauaugcggaaagagauguguguguuagugguaggacuugacagccuacuuuccccuuuuuccccuugacagucuaccuuccucuuuauaaacaaccugagaugacuuuggcugcuccuccagcuauacaggguugcaauggaaauuuuucccacuuggcagggaacauaaaaccacauggauaaguaaggggguuguuuuuuacuugccaccuugaaucacaauucauggcauucauucucuuuauggaucugucuugauauuuuuuacuggggagauaaaggugagucaggcauauaggagcacacagaguuaucugguccaacugagugguucacagaaggcuuccucgagguuugucugcucucuuccggugcugaggauguuuccaugaggcaggagaagaaagguaggcuguugcagguggagaaaacagguugggugacacuggaaaacacugggagugggaagaacuacugggagcuuguuagagcuuguguauaugaugcgggggugcugggcauguggaugaagagguaggagcucggucaagucagcugccucacuagggagcugagauguuacuucauaggcaacguggagugagcagagcuuuaaaagagauaguaguggagugcugcccauuauuuuaguuagauccccacagccguggaauggaggaaggauuggagaaaggggcaagccuggaaauagagagaucagcuaggaagcucuagauggggucucagcacugauuucaaaucccaguuucucacuuaauacuugugugaacucuugaaguuuugaaauucucauuuguaaauugaagagaauguaauauagcuuauagugcauaagauuuguuuuggagacauggucuugcucugccacccaagcuggagugcagugguguccuccagccuuccaaaguguuggaauuacaagcgugagucaccuugcccgcuccacaagaggauuaaauaagauuuuguuuguaaauaucuagcuugagacuggcauggaaagaggaaucaauaauugcuaguuucuuucccuugccauuuauuuuuacuuuuaguuguaggauucguuggauucuccagaaggcagggagaucaucugaacuucuuuacuguagcaaaagauacucaaaucccacggaaaguuccuuuucuauuuuucuuguaauuaaaugugauuuuaaagccacaguuuaaauucaggucauuuuugaagaucaugauaggagaaagaugauaggagaguguaugauuuuguaugaauguagauacauggaucauuugccugauccauuaauuguggaaacuugaucccaugugaucucauaauguacacauuauuaaucuagauucuaggguauaaucguggauuagauuucuacacucuuguuuucucuguauuguaaaucugaauauaaguacaagaugccuggaucaucuuuggaguucuuagccagaauaaggagguagcaauuucuaaucuuauuaaaauuccaagagccugagcauaagcaggcucaaagaggaugggagauguguauuuuuauggggaguuggggaggggggugggggucacacacuuuuaaaaauaagguaaauuaaaauaggcaaggcuguaauucuaaugugaaguacuugggcuguuaguacucuguauauuuaaacauagucuuuggaggucugggguuaaaaauugcagcauugcaaguaaaaauuuuuaacuuccuuagucaccguuugugacugugcuaaauguaguuuaacauagcaucugcuucagcaguccaggacaggaauuaacagucaugauuaggaaaagucugcauacuguacuuucuguccacagucuuuccuuuccauguuaaaaggcucccaacacgacucugcagccuugcuguccauuuagauguggggggaagaaaaacugacaggcuuaauccaaaagacagauaagcaaauuuucuuucuuucuuucuuucuuuuuuuuuuuuuuuuuuuuuuuuugagauggagucucucgcacuuuugcccaggcuuggggugcaguggugcgaucuagacucacugcaagcucugccuccuggguucaugccauuguccugccucagccucccguguagcugggacuacaggcgcccgccaccaaguccggcuaauuuuuuguauuuuuaauagagaugggguuucaccguguuagccaggguggucucgauauccugaccucgugaucugcccgccucggccucccaaagugcagggauuagaagugugagccacugcgccaggcccagauaagcaaauuuucuaugcuaacauuuuaagagacaucuuguuuuguccagcaauaaugauaauacccucuguucacuuggcaccuuagaguuuguaaagugcuuugacauuaucagacaaaauauguauauguaauuaaagcuuuuaaagagaacagaccccuuuaccugcucuuuuccuuccuagaguggaaauaauucaaaggcuaaugcuuuugugauuugagucuuaagaauaauuuccuguuaaaauguagccuguaauugcguaugugcucccuucuccucuucagccugugggggauagauguuucucaucaacacuugggaauauguguguauaauguauauacagguuauacauauacauauaugcucauacacuugcuucauuuuucaucuguaacauggggguacuugccccaccuacuuuuugagauccuuaagcguucguuucaaaugugcuuuacuugaaugauacuaagacaacuugcaaagcgggaagucugacaaaaguaggaguaagaggaagcucuaugcugggugagauggugaggucaucaaucuaagcauauugaccccuuucucuguuaggggguuguucgaaauuggguguaugugccugauguggauauaaguggauaaggucugaggcuaagaagggccuuaccuguucuauagugucuagcauuaacuuuuuugaaaaacauuauuaacucuuauauacauucuuauguagcagauuaacaagacauuuccuugagauacuucucgcccuuagcaacccuuuccucacuuuggaaucacugaauaaaaauaacacuugcauugaauguaaauucucccccucccccacuuuuuuuucuugaaauguaguaaauaaccaggaacuuaauuaccauaaaaagucacagauguaccuagguguguuuuguucuagcugggaugucgguuuuuaaagaaagcugucuuugggggagcaagaggcagagguggaccaaaggaaauaaaguuacuaucuuagggugugaaucuuguuuuuuuaagaugccucaaauuuccauaguaaauaaaacauaguugugucucuaaaucacaaguauacaugucuugggaaucucaggacguuacacaucaacagaaaagaaaaacacauuucauaggugaauaccaguaauugagaugauccacaguucagagcagaaggaagcugucuguauugaucaagguuuuuagacuccuuguuuugcucuccacaauacaucaaugaauucuaagauauuuaugugcccugggauggcaucccuuuauuuguagccuccuaauguuacuaaggaaauaaaucuuguugguugacauuuuagaugccuuuuuuuuuuuuuuuuuuuuuuugguguaagcugcuugagguuaaacaguguagcauuugguuuucuaucucuaaguccugcuaaauaacagugaaaaauaaaauguuaaccucacuggccaggaggaguguuguggccuuuauaacauuugugaguuaaaaaacauuauuuuuguccauaaaccuuccuugucuuuuauuuucccuuuaagauuagucauucuuucugcuuuggaguuuguacaugacagaguauuuuagugucuguauccaacagaggagcuauguuuuuaaccuaccuaaugaaaacacucaacuacugggauuaauuugaggauuuccaaucagccuuucacaauuuguacuacccugaggggguuccugauagcugugacuuuuguagaagaaugugaaguuaauccaauuucuguguugauuacuauguuaacugucuuaauuuagcaauucagauuaaucugccuauaccaaacaaaaccucugccacaaaacugagggaguaguugauuuuauucuuguuguacucauaucccuuuuuagauucuauugccaaauaauggcauggaaauuaauuggguccacuuagguuggaaugaaagaaugggguuggaaugauucaucaccagaagguaaugauuuaguguauuccagccuauaaccaagacagaguuaucucauggcuuaaccuuuacuauuguagagguauauaaaugacccuguugaaaaauacagauuuuaaaguuuacucccauuuuacaaaaugugacuuaaucuaaucuucauccacuuuguuuuuaaacuuuuggggagagcuuugagcuauuuuacuuugaauucugaaaguuuuaagggggcucacauagauuacaaaucaauuuucugauauacuauguuuaguaguaguugcauguuuuaagcuacugauuugugauuuuauauuugcuccuaaaugaaucaguugauucuuuaagaagcuggcaguggauucauuuaguagcaaauauaaagugaauagugaauauccaaccauaaagugaauaacucuggauuuaauauuuauaaagucaaaauuuuuguauguuggguuuccuauauauaucuauauauagauuuauauauauauccuuauuuucuuuuaaggcacaacuguccauaaaaucucuuccuuugcuuauucaucuuguguucuuaguguccagagcauaguaaauguuuuggugguuuguaggaaugugagcaguuaguaucuaaaccaguuuuuugacaauggauuucaacaguguacugauguaauuaaaauguagcaccuuaauaauguguuuucuucuggguauauccagaaucugaugacuucuccccaacuucacccuggugggagucacugucauccugcaccugaauugcugcaguugcuucuugacuggucuguuuccaaacucacugagucuuccugcacacccacacacaauuuauuuucacaguagccacaugcuacucuuuugcugaaaaccuuuuauaguuuccuuuuuuguuaugguggccuucaaggcccuauguguuccggccucauuaccucuuagacucaucuccuccuacucucccuguuaucuccuugucauucugcacagcagacaagcuuugcacuggcaggucucugccuagaaucuuuucuucuagauaucuccaugggggcugucuuuacuuccuguuagaccucuaacaaauuacuuuaaauuuacuggcuuaaaacaauacaagauuuauugucuuaaaauuccgaagaacaucagaaguccaaagugguucucagugggcuaagauuaaaguguuggcagggcugcauuccucccagagucuuuaugagagauuguuuccuugccuuuugcagcuccuagaggcugcuuauauuccuuggcugguggccccauuuaaagccagcaauguccuuucgauuucuucucaugcuucaucacccugacagucucaccuuccucuuucacuuauaaggaaccuuguaauuaccuuaggcccaccucaguaaccaaggauaaucucccuuucucaaggugagcugauuagcagcuuuaauucuacaaucuuaauucccccuugucauguaacauaacauauucacacuucugggaguaggauguagacauugaggggaaggggauuuuucuuccuaucacagcagccagcccauaucuccuucaaaccuugguucaaagcucaccuuuucauugaggccugcuuguuuaaugcuggaaacuacccgucuucaucuccacauuuucaaccccccuuauucuucucuauauguauuccacagcacucuuacuuauugcugauguacuguuuucuucuauguguucauacuuguauauguucugcacacaccauccacagcaaaucagcacuccaagaugcuucuucauugcuguaccucaggacucuccugaauucgugggagcugcauggagauguucguugaauggaugaaugaacaaaacaugaaacuuaagcagaucuuuuucgccagaucuuuacuuucccauugcucaaacuggauaccuguaauggacuuagacugaagagaaggacuugggacccuaaacucauuaucuuaccucucuaaccucaaagcuuuugaaccugccagcucugaaacuacaaaaccucagaaagacuggcaugaaggagacuguguacuuuguccguagaagucauaaagggccaagagacagaaaaacguuaguguuugcugccaaagaacauucuccuuaugacgcgugcagcuguucagugcauugucucugcaaguucuugggccguuguuagccccaaggcugaaaauguggguuugaggaauucguagagcuagugagacagcuaacaugguaugugggugggcuggagaauugacaaggauucuagauugaauaaauccuuugacauuuaaagcuacaaaccuuuauuuuaggaaucacaaagcaaagagaguuaaagaaaacaaacuaauggcuuguuccuguaacugacauuguuagccuugugauuuuagcacuugguugacuauucucuugcuuaauuaagugaaaccacaaacauauccugaaaauaccacuuagugauuugaaugggaaagauaaagcauuugcuauaggaauggugugugucgggcagaugaucccuuugacugccuacccagcugucaucuauaagcucauaugacuuauuucaccaauuuuggagugcuuuugucccugcugcaaguuccccaaaggauggugugguaaagguugugaugccugguuuuguuuuuuguuuguuuguuuguguuuuguauguuuggcucuaaaacuuuagagacaaaugucuucuguucaucuguaacuuggcauuuagggagagguuugauguggucagaaggaaggccuuuguacugggcugauucuguccuggugugcuguguuugaauacucaggguauucaaagcuucuaguugcaaauaaguguagagaccaaguucacucuguuuaggcuggaccuuuccagccugagagauaagcuugucuuugccucuagccaugauucuuuuaagagauguuaucguuucuguuugccuaaacuuuucuaguuaguaugaagaucacuggugauccacgacuuaaucaugaugugcuucuaaaugccuucuucaagaucuguuuaauuuuccugcauuuaccuuugauuuugccauuuuccugaaguuggacccaaauuccacaugcccauauccauaacccugcuggccagaggcuuggauuugucuugucuuccaggguuuuguaguuagugugauagauuguugaaauaaaaauacacaacuuuucacaaagguagaugguuuccuuuuaccauauaauaggaauuuagauuucagugggugaggguggcugauggagugcgucaaaacuugaaaauaugcuuucauaauuacuucugguuugaaauacuuggugggauagaaaaacaaguuagagccacucaugauuauuuguguuuccaauuuauaguuuaaauguauuuguaaaaaguaaaaaaaaaaaaaaaaguuaccuaguuuguacacauuuagggagggauuugcucuuucagucuccaauuuuuaagaaacuguucuugcccuuugcuuuuucaaugcuuaguuuguacaaaccccugaaauggagaugggguggguuuggauggagccuugaauaagggagaugggacugcauaaacaaagcuagaagagugaagguacuggacuguuugagggacaaggaguaguucagaucuuaaggugcuugaauaagugggcugauaaaaguaguuguacaggauuucuguugauaccuaguaguuuacacuucauuugauaggcagcagggagcugugggaggguuuagaaagucuaccugggaacauuguuaagguagauuaggaugaggagagagggaccuuuuggaggcuuuaauuugcugguccugaagaagaugagagcccaggucaggauguugaccauggcaauggaguggcuggagcaacaggcgcagccucaccaggggucauuguauuggcccuuucagcagcccugcuaugacuuuaacccgcagaagucuggucccuaaaucaggugguuucuaggcuauggaaccuuuuucccuccucgcaacauuauacugagugaacuuaauaacaacucucagaauauaguuaggauauauuuauuuacuuauuuuggagacagagucucucacugucacccaggauggagugaaguggugugaucucugcugacugcaaccucccccuccuggguucaagccauucuccugccucagcguccugaguagcugggacuacagaccacgcccagcuaauauuuuguauuuuuaguagaggugggguuucaccauguugcccaggcuggucuugaacuucugaccucaagugguccaccuaccucagccucccaaagugcugggauuacagacgugagccgccgagucuggccuauuuaagaugcuuuugauuaacuaccugguuuaguggcugucugcaagagguuugaaaauagugaagaagcugauuaccuuaguuugcagaauuuuuuaauuguaagauuagaaaauauagacugcuuuucucucaugugaccaggaaacuauuggaucaguuugacuucucaaauucuuaacucuucccagauaugagauauaaagcauuuauuuucuaaauuccacuauugugaaaacaguagauguuaaaauucauaaaggauuauuuaaauaaaaaguuuagaagucuuuauggcuuuuuggaaguaccuguguguauaaaaguagagacaaucuucuauuucccaauaaaaccuacgcuuucaccauaguaacagccauuuuaccuuggagcccagugaaaguuuagaauauucuagauucaucuaugcuaaagugccuuuucguaaauuauuacuuggauaauaacaggaggaaaagcagucugaauuggcacaagugaugucuaaauuaagaggagaauauauauugaaacauuauuuuuuuaagccuuaaaauuaauggcucuguuucacuggaauauggccuuuuuuuucuuuccgaagaguuucagagccaguggaaucuauaaauaguacacagcccaguugucugugguagauugaguagagcagaauugccuguccuuaagugaaggggaaguagcuuuacauuuuuaguaacugaauuguuggccagcauaaagguaagggccaugugagcaacuuauuuauaacuucccauaaagguaugugucugccucaagcggagaagacugucuggggugcuugaaauguaaaagugcaguagaaucauuuuccauacacagccuuccuaucuaguuggugcaauaaagugauuguucaccucccuggggcuuucagaaagaggggugucaauagauuagcucauuaguguccaccuccuaugaaauagaagggacugaggcaguuaaauuaaaaucuguuuuauguagugagcaauguuuagauugaacuccugaagguauucaggacauacauuuaugccugcuuuacccugcugggugugguccugcucauguagucuuaacuacaguuggguucuuaugaaaaaucuuucauggguguaaagcacuuuuucacagguucaguuaaacuauaaguaguuuuuugaaaaauaacauagggucagaccaaaaucucuuguuacagugggagaacggaagaagaguaaaauauuuucauggcuuccuguaaaaaaguauguuaauccuuuuugauagaugccagaaaguggaauccaucguuacuggcggcauugcuaauaucaagaguaaaucacagccaggauugccucucaggauaaaauuuuuauaauuaucaauaaguaaaagacauuuuuggaccucuucuguuauucacugucuauuuuuagaaacuaaguuuucugauuauauugaccauuugaagcaucugcauauauggcaaaaaaaguaaacuuuggcuuuugugccaauaucauggcucuguuugguauuugggcaaguuucaauaagugguaaauggcccauuaacuauauuggaggccucauagcagcacuaauuucaaaucgugcuggguuuacaauuuacauauuaaaaaauguucacuugauuucguucagggacaaagcugacauccuaugcgagcauuacuccaaacaauccuauuuaucgguccaauuauuucaauugaaagaugcugguuuacugccucuuaguauaugugagcaauucucauugaaacuguuagaaaccguuugacuguaguggcaaaauaaccucacaggguuucgauucacuuuuaauuuuaagucccaggauuaaggaucauuuauaguauaauguaacagugugggcaaauauagcuucucuuaaugucuuucugauauuuuggggaaagagugcuuuuaugcaaaccaaucacuuaggaauugcaugaugacuuuuucccacuauaaaauuucauucacauuuccucccuucucccacauccuuaagagauaagacagccugcaguauuuugcuuuauuuuacuuuauuuuuuaaauuuuugaggugugguuuacauuaguucuucagaauagaugccaagauaacuaguuaauacuguuuuaaaaucaggcucuuaauuaaaaaugcuuauauuugugcaagaaaacuacauguugaaaugaauuuggaaagauuagauuggaauugccucaauuucaauuaagccacacugcauggacgugcugggaauaucaauacaaucacuguaaauuuuguacaaacugauuuguugcauuaucuugcucaucuaacauacgguacuuuuuguguccauauugcagacggcaacuccaaacuaacauggcagucagacugugugauguggcuucucugcuuagaagugguucgugggcagcagagccuuggaccggggucugugggauuuuucuuaaauucuguaggcuacuuuuuuuuagcauguuggaggagugcugaggccauaccaaacacuugaaucuuucauuuggcauacuaauuauucuuacauuuaaccuauugugguauggccaucauuaggacuuaaagcacauugcaauuuuaacuguagugguguauguagcaucagaaccaugcucucguauguaauuuuuuuacaaucuaaauuaggauuuagcgcagacucaaaagagugacaagcuuuuuuaaaaaaacaaaaaaaguuuugguauggucugaauacuaaguuaccguaauucuauacauucuguuuacuauguauuuuuuugguuacuaaauuuugaaguuauuuacaauucuuuaugcuccaaaaaaaaaguugaaauuguaaaucuggcugaaaauuauuugcccaguaacuguugaaagaguuugcauucugugaacaguuguguugagccuaucaauggaauaugcauuauuuguaaaauauagcacauuaguaucauuuuauucugagcagaugguccuauagcagagagaugcuguaauuuucagcgcacacagccuacugcagcuguucacuugaauguuggcuuaggagcucauucuugccaccugaacauggaaauaaaugugcaauuaagugaggaguguuuguuguccuuucuaaaucuugcugauuucagucaaugaacacuuuguauuucaaaugcuaucccaaugagcuuuaguccgaaucucccauucgggucucuuguaguuucuacacccauccaaacuuuucaguagugauuuaagugucuuuggccacuuuaaucuuguagcucauuguuuccauaacugcugggcaaggguuaaccccagaagaauuuuugcugugaaaagagugacccacagcuaauauucuacaaaccagaacaguuauguuuaauuaggaaaucugaaacuucccuuuucaaauucaaauagauuugcuaauuauaauaaaacccauaucuugaauuauuuaagauuuuuaaauacagauuuccaaagguuuauuuuccuucaucccuuuaaguauucccugagaaaacuuagcuuacguagagaaacagcuugcagcuuguagaauaaauucccacuucuuugacaaggaaaugaagucacagagggguuacagguuguuggauauuucaaaagcuauucuggauuuugccucauguuuuuuuaucaugacagcacugauucuuguucagucugaccagucucaauauguccaacacugccuucuuuuguaaacaucuccuggcaguagagauuucuuccuauauguuuaucugcuaaugugcccuuuuauuuuucuuaggcaauauguguuuuaaaagacaguuuuuucucuuuccuuguaacccucuuucccuuuacuuugcuuuuuuucuuugccucaaguucuuugccuuuucuauguuaaagcuucccuaaaacuagcaucccgucaauucagaauugucaguuuugagaagcaguucuuuguggaggugagagauguaugcaauaugaaggauaauccuuucagugaugcguugauuuuuagauuccaccacagucuuggcuguccaaagauagguaguuaguggaaaaugauuuuggaaaauuuggggcugugguuugugacucuuuugcauaggauugguuuuaggaaacuagauuuaauacugcuuaauaagugauuuguagaguagccugaacaguuugaggccauuuuccccaauucuguucuuuaucugguguuuggaguuuauagauacccuauuacuugcauuuucaacaggcuuaugugcucagacgagaauuccuugggcuggucuguuugcaaaaguugauauauuuacauuguuguuuucauugacuggauagguuuucuuuuuucucauuaaaaagcagagucaaggagaaacaccauaucgaaguguuuggggauuuuauuuugauguuguagaucagucaccuuguugguaauuuuuagcugccaagguugacaggaguguccuauuagauucuaccaguuagacaaaguauucauagcucauucccaaguuaccuuacaguuaguuccuuuccacucccuaaaauauagcaucuguuuuuuucuuaccaaugguagagauaagauauuguccaucaaaaacguuuucaauauguaaccaaaacaguacauguugacaaauuuauauuuuuaaaaguacucuugcucuuugauuuuuaaguuaauggcuaucugucaguuuuagaauauugaaccucuuaggauaacugaaaaucucuucagaguuagguaggucauuuuuuuguucauuuuuguagcauguuaagcacuuuuauuuucuaguaugauuuuuaguuaggguucaauucugugcccuuugguacuugauuuucucaucuguggacacugcaggugaguaaggauaugugaauagacccagaaugugauucuagaaaauguuuaagauuuaaauugugcuuauaugcauguauggaauauguaugugaaaauauaguuguaaccuuaagaugaauagguuaauaugaagugaaaauuaguguagguauuacacuuuuuguugaagcauuguuguaauuucauuagaacgacuuguguuuagugacaaguguuuaaauucuuggauggagucucuaauagguugugaaauaugaauucugacauuucuuguuuucucuguuuuuagcagguaauugcugccauggaaacacaacugucuaaugggccaacuugcaauaacacagccaaugguccaaccaccauaaacaacaacuguucgucaccaguugacucugggaacacagaagacagcaagaccaacuuaauagucaacuaccuuccucagaacaugacacaggaggaacuaaagagucucuuugggagcauuggugaaauagaguccuguaagcuuguaagagacaaaauaacagguaagcaguuuuauguagaugauuuauauuuaacggaucgugucucaagauaggagaaaauaauaagauuacugcuuguaaauaauucacugcugcaauuuuacauaucuagauuuucucucuguuauuacaucagcaauaugaaacuuaguuuaaaauuuucuuuuuaaaucauaaacuauuuugggggcaguauauauuuuaacuggacuuuaauguacucugaucuggacaggaucuuuggaaaaucuucuaaaaguauauguaucugggauagccagugucauguuaacuuuuaucuuuuaguacccugaguguauuuaaguuagcauuucaacagugagauacaauauguguuugggagaggggaaaaaaucuuaaaauguguuuuccuuauguuaauauaaucauuuugcuuauauaugauaaaauaaaugguaauguucacauugucaguguauaaacauuuucacugauauaauaccaagcgugaugagaucuuauguuccguuccuuaacaaggaaaggacaugguauaugauuguccuucuuguuauaaagauaaagccuuaauuauaguacauuuugaauauuaggugaaaaucuccuuaguauuuuuuaagauuugacuaaauuuuuagaguaaaccaaaaccuaauuuaaagagcacguucuugggauagaaggguuaaugcuuccugcaggaguuguuuucaaacacuaaaaauacaugaaguuagacauacauaugaaguuaaacacuaaaaauauacgaagguagacagacucuguggacuuuucauguuaauuaaauuugauugauaguguauaccaaauugcuuuacaaagcuuauaaccaaaaauauaaaauggaauauuugaaaugaguaaaagauacuuaaaggcagugugaagaaugagaccaggagucugaacucucaccuagucaugugacauuggauaagucagcccuagacuucugguuuccauuggcaaaauaagguaaaaggcagagaaaaaggggguaacacugggccauuucuaaguucacuuuugacuuuuucauacaugggacuuugagcuauuccguuaaucguuagggcucauucucuccaagaucugcaagugaguucuagagccagccccuggacuuggcucauaaucauauuuccucaagcuacagauugagauucacagagacaacuuacugaaaucaaguuaaaaagcuaaguacaaacugauugucauugauccauagcaaacggccauuauauuuuaauuauguugcuuaaauguucacuaugauauuaggaaggugguucuuauguuucugaacacugauaaucagauggaugagauuuuucaauuucuuuuccaaaaugagugugauaagcauaugugaaauuuauaguguuuuuaauaaguugaaaaaggugaagaacaaaaggcugcucuuacgucucugucgugauguuuuuaaacaucuuuuuaacauguuuuaaacauguuaucuuuuguuuuuaaaguaaaacaacaccccugacauguggauuuugcaaccuuuuuaauauaaaagauaaaaauaugauaaaugacuugagggcuaugacacaaaugaugcaauuucugauugcuuaguagagcuccccuuacuauuaaaaagaaagaugcaugaacagagcacaaaagucauguuuuguuaugaaacuguuacgaaaugauacauuuuaucauuuuauaagaugaaaauauuagacaaaucauacaucuuucauauuaggcaucugccacaggagacaucuuacagauccucacgucucaccucuagucaaucuugaauuaaucuuacucuuuugugaaucuuuagagcuguuauguggcaaaaugggauaaauuugaguucuuuaucuucaccuccuuugccucucuaacuuuagugugguagacggugguaauagaagcacaacacauggguauucuuuaauacauaccuagauacuaaaaaacuguguaaauauuucucauccauuuccuucaccucugaccccugccuguugucuuuucaguggcuugaggggaaggauguaauggagauuuccacugugguaaaauuucuauuaaaaauauuugguaagcaaguagaguccccaagaaauuccacaauggucaugaguauugaaagauguuucuaaagauguaagacguuucuauacauuauauauauauauauauauauauauauauauauauaauacuauauaugauguauacacauauauauuacguguacacuacuauauauaguauauauuuguauauaguuaacacauaauugaacaaauuuguggaguacagugagauguuuugaugcuauauacauuguguaaugaucaagcaggguauuauagcauuuccaaaucucaaacauucauaauuucuuugagaguguucaaaauccucucuucuagcuauuuggaaguauacuauacaauauugcuaaccauagucacccuucuguggaauagcacaccagaacuuauuucuuuuaacagugacccuguacucauuaaccaucuggcccccuccuuccuuccuccucucuucuccacccucugguacccacuauucugcucucgccuccaaugagaucagcauuuuucgauucuaccuaugagaucgugugguauuuggcugucucaccucacuuaacauaguguccucuaaguugacccauguuucuggaaaugacagaauuucauucuuuuuuguggcugaaugguauuucauuuuguauauauagcauauuuucuuuauccauuuauugguugauggacauuuggguugaguccauauuuuggcuguuguaaacauugcugcaauaaauauggauaugcgugcaucccuuuugacaaauugauuucauuucuuuuggguuaacaugcaguaguggggaugcuggaucauacgguaguucuguuuuuaauuuuuugaggaacuuucauaccauuuuucauaguguauuugguguauuaauuugccuucccacgauaguguguauaagauugaaagauguuuuucaaccuucauuuggugagauacuaguaauuauuucuuaacauaaguauuauauugacagacaaguuuaggaagugcugcacucuguaguucuuuauuuaagauccauacucgauaaucacuguauuaagaacuaugaaaaauccagcaguaaagaaaaccuguuugaauuauaguuccccggccuuauuugaucauagagccuauuuggggacugugggaagagugaguaucucucccugacaguagauuacacugaacauggugcuauaaaagcuuuugaaaucauuuguuguuaacugguuaucagaccaguuuaaccuguucacaucaauaacauaugagcaugauuccuaaaagaaacauauaugauaauaaauucaaaaguggaguagguaaaucugaacacuaggcaucucaacuucugguaaucuugguuugauuuggaccacugacauauuuguaauauggguuaaaauggcuuuuagaaggaucucacucauuuaacuuaagcauaaacugcuuuaggauauuuuuuuuucugaguuucuuacugaauacuucuauugaguaaaauagucuagaaaaugguaguaucuaaaucuggguucugagugguuguacuuugaaaaguaggcauacuucguaagagguaguacuaauguaucucuagcaagguuuugaaagaauuuguggagcuuuggacccuguccugugguguguagcauuacccgucuugugcaguuucucaguacguauuuuagggacagaccagaguucuuugguccuucucuaauuauccagcuuauucuaccuccugggaagcaguugggacccauuucuguauuccgauuuuguaggagcaugugcguuaauuggguuacaggaaaacucuggagucacucuacaggaagauuugaaaucuuuccuuuucccuuuucuuaaaucuuucuuaaugcugaaucaggaaacuauaucuaaggaacaaaaauaucuaguuaggaaagugugugcuucuuaaguccuugaagagaguguauaacuuuuagacugugucaguguuagcaaauuaaugucacuauuuugaucgagugaggauuagggaaguacauuaagaaaugucuucaguagcaaauacaauaaucuucucucuagacuaaguucuauuuauuauguuauuugucagguccgucucuuugggcuucugcccagcuguaugcuucagccuguuuccuaucuauaggcauucaucaugagaagcuucugcugcuuguacagcuuagcugacuuuaguccaucccuuugcguuuuuaaaugcacuugggaguccuugacaccugcugaugcugcauucuagaugaacgaaauggauuuuaugaugcaaggaaugaguaauaaaguguuacagucagaaaagcccuagaggugaccuuaaccaacccucucccuucuuugccccaaacaucauaggugaugagaggcccagguuugugaaaugacuaguucaaggccacagagcuauuaagcgguagaguagggaccagaauucugauuaucuuaugcuuuaccuggauguuuccucuuugccacuuguuggaggcaagagcucacucuuuaaagaugaagcaaauggccaacugaugaauuuauagagagaugugugauuuuuacagaguuauccagagggcaucuucuggcgagugugucuucucuggaaggagaauggaagguuuuugacaguaaggacugacgaauacaccaaaugaacaagaacaucugugcuucucuagaaacauuauaaucuaugguugugaacuugauauucuagcccggugguacccaaauuuggcucuacauccucaccuacucaccuaagggaguuuuggaaucuguugucagagagcuucccaggugaucuugaagcccaaaaaaguuuugggaaucagacugugucucaugaaguauggucacaggauucccgcauuggaaucacuuguaaugagugcuagaaaugcacgguccugggcucuguccaggccuacugaaucagaaucuguaguggggaccuggaagguacucguuagcuaggaguuaucaaugucuuaaacauuuuguagggagauugaaccagggauuuccagguuuaccugaauucuagauuuagggcguuauggaagagguguuaacaauugcaguacuuaauucuuuggaaaguuuaaguuuaaagugcuguccccucuucagcauuggucucugaguuaauuccuagcuuucagaacuagacauguugaguuuacgucacuaggcuguguccuuacugaucugauauguugcugaaagcacgugugcgagcauguguguguguguguguuuaaguguaauuagguuuuugaaacuccaggguagauuguucuuucacuguuauuuuuccuuucuucuaaaagaauggcuagaggaguaguugguggaagaccucagguaaugaguauuucaccauuacucucaguuguuugagguaggucuuguacugaccucaucagcugcuaacuagaaacuuugacaaaaggggaaaaaacaaaaacccaaauauaaauuccagagggcccaaagagauguugauuaccucugaguagguagugccuugcaugauaaggcuccugccaugccccagcacgccuuagggcuaguaucuuaaaauauuuuuuauuaauaugaguguucuuagcuagguuuaucuugugucucugcuugcugagaauuuuacagcuaguuuugauccuucuuuauucuaucaaaauaaugugauuuccaaacuauuuuaauggcauaggauucucuucuuuuuaaacaaauacaaucuuagcuccucaggauugaaacagauaagugguauuuuauuagacuaaugggaaccuucaaauuuaauagcacuuauuuccuaugagucaaucacagugaacacaaagcuguuuugaugaacauuaauuugaaaaugugauuuuguaugucaguuacaguuguacagugagcaugugaaauguccauaguaucaagagaucaagaauucugauucuugcagaccaguaguuggaaacagcagggugguugggugggugguaacuuaauaaacaccucacuuugcaaacucuguaugcuauuuaauuagaaagauggcagaaagguuguguguguucuuaggucuguaggaaaggagaugccugcacagggguaaaugcuuugguccgcagugcguuaacuguggaauacaguacauuugaaucuauuuuuagauuuuagugcccaaguuuguauaaaaugaaauuugugucaaguuuguggaaccucuauuuuuggaacaucucucauaggcaaaagguaauggagaaacuuuauuuauaucuucauugauguaucuuuaaacuuaauuauuuuuucauuauaucuuguuucuuugccaaaggucuugcagucauuuaaaaaauuugguguuaucacuguagaagcuucauauaaaauuuuggagaaagucuuuaacauuuauucuucuagguucacuuuuuacuugaaccuggguauuuuuauagaacaauuuucagugucagccuugauuaguuuaguggaaagauuacaggaugaugaaacuagaaauuuguaacauuuuaagaaaucaaauacaguacaguucuuuaucauuguuaggaaaaacaacuucuguccucuuuuguuuaguaccuggggacuuggaaauuaauuggagaaauggcacacaauuuuugcucguauuuuguguuugggaguugacagaaaaguauuauaaaacuaaaguggucaggguuggggggcuuauauaccauuuuaacaaaggaaagguuuggacuuugcggaauaggaaaucauggggaagcguucagaaaauauguagggguaaguaaugacaagauaagggcacuuuuaacaagguugguuuauacagaacuguaugcauaaacaaucugauguugacugucucaaguaaugagucgcuuacuucugaacugguacaggacagagagacaucuucccaugggaaauuuauacucugcuuuuagggagaaaaggggagggcagagaacucaucuugcaucuguugacuucuuauuuuccucagccuaaaauaauacuugaugccagccaggcgcagugauucaugccuguauucucagcacuuuggaaggccaaugcaggcgaaucaccggaggucaggaauucaagaccaaccauggccaacauggugaaacccugauuguacugaaaauagaaaaauuagccaggugugguggugcugcacgccuguagucccagguacucacaaggcugaggugggagaauugcuugaacccaggaggcagagguugcagugaacugagaucgugccaccgcacuugcauuucagccugugugacagagcaagacuccauuucacaaaaaaauaauaaaaaaaaaaaacuuaaugccaaaguggaauauuuugggguggcaaaucuggaccuuuucaccauucaguaaguuaauucccaguuaacaucucuucauaaaucaaagagcugcuucuuuagauaaccugugguaaugaagccuuuaauggcuaguugcuaggaugaagaaacaucuauuugaggauacagaaaaguaugaaacaauauucuucucuaguaauucauuaaucauccagauuuguuucucugauuuccugauauugauauuuguguuacuugguauuuuguuccguuagaauaaaauguaaaaaaaaauaugugucacucccacgagacaguuauacaguuuuccaacagcugucuuagaguguuuacugggaaaauaaaguugaaccuaugguguaaaugagguuuaggaguuuugauuuugugcuuuccuagcccuuaucagaggaacuuuuagaauagccguauuugccuuaccaguagauuaggaauagucuucaguaaccuuucucuuuguugcuuugcugguuugauagaaaacacaaacuuuguaaacauauucaaauucauagaaaauaaaauuacaguugaaauucucuuguaacauuugccccuuuauaauucagcauaagagugcacgugugcuguuugcuauuccagaccuuuucugggggguagucuuuguuuacuuugcaucaggagauuggugguauagaagagacaccauucucaauuuaagcgcuugucguaggaaugauggaaaaugucgaugaggaagauggugaacuaaaauggaaauaguucaguuagaagauaaaaaacaguuaaauugugauaugaacuuguugcuucuuuuuuuuguaguuuauagaauuuuaaaauucuguuucuuugguaugaaaaugauuuauaccccccauuuuuaugauguaguacaaaaucaaccuguuuuugacaguuuucauucuauuucacuaccuuaacuaugacacagcuuuggccaccagccuuuuauuuuuuuuuuaacuuuguuuaaauucagaauagaccgaagcacuuuuauucuguaccuguuggaacauuuccuuucaaauauuccugaacagaauaguugauuauuggagcuaaaacugugcuucaaaauuugccaacuucuuuugagcuuguucuaaguuaauugacuuucagcugaguacacugcugcuacugaacguugagagcuguggaaacccucagagugugcuuuuccagcucaaaaggucaacuuuaacagauauuuucuggcauuuuauuugagugucauucgauuugucaggucuauacaguggcuuaauuagcauguuuuaguccuuaagguauuuguuuuggcucuuuaaaguuuuagauugucaauauuucaaaacccuuggaugccccuuuuauugguguugggaaauguaaucaaauauuuuuugaggggcuguaaaucacagaguagcauuugcugcucuaaguguugugaagaaacagauucgcaguuaaaaccaucuuuucagacuccacucaguaauuucugacaccauauaucaucuuuauguaaucgaggggugaucauucuguauuguucuaaauuagaacaaagauuuaccuuaugccuccuuuaagggggaaaaaagcaagacagaaguauuuaagcuguguuuauaagaguuccuuggcuggguaugguggcucaugccuguaauuccagcacuuugggaggccaaggugggcagaucaucugacaucaggagaucaaggccagccuggccaacauggugaaaccccgucucuacuaaaaauacaaaaauuagcuagacuuggugcugggugccuguaaucccagcucuucaggaggcugagacaggagaaucgcuucaacccgggaggcggagguugcagugagccacugcacuccagccuggaugacagagggagacucuaucucaaaaaaaaaaaacaaaaaaaaguuucuuaagugguaguaggauuuacuaaaccccuguguacacuagguuuguuacuuaguuugggaucaaguucuugggauuaaguuugaaucaaaauaccuuugcuuccuccugcuagggagguggccuacuggacacuaaucuuagagcuuuuagcuuagaacauuguuacacuuggguuccaauuccagccuagccacucaauuuguguuguguccugugugugcuuuuugacucugaacgucaguuucuuucauaaaguaccuagcacacagggguacugucucucuuuccuguccucuucuuaccaguuaauacccauucaguuacgugacaguugcagacuuuuguuuuuccccccauagguaaaaaguaguuuuugaaaaacaucuugaaguagaucuguuguccuagauuucuuggaguuugucaugaugugggaagaaugcaaagcucauccuccauccuuugcuuucuaggugauuugaccaacauaauugauuuuccagggguggaacaaaguaagaauagaaagugcgaggcaggacuugggagcccagaaugaugauuaaugauauuacaccagccuuuaugaacuagagcaccggaguguggaauuauugcucuaugugguauugugugaauguuucagaaugaauuagcuugacuuaaaauaugaaggugcucucaagugagcuuuccagugagcuauuacugggcuuucgaaggucagcaaguuguuaaauugagccaugaaguguugguuagauaaaaaccaacugcggcuuauuuuuacuuuuauugacaucaucuuccuuaagaugaguauccguuuaauauaaaacguaaauacuauacuaaauagucucauuuuaucaaagaugauguucaagucuagauauacagagaccuguguuuugggauguucaaaaaccuaauauuccugcaguguuagcagaucagaaggcugaggaaaaaaauuacuaucccuuuguuuucuuuuccauugaaauauucauugaaaacaucuaaagcauuucuucauucagucaucacagacuuuacagauuucaguuuguguguaugggggagggggcaguuuccaugaggguaugguuaacuuagcagaugcaauuuuacaucuuguuuuccuuuuuuguuaaauccuuaugcauauugugaauuagaguuuauuuuuagcucuuaaugaguucuuuucucaucauuguacuuuuuguuggaacucuguuuuguacauacugcuuugauuuuguagggaaaauguguauggcguacaaguccuguauccaccacccccaacucccauccucuagcucaacaaaaauuugcauuucuuggugagggaugauagacuugaauguuuauuaccuuguagaguagaucugauggggcccuugacucuuuacaaccuguuugaccuuuggacuuaauacugagaaagucaaauccuccuuuuaaaguaaaguuuaagggaggcauagcuguguguaaacugguaaaucagaaucacugcacuguuuuuaaggucacuggagccugagagaacaguuuuauuuccucacauuuuaaugcuuuaaauccagucuuaaggaguugccuccaaggguacugucguacgaauccuuuuuccuaacccugguacuaaguaagccaugggagcuuuuuucauuccauuuaaaugaauuguaguuugcucuuauucuacuuuaaauguaucuaaacauuuugaauauaaaugagagacugaugguguaucaaaucaauugacaucuucucauguagacaagggcucuccuaaaugacuucccaaauccugccucuaaaauugucuuuuuuuucuuuugugaaccugaguauuagguuagcucuuuuuaaacauggugccaagugauuuugccauuauauggugcagacaguguacuaccuucucaaguagaaugauuugggaucuaauaucuuaaaaucuaacaauguuauaccagguuuguuuuuagaccuuuauauucuuuauuauuuguuguccuuuuuuuauggggguaagcccuuuuauacauauuggaauaggauuaaaauacagaauuguuaauaccgauuuguuacuguguuuuauaucaauauguguauuuuuuuaagugcuggaaauugggagccuuugcaaaaaggcgugauaacauuccauuauauccccagcucuagaacauacaaagcuaguccugaugugcuacuuaaaaguagaauauggaaucuucugggguuaguuucuuacucuauuugauauuuuaguucucugaaugcuuauagaaaacaauauauuuggauauagccaucaaaguaaggaggaugucuaauauucuuuccuagccuuuauaguuggacaaccgacuuuuaaagagucuuuuuuuuuuuuuuccuuuuuuaagacaguacccuuggaggccacuguguucaugaccagugacuccuugagacuggguuuauuaaauggaccuguuaguauagugaauaacagcucuuagguaauuuugcguaguuguuaguaggcaccaaaggaggaagggugagcguuaguugcucuauagauuauaaugaaagaaggucucaggccagaucccaccacacauagaaaccucuaucuagcaagcaggaccaaauugauggagaagccuuuucugaaagcuugguaaagucccacuucucucuucuuuuuuaagugcuuugaacacacuuuaaaugaaauguucaccggaggcuaacaauaucccaaaagucacguucugcacccucacuuugcaucaugcaaaaagaaaucccuuuaaacaaagacugaaacccaggaccauuuaacauuuagggguucucuccauaaagauauaaccaccuuggauuaugccaccuuggauuuugugcccuguuuauacgaaggugggaagugucucuaaacuaauuuagcccaucugcguaucuugaacuccuuuaauuuuaccgguaagacuccauuucuaacacucguuaugcuaauuaacaaauaacuggcuuacagaacaaaacccuauuuugacauccauuaggugaaucagcagagaauugguuguugauuuagguauggauaguauguaggcuuacacuagucacuugaauuuuagccuacuuguauuauacuaguuaacuaauccuggauugugcauuaaugauaguauguuagaugaccacccagaauuaaagcuuaaauggcuggugcacacgugucaucagauuaauucuaaacuuuaaaaagaaauguuuuuauuguggcaaaauauaacauaaaauuuaucauuugaaccuuuucaaguuuacaguucagugacauuaagcacauucacaguauuaugcagccgucacccuuauccauuuccaguaccuugucaucaucccagauagaaacucuguaaccaucaaacaguaacuccucacccaccuccuuugcucccagccuuugguaaccauuauauuuucugugucucuaugaauuugccuauucucgguaccccauauaaaugaaaucauacaacauuugauauaccaaaguauuuugaaaguaaauuaugauaauuguuuucaggagauacuaguuuuuuuccccuugggcuguagacucuucuguauguuuuauuucucuuccucuccaaguggcuuuagggaccaaccccucccccugaaauaaguagccuggcuucaaauuuaguucaugccacauuccccguaaaagaaacguccaauuaaaauacugaauuugugcaauauuuugccagauugcugacuacuugcagggacuucaucuuacccccuuugcaguuguucugccugguuucaagcuuguuuuauucuuuugaaaauugccuucaaucucuuaucacuccccaucuuggcaaguuaccuggaggaagaggcaguugguguauguacagugggucagaaagaagaacccaaguaguuuugcucccuggaagucuucucugccuucauacuuuucuacucuuuucucccagagagucagagcauccagggacaaacauccguguggggucuugggacacaggacacaguguguaacauccccagacuacuucucguuaccucacuucauucucugcugagcacuugaaggaaaucuuggcagaaagccauuccucaaucagagucaaagagcgacgaguuagaaauucucuucuguaguuuuaguucuuccauuuuuuucucccccuucccuaguacucuuucccccuaccccucaaggaagccccccaucaauauaacagucaaccacccaaccagaaacccacaggacagagccauuucuuuuuuuuagaccacuggaacaauuauuguaguuagagaaaacuuaaauaucuuucugaagcaaccuugggagacagaugcugauguauguugaagcuagagaggcaggugguuuguggccuauuucugccuuugcauuauuucagauucuguuacugaguagaacaguccuuuuuuuaaaaaaaaaaauuuaggucuuauaucuuggccuccugccuucucuguuggcaucagccaaaugcauguuggcugcaaguacaucauuccacacuuagugacuggauuuauuuucagacguuggcuauugacaacugaaaagcaauuuccuguguuggggcuuaacagaaagccuccccuggguuguaagaguuuaaaauaaugaaaaaggugaauacuucauggguaagucuuaaugcaagcuuuguguagacuuauccccacugccuacuuugcacucauguuuguagggaguuuccaaaagccucugauugagaugaggaaggucuucuaccucuggagcuguaaggucuugucuugauuaaagaugacucaagcuuaaccaguuguucaguagucuuugucugagcuuugggugugcuggagaauaucagccaguguuaaguucuugauuucaaguggugacuaucuguugaagagagccugugccaugaaauaccguaguccucccauuaucaacaguuucgcuuucugcaguuuaguuaacugguggucaaccauaguguuaaaauauuaaauggaaaaucccagaaauaaacaauccauaaguuuugaguugcucaccauucagaguaucgugauuaaauuuugcaccuuccugcccaggaugugaaucaucccuuuguccacauuauccauggcugguacauguucccuguccuuuaaucacuuagaauccaucuuaacagaucggaaaaaaaaaaguaguguauauuauguuggauucaguacuaucugugguuucaguuauccacugagggucuuguaacccccaaggauaagguaggggguggaggacuacuguacucggcuaguggaacuucuugugguauaccucaugguucaagggagguagagaaggagggaauugucauacugugaagguggaaugcaggauguucuaaauuggugcuuguuuuguugagcgaagauguaaaguauagucugguccacuaaugauuuguugauuauuucauuugaugauuaauauuggaugcagucauuuauuugaacagaaaugagagaggcuuuuuuuuuuuuuuuucuuuuucaguuuacauggaaagacuucuaaggauguucguggauccaagacaaacuugucucagucuuacauuucauuaggguccuucuguauuggggaauucucuuucuuaguauauugcugaugggaaaaagcuaauuccagaagccaguuggguggguccucucucuuucugccugccuauaggcaagcagccaguaaggaaccgaaguaaagucaauuaggcauuuuaucucaggaccuagggucucaaggaagugauagaaggauaagauggugaugaugacucaccucucuguucugagguggggguaguuuuacuuccuacuacuuaacuccuugaagucugguucccagcccuuacucauucugaaaacgcucugugacucuuccaguguguuucuuugugccaguuagguagagucaguguacaaucuagaacuccauugaaacaauauuuauguaauucauauuuuuuaucuuuuucuaucaguguuuuuuaacucaaaaguaagcuuauuaauuuuguauuggucucaauuugaccuauaagagaauaacuuuuguaauugguuagaagccccuguugugaacuugccauagcuauugguaaaggaguuuguuuugagagguguguauguauguaugcauauuuuguaaauaaagucacuugucagugccuuucaaacaauuuacucauauuugugucacuuuguuaguguuggaggaaagcaaaguuugaauuuaauuuugaaaauaguaggugcagugaagauaccgauccucccuuccaagucaucucuugugacuuccucccccuuuugauuauguuucuugggcacuacuuugcucacugagugugagcaagaacaaccugaagaaugacugagaugacuacuagcaguagcauucacacagcaggucuuuuugaauguuucaucucuagcuuuuagucuucagaggucaguaauguuuggugacucccauugcuuuuaguagcuaaggagagccauauaucuugugguaaaacagauuugccucugaaugaccuacauuuaucuccucugcuuauuuaguggucauuucuuuaaaacccuucaguuaacgcuuuugguuuccagccauguagggacauguguaugcuuacaggcauuauauuucuguguccuaugggauaaguaguauaugucaucauuagguuuuuggacagucuuugguucuccuugaaaagaugcaagucuaguuuuaccuuuauuacaguauguuuuuuuucccagcaaguaagucauugauggugaauuguaaauguaauuguucaaaaaagaaucuagucaauuuuguguucuucuuugcaaccuauuaagauguuuguguacaccuaaaggauuugaaugggauaucuguucagguagcuuaaagugaaaagauggugguggguagggcaggggaaugaccuggccaagauaauaccagguuauagaggauuacacagaaaaucuuuguauaauaucuuaauuuggcuguagauuauacauucagaaaacauucuucuuuggggauuguaaaaaucuaccauaguuccugguuauuugauuuguauuuuauuuguuucuugagacagagucuugcucugucacugcccaggauggagugugguggugugaucacagcucacugaagccucaagcucccaagcucaagugaucuucccaccuuggccucccgaguagcugggaccgcagacaugugccauuaugcccagcuaauuuauauauuuuguagagacagguucucccuauuguugccuaggcuagucuugagcuccugagcuuaagugauccucuagccucagacucccgaagugcugguauuugggagccacugugcccagccuguuuuuuugguuuguuuauuuuuaaaagaauuuuuuugcuucauuuucuuuaagucauagauuacaaugacagagagugcaaaugaaggaacaaauuagcuuuguagggaauaaugagguaaaaguucuaauuccuuuacuauuagauuuaauuauuauuuuuauuuuuauuuuuuuucguggggggugcgcgagaaggauaaagaagcccaaaauaguauaguaggcuuuuguguuaagauccauuucaguauauauauguuuucuugcuagaaaguacucuugcuugagaaaaauaaaguuuauaaucuaaguagaauccuuaauaauguuguugucaauuaggauaacuagaauaagcacuuaauagguuauauucuguuuggguacaggggcuaguaagugaucuggcagcauacauauuuaaaguuuuucccugaauaaaggagauuaguuuauaauauauaacuauuuuauuccuucauuagaaauagcaaggaagaaguuuucagcaacaaaauaggaaaacucuugacagcauaggcuauugaauauuggaaugagcugaaaaacuaguuauuuaguaaaacauucauuucuucgagugguguacuuguaauugaauaccuaacauuuuguauggcauucuacauuguaggaaccucuuuuaacaagagugauucuaacacgcacaucagaaucuauuugugaaacuuaagguggagacgguagaauaauaggugggggcgagcaucagagaguaccuuuagugcaguuucuuuucccacagaugagaucccaaucucaaauucauaaggcuaguuagcuggaggccuuaaacuccuaaccuccuuuuccuuagggaccccuuugugguaauaagauggauucuucugauccacuugucuuagccuuaaucuuaaaauguguuugccaagugggcauguaauguggcccaaauagcugagaagcucuguguauagaaguuacuucccacaucagaugguccuucauauuguuuaaucuggugccauaaaaacauagcgccuuccccaagagugggucucagauaugugaauaagcaaaucgaguaacuucaguaacagcagauuaaagaaagcaucacauuaaaaguuuuuaagaugaauuaaaauugaaguguuguugaauaagauuuuuuuaacccucuacccuguuauacauuuaagaguacuugagaugauaaaaugguaauauguuaaaauuauuuuuguguuuagguuuuuccuguuucauaggaaagauguauccagaauuagcagcaauggucagauguacuaaguugcuggguauaugauuuagauaguucguuuuuaauauacuuuaaagucagugguaaaagacaagacaagccucugugcucugcucauucggcaggauaaugcguuuacuauaccaugcugauguggauggugccacauuacuuuuguguccuaaugaaucauugucuagguaaaaucuuuuuagcaaaaucuuccucaaaguauccgugaauuuuaaauuuggaggauuacaauagcuaaucacuucaacuuuuggaugaggugauuugggaagaaaugcuuaugugugauaugaauguggcaaucguaggagcugcaccauuuuguacuucucuuuaggagccaucuguuaauuggugggcaaguugcccuguggucucagagugguuugcuguagcauaagcugucccugagcaaaaacaaaauugauacuuauuucugucaggguaccucuuugacuuaauucguagccaugguucccaucugacccauagccuuuacaacuuuaaccauguacagcucaauuuccucuggggacuguguuccauuaggauuccuuuucuuuauugcuucagagagaguguucuugagguuugugaagcugugucuguaguauuuaaauagguuuccuuuauacucagcauuuauacccccaccagcccaaacaccaucagucuguuuuggaauuuuuccuaagcauguaaaaaucagugcugugugugacuauuuuaaguuuagaggaaagaaagaaaaauguuccuccuacccucuugauuaacuaccucuucauuaacuauaaacuaagcaacauguccuguacaaagagaagaaaaaucacguuauuuauacuuaauccuugugucgacuggggacgauggauguccuuuggaaauuuacuuccuuugucuuugcuaaaaauaccucuaauuuaauucugcucuuucuuuuugauauaaaaggaauuacaguggacauuuuccccccgguggaaggguuguacauaucggucuauagcagauacuuuaugaucaguacacauaaggugaaauauguuuuuauugaaacaccugaucaugugaugcuacccaauauucccuucuuaaugacucagcuucccucccucuuucacuccuuuucuaacuugaugucaccauauuguaugcgaaggacguagguauguacgugcauucacaaggcauguguaauuuugcaguugcuacucaguuaaaaauaagguuuguuaacacuugcaguaguuuuuccccauuuacugugguaguuauuaacacuuuguccacucauaauagcagcuuagcuuggucggggggcagaaagaggauugagguacuuguuuuuacagcuguguaaaggaggucucagaaaaucguaagcccugccugauguagucaucuuggguuuagcuuuuuggugguugggguuauccauaucuguuaguuuuauagugcaagaauacuuucaaggcugcugaguugguguguuguauuaaucucuggguauuaugguucaaaagguuucuugcccuucuaguuacuuuuacaaaggccagauguuaucaugccaaggaaguauggauccuccugggacacaaggaguugcuagguuucaauccuggccauuacucuagaaggccuguaaccgaacccagguucagcugcuugccacuugaaagccagaacacaagaggcaaggauugguggaaggaaaagcauuuuuaaugggagccagcaaacugagaagauggcaaacuaguauucuaaaguaccaucuucaauuuaaaaauuuaccguagggcuuucaaagggagaaagguaugggagacgugcagaaguggugcaggaucugugugucuuguucaguggcucucucaggugucugaaggucuaauuggcauuaucuugacuuuggcucaguggugguggacuaauuaugacuccuccuaaucaugaggauuuugcaguggggacucuguuccugguuuguuucaagauuagccugugggauuucuuaagagccuaaguagauaagcauggauugccuaagggggagugucuagagagggaaggaauaaagaguugagaggggagggaagaaggaaaaagaaugugggugauuucuaacacugaggucccuaguuacagucuuacaucugcaucugcucagugauuauaccaggccacuaaggugacugucccugggucccucgugugccuccuuccucauugugccucagugcuuggugcauccugcaguuugucugcuguaaaccuucacaugggccagucuugcuuccaggauggggggucgguuugcuuaccucuacauagaugccuuacguucagcguaguaugcuuuuggcuugucucuuuuauacuucuuuacaaauuuguucuucuccauguuccuauuaccuuaauuuguuugucaggaaacaccugaauuucaucuucucuguuuugacacacuaaagaguucucuuuuucaagcugguccugguuaagccugaaaccccugcgaugcacuuuauguauuucauguucauuaggugccugccucucucccuuguuuacuguguugggcuuaaaauuuuugagcaucuuagagggcagagaccaugugguauugaucccaucuuuuuuccaccgcuaugaaaucaugcuaugcguaugaaagcauuuuaaugcaaucugcugaggagagaaaugucuugugugggagaccguuuuggcaguagcaaacauguuuggcuuuagccauaagaacugcuuucugaguuuggaaaaggaguauguaaaucaaggcccauuuuaaauggaucuuuuuauaaugcagauaccucucaucuaucuguuuuguaaugauggauuuguuuugggggcuuaagugguuugugcaccugcaggauguccuuccuuuucuuucaggucauuuuuuuuuucuuucacagauagucucuuggauggauuaagaaagaauugaaguuccagucaauuuauuucaugacaaagaacaagaaaaaaauacagauguauuuggagauuauaaauauucugauuggaaaguuguaaacuuuggauguacaggauucugccacaaaguaauuuccacacauggccaaaggcaacaaaguguacacuuuugaaagacugaguuuggaaagguugauuguaguguggaaacccagcugcuccuuugagcuagcugugugugcccuugagcaaguuaacuuagcaucuuugaaccuccaacuuuauguccguaaaauggauacagauguauuuacauguagccuuguggugagaauuaaaugugauauauguaauguaaggauccuaguugcuugauaguuuaguuuggcagugguacuguugacugccagacagguagacauagcauuuauggggcagugggaaugggcauuuuuccccgacaaacuuacugacuuuuucauacuggaagguuugggcuggugaaccuuuaacuuuugggugagagagugauuuuuuuaagaaaaauguguucaagaagaaaauuuaucucuaacgagaauuuuuguuucacauggacuuggugaguuuguuagagucuaauuuuauaguuucccguucuugacaaaauggggagcucuccauggugguuugcagggacucugacauaguuucaaaacagggccuuuaaauuuuuuguuucuugugguaucugaguuaaaaaaugaucuuguacagagagaaaaacacauuaagaagcuguacugccucuugauggacugcuuaguggggggggugugugcgugugugugugcaggcacaggcaagagugcauguuugugaagauugacaccagcuggucgcacaagcaacagcagaugcccuuuuuacuaccacaguuaacuuguuuuccucuaccacaauacuauuuugaggaauacaguuccuuugccuucaucccaaaugguauauacuugaacaacuccauugucuuuuaaguaaacacaagauaaagcagauaauauaagacuguuaguguguguggggguggggguaggggcgguggcggaucuguguagaauuaauuauaauuaacaaagaaaugagaaaguugcagcauacccaaacuuuuaauugaaaguagauuggacuagccuagaguuguuaauguccuaaccuuuuuugaacugucagguaugacuuucaggcuaucugaagguauuuuggcauuugcucuauccugguggcagcuccaguguuugaagguagaacugcugaccuaucuuuuagagaaacuaccuauaucaauaagugaugagaaccgccuuuuguuuucauuguggugcugagcgugcuacacuaucucagucacuuucuuucaggcuggagaaccugcuuucagguagagucucauccuguggguuguagaggaauugguuuauuuuccuacugcacauaauuuuuccucaucuuccuggucuuggaugcaagauaucuuuguguacccgguguaauacuuggcaagaauuuagaggauuuaauaugcuguuucuguucucaauagucuaagacugaauugugugggaguucuuaauguugucugaaaaugugauauauuaagaacccacaguaucgccaacuuaagcagggucaugccgcauugccagcagauucauaauuacugggacuggaacuacaggaaaauagagcucuaccaguugcauaaucaggggacagauauggcuauuaaaauuaacuugaagggaaaaugcccuggugcugaggacauuaaccgcucucucuagaauuaggcugcuuagguaauauuuaccaaaugaucacuauuugcagcuuugauuucagcagaaaaguuaugauuuaaacucuucuauauuagcuccauguaucuguaaaguccugaaaaucauuuagaaacuuuggggccuuucagucucaggccagcuuuauuagcauuuggguggaagaugagucuucgagugagccaucuguuuucuguauuaugugagugucuagguugaauucuccauccuugugauaaucccugguaauguccuuugggaagcugguagaaaugcucccagcuuucaggaaggcuggcuuggacuguaguaauaggaucucaccaguccuccaucucacaauuugaucuuacucauuagagggcagcaaggaagaccuguuuaacuugacccaccuuaacuugaguguuuaaauggaaggaccugcugcaucuggcaugcuacauuugaggagacucaggcuaagucaggaauuaaaauguggagaaaaacgugacuagagagaacugcaucccucuguucugagauucucucaaaccuuuucccugcugugugguacccacaugguuuugcuguguaucagaucugagauauuaagaaagcuccuuugugaagucuggugcgaguugcuuuggugccagaguugcagugcacagccugucugaacagacacacauaaugagugcccaagaacaguaaguccaucugaagaaauacaauauauuugcaacuuuauuguguguuugagggaggagagagaaggauaucaggaggcaacagggucuuuauuaaaaacaaaaauuuucccccuuuguaacgaaaacuuguuuuugcaaaucaaauuauuugcuuuuuuuugucguuaaggcaugcaguuuuaugcaagagcuguguuuggaggaagcgaaucuuuccauuuugcuuuuuaaaaguauugcauuauuaaaccucagguugcaagucuuccuugacagagaggaccauagugaccuguuucugcuaacugugggauuugaaaaagauucacacggcuuuuauucuuuuauuucauaaaacauuacuacugcuguaaauggaauaauagauacacaucaaucaguguagucaccuuuuauuguugauucaacuaccagguuuuuacagaauucacucugcauuuuauuugacuuguacaugaauagucucagcagacuuaauuauauuagugaaaaaguacuuucaacaaaauuauaugcugacaucccauaauucauacuuaccgauuuguggaacagauuuauguaaaucuaucaaauuacucuagaugacacuuuuuaaaauugagacuucaucuuaaugguauuuguagaaauuuuucguaugaacaauuuuacaugaacuauuuaaaacucguaugacuuccuuaugaaggcagaauuacuauaacauuugagcaucuugucuccacaaguucuguaauccaucugguacaauguagggacaugaggaacauguuuauaagggcaacuaucuccuaaaccacaggcuccuggaaggcagaugcugcugcuccuucauuuguuuuucauucagucauucacagaacauuuaaugaucugucuuaggguccuccuugucaggaacuauguucugcuugcccuugcucagcagucuagugagggagcauccaaauggaccccagacacacauaacaaagauaacggaauaauauaagaagcugugggaggacuagucgagaggagcacuguacagugugcacuggggauggggcaaguuguggcaggaaaugacuucagagagucucaaaggauacaugggaguuggcuaguuggagagcuguguuccagacauagagaacugaaugugcauuuuaggguguauguguaggagugguggaagaugagcgaaaguagaagugagcaaaaaacugacagugacuggaaaccagaguaugguuagauuuguguuuuaagaaguucuccuggacaauguuuugguggaggauggcuguuuuuggaauuaaugggagucuaagcaaggguuguccuauuaggauaguguagcagugaucagggccagaauaauagagaaccaaugcuaacgcagacaaggggccgauuuagcugguaggacuggcagaacgugaugcggguguggcagaacuugggcuggaacgucuugcacaucuucacuguuagacuugagcuaguuccuucaagccuuggaucaaauguuaccugcaggauagggccugcucugaccauuguauuuaaacagcagcccugcuccuccccuccccacucucacccccugcugcuuuuuucuccuuagcucuauuuucuucuaauacccuguagaauguguuccugucagaauauaggcuuuaugagaaagaucuuuuucuccuuugcauucucagggccuagcaaaaaguaugguucccauaguuauugaaugcuuauuguagaugagaaauuuguagggugacucuuguuuuuuuuaaauacaaaauuuuauuuuccacaauuuuguguugagggucuuguuuaauauugguuggauaaaguuaauauacuuuuaaucaagaauuacgguagucuauugccuuuaccuuuaaaccugaggggguaauuugauuuuucugaacauugguaguaauuuaaaauagaaaagacuaaauaaagugaccuuugaaugaaacagguccagaagauuguguauuuuuaauuaaaauaugcaauuaaaauuuuaauuaaaguaggguauuaaaacaauguagguggcaggggaauagcugaugcuuugaauuacacacaguuugggauauauugccauuuacuguguuucccacaguagcacuuugccacuaaacggguuuucuuccuguuuuccucuccuugcucugaacccugcucucaguagucuuugguccucuucagaggccucuggagugcuucagcucugugguauagaucccuugaccaugauuucuaccagccuguuuauaacuguucuccuugugccaggagcaucuuauaaacuauuuuucuaucucuugugaagaaggguuucuuuucuguggcauguauguuagauuaaaaagaagcgugugaaacaaaaggcauucauacacaacagugcagcacagaauauagcaaaaguucuagaaucccuaccaaggccauuaaaaucaagacuuugggccagguacgguggcucacgccuguaaucccagcacauugggaggccgagguuggcagaucaguugaagccaggaguucgagacgagccuggccaacguggcgaaacccugucucuacuaaaaauacaaaaaaauagcuggguguggugaugcaugccuguaaucccagcuacuugggaggccgaggcagaagaaucgcuugaacccaggagguggaaguugcagugauccgagaucaugcccacugccauccagucuggaugacagagagagagaccuugccucaaaagaagaaagauuugaauuaaugguuugaaaauucuuagaacacuugaccacagguagcuucugagaauagcugaggacacguggcauugagccucuucuuuauguucaguuaccaggcaaauuuuuuggcauuuaaagacaggauuuguuuuucuuaagggcuuuuuuuuuuuuuuuuuuuuuugaagagccuuagcuuugucauuuuggucagaauagucuuuuaaucauguugguuuccauaaugguuguacuuggaauuuaaauguagcaucuuauaaaacuuuuuaaagaaaugaaucuuaguuuggggauuaucaguaugcacauucuaaauucagagagacuugaaaaauagguuuggaugauauggauaagugaugcuugguuuccaagccuucccugguggcccaugacuuacugaugaauauaagagugggaaaaggguagguaagguauuuuuuuuuguaauguuugccuugcuacugcuuuuauuuuuaaaaacugugcgcucauuuauaaccagaaauaugcacuauauaaauaagaugcaauuuauguugucauaggaaugaauaauggcacugaaauucauauauaguaaaacugauauuuguauaaaagguacagaaguuugagauaguaaucaaacaagaaacaacuuuugcgguaaaagugucagaagugccugguuacguuauuauucaggcauauuggguacaaacuaguccugggcuuauacgcaauaugccugaagucucaguucagguauaaacuaguuaauugaguggaguagagcacagcauuugaaaguccugacuucaaguccugacuuuacuacuuccucccugccuuuuugauuuguagaagcugauugaccuugccaagcuucagauaucauuucuaccuuguaggagaagaaucugaauaccgaacaugguuaaugugaagcuacaauuaaacaguaaaauaccauguagcuaaaaggugagaauggggaggcuugccuaucuugguaucaucugcgauacccuuaauauauuuuaaacauccaauaaauauuugcugccuugauuacagauuuucacuguaaaguaauuuaaaguucuaacucccuuuuguuauagugccaacauuuuaauacaccaacgaugguagguuuaggaaugcagucuuuuaauagcagauacccccuuucauauuauuuugcuuaggauaauaauacaguuuugcuuaccucaaacauauucugaguggcacucauccuaauaaugccacuaggcaaauaagaaacuuuuuauaaggaggcaaagucauuuggggauaaauauuucugaguauaaacaacuuaacagauacuagauauuugacugacucauauagcuagucaugauugcuugaggguaucagguggaagacccauuugaugguugggucuucugaugguggugguggugaugaugauaauaccuuugguuaaauaaauaacaucaguaaguuucucauucuuucauuuagcaaauguuuccaugccuacagcaggccaggaguaaggguucagaggcuagagugggaaacagcuaaguaggaaguaagcaagacaggcuuuucacuuuacccagugaucuaaucucaguaggcacucuugugccccagacagaccucaggaggccaauaaacuguuucuuugaaguaauagguaacuugaagauuuuagaagaaacacauccacguguaccuaaacaacgcaacugugaaacagcagucaucccugcaagaccuuucuuagaccucccagcagccccguuguagccccagcuagguucucaccauuaaggcagugauuucucaacauggugguuguacguuagucaccaggauuuuaaaaagcuaguaccaaugcuucaugacagacugauaaaaucagagcccaaggugggaggaucgcuugaguccaggaguucaagcauggcccagccaauguagugagaucucaucucauauacacauauauauacagacacaaacacacauauauguauauauaucuaucuauuuuugggagugggauucggggaucagguuuuuuuguuuuaguuuuuuuuuuuuuuuuuuuuaagcuuucuagaugauuccauugcagucaaguuugagaaugcacugggguuagaagcugcuaagaugcaggaggaggaguaucuaucaguagaaagggcaauuagacuaugcugauacaauugauuuauuuugucauagaauagcaguaugacaaaacuauauuuguauugcccuuuucuuuuucuguuauauuuguggcaucuuuuuuauuuaacuuuaaaugaauauacuuaaaaucuuuaacaguaagcauguuauuuuuucucauguuaucuuuugacuagggugacgauccacuuucaucauuaaugaauauuuucaucauugcaucagcaaccuaguuggguaggaauuacccucguuuuagagagaaggaagcugugguucagagagguguuaaguagcuucuucaaaguugcacagcuaacugcgagccaguaaacaccagagccgguauuggaagucugucuuuccacuauaagcugguuccuugagcagauuuuguuacauucagccaauuuaauucuacucaaugacaauaggacugcaacacauuuucauaagaggggcacaaugcaugcaguaaacacaugauaaauuuugaauuaaugaaaagcugaaugcuuaaaaauacaguggcuucacaugugacucuuuacuagaacuguaaaauaaaaccucaauuuuagugugagaugaaauuaaccuaauuaguuuuuagcucucuauuccuuucucuuuuuuaaaaaggaaaaaauacauuuugauagaggacauauauuagcagugauuauccaaaauucugauuguggucccaaaauauaaucacuaguuuucauauugggcacuguauuuagccuucucuuuucguuuaugugguaacaaguauccacauuaggauaaccagaguagcuguccuaaaaacccacauugauaaccacuugcaccuacggugccccaucaagaaaaaauaccucacuucccuaugaaauugaugcaacaguaguacuuaguaaaagcauuuggaccguccuugggcaucugggaaaucgucauuuaguuuguuuugacuuuuguagacuaaacuuuucuuaugccauuuuugucaccuguauaauguuucuugccauuucaaacugagaaacuugcuucauugaaaaguugagaccauugcgauugacuuuaguuaucuuugcauuccauugaugcaacugcuuuugauagcucccauugucugagaucuagggcaucagugaaccaggagugagagggcucagaugauggggggaggguggcaacaacaacaaacacuuagaagcaacuuuuacucuagacuuuuuuucuccuguuauuuuuguuuauguucuauuucuucuuuuccuauauguucucauugucuucgaugucaucccuguaagucuuuuguguucauauuuuccuguucuuaucuagaucauaaaacccucuuuggagaaauuugauugaguguauuugaagauaagcccucgucuaaaauaaacuuacauguauacacgcccacacaugguucuucaccauuuuagacuccgacauuauuguacuugguaaaggcuguaaauaugucaggguacaauuuacugaacacugacagauucuugguugauguuuucugucuucccauuuuuauggcuaaggaaacugaagcugaaaagguauugccuguuaagcccucuccauagcacagagauuuauccccacaguuuaugaagcugaccuugucuugcugaugguauacucuggcucaggcagggcauggaugguggaauccuuuggggauguguguuuuuuuuuuccuaaacagcacugcuugcugaguucuaaaacuugaaaauguaguagacaggagacauaaagacuucauguauauuucuagaauuaauagagaguucuuuuuacuguugaggaaauaugcugguguuaaugacaagaccauaugccaaaaugaaaguugaucucugucaacaguauagaacuaauauaugccuuuuuccccuuccuuuucauuagggcagagcuugggauauggcuuugugaacuacauugaccccaaggaugcagagaaagcuaucaacacccugaauggauugagacuucaaaccaaaacaauaaaaguauguuuaaaguuuuuuuauaucuacuugcggaacagaaguuuaaaaaaauuaagauuuauuuguaguucuuuccuuucuuccuuuugggcccauauaaacaguuaccugggagacauaguggaauuuugguguuuguugcaagauggaagaaacuguuuguucaagagugcuauguauaaucauucauguauucgcaaagggggacagagcaacaacucucuuagauaaauguuauaggaagccuacggaaucaagucuccuucccuuauagagaauuacuugcccuauaacuugaggaaaccuuagacuuguucuucuauaaaggucuggguagugaauaagcaagguuuugcgagccaugcauucugucacaacuucucaacucugccuuuauaguaugaaagcaguaauagccacuacauaaacaaauggaugcagccguuauccaauaaaacuuuauuuaugggcaaugaaacuugagauugauaagauguuuauguauuacaaauauucuuuuuauuuuuuccaaguuaaaaaauguaaaaaccauucuuagcucauggguuauacaaaaagguggcaggcuagauguggugcuugaguuguaguuugcucuagcuaauucagcuugcuuugaggagacugacuggaggaacuuacaugacacagguuauuuuuucuguuguuuuucuuuuuaagacguacaguaaauaacuuuguacauacuuugcugcuuuugugaaucuuugaaauucuuauguagauucucucuugagagggagcuaaucuaauucacagcauagauuucuuuuccuuuagaaaauaagagggaugucgccucuagcaaauucuuaguuagcuguaccaucaauuugcccucuccugcccagugcagacauugccagucaaucauggcacucuuucucacagagucuagauguggcucccaaauauuuuuuucaaaauaguguuccagacaacuucuaucaauugacucaaguuugaaccuauuuuccacccuugauuuaagaaaccagcucagacuauagccugaaguggugaggggaaguuagucaaggcugacuguaguauccaucuugcuuagagacuuguguaaaagauuuuugcucauuuuuuucagguaucuggaaaugaagugucauuuuugugcuuuaaaguugcuuuucuuagaauuaccaguuaagguaauuuauuagcccugagugguuuugacacaucagucuuuauauuuauuggccccuaagaaaaaugccuaccagcccugucuuaucuaaaugaaaguauauagugguucccaaauauacuaggguaugagagguccaagaauucuagauacuucuugagcaagaaacuguucuaugaaaagauucaccaaucagaaaaugaacugguuacuguauauuaucaaaaugugaagggaaaaaugagauuuccaauaaaguguaagacaaguuuguuuugaaguuuuuucagucugaacugcuuuuucucguuaucuauauuucucugcauacuuucugugucagagaucuuuuacuaguacuauuaaguaacaauaaguguucuuuaaaaagacauccaguguucaguuaccgucagaccgugugcucuuuauccuacagcagauuuuugcagguuucuuuuccucaauuuauauugauuuccagcguugcugcuaauuuguccuaguucugagguccugaguuguaguugggaagaaaauggaauagguggucaagauggcuugucccaggaacuauccuuuucuccauucuagaaauaauuacccuuauuucauucuagugugucaguucuuuuacuaaauauccuccugcacgaagauccagaagaagguagaaaugcaggggaaauaggucuccacaggagaaaugcccguggccuucaaggagacaguugaugacagcugcuuccuuacuguucaucauccagccuuuucucuuuagggcccagcugcuugggcugaauauguggaagaaagcacaguaaagcuuuguggcuuuuauagugugacaucaguuucugauuuucugagaugugggucaggguaaugggcaaauagcaggcuacuucuuuccccgccccuauuugguuccuguaaaaauaucagauaacagcuggcauccucaauuuggcccacauuugucuaagaggcaaagcagaccauuucccacaaguauauagcacccccuuugccuguuuguucuuucuauguuuauuuauuuccauuagacagauuuugugcucuuguacaaugucuugagccaaguuuuucuaguauucacagcuuuaagaauguuuuggaaguugaguuaagccuuuucauuuccugggauacuauuccauaaauaagucuuuuucccucgucuaaucuauacuggugauggcugucagcaccacuuucuuacacagcaccacuuuacucguguuacugcucacucaaaacucuaugguguuucucuacuguuuuacccuaucaucuggcugaguuuuguaggagugaugccagugcuauugccguucuccacuguucucagacuggcucuuuacuuguaagcugaucuuacucccagcguccaugcauaugcuuuugcagcuccgacuuuuugguauacccuuucacacucauuuuuaguuuaacuguggucaucucaucuuuuggagcccaucuaaaggaauucuguccuucagcuucugucuuuccagguuguuccagcuccugcugaguucccccuucuuugaagucuauauucuuuacccuugaggaaccacagaaguuuuggaauuacagggggacccauauguaauuuaggcuuaagcacuguucucuguccacagucagaguggagaucuugguggucauacaauuuagccaagaccaggcaguugaagaaagagcugcgacucaaacaaauccuugucuucugaucguuauaucaaaacucuugccaggacacugugcuuuacuuuagaaagguacagaagauugguuaguauauacaaguguuuguguacuccaagccacuuagaauuuaguaugcguuugguaaaauuccugguuauugggauauugaaacagugaaucaagugcugugaaaggugguuuauuuagcaguuucuccuggggcucccuaauagcauuagcucaguaggguuuugugcaguaguugguguguugaauaaaugacagauguucaguauuuccauggugagugaagugaagucccucaggcucugugaggaccuaaagcauuuguucccaaacuuugguugcaucuuaaucccaagggaagugaguuagaaauacaguuucugggauccacuguagaucuacucgaucccuguccacaggugagauuccggguucuguuuuuuauuaugcuucccagguaauuuaugacagcaagucuaaggccuagcacuugggaaucaccaaagauguuuggcgguucucuauacauuugguauuugugugugcaaaguucaguuugucuucuagcauuuuaccuuaauaauccuccugugguucauucuguuaaccaaaauauuaauguuuuuucuugagcaugcugggcgaucguuuagcauucagaguucaacgugguucaccagccuuugcuuauaaaaaaacauggcauagaaauugaaaacaacguauccgucucauaguaggaugcuguuuguuuaaguaguagcagauacagguuaaagucucgagauacuuguucucuuguccuaaaggucacuuuuuuuccugguuaaggagaugucccagaggcauaccuugcuggugaaaugacaucaucccuguacugcaugggaggcagcuauuuuggguuaagccugcccacaguauccccaguguugacaugguaaauaaagugugaauauuacaaaaauguuuuaagauucucauuagggaagguagugaaaaggugauauguguacaguucaggcaugggggugggggaguaaucucauggaagugucaaguuguaugcuggugagaagaagagagguuuuucuccaagauccuucaggucccuaaaggaauccuuccuuuggugaguuauucaugaagugagugguuguaccuacuguguucagucuucaugcucuuucucuacucauuuuauuuuuaggggucuuaaguauugaaaaaaaucuaaauaguauguggaauuuuuauggcuuaaagccaauacuuuugacuuguuagguuaacggugucagacuuaaauucaugauuagcaaacuaaaaucauucauuuccaagaauauguguagacuuccucccuccucugcauaaagaacucuggauaggugauuaucacauaacacagugaaauggauacguggcucccagcaucucucucagcuuuucccuccucuacaaugggccuaggaugcuuuauuuuuccugaaacugggguugauuuaucuggaaagaaggagcuguuaucucagggaauagaauguuuuauuguuauugguaaguucugaccccucaaaagaaaaaaaaauucugucuagaauuaacuaccauagaaaaacugcccgauuuuggucuugauuaaagaaauauuuuccuuaaucauucagcuauagaccaggcuaaaauuuaccuuugcuuaaaaguuauuaauugguauacaaucaugaaauuucuuauacugaaauaaaccacaauuuaaccacauuuggaaaauucuauuauaaaaaugagaauauuauaaauaguauuaucuauuuuuuguguucaguuugagagugauuaagcaaaccuaagaaaccuguauucuaagcuacuguauugccauuaacuuuuuguuaaauuuauaccuuuuucuaacuagcuuauccuuuccucauuaguaaaugucauauuuauacuuuuuuuuuucuguucagcaugagcuugacccuuaacauaggaauauagaacuacauuucugaaaucuuacucugucuaaauuaccuuacuaaaaugauuuaacuggcugcuuaaucuuggacagagcuuuuaaccauuuaaguuuccauuuauaucguuaaaauaauuuauucaucacugagaauuuucauuaccugcuuuuuaggagaggaaaaaaagcuuuucauggucugcuaaguugcauauuaagaagaaauguuaacuuuuuaaacaaauucauguuuauugcauaaaaugauuugaugaaaagcagcaaccucuccugaagagagaauaauuuuaauugccuucuucuuucacucuugaaaguuuaauagccacuguaaacuuuauauggggauuugaguuucuaguucaaccuccuuuugcgacaggauuauugggauuggguugguuuuucuuuaucauuauaauuuguucuuuuauaaaaguuaauacuggccagaaggaaauauucuuagaugcuguguaaaccagcccccacuguaaagaaggaggagaggguaugcaggcaggaauguaaguaaagcuacgcuaagggcuugccacccaguagguccucuguuaaaauaccugcagcacaguucuguguuugagacgaguggcucuaauagccauaaugcugggaguucaugacuuuaguagggcauggaaguuuuaaagcaguugauaggggaaccauauagaauuugcccaaaaagaaagcaggaugggaggcgagugugggaaaugagccugaguuaugcguuauagaaguguguucugggugcgcauguaugugaaggcgcugauguuuuguucucuaggugaggaaggggcaccggaggguuuugagcagaguaguguugggauugaccuugaguauuuauucggagaggaagguuuguuuuguauuuaaacgccacaucuuucucagcauuucaacccacccuaguguuuuucuggcuuguguaguuuguuauuuccugugaugguacaaaggguagaaauuuauaaaucaucgucuacaaaguaccccucauuuaaaaaccuuuaccuugagcagauuuggaaaauuuagaaguaauaguuggaagaacaggccucaaauuaacugaccuacuuaugagauguuagccuaauaacuguuauuuauccagacaaaaaaaaaauugaaaaaguauaugccaggagugggguaaaaauugaaacguugaguaaauuguuccucugccuuuuaaaaaauacagacugaccgaguacauguuuuccuaacuucauuguuaacuuguauucuggaaauuuccacagccacaugucaaguuuuaacaguauauuacaucugauuaucagcaccucuucaauacauuuaaauaaaaugcuucuaucuauauugagucccauuuacauaguccuuauuugaagugagaagucacagaugacuuuuuuauuguuauuuguauaaugcccuucauguguuuuguagaaugcucucuugucagcuuuaauuuuuuucauacaaaaagcccagaaauuucuuacucaucuaauguggucuagggaauguggguagguagcccaaguaagguccagagcuugaauguccuguccucaggccucuuguguuacuucuguuccuuuuagccaacuccaaagugagaguuaauuggaauucucaaagggcaauaacuaggcauucuuccaauggauuuccuuuagauuuucccacaguuguuggagcagaggcagagccuacaaagagggaaggaugaggaacaggguucuugguggcaguguccccugcuuacuuccugccugucagccacacaguggauagugaugguagaagagucucaacaguugacugaacccaucuuuauuggaauugauggaucauuuuguuaccuaagcaugcuccacagggguaucauagccccucauggcagaugcuuaaacuuaugcaaaguauggucuauaccagaaaagccuggcuauuucauuucuguaaccagcauggagaaugucagguuuuaugaagaccuccauuggaauuaaaagaguaacugccuccuugugaguauugcuucuguguaagguagggggaaagccacagaaguaauaacuuguauagguuuaggaaauuguugcugucugugugugugugcacguguggaauugaaaggggcaugugguggggaugucacugaaacuuacuguuuaucagaaauuugagucauugaggcagaacccuuauaacagcucacaggucuagaauguuaagugcaaaauugguuuccgaauaauaaggaggcugaggaagagauucaagcaaaccaugugcaucaugauagaagacacugaaaauaguugaaccacauguucaaauguguuugaguuugauuucuaagauaacagugagauaagauaaauugaaacugaucuggauggccaaaaaucuuuucuuuuuuuuuuuuaaauuauuauuaugcuuuaaguuuuaggguacaugugcacaaugugcaggucaguuacauauguauacaugugccaugcuggugugcugcacccauuaacuggucauucagcauuagguauaucuccuaaugcuaucccucccccguccccacaacaguccccaggguguguuguuccccuuccuguguccguguguucucauuguucaguucccaccuaugagugagaacaugcgguguuugguuuuuuguccuugugauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauaccagaaucuacaaugaacucaaacaaauuuacaagaagaaaacaaaaaucuuuucuaccugaacaucacacugcuagcccuuguugcuuuacuuucccacugcuuuuuaaggggaaugugggguagggcuuuucuuucauuuaucaccugggaaaaguggugcuaggucaguuuggcuucagucuguucuaccacauaccuggcuugugaaguuaagaugauuguguuaacuucccaagaaggagcccuuaauucuuugcuguaucuacuuuugaaacaaauuucauaggacuauuaucuuuuuacuguuuugaauucgugcagaaacagcaguagucucugguaggcaaauacuuaaucccuuugaugaaauaaagcucagguuaaaagggauuuguucaaaaugaaauagcuaauaagcaucagaaauguaguaucauguuggcugaugccguagcuuuuguuguuuucuuuccauuucacauuauugauguuaaacuguuuugcucagauaccacucuaaauaaaccaacugagagaggccuuaauuugggccuuugagugucuuugucuugagacuuucuggaccagaucucuuaggugccagagaguggagcugucuuugccuaggagugaagaacucugcccucuugcagagugagcacuugagacagccagacguacaguuugagaagaaaacuggaucuggaggucauacuuagcagauaagugaguuaacauugauucaguuauuucaguuguaaugaacaguaaaauuauuauuauaguaguaacuuccugaaauuauuuuuuaggcagcuacgcauucuucgacaauguuuuucugguagguucauguaagucguagaugcuaguuuaaagguuacagaaauguguguuaacauuggucucucuuuaaauuugcguagacucuuuaaaaaagcauggauggugcauuuucuuuuauuuucacuucugccagccauuccuaucauuacuuuuaguguguguucucacccgcauguacuacauuagaauuacuuguggauguuuuauuuccagaagugucuugacaugcugcuuuugggcaaugagacagagcuguacaguugacacuugaacaauucgggggcuauggguagcagcccccauauagcaaaaagucuaacuuuugacuccucaaaaaccuaacuacuaguagccuacuguugacuagaagccuuacugauaacauaaacaguuaucacauauuuuguauguuucauguauuacauauuauguguuauuacaauauaaaguaagcuagagaaaagaaaagguuaagagaaucauaagguagacaaaauauauuuacuguucauuaaguggaaguggaucaucauaaggauccuucccccuugucauguuuauguugaguaggcagaggaagagggagggguuggucuaaaaucccauauuaagugcacccacacaguucaaacccauauuguuccagggucaucuguauuuugaaaacaguacaggaaaucugauacuugccugccuccucucccuuccuucugugaagaacucuuuugaaugcugcaauaggacuuggagguguaagucuuggauuuguguucuguucuugguuucuugaucaggugagcugcaggaagggcaaggaaaaauagaacaagcauguaguccuggaaacuaauaauucagaaaaaguuucaguuucuaguuuugguuguuaaaugucuaucuagaaauuugugcuugccuuaaccaaauaaccauauucauauuccuagaaagagucauugagagaagcuccuaacuucauagaaucaagcacaguggccuuuuugaagaggcuaacccaguugagccacauccagccagucuggguucuuggaaauaucuuuggaugaguuucaugggcuuuauuuuacgucugcauuuuugcauuugcaggugauuuauauuccuaaaugcuuugcuuucaagcuaccuggcauuugucuuauuuagaaacuaacgaucaguggauggcaaggaaaagggcuuggcauccgugguuguuaugagcuaucuaggaaacccuaauaugcccagaguuuugaggauuauuucaaaugccuuuacacaagagacugccaacacuuuaauguuuaucaggaucagugggguggggugguugauuaaaaaugcagauuucuacaccccaaccaggacuuacugaaucugauuaucugcagagagagacugaggaaauuguauuucaacagccaccacaggugauucuuaagcagaugguggccugaccugagaaacacuguucaguggaucuuaaugauuugcacuuggguaggucuguggugcuuauuuuaaaacaagucuacuuguaaaaaauaggauuuucauuugucgguuacaucaagauauguugaauggcugggauucacuaauguguuuuuaaugaauauagugcuggauuuaccuaagaaauaaugcacguucucacacacaauuugcucauuuucagggcauuugugugucauuaaauacuucaacauuacaauuaugcuagcauaauuuauuugcuucugaggguauuuggagaauuuucaguaugguucuuuagggccuauccauuuaaaaugggugucuuggccaggcacagugguucauaccuguaaucccagcacuuugggaggcugaggugggcagucagaaguucaggaucagcuuggccgccaacaugacgaaaccccaucucuacuaaaaaguacaaaaauuagccgaacaugguggcgggugccugugaucccagcuacuccggaggcugaggcagggagaauuacuugaacuugggaggcggagguugcugugagccgagauuacaccacugcacccuagccuggguggauagagggagauucugucucaaaaaaaaaaggugaaagggugucuuauagagauugggaguuaaguuuugaaaguggcuuuugagccaggcgcgguggcucacgccuguaaucccagcacuuugggaggcugaggcggguggaucaccugagguccggaguuugagaucagcguggacaauguagugaaaccacgucucuacuuaaaauacaaaaaauuagcuggguuugguagcaggugccuguaaacccagcuacuggggaggcugaggcaggagaaucccuugaacccgggaggcggaaguugcaguaagcugagaucacaccauuauacuccaaccugagcaacaagagcaaaacucccaucucaaaaaaaaaaaaaaaaaaguggcuuuuaaaauuuaauaaaaauuugucuuauuuuuauagccugccaaccaaaccccucuuccuucccuacccagugucuugauauuugagcuuucuagccagggccucaauaaaugggaauuugcucuauuauaagagcuuccacacauuuuaugcuauaauuuuuuaaaggaaaaaauuuuuugcuauaugcaaacuuaauuuagaaacccuuuugaccuguaaaccaaauguugccccaaagcuaugugaaagcagugcauacucuugccaaaaggcuuacaguguuuucccccugcucagaguugcaaaaaugaauuaauaagaaaccaaggauuuuucuucauguucuucauuaagcaaugucugaggggaauuguaaaauaugcauugucuacaguauauguauauccuggugcacaaagucagaugaacugugaaggugagggguaaaaacaccccucucaccuuuguacuuuguucuuuggaguauuaaagaacauuuaucugccaaguggcaaaggggauacuauuuggcgguuuaauuacagccagugaguguuauugaugcuaucagucagcaagacccagggaaagggccugguaccaaaucauucaguguaauuaaauaucucaggacgggauucucaaggugcuucuggagaucugaagcaggagaacacuuugucuuagaacaaagauaaaggugguaguuccccuccucgcugccccucuuuaaauuucugcagguguugcauagauggcaaugauauggucucuuuauugcguacagugaagguuguccauguuuuccuuaaaaacucuuucuuuuaaaaucuucacaacugucacacaaaggguuuugggaauacaguaauuauuuuuuguuaaagcuguuagggggaauauacagcucaggugucuaauagauacuuggagaaugaaggauugucuuugaaugagacuauuagucuugcaaaucaguucauuuaaaaaaagcuuucccuaugguuauucucuaaugucuaaucauguugugagagaaauaucuugguagacuuaaagucauaaaacaacacucacuaauguuucagggguuauccccuuauguauugaauaaauuuuucauaguugcauaacuuaugucagccccacaaaauauguguagguaaaacuuccuuuggcucuguggggagggcuuuuaauaacauuucuguuauucuuuuuccuugcuuucuccuuuaucauacgugccuuacacaaauuuccaucucugccuguuaaaugccauaagcaaucugcaguguuugcuguuacugcuuuuuaaauuuuuaaaaaacugguacaguuucuacugauugaggauuaccaaagacaggcugcccuugaaagaaagugagcuggcuuccuaacuucuuuguguauguauaccuguauacauacauuagaucccugauaauugugucaaaucagggcccaaaacacuaaaucuuggauagcguaugguuuacuuguaauguagauagggcuugcagauuguguuuuaaauuuaaaacagguguuuaaauggggauuguugacauaaaacauccuuuaagaggaagauuauuuguuaggaauuuuucucuggguguuugaggaauccuauuuuuaaaauacguuaaagauuuaguagaaguaguuacuuuauguucaagacuucccaccccuuagggcuuuauuauauuauauggaaccauaacaagacuaauaggccugucuccaaguuuguaggaaaggucaguagcuuuaaaagaugugcauggugcucaccuugcccacaaaacaaagggccaggauaagcaaauguaaaaguuuuugagaaguauuuaauugcaaguuguuuuuuuguuuuacugagaccauguaaucuuggcuauacaguguuggacagggaguaucuguaauuaaauauuuuauaaacauuuugagugcuuaaugugggcuaguuagcuuugcuaaauguuugaacagcauuaaaauaagacaagagguagccuuguccuugaugucauuguguaguaagggagacagcacuuaguuuauaugaccauuauuuggauauaugaugaguaagugcagaauacaaugaaaauggauaugccacuugcugucuagaggccucuguguugauuucagaguugaugguguuuuacaagcuagguuuuauugggcggaaaaagaagaaauguauuacacauaagggaaugucucauucaaaagcacagaggccuucacgugauguguaccuuuuaggagaagcuuacaucugaacaccauaaaguauacuuauucuaucaaguaauaaccuucuacaaaaaugauuggcaggaaaauuugauuaaaccuagcccuguacuuuacauuuaucccccuuuagugaggaccuaauuuauaagagaaacaauaggaaugaauuuuggguggaucaaguaauuugcucguagaaacauauuugccuugcucugcaaagauccguggagacccaugggacucauuuaaguauuuacaaaugguaucaagaugaaguuucucuaagcaguauuuaguguacacacagaggaaaggaucauuauauuuucauuacuauaugaaguaggucaaagaagacuuggguuucugaacauuguugcaaagcaguuuuucuucuaguuauaguacaaagggaaacuuaacuguagauggcauuuacauuuaacuuuacuaccacacugauuuugacuguucuccucaccugcguuaugaugggaaacugucucuguauucuccuuccauacauuucugucugauaauacuuaccaacauuuagauugucauuccucugcucauaaaaguuuugcccugacauucaaggucucuagacucugcccucaacucacuguucuaguguugucaguguccuacagaaaucuuuauucuggcucagcugggcucuucaucauucaguauggaagccuaauucuccauugccuuggauuauucucugccuacauggcccucuaacccugucauugauaaaguuuuauuuggccauaaaauaaauuaauaaaguggauaaaaauuucuuaacuauacauuuccuuucucaucuauuugguggucugcucucugagggcaacgggauuuuugucuuuggagagcagcuugcagaauguuuuuauuuauaaccucugcaugaggaagcuucugucuauugcuuauaagagacagugaagaccugcucugugugcucaaagacgaaaaaagucacaguuuaagugaaauuaaaaguugagauucuuggagguuuuucguuuuguuuuguuuuuguuuuaaugccauuuuuaacuuuggguguguuuuucaaaacuuguugguaggugucacuauacauugaagauguggucggaugaaggauauguaaaggacuuaacagcuuuuuuguuucauacaaaaacaaaguuuuuuuauauauacauauuuuuaaaauuauacuuuaaguucuaggguacaugugcacaacgugcagguuuguuauauauguauacaugugccauguuggugugcugcacccauuaacucaucauuuacauuagguauaucuccuaaugcuaucccuccccccucccccaacccgacaacaggccccggugugugauguuccccacccuguguccaaguguucucauuguucacuucccaccuaugagugagaacauguggugaaaaacaaagauuuaaguaaagguaucccguuaugugagauuuucuacauaauguccaccuacccgucucuugucuuauccacuucuccuuuucauguacuucucucugucagaucauggaugaagaaguguaugaaaguccuaggauguuuaauucaccaaaauuggcuugaugagaaccuuuuuucuuuuuucacauuaccaaccgguacugguuguuuuuuauucuaagacaccugcaguuuauuuaugccagccaguguguaguccuucuuuaguuuaacauucuaacucagcauuuuaaucuguugacagugucuuaggcauacuagacauucagauacuacacaaauuauaucuuaaguacauuuuuggagauaaaguugccaugguuaucuugauaguauuggcaucuguucgagaugucauugggucaaguuucagaaucuugaaagaauacugaagccauugcuggagaaugggcuucuaacaauugaaugaauauaucugauuuucugcaagccaauuuagccugcguuguuuucagugaagcagcaaaagccaaguuauuugggcaaaugccacaacuucuaaucaucuugcuugagagguacuucagaacaaccuccuagcugggcgugguggcucacgccuguaaucccagcgcuuugggaggccgagacgggcggcucacgaggucaggagaucaagaccauucuggcuaacacugugaaaccccgucucuacaaaaauacaacaaaauuagccgggcgugguggcgggcgccuguguucccagcuacucgggaggcugaggcaggagaauggugugaacccgggagguggagcuugcagugagcugagaucgugccacugcacuccagagugagacucugccucaaaaaagaaaaaccuccugcacaaggccauggaauguauacguucaacagguaguagagucccuacuuggugggugggacuaugugagauaggcaucauauaagacuuaguuucaacccucccucuagaaguauaaaacauaguaauauaaaagcuuugaaugguaauacuguuaacuugggaggaagcuuugaggcagucuaguucucuggccguauuuaagaaggcucaaaauacugaguacugacuagugaguacugagauuuuucuuuuagucucucgaauguauucauaguauauuuaaugaaaaugucuaaagugaaaguuuuauagugguacuugagaguguagccucuucaguauuuuuuuuuuaacugggaaaucauauugaaucaucagguggccgauugcaugguagcuuguaacacauuucacaugcagaaacauacccauaaccuucaucucaagauagaaguuauuccaugaaguucauuuauauuucuacuacugucuauccaaaagaaucgcucauuuuacguuuuacuggcuuagguucaacaggucucuacaaaagagaauugagguagugagagguuuaauauguaacagcuugaugggagaaauaaaauuuuggggccuuaacuguuggcccauuuauagauguugaauguuugcucucuguaugucaguaagacagcuccuuccuuauguucccuccauccaggcugcaggcuucccagcacacucaucugcugucaucuuacaaaauauuuggaauauucaggaauuaacuuuaauaauuaucaccauggauuuggaagaagccucauuuauauaugugauuuuugaacuguuucuguguuagagugcauacauuguucuugugccacgucuccuccucugugucaucuuuccugaccucaaagauaauaguauuccuugaguuuuuguuccauaaauuggggaugaugaugcugcauaaacuuauugggaggagcaauugaauuaacauauguuacauauccagaacagugucuggcacaugguaaacaauaaguguuaggagcuaucauuaucugaauuguuuccuauguauguauauaaaaugauguuaugauuaaaacauuuaugguuccucugcucuuugcuaauaguuuuauuguugcauuuaauacuuguaagguuuccaugagguaaguacugugauuaacaucaaauuacaaauaaagagauagaagaccuaaggaaaugauuaacugguaaguaacagagccaagaccuggaccuagcucugugugacuccauaccauauguuuuuacuccuuaacaugggaggguucugguccaaacauuccauccuaaccucuaguuucauaguaugcuguguaguggccagaacuuuaccaguuacaguguauucucuucugcuuuguauaauauauuuuugaaccuggugcuaagcuaacacgugcuugccucaguugcagccuauucacauuacuuaguauuuauaaauauuauguggcuaaauaaaugcaggcucauuucugaaguuaaaaguaagggaguuagcauucuuaaccacuacugacaauuuucuaaugcagagagcuaccgguaggaauagacucuuuggugguuacgcuaaaacucccaucuauuuuuuauacuacuuuaguguaaucaccuucuaaagucugaaaaggcuaagugaaauauacaggauuggaaauggaacauggaacauuuugauugacaaguuccugcuuagacuuggaauggcuagccuacugccacuaccauagugaauuugauuucacugccuccaccucagaugccauauccacuaccauugcucaauuguuuuauuuucuguuaaguaucucugcagguaaaaaauuuaagaaaugguaagguauuuauggccuaaguugcauuucaagaauaucuuuaccauguaucccauuugccuuuaccaguaugagauguccuuguugaaccaacuucauacuagaaccaaggagaaacaacaauaaaagggcagaaguuauguaccaguuguacuuuacuaaaaacgagaugccugucagggcagccuauuuagacccucuuugauacacauggaugcaacuguuuggguagcauuuaauaaaccacacucagugcaguguaguuugucagaggcuguuuaagaugugugaaaaagguggucuaauuugugaagucuguaguugaugaucaguugcuugauauacaguucuuacagccaaaacacuuuuuauuuuucuguggcuauucaguagauuuauuauugucuuuaacaaugucauaggaucacuuauuuuuaugacauuacuuauuuauuccuaggucgccuuuaaguugaagcuaagaucaacugccuugacuaauauuuaaugauguugcacuaaaacuugaaaauucuaugaaaaugagaaucuccccuaguguaaacagccaguugccauucuguuuuccuguuaauugguuuguaaucuuauaaaagggagagacacuaucaaaaagauucuagcuauuguagguugguacguuuuaauugguggaaaguacuagucucaggauucuuaguuugauuuuucucuucaacucccaaauaauuagauuuuuuucuccaacaucuccuaaauaauucucaggcauuacuaguagaagaauuauaauaacuguccuaagacaguuuuuuugauguguuuuauuauuuccuuauguguauacaagaaaauauucuauguagcaaagcuaagguucuuauuuucuaggaauagcucuucugaugucuccuuggaaaugucugauuauugucccagucacugucauuucacaggaagauuuuaugauuuugaagacuguguugcagcuaaugauguaauggaaaaucccgugaugaagagcuaagaccgcgaguccuacacccaacucuuuuucuuugugucuuuggaaaaguugcuucaccuuucugugccucagucuuccuauuucccagauacaaagaaauuggacuaaaugaucacuguauuuucuuuuugcuccaaaauuaagacuccccccgccccacagccuccuaucagcaccauauuacuuuguugaagauugugucgccucuggggacuugaauccccaauuugagaaaugaaauuucauuuuugaaaugauuaauagaauuuucauuguagucuguacacaaaguaccaaugcguauaauguuggguauaugacaaagauuguggcuucuguuagcuuuuaaacaguauuucagaaauaaacucucaauuuaauaugugauuauaaaucaucuucauuacagugagugugugguaguuaccaggauguacaaaguaggaugaugacaagguuucuuauuucaagggguuaagucagucacaagaaaggguuaagagauaaguacauuuugguuaagucaguauuuaagaaaacaaggcauauaaugcagugugggugcagguaagaggcacccaacucagacuguaguggagaggacugauuaguguugacuuuagggacuaggugauacccaugaggugucugaaaugacugaaauuuagcugauuggaaggagggcagcuuauuuuuaacacagagaagugagagcaggaagcuuggaauacuaccgaagguuuuguauacuuguauggaagagguagccagugcucugaccauaaaggaauaagaauucuaaaauuuaucugaaagucuuagggagcccuuuagguaauuuaaguugaggaugacauuaucaaauauauuccgugguaucucugaacuucucacuugaauuaaagcaauuguuuagucuuaaaacauucaacaaauccagucacgauaaaauuuaagguucuguguguauuuuccacugauaguuuucuaaauccuauauuuuggaauauccguuaaagauaacugcccuaaccuuuaauaccuuuuauaaaauuuccuguuuggaugugauuauuucuuuuagcucuaacuuugcuggagcuaauacuuaauuucuuauuguuaucuuaggcuuauucauuuucaacccauugugaaauaugcccuuccuuauugaaaacuuaauauuggacugugauacauguaugccuugauguguguuugagacuuguuccugguaggaguuugaauuuagaagcagaucaaaguacacaucuuccuuuugggugaauuuugaggucucuggccugaguugugguuagagaucccccuucuucuguguacuauacuucugagcucauuuuggaagguccgauguagccaccuguccaaauauccaugaugcugucacaagaccuuugcuacugcuuacuuagagccuagagcuaacuuuuauugaguuauagugucauuuuucagauagucccacgaagacuccaucuuuaaaaaauaugaacagcaauuaacuguccguuuaaauaggcauaacugugaccuuucagcuggagagauugaaaggagcuuuuugaaaaaagucuaaaguggcaagugucuaauuuucagguuuaauguuuguaguccugggucaguaauugacaagugauaaaaguuguucaguggugaucuuagcagugggugacuucucaaauguuuuuaguuuaaaaaagagggaacuucuuuguucauuuauagaccuuaucacuuuaaucuauugguauuaauguccacugucacugaucuuuccauugaugaaucagagaaacgagagcaguuguguguuuggacgaaagcauuuagagggacuucugauagugaugcacugggauuuuaaacauugcuauguacauuuaauaaaguacuaauucauaagaugguuuuguuucuuuguauaauuuugaucaacuuguguuugauagcccacucuuaguguauguguuacucaucuuuguauguuuaauguaucauuaguuuuagcugcugaugaagaaaugagcuuuuaauuacaaguaauacacuauauuucaaacgguuccauuuucaagacauaauucaauaaauauauucuaucuuuauuuugucuagucuagucuuguuugugaagaacaguuugagaagccaugggccauuuacuuaccuguaguagcaaguacuuacugccuccccgucccuccccuucccucauauaaucucaguauugcuugucuuuguuuauuauaucacucguagcuuuugugagaaauuccagaauaaaccugaguuuuaaauugcuaucuuuggaguagauugguguucaguguuguacucccuguaucaucuuuaaauauuuaaauugcagacucucuggcugccucuuaaauuagauccuucacuuaguaguuuugacauuucauaaccuugcuucucaugcauuaaauauucaccuguuuaaguggcagugaaaauuuaaaauccaaacucauauauuaauccagcaaauggaaaauggagaacagauugcaguggagaaagaggcuauuuugaccucaguaggacauaugcuggaaguccauuguuuugaagcauuucuaaauagaauuugucauuuaaagcgaacucuuuugggccuucaagggaguuuagucuuguagaaccaaaaagauacuuaacacuuucugaaaauagccccuguaugauucuguaggugcauaugaaggcaccuguaagaucuaaauccacaggaaaaaaaaaaaaucggaauggagaagguugcugguaauggucagauacaaaauuuaguuugguaacugauuugaucuccagagugugaguccuuagguaacugaucuccagagugugaguccuuaucccacuaucagccuucuucccacuuaggucuaaauacauuuucuauuuauaaucuuuuuagaugaaagaagaaauguuuuccaggaagggaggauuuugaugacagcgauauccuugauaguggaagggaaaggaagcuguuuuaauuccaagaacaguaaauaaagggauagggguaggaccuugagccuuggucugggaggaaggagaaggcaauuacccuuucuuacaccuuuauuuccugaaagugaacgaaaauggcauugcuuacuccugagaauuagaaaguaacaaaaauuaauuuaaaaauucuaaugaugauguguaguuucuuugguuaauuguaauuaguggccacuucucuuuucuuagaaaaaauuacucuuaaaaauauuaauggagccgggcgugguggcucaugccuguaaucccagcacuuugggaggccgaggugggcugaucaccugaggucaggcauucgagaccaggcugaccaacauggugaaacccugucucuaaaaaauacaaaaaaagccaguguggugguacaugccuguaaucccagcuacuuggaaggcugaggcaggagaauagcuugaacccgggaggcagagguuacagugagccgagaucacccacugcacuccagccugagcaacagagugagacuccgucucaaaauaauaaaaaguggaauaacuuuuaacuaauuucuagcaacauccuguuuucugucuguggccaguuucucuguguaugccuuuaagaaacagccaggauucauuuaauuuuucccaacucagaacaagugaacugaaacacucacuuaccauaguauuauugaaggaaaacuggaugaggagaccaggacacagaaagagaaagaucagaguuugaacccagaauucaacacuaguuguguauaaccuuaggcauguuauuuaccuugucugugccuguuuccccagcuauaaaauacuaauauguaugcugccuaccucaugggguuguugugaggcacagacaaaauauuguaguuugugaaaaugccuuguaaauggugaagucucauaaugcccuaaauguaaguuuaacauuaaacauuguuaccgacguaaguuuauauauaaucuaaucacuccuguccugccugugguaguggaaaaugguucuuugacaaugucacugaaagauacuguuuuugagaagguuugucuuggagccuuuuuaauguggcugggaacuaaagauacaauauaaacugaagaguggacauuggggaaaaaaaaaaucacauaacugaccuagguauguuuucaaagccuuuauauaagcauuaaauauaaacccauuuuccuaaauauauuuuaggaugacuuuuaagacacaccaccuacacucaucugaauugcacaaagcagugaaugucacugcaugaguaaauuguucuagaacacuguaauggacccagguuucucucuacuuuaaggggcugggcauuuaccuaaauuuucagaugcauguagagguaaauaauauuuauaaugucacauagauuaggcucugaagcuuuucauguggauuagaaauuauuuaauuauuccuaauagccauauaaagaagguagaauugugguaauaggcuugaagaacuuaguucuaaguucacagaacugguuaugaauuaaaccuaguuuugagcccaggcacaccgauuagcuguuaccuuuaaccacauuuccacugccuccugugacacuugaucucaugcagagccugucaccugcugcugguugcuugaucagucauuggaaguuagccuccuuggagaauguguagaugccugcccuggagcccaugggacauggcuguucauaaugggaguacuucagucacaugaucuggaacagaguaacagcugacuuguugggugcucccuccuguggaaaaaaaagccauagaauccuagauagggaugcacgucccagcuggugagguuucaccuuuucuggauaauugagaaucuuacacgagaaaagaaauuaaguuuucauugauucauauuacugaaugcauauauaauucauuggccuuguuucaucaguuuauagcaaucccaagauuugauuccaucuaaguuacauuaaucacuugaaauuggccacuuguucuucacuuacauuuaaguuccccagucuucauuguucuuaaguauuuaggcauagagaaaacaaauagcguaugaauaguuauguauguuuucuccaccacuauuccaaauuccuuguuucuucuguagaacaggacagugcuaauauaacuuccaaacauagccuuuggaacaacagguauauuuucacuuguuaaugagcaaacgguuugaauaaagaagaguauuaaauguuaacaccauuggggcaggggugugaaagauaacgaggucuuuauaaaguaguauaaaauguggcuuauauuuuuuucuggaaagccaagaaaaaguggcaacagagagcugugggcacaauucaaauuauggggaaaauguuuggugcuucauacuaaaaguuauuuaaguauuaguguaaauugggaaaguuuguuguuaacuggauuaaagguggguaccaauaauaaaaugagcaggcaguaguuaucacuuuaccucagcaaaucaaucccagacacauugaccauuuuuaguaauaaucugaggauggcguauauugugaaauuucugucccuugaaguaggcuaguccagaauauuacagcuaaaccaaagggaaugcgaucaggaauagcucaugagacuaaauguuggcaaagauagguuauaggcagagagucaucaauuacaauuggggcaggagaucuggaugacuugaacugacccuuaaaugcucugguucaguaagccguuguggaucugcaugaucaaugggguauuauuggaugggcuuuacucaccaaauguguuagcaucuaucacaugucaggcacucacuaggcauugaggauacagugaugaccaagaaugaugugguuucuucccucacagaguuuacaugaggaaugaugauuauaaacaaauacaugcagaccuauuuugucuuucguccuugugggauuugguauaccguaucucaaagacaugaaacuuuuugaaaguacauacaguggcaggcaaaguuaauuauagggacuuaagaccuuuugaaaaucaagguuaaaaagaccuguggaugagaagacaacagacaaaggauaaugagggcuuguucacacauucaaauuucugggaauuuauggacaaucauacagcauauaucaaaagagcauacuuacugauaagggugaauuuuuuuuuagaaauguagcacuaccacccacacagaugugagaggcuagaaaacaaaaauguuccaugaauuuggaaucuuuaagcuuagaaugauugggccuaaaucccuauucuagagcagguguucccaaccccuggccauggacccauaccaguccguggccuguuaggaaccagugcacacagccagaggugagcagcaggugagccagcauuauugcccaagcuccaccuccuguccgauuagcugcagcauuagauucucaucagggcacaaacccuauuuugaacugcacaugcaaggaaucuagauugugcaguuuuuaugagaaucuaaugcaucccccaccaugguccauggaaaaauugucuuccacaaaaccagucccugguaccaaaaagguuggggaccacugcucuaggggauuggccccacagaagacagccuauuauugugaacaguacugugcuguaugcaccacuggucuguuuuaagaacuuuaaauuuuagugaauuaaaacuggacuaaagguggguacaaaugauaaaaugagcaggcaguuguugaaucacuauaccuccgcaaauugaucccagacccauugaccauuuuuaguaauaaucuggaggaugggauauauugugaaauuucugucccuugcaguaggcuaguccagcauauuacagauacucuucccuguccaccuaggggagagggaaugggaauacuacuacccauuugucuagaauuuuccuggaaaugaauaaagcaguuagcaccugacuugcuugaacuucaguguucuaugcuguucaugggaaaguuaccgaggcaguuuuugaguuucuaaagggaggugggugagugagcaugcauauacauuuaauuuuauuuuccuuuuccagguuuccuaugcucgcccaaguucagcuucuaucagagaugcaaauuuauaugucagcggacuuccaaaaacaaugacccagaaggaguuggaacagcuuuuuucacaauauggacgcauuauuacuucucguauucuugucgaccaggucacugguaaguagacagccacuccggacagucuuucccugucucugacuagcagauugugaaauauucugucuuuccauguagcagucuugcuucuagaacauaucaaagguauaugugggccagaaaaugcaauuuucugcuggaauuguucauaaauaugcauggauaaaaauagauuguggaguauagugagcgugcuugagucauuuccacccugaaggugcaggauugaagccuguuucauggcuuguaauaaauuuauagaugcuauaaucuucauuuccaagccacugugugauaaaagcccccauccugcuuauagaguacuaauaaacaaccuuucuuuugucaaaaagcgaaguuuaaugcagcgguaugcagcuaguucuccaagggaggauuacacuacauccacacugguaauugcuguucaggcuguuuuccagguucaugcugugcuguaugggcauauguaagaguuugaaauuuugaauguuaaaaauuuauuuuauuccuaauaucacuguuagcccaacugaaaugggaagacuaaaauguucauuaaaacucuugaauguaagggaguuguucugccaaaucuuaguuaacaaagcuauagcaauauagauuugauuaugaauuuuaaaaauaaaauacagauacaauuuucuauuauaaaagcaauacuuggccaggcacaguggcucaugccuauaauccaagcacuuugggaggccaaggagggcggaucaccugaggcugggaguucaagaccagcgugaccaacauagagaagccccaucucuacuaaaaauacaaaauuagcugggugugauggcgcaugccuguaaucccagguacucaggaggcugaggcaggagaaucacuugaaccccagaggcggaggucacggugagcugagaucaugccauugcacuccagccugggcaaugggcaacaagagcaaaacuccauuucaaaaaauaaguaaaaaauaaaaugaaagcaauacuuguucuuuaggaaacaguuaaaaaauagagaaacauugugaggaggaaauauuagcuguaguaccauagacugaagcagccacaugaagauuugugagguuguuuuuguuuguuuuuuuaagguagcuuuucuccucacuguuuguuucucuccccgccacccguauaauaauaauaccuuggaggcauguuguauauuacaaugucuaauucuuuuaaagcagugacuucagaagaaaauugagccagauuuuucauucaucaagugaagauccauuuaguugaucugaaucuaaucagaggagcccauauuaccugccucuguguuguuaauuggcuucauaggaagcaccaccuuuagaguucugaguagagagagcuagcacuacaugcaugccugggagaauagccuacagauuuugcugucaugagacuauuuagucaagugagaguauauaaaauacagccuccuuaauuguguuaguuaauucauaauacuuauacauugccacccuguguuguuaucacauagacuaauaaugguguuaaauagaaauccaggccuagaaauaaagaugaauuuguucaaagcaacaaaaauauuuuuuauuucauuugugcuuucuaauucauucauucugagaucuugugaauugagaguagguuucaccuaugacacaaagugcgucucaucuuuuaccugcuaguccaucacagguggaccuagcuuguuuuagucagcgguucucaaguaugucccgcaccugcaguaucagcagucuucuggaacccugcuaaaaaugcaaauuauugggcuucauucagaaccuacugaauaaaucucugagggugagccacagguuguucuuagguaugcuuaaguaggaggaccaccgauuuaggugacucuagcuguguagaggcuguuuuuuuuuuuuuuuuuuuuuuuuuuuuuugcuaaucugaugcuuuucuaauggaacagcuaaauucuagagguuauuaauucuuaauaggcgcuaguagauaagugaaaggauuugcuaucauuucacuauuuauucuucauacuuaaggcuuucaaagugaacuuacucaauuuaccugaaaugaaaaaugaaacccugcaauuuucuuauucagccaucaggugguaauaaugugcaaugcaugcucuuuaaauagaaaagguaaagugauaggggcugucuuagauacgcauauguggaaaaaaugcuuugucuacauuagaaaauucuuagucauugaccuuacacaguauuaauuuuaaagcaaguagaccuucuuucuuuuuuuuuuuuuaagcuccuccaaguaugaugguccagugcucauuuacuugccaaaaaaaauuucccugccacugcuuaucucaugaugaccagcuguggucaccccacuagccuguucacgcuaauuaaauggaauaagcuggguuucccucuacaauuuuucauaaccuggaaagguucuuggcuauccuuucccauuugugucuuucacacuggggagaauguggggcagggagugaucuucuguagucaggagugaugcugcugaggucagaaagcuuugaugcuuuacuucuagaaauuuauuuauuuuuaaaaucuacgucuuuucuuuuucuccauauaauauuuuucuguaauaaaauauagcuagucagaagcacaagagagcuucagagaacuggaagagcauuuucaggcauuuuuuuccuaaaggaccuauauccuaugcaauauuauuaagcugaauauauuauuuaaaauuucaaccgaaaugucuuucuaccacaguguauguauuuuuagcauagcuuuguagcauuuuuagcaaauucuucuuucuguucuccuuguuucaaggacaggaacuacugugucccucauuucugagcugcuuauccaauagcacaaauugaaaaauggaacuccgguacacuauugacauuaaaagaguguacgggagggaggugggagagagagaaaacauggacaugcuuguguuuucuugucuuagcugauuggaaugcaugugauaauggguacucagauuauguaagugacacgaauuuuucuaaaaaugcaaaauugugauucuaaacugaauggcuaguaaguaaaggggaaaguuuccuccuggugugauuuugugggaaauguuauauguaggugaaaacauguucuugagaaggaaaaauuaauguguccuuucuucucuccuucccuucuccuucuguucccucuuuuccaaaucuuuacucaaaucuaccauaggcauaucaagggguguaggguuuauucgauuugacaagcgaauugaggcagaagaagcuaucaaaggccuaaauggccagaaaccucccggugccacggagccaaucacuguaaaguuugcuaauaacccaagccaaaaaaccaaucaggccauccuuucccagcuguaccagucuccaaacagaagguauccaggaccgcuagcucagcaggcacagcguuuuagguaagucugguuugguucuugugcccagcuacuaaacugaaagagaauacucagguuuacuguccaguacuuuuauugacaggaucucugguuugcuuuugucaguguuguugguuuuauuacuauuaauuuuucaucuccaugggcacagagagaaucuacuugaggaauagugucuuuugcuaauauugaagguggggaccaaaggacaguaaccuacagcagugauucuuaaccaagggugauuuuugccucccagggaacauuuggcaaugucuagagguauucauguuggcacaaccugugggggugcuacuagcauguaaugcuagaggucggggaugcugcuaagcuccuacaguguacagcauagccccagcaaccagaaguuaccugguccaaagcaccaauaaugcugugguugagaaauucuaaucuguagcuuucugggguuaucugaauuguuuccagggcuucagauuuccuuuuuuuuuuuucuuaaaggauuuuauucucaugugucaauuuuuaggucaagcuguuucuguuacuucacuuuauaguaugugcaccauuaaggguauauaaccuaugugacuacgugaaguuucuacaaaugaguuccucucuuccuuuucaaaauuguuuacaaacagguuggcagacuuucucuguacaguaccagauaguaaauauuuaacuuuauggguuauggucacuguugcaucugucuuguuuuuguuuuuaaacaaccuguuaaaaauguaaaagccauucuuagcuuauagcccauacagcaacaggugggaggcagucuccauuuggccugucgguuguaauuuacugaccucucuguaguucauagaaugaccguggcuuuagcccaaagaagacacucuaucucacugacagguguacauaugcuaacuguuuaaguuuuauucugauccugggauaacaaaccaggagucauucaaaaaaucucuaaucugcaugugagaagaacagugacuuuaagaaguuaagcagagcagagaguuuuugguuucauaagcaagucaugcaguuuuuauuuuccaggacauuuuuaaauauccuuuuuggccauaugguacacuauacccagaaugcuaucuaaccccacacugauuuuuaaaaauuauuuccaagugcauaucaauuuuauuuauuucauucaugggacagaauaguuaauuaccaaaaauauaaucacaaauauaaccuaauaagaucaggaguuauguuuucuagcuuaaaucuaugcauuuauuuuuuucauuggaauauuugcagugcugaagagaguggagauaaaaucaguuaaaaauagcuccuuuuaaaaaaauacuaaauuauguugcuugagauaugagaaggaaauuuguuaugaaugccacauuaaauuucaacuuaaguuggccuuugccgugggagaagaggugguacugucaaaagcauugagccuuguacuucaugcucugcugugaggaaaaggcauugguauuaaaaaaaaaaaaaaaaaaaaaaaaaaaaaaaaaaaaaaaaccuuugccaccuuugacuucccaugguaguggugaucagacuagugugggagaugcguggggcugccugaugcuugccuuuguggagaaagaagucucacaaagaaagcccuuuuucagcucugcacauagguuuccucugugacaucuuaagugaauaauauauguauaaauauacuuuuuuaaauugcaaacguaggaugaacaagccugaaggaauuuuacagguauuuccuaggcagcuuguccaguuaauuucagagcucuuuggggccuugaaaaugaucucgaguuuagauagaacaaaguucuucauaauguauugguugauuuuuaacauugugaaguuauaaaauguuugcuguuaguggaaagcuauauuagcuacuuuuuuuuuccagauugaagcaaugauuuuguuugauaguuauuaaguaaaacaaaguucuuggaaucaagauugaauucuuaggaagauugagaagacaggauuugggagagugccugauuauugaaauggcaaggcuuguaggugacucaggugcuagguuguugaugggugucagcccuuagguuuaccuagccuccaucccugcaggcucugugcuuuuuauuuuugguugaguaaagcuuuacaggauguucuuauggucaaauuuaauuaucuuuuucuggcccauucuguguuuuuaucuuuuaguaccauauguuaucauuaacuugaaaauucuuuuuccuucacuccuauagaaagacauuuuggaagaagagaauaagagauugucaguuguaagggaaacuugguuucagaaaaugggagaaauuguuauucucucuucagauuuuuaacuguugucccauucaccccauuucucauuccucccaugaucccuguccagauaauaaaauaugaacgaguuagugugcucagagauaguguuugaucuagauuggguguguuggaagaaaucagauuucagguuuaaccugauguuugaugcuuuucuuuaauacaguauauugaaccugguugucauuaucuugauuuccgccccacucccccuucuucuuucaccugauaaagaaacuugaauuaagggcuugcuuguuuuguugguauuuugcuguuuucuguaguucgagucuaaaucaucacacagauauauuuugucccugauauuuguguuuuaaugcucuugccuugaguuuuugucaccuuucagcagacauguagaaaauuucucacuguauuuuuauguucucauaguaccuugggaguugagagagauugagcaauauaaguuauauguauuauggucaagaauacuuuuaauaaucauaaaguaugagccauaucuuuuauggucaaaaagcuuaaaaauccauguaauaaggguuaaguuuaaagguggguuugugagguuuauggcuuagucaaucuaugaauaaucagagaauuguuguaauaugagcacugcuggucuaauacgcuuauuuaauugacugcaguuuucaaaauaggacaagccuuauuuauuuggauggaugguguaauucaagccccuuaaguauauucuugggacaugauaucagaauuaaacuuuaagccaaauuuuuucauguucuuuucugugaaacagcuauaauuuuauugaauaugaucuaguguaaugaccugugugccugcuucuaugagccuuuaugcauuuuuuaaaaagccuuuuaaaugagcacuugaguugccuuuaaggcaugacguacugguugcauuaucacaauuuccuuuuggaagaaaccgguaucaauccccuugaauacuuuuccucuuucuuagaggacagaugauaccaucuaauugaauaaggcaguaaggcaguaagaagaugaucuuguuguagauaauuuccaagcaguucucgguuggcgcuuuggagagauuuugauaaucauuauuugugggauuccgaguauauuuucuuacccaucaauaacuuaucuuccuauuuuuauuucugacuuuaaucggguucacauuuccccuuacuuacauguaggccuucccauaguccaucagcuaauuuuuuuagaaauuaggcagguacuuuauuuuuauuuucuacuuaugaacaccuagcuuuaaaauaggaaugaucugauacaugguucuguucaaaauuuugacagguuauaauuggagcuuugguccuguugauagaaaaauguuuauacacaucucucuccuaugugccuuuuucauaaauuacauauguacaugggcgugugcuauucauuaaauuauaaacucuaaucaaacauaaaaaaggauaaagaugagacaaucuguauuaaaugucuugcuaauuacuauacugguuggcuucauuuuccauguaccuaauaucuuaauaaaugucuuuuaaagcaagaccauaaaauaauuucagauaucucaucugacuucaugugaugcauguuggauuaucuugugucuaaccuuauaauguagcuuguacuaagaguaggagaaauaaucggcucucccuuuccuuauuuacuuguauuucccuuacugguaccauucuuuacucugauuuacauuuguaguaaucuuuuuuuaaguuacuuuuucuuuaaauggaggucauuuuaauuaaagcagguuauccagucuaauccuccauaucugcuugcuguguuauuuguaaaauggauuuuguucaggcuaaagagcaggagagagugccacucgccgccucuccccuucgaugauugcucagucuucccccagggaggcaggugauacacaggacugagaagguacuggguucagugcaucuauuaaauauaaguaaaaaauacuuuauuuuaaauacauauuuauuuuauauuuuauuuuaaauauauauuuaauggauacuuuaauauuuaccuuccauauguacuacguuaucauccacaccccucccugagauauucuggaggcagcuagcuugcucuccauuuaaaaauugacuuccauuuauaaaugaccauaaauaaaagauggcugggcgugguggcucacuccuguaaucccagcacuuugggaggccaaggcggguggaucacgaggucaggagaucgagaccaucauggcuaaauggugaaaccccgucucuacuaaaaauacaaaaaaaauuagccggacguggugguugggugccuguagucccagcuacucgagaggcuggggccagagaauggugugaacccgggaggcagaguuugcagugagccgagaucacgccacugcacuccagccugggugacagagcgagacuucgucucaaaaauaaauaaauaaaauaaaaagauguccuugagcaguggacagacccagcagacauauuucuaggggcuuguuguaguaguccuuguguuugagcugcugcacuauuuucucuuacaacugccuguguuacaguuugccaacugcuacuggauuuggagugaauggugcccauguagagcacccguugccuuuucugagcucccaugggaaacaugaaucuauggcaccgagaaagcuaggaaauacuucugggcucagaugcauacagucagggggcuucagcagugccugggcacuguuuucuagguuccaugcuucucccuacacucguuggugauggaggagaagaaagauuagaguggauaacuuggcuuaguuccaaaggaccaauuuuuuucuaaaaugagagagaagugaaggaaucagugaagaucaugguaucauguaaaacuucacagauaggguaaaaaagaugcccuaucauaauuuggaggguccucggagauccuguuauaaaaaauucgaaaccuccugucuggggaugccagagauggaagugagggagauggaggauggaaaacgaaauguuucucccucacugcauguacagucaugcaucacauaacguuucaguuaaucacauguacgaccgugguaccauaauauaguagacugcaaaaaauuccuauugucuagugauaucauagucauccuaauauugugcaaugcauuaccuuuucuauguuuagauaugguuaaauacacaauacuuagcauuguguuagaauuaccuacaguauucaguacagugacauguuauacagguuuguagacugggagccauagcccauaccauauaacuaggugugugguaggcuauuaccaucuagguuuguauaagugcauucuaugaucguacaacaacgagaucaccuagugacacauuuucagaacauauccccauuguuaaaaaaggccugacgguaauucacuucaggggcagauuugguuucuacccuguuugaaaauucugaaaacucaucugucucugggccguaugcuugguguccugagugggugguagcaaagcaugaccugucccuacauggaugcaauuaaugggcauagaugauguaacuuuugagugaauugauaaggugccucugcauucugggucuucuagcacuuugguuggagaccucaguaugcgguucucuucuacagguagcauaugccaaaugcauucuguguugaucauuccagcaauuugauaaaauuguauuguuacuuuaugauugguggugcuaauauguguuugucuuuauugcugguaguugugauccuuauucuugacuauaaaggcauggcaucuuugacuguacucaccucugcaaaaaauaaaaccccacaucuuuuuacuuaugugcagacaaggucauccaaccaauccucuuacuaguuuucauucuggacuaaguugaccauaauuuugguaaccucauugucuuuauuuggucaucacauauuuauuauaaacuaucagugacccuggcuugugcucaguggugcaaugagaggguggugggucaaggcacgcacacacacacacgcaccacgcacacagagacacacucacacacgaagaucuuuugucauugugaucuguucuguuuccuuacacuuugcauaagcucaguucuucucaucuuuacaaaacagaauuuucaguggagacugagggcagggaugugggaggcuauauauuuccccauucugaaagaccagaugagauguguuuuggcuuuuacaaaacuaaaagguguuggcuuuugcauguauacuuuagcgugacuugaugccacagguuaggugauaaggcugagacuuuucaaacuuaccuuucacggguguuaaagaaaaaauucucacccccacccccagucccagagggacaacccugggaugucuuuggagaguguugagcauuguagcaguugagggugguuguggacuauguauuaaguuaugccuccuccucagaacacauaauuaguugguaagcacuguggaaauuugggacauuagagugguguuuugaaacugauaaagaagagucaaaugcuguaaaacuaauauuugauauaggaaaaauguagaagguuuuaaagaguacuuacaccuccacccccaccccuauuuacuuucuauaaacauuuuaagugaggcucagauuggcuuguuuuguuuccuaccuggccuuugaaaacugaguaggacgacacuuccuguagcguaauuugaauacagcauccagaucaggaucugaacucuuggcuuuguugcacacuggagugauggauuuuucuuuuuuccuucucuagaccucagcugagcacauuugagaaaugggaggguuagcuuggguuguccauaagguuuuuucuaccuguaauuauaccuccuugauucuaaaagaugaaagcccuucaaaguugggaaaugaaaggaaaauguauagaauucuguaaccugcagaguuugaguaucaaugccauaauuuacuagcccuguggucuugagcaagccacuuaaacccugugugccuuagguaucugcaggcaccaacagaguugugaaaaucaaaaguaguauaaagaacauguagcuauacauugaucacuuugaagcuaccugaugagaacccuaaaguuaacuaucccagagcuuucgcacuuccucucugaaagguauccucagaugaccgucacugugucccauguacugacccuuguagagagaaaccauucauuggaagaacuguccuguggcagucggugcccauuagcuuaaaaacguaaaaagacccagcauucugagucuucacauauaaucaguguacagauauccccucggaagauggcaguaaugagcccaacuuucuugaacaucaaggggaaaaauuaaaaacugaaguuugcuaaauguguguuuugcagguuggacaaucugcucaauauggcuuauggaguaaagagguaaugauagagguucaugauacucauaaucccuuuccacaguugauugguuucuuugauuuugggagugcuauucacaccccucauaaguuuuuguuggguuuuauuuugcaugugcaaccuaaugaaaagcugcucuuugaagcacaauugacucaagaaauuuuuauaccaccggaugccaccuggucuuuuaaaaacccaucauuuguuucguauugcguuacgacguuacagcauguuuacguauguguugaucccuuccccugccaauccugcuuaauucaugaagccaguucuaaauauauuucuuugcuauuguggaugauauucaguacagugaauaauggucauuucauaacuuauuaauaucucaguagucuagcaugucacugcaaagccacacacagaccuuggucaaaacaugaaauaguuuauauauuuguugggggaggagaguuacuaaaauucuuggggauggaaaagguauacguucauugcuauaaccaaccucuguuuuuauuuuuuguguguauguguguauuuccuauucuguuuagcagguuuucuccaaugaccauugacggaaugaccaguuuggcuggaauuaauaucccugggcacccuggaacagggugguguauauuuguguacaaccuggcuccugacgcagaugagaguauccuguggcaaauguuugggccuuuuggagcugucaccaaugugaaggucauccgugacuuuaacaccaauaaaugcaaagguuuuggauuugugacuaugacaaacuaugaugaggcugccauggcgauagcuagccucaauggauaccgucugggagacagaguacugcaggucuccuuuaagacaaacaaaacgcacaaagccuaaugagcucuuguccucaguccauuuauauaugaaaacuauacaacaaaggcaaguuaagagaaacuuuauacauuaguaaaugucuuuguaagucaguguugagauggggauaaaaugacuacuuagcauccuaagaaauaugugagauuuuuuauugcuaguauuugaauuaaaacuucuuaaauaucuuuuauguuugaauauggacaagagguacaggguuuuuaccugucacauugcauucuauugccuucuuugaagaagguggaccuuuuaaaguguuucagcuaagggaagacauuucuuuucuuuuuacauaacugccuugaaccugugaguaaauauugaggcuuuguguuguaauucuucaguugguugugucuuuuuuuuccccccuuuuuuuccuuuuucugauuagcuuuguguuugguuuacauuuaaagcauugcuguuaugucuguuuaagaaaaguauuuugaaguuuacauuuuuauuuaugaaguuuaaaacaguauuuauuuuguaauuaugauuuggguuggggaagggggggcuacauuauaaacgcuuauuguaagaauacuggagaacuuuucguaaagcaguaccuugccaaagagauaagagccucuuugauguggguuuaaaaaaagcaucuauuuuuauaaaaaagaaaauuuggagaaacuuuuuacugguccuggaacaaauauuuugacuugaauacuuugagaaaucucuucauaugacaccuagugagcuuuuaaaauuuaccaggaaauuugcagcgguuggaaaauuuagaaagauuuaugguguagaaaauacuuuugagaucuuuguaugaaaggaguagaaucaauggggggaaacacugcugguuucauuuuuguaaucaccaguggagcgucugaucauccugguuauuaugugauagguggcucacauugauuugugauuuugaaacaaauaaaaaaaauuuacaaaagaauauauaagagcaggcaagaaauuuaaauuaccgagagaugggggaaaaaaucuguucuuccuaaagaaaucccuucagauagagcucaugguguuuagugauguacuugcaguauuguuugaagaauuguuuugucuuaaggaaaaaagacguugcacaugauuuguacugcagcaaaucagcaaaagugaucugaguuggauauauuugaagguauuuugaaaguuacguucaaggcuaacaccugagcuuuguguaauguaaauaagaccuuguguuuaugaaccuuucagcuaauuuaauuuuuuuucccuuacaugccaagugauguucagguuuugaauguuuuuguaucaguuuuuuccuuuguaaauggcauuaacauuguuacuugaggucuugcuuaaucacuuuuguuguccugaggacuugaauuuacagugcaucagauuuguugcaaauuuugucuguagauagucuagcuucagcuguuuauggugaugcuacauuuugguuuauaaauauguuugugguauaaaaaaaugaguauaaccauagguuuugaacaaauuuccuuacauuuuucauacaaaaaucauaaauaucuguaugcuauugaaauuuaacuuuguaugaugcuuaaaaaccacuauuuggggaaauaauaaaauaagucuuuaccauguaugaaagaaauuuuaaaaaauacaaaauauuuucugauuagcaucuagcuuauaauaaauuuucaaaaaagcugaaggcaaaaaugccuucaucaggaugcacugagaacuauauaguuacguccugcuuuuuguauaaacugagaugcucacaugcuuccccuuagaacaggcaaugugcuaugcauaacauaguuguacauuaucuuugcgguugcuuugaguuuuauuuuuuauuauuuaaaauuguaguuauaaaauuuuucaguauaguacaguacauauacugugaggcgcgugcuaaagugaauaagcgaguuuucaugcugacccacucaaugcuauucagaaaucaauuggcuuagcacuuucucauauccuuaggugcauuuagauugccagaguuaaccuucugcguuuaaaaaaagaaaaacacuaaaaaauaaaauacauguauauacuuaaaaaaaaauaauaagguuucccucaagggaaaacagcagcuacaugcuucuuuccuauacuacuguagcaaaccaaggcauugaugagagggcaugcaaauugugcuucacuuuacaguguuuuaucagagcacuuaauaaaauguaaggcugguauuuauuugaaguuguacaguaugacuuaauucacaucuguuggaauagaaaauauauucuguugaguauuuaagaggcuguacauguuuucuuuuguguuuggauucuuuguacuuuuucauguucaguacaucaauaaacaaaguugaagggaaagaacaguguggugaguaggucuuuauacacaauucgggggcaccugugcucagucuaauaagcag

SEQ ID NO: 14022 - RNA, 1447 nt, Homo sapiens
ucagauaauuuuuaaugcaccagauuuauuuaccauuucaaaagaucacgauauaggcagauaccuuaaaaauucucugggggcaaacaaaucaguauauauuagauguacagggacugcagccaagacaggcaugaguuccuagguuauaaauaucaucuuuauaaaaaguggguauuuuauaggacauccaaguaacaccgacuuauaaaagcaaacacuguacuuaaaauguuggccacauaugaaagaauagcugaaggcuuuaggggauugaagaauggauaaacucaaccaacuaaaaacacauuacucaucccucagaaccaaaauacaggaaaaaaaaaaauacaacagguucgcacaacauccagaaaaguucagggaauaugaaguguuucuuggcacccaguucucgcuguuuuaaaauccgucccuucguuguuggcuaggccucucuccagggaaacuagccggggcaagaggcaggggaacuguacaugugggagguccugagggcccuugcacccacucgaccuccaccaagcggauggccaagcgccacccggaaguguccacuggugggggcgggaaggcaccguaguccaagguauccgcgggcagggagcgggccagggcgugcgcgaggucggggguagcugggaacggaggaggaggggcccgcucgaggcuccgccucucaccggcugcggccucggcuacagccagggcccagagggcuccgagucccgggagcggaggccggagucggguuccuguagaggcugcuccuccuuguccccgcucggacgugguccccgcugcucgaggugcagcugcagcagggcccggcgguacauggcuuccagcuucucaagucgggcccucagggcccuggggcugcccggcucguccucucggccgcugucucuagcccuccgguucgugcuggccucuucagggacccggcgugccuccgcgggcgucccguugccgccuucgccggggagccgcaaagccugacggaagaggcugcgguucucgcgcuucagccgccgguucucgagccgcagccgggcguucuccugacgcagccgcgcguucugccggucccacucgucccgcgcacggauggccuccaaguggcucgccgccaggucggcaaaccgcuccuccagcugcugucgggcgccguccgcgcggccucgccagcccacgccgccgccgccgccgcuggggcugcccccaccacgagcccggccggagcggccuggcccucggccguccgcagcaccguccccgccgcagcaacucccgcgccuaguggcgccaccacgcaugcgccacaucggucccaucccaaccgcgccgccagccccgugggcugaggggccgcgcggccaggcgcgggcaaguucggggcuggcagggcggccggggugacgac

SEQ ID NO: 14023 - RNA, 45374 nt, Homo sapiens
cgggaucucucgggaggacggacggggucaggucccaucauggcggcugaagaggcggauguggauaucgaaggggacgugguagcggcggcgggggcacagccagggugaggcuuagagaccgggucucucuggggcggagaggggaguggauugaaggagcgggcccugggaaagcugcagguccggcaagggaaaagggaacagaagacuguccccugggccagggucucuuguuggccugggaggcaccucgcccgccggcuugucccaagcccagcgggcagggcgguuaccuggagcucagguacuccugggucgcuuucaccuuuugccggaugcugugagggcaccgauuucgccuaccacauugcguuugauuuacauuuagauuccuucuuccguucccuccuuuucaggaucucaucgacaguaacuagaacaagagcggcuacggacgagaccugaggucagggacucuuguucuauggcuugcuagccgugugaccuugggcgagucguuucaucccuucuuccacauggggauaguuguaaaacuucccgagaagcagguugacuuaaaugggccagguuuuagaguuggacaguucuggguuuuccuucugcauuugcucgcccuaccaguuaauagcaaugugaccuugggcaagacacuuaacuugucugagccucagacugcucauauuuaaacugggagucaugauauguaauugggaggaucaaaugaaaugauuaugagauaugcuuuagcauacgguaggugcccucugaauguauucuuuaccauccuguuacccucggggacaguacugugagaauccaguaagggaucacauuuuuuaaaauaccuguuccagcagaacaaacagcccagugugauuugacacagaaccuccuuugacuccuugcuuucugaaucaaaaaugagucuccuuuuagucaugaagaguccuagacuagccaggaaucagaaagccugaguucuaaagucagccagcuauguuguuuauaauuauguacaauuuccuuagaacuguauuagcuugaaccauaugaaauugccaauauuuagaccauuuuuguucuauaaagcggcaacuucauguaguucagccuaauauuagggccucugugaacaggggagaaguacuaacccagcgcuugaggcacuaagauaguguguuuagaaguguaucaugaacucuaaagcccuauaaagacgugaggggugauuaaacucauauggucauugucccucaaagcuuugcagaugaguagggagcccuuaauaacaauacuuguugacauucauuuaguguuuaaaucuugaccaagugcuuuugcauguuugauuuaauuuacuuuucgcaacaaguuaaugaaauagguuggcagggauacuuaucugcagucuagaaagaaaugagcuggccuuggaaacacugaagauuggucaccugagggcauuggcuguaugcuucuuccauagauuuaucuuucugauuguguuucauuuuuccccuuuucucuuucuuccuauuuuaguugaggccuaggucuacugguggcacuugugguaacaagcaggauuacaaagguuauugguuccugaugaugguuacaauuauugucuuauacaaccccaaggaguaucauuaauauuauauucugggccaggcaugguggcucacgccuguaaucccagcacuuugggagaccgaggcgggcagaucacgaggucaggagaucgagaccauccuggcuaacacggugaaaccccaucucuacuaaaaauacaaaaaauuagcugggcgugguggugggcgccuguagucccagguacuugggaggcugaggcaggagaauggcgugaacccgggaggcagagcuugcagugagcggagaucacgccaccgcacuccagccugggcaacagagcgagacucugucucaaaaaaaaaaaaaaaauauauauauauauauauagucugauaaauaguguccagugguguuggagcuccaaccguauggaauuuagugugaugguacucucugaaguauguaguuacaguugauauuauagcaucugugaaaccguugagaauuaauuuaauagacacuuuuaagcacuugguaagugcuagaugucaaaguuagaagaugguauugaaacuuuuggguuggcugggugcgguggcucaugccuguaaucccagcacuuugggaggccaaggcgggcggaucaccugagguugggaguucgagaucagccugaccaacauggagaaaccccgucucuacuaaaaauacaaacuuagccaggcaugguggcaccugccuguaauugcagcuacuagggaggcugaggcaggagaauugcuugacccugggaggugaagguugcagugagccgagaucgcgccauugcccucuagccugggcaacaagagcaaaacgccaucucaaaaaaaaaaaaaaauuuuuuuuugguuucucuucuacuucuaccauucugucucauucuccuuuucuuauguucuuuacuccuaguguugcaaggaguuuucucauuggacuuugauucacugaccacacugucccucuuaagacuucaacuucucuuuguuagguugaaccauaugaaauuuuaccaguguuaaaccauuuuugaccugccagcugauguuucccgaaucuguuaccaacccagaucucucucuuaagugacagauccauuuauccaguucucugaaucuaucuguaccuggaugucucacaagcaccucaguuucaccuuauaaauuuuccccaccagaucucuucacuguacccuaguuuaguaaauggcaccuacacacacccagucacccaaagcacagaccuaaacuucaucauuccuuaccucccuccuucuacuccucuacccuaucaguuauuuagggcuguugauucugucuaaauaucuucucaacuguauucacuucuuccuguucacauuguccuguagcuauaaguuauugucaccuuucucuaguauuuuuaaaaucucucccucuuaacugcuccucgucuccuuggccccauucuguucuagucugaagucagaguaaucuuucuuauauccagaucugaucauauuauucucuucacuccccaguugguuuuuugauaaaauccucauucuuuaacuaccagagaucugagugauccacgcccuaccuaccuuguucauuuaguccaacaaauuuuuauugaguaccuucuacaugccaugcacugauauacaacaguguaucaaaaccaagucugugcucucauagaacauucuuguuagauaacauagacagcaauccuauauauaugucagauggagauggguggagaaagauaaaggaggggaggugaaugguuugucagcuuuaucuuuuacauuuauccaggaaaauuauauaagauuggaaacuacaggaccucagagguaguaugaaaauacuggaaggacuggauuuggaaaaugggagaaacagcagaauuagggcagauuaaauggggguugugaagaaaauggucaggcuuggauuucuggcuuggauaacuacggagaugguggugccacugagugagauggugaacaauagaagaguagcagauuugggaggaaaggugauuucaagcuuuaaacaugcuaauaugugguaccuauggagauucagguagagauccagaaguagcuaccagaguaugaguguugcugauucuucuuauugaggaauaaaaagauuucuacagugaauuugaaaugauagugguucuauuuucugaacucuuggcagaccuaguuacuugagcaaagguuucuuugagcugauaaaagucucagaauccuuuauuuacccuuccugguagccucuuccagaucauaguugacauuuaagauuaaaucuauuuaccaucaacaguugagagaaaugauugcuuuuagagaauaguucauuagccccacaauuuauuauaacuacugccuaauuaaagauucagauuuauaagccuguugaaagguuuuugcagucuuagagauggaaaauucuuaucacuagacaaggucuagaaaaagucaauaacgaagcaaaauauuaaauuuauaucauggauugagccccccaaaacuuacucagccuuuucaaauaugggguaaacaauguaacuuuaaagagcucuuaggagcuuaaugaaacgagugagauaauuuaaaaaguuugaucucccauggacauugaaaagcguccaaaucaaauuaauuuuuuaaauuauaugaguuguuauuaaaaccacauuuuucuuaucuauucacuguacuguccuucuuugaguauuuucuguuuugguucucucaucuaguuuuuuuuuuuucuuucauuuuauagguggugcuauugauggugguuuuuauaauuuagauacagcuaaaagguuuaaucacaaaguugaauuccuguauacacauggguacugguacuaaucagcugaaacugcauuguugguucaagucacagagcauguugugauugcugcuuugggguauuguuuuccucaugagauuguuuauucucgagaaccaaaagaagugagcagucagacuugauguuucacaauugagaugggguagcuuagcacuaccacguguuucacaggccaaagagguagagcaggcauuuccacaauguuaaaucuguuuguuaaggggagaagggaacuaaguauuugcuuaguucccuuacuaccugcuggauucugugcuguguaaguuacauucauuaacuaauaugauuuucacuuauauacucauuuucuuaauuauuacagaaguggugaaaauacagcaucaguuuuacaaaaagaucacuaucuugauucaucuuggagaacagagaauggccuuauuguaaguauuuuauaaaaauaucaggugcauuaagcuguuauuuauugccuagagugcuucuucuuuuuuuuuuuuuaaacuuagugcuaguucucaacuaucacagauauaauauuuuucuuuuuuagaaauuuagaauuuuuuuuuacuuuaaaaauagaaaccucuuucuuuugacauugaaaaauggccuguugagaaacagguuuggagccagcuagauuuagguacaggucuuugcucuaccacuucucaaauuugugaacuucaguuucuuuacaccuaaaaaagugguaggugggcaagguggcuccugccuauaaucccagugcuuugagaagccaaggcaggagaauuccuugagcccaggaguuugagauugcagugagcucugauugugccacugcucuccaaccugggcaacagaaugagacccggucucaaagagaaaaaaaaaaugggauugucacagggcuuauuucuucauguaguaguuacuuuuuuuuuuuuugagaugcagucucuuugucgccaggcugaacugcaguuucgugaucucggcucacugcaaccucugccucccacauucaagugauucuccugccucagucucccgaguagcugggacuacaggcgugugccaccccgcccagcuaauuuuuguauuuuucauagaggcgggguuucaccauguuggccaagcugaccuugaucucuugaccucgugauccgcccgccucagccucccaaaguggugggauuacaggcgugagccaccgcgcccggccauguaguaguuacuuauugaguacuuacucggugccagucaguaggucaggcuuggagaauacgacuacaaugaagacagacguguuccugcucucaagaaguuuauuuucuaagagggaguuaaguaauaaacagguagacaaacuaauaauagauuuugaaggaaauaagcaagaugcugaaugagaguaccagagugggaaaccuaguuuagauuaaauugucagugagggaaucucagaggaggugagauuuaaguugaaaaugaugggaaaaaggguagauaugugaacaguuaaaauaaaauuauaggcagaaggaacagcaacuacagaagcucugguugaaggccagugucuagaauauggugggaaaggaaggaguggcagcauguggcaagguuggagaggcaggcuagaguucugucaugcaggacuuaugagucggauuaugcuaaaggguuuacauuuuguuuuaaaggaacugggacaucauugaaacauuucauauagauuuaauagagauuagcaaauuuauuuuuauaaaauuaauuuuggguacugugguaaagauuggagggaaguaagaguggaguuaaagggaccaguuaggaaacauucacgguaauggaagcaagauuugaugauugggacuuggccugagguaguagcagaagagauagaguagauagauuugaauuauauuuuggagguagaacugguugauagauuggauaugggcaucaaaggaaaaggaaagaauccacaaugauuccugaauuucuacauggaauaacuuagugaguaauagugccuuucguagaguugggaaugcagagggagaagcagguggagauaagugauggugaguucuguuuuagauauguuaaguucuagaagccaauuagauauccaaguagaaaucucggaugggcuguuggguauuauggccuagagcuugaagaagagauaugagcugaaaauacuuaacuuggagcguugaaaaugaguaggaucauggagauuguaacugaggaaaaaggagaguuaguggugaguuuuggaaagagguuaagugucugacagagugucugaugccuaacaaaugauuccuuuuuugaauggcgauuauuaccucauccugggcaggagcaugagccugggaauccaacagacucagguguaaagucucugcucuuccacuuaaaaugcuaguagugcugugguugcuucuguaaaguauuaaugccuaucucaauguuacugugguaaucaaaaauaugucugugugcucaguaaauggugacugucauuuauaaucauuauaacauguauuuuucuuuaccaaaacagaagauaauuucaaaaagcaauaaauaaaaagacaaauauauucucuuuuuuaauagccuuggaccuuggauaacaccaucagugaagagaacagagcuguuauugagaaaauguuguuggaagaagaguauccuuuaaugauuaugaggaaaguacagguuucagggugaaaaaaaucuauaaaugcaaaauuuacaagaggccacuguuuacuagauggauuuuauacagcaccagacugcuauuauauaauuucauguuaccuauguaugcaaaaagcagcauuuucuuccucagguucuguuuuacuguaacaucugagaucugauugcauauuuugaguuucugucacuagccaacuguuuaugauaucugaauauugaguagaaaugauagaauauuuaagucauuuugaaccuuaaguccaagcuugcauuuuuaaguuauauaagcugaaacccagagauguuaauuuuccaagggcacagaguuggaacauguaaaaguucuucucacuucauaauuuacagguguuacgugggaggaaucuaaauaaaaagcacaaaacaaauacuauagaaugaagauguuuucccuacauuuguggauccuuauuuauagcucaguuuucguacauguaaaaggagaggauugaaugaaaugauuucugauuuuaugauuuauaaagauagcuagucauagucuaauaaguagugguuuauuaaucuccuucaucuucauuuuauggauuucuccuuacuaagccagaauuucucuguucccacuauuuccacuuauugccauguugauuuuagagugucucuguaccuuuaauuaucauagguuaaccccauuuaggcuuucuuauucucuaauucuccccagacauugcaguuauagccuagauuauugcuauucagagaaagucacauauaauuuaaaauuuuccgauauccucauuuaacacaaaggaaauuaauuuuaacuauauauuauauaaccuaaaauauuuaaaauauucucauuuuaacauuuaaucaagauaaaaacauuaaugagauaauuuuacauuuuuguacuaagucuuugaaauccacuguguuuuguuuuguuuguuuuuugagacggaaucucgccuugucacccaggcuggagugcaauggugcgaucuuggcucacugcaaccucugccucccugguucaagcgauucuccugccucagccuccugaguagcugggauuaugggcgcacaccaccacaccuggcugauuuuuuguaucuuuaguagagaugggguuucaccauguuggccaggcuggucuugaacuccugaccucgggaucuaccugcuucggccucccaaagugcugggauuacaggugugagccacugcgcccggccaaaauccacuguguuuuauacuuagaguacauccuaguucaugcaaauaguguuuccacuggucagaaaccagcgaugcacaugugguugguggccacugucuagauaaaacacuuaaguagucagugguucacuucuagauauggaaacaaauaaugagaguaucuuuguucucagcaucuauaccuagcauaguaccugacauaugcaguagauagccaauaaauacuuguuaagugaagaauaucucaggcuaaucuuaaaguacuucaucaggcuaguuuuuuguuuuuguuuuuuuuuuuugagacggagucucgcucugucgcccaggcuggagugcaguggcucaaacuuggcucacugcaagcuccgccuuccagguucacuccauucuccugccucagccuucugaguagcugggacuacaggcgcccgccaccacgccuggcuaauuuuuucuguuuuuuaguagagaugggguuucaccguguuagccaggauggucucgaucuccuaaccuugugauccgccugccucggccuuccaaagugcugggauuacaggugugagccaccgcgccuggccucaucaggcuaguucuaauaacuuuaagagggaaguucucugguagauuugaucuaaauguuugcaauuuuuauuaagguagagaagauccuuggauucuucucuguuggcuuuagaaauguggaaaauuauucccgaauugccuuggacaaccaaccaaguuuaccuauuacauucuccauauguuuuggaagaaaauauuuaaaccaggguguccagucuuuuggcuucccugggccacacuggaagaagaauuuucuugggccccacauaaaauacacuaaugauagcugaugagccaaaaaaaaaaaaaaaaaucacaaaauaaucucaugguguuuuaagaaaguuuacgaauuuguguugggccacauuugaagccguccugggccacauguagccugcaggcagaggauuggacaagcuugauuuaaacauggaggcuguuucuuguagucacuucuaauugggaagacaagggaacuauuaauaacauuuauguagcacacguuuuguauaaguaauguaaaaauuacaugacuguaauauuguuuaaaaaguuuccuugauaguuacacagauauuauuuaucuaaaaaaucacaaccggaaaaagucuggcuugaucaaaaggaagaugauaaaaaauacaugaagagguaaaaucaauuuauaauauuucuaaaagucuggauuguaguuuuagaaaccucacacgcuuccuuauuuucuuuuuucaugugaugcagucugcagaaaacagcaaaaaucauguauguacuuauauuuuauauuuauaaaucuguuuucauuaguuaaaaauuauggaauaauuuuuuuuuaauuauaguuggccuguggaaaagcccucuugaccuuaaaguagauauaaaaacaguuuuuuuaauaaagauguuggaguggcacaaguauaauuuuaugguguuauuuacuugccagaauuucuuucauggcccuauguaggcaauucuuucagauugugaaaaauaugguuguccagggguuuauggggaaauuuugagaagcuguuaugugauauauuggaauugacuugauuucuuuuacucugucaguuaauuuucacuuauuuucaacaaaauuuucauuuggauuuguggcuuucaaaaauuaucuggagaaauuaacuauuuuaaaaauauccuuucccuauaauugaaaaaacauuauuuagcauuuaugacuuuggaaguuuaugguccuuuaaagggugguuuacguauuugcaauugcccaagagguugaguacugagcagccuuuugcuuuuguauuuugcugaauaaacaaugaaaugaaguuaacaaaaggauuaauggguugcuuaaauuagugagcuucaucaguuuuauuuuuaauuccuugagauaaugaauuuuaaaagcaauaaauacaaugcuguaguuuuugacuucuuuucuaaauauuuacauggauuuacaugaaagaacuaaagagauaguauuuguggaaccaauuuaaacucuuacaugccuuucaggauuugggaauguauuaacaccugcugcuuuguauccagucuaagggagccuauuuguuuguuaucacauugacuuccuuugaugucuuuuaguguuacccucacucagacccaaggauuaugucuuuuggggcucccaucauccugagcuagagacacgugacaggguaaaucucugcccccagguagaggcuguagccuucuuguuuuguuuguuuguuuauuuuuaauuccuagacucaaaguauugaauuuagcccauggcuaucuauaaccuuuaguuacauaaauauggaauguuccauuucagaaauuuuuuuugcaauuccuuuuuuuccccucaggguacacucuccuacaaaaccagccaguuacucaguaaaguggacgauagaagaaaaagagcuguuugaacaagggcugguaaauagagcaauuuuaaauuuuuaguaaaauaauucuagaagcaaauauugguaaaguuauaagguuaaauuaauuuauagagaccugaauuuucuuuuuaauuacaguuuuaacaccuuuaguucuucuguaguuagaguaaugauguuuauaguguagugcaagagaauuccuuuuaacuuagaucuaagguacuaaaauacuaaaauagauuuagaucuguaguuuucacguucuugugguauuaucaaaauccaagaaauugagguauaucuguauacaugacaccaacuaccuggauuaaaaggcaaaauuauuuaguaaucucuuuuuuuuuuugaaauaaaauaaaaacuuguauauuugaaacuguuggggugaucagcugaguuuuuauucagauaauuuggcauuguauacacugucuaaauauuucagcgacucuaaaugaagaccagaaacauuuuuuuuuugcgugaaugucuauuacacugaaaucuauuuaaauguucacaaguugcauaauggaaaagauacguauucugguuucuaauucugaaaauaccccuuaauaugaagaaacuuuaaaaaaaaauacuuaggauuuuuuuuuaauuuuuuuacuaucaagauuaguuuauaucuuuuccuuuaaggugcaugauaccuaguaauguucuaaguaauuuugaaauuauguauauuuauacauuacauauauagaauauuuguauauauaaaauuuauguaugcuaauugaaguaucauuaacauuucuacagaugaugagaauaaaauguuuguguuuguauuuuagucaacaccaugagaucuguauacuguaugauauucuuauauaaauauauaaaugaucuugagguuuuuaucucuucaagacuuguuccuauacuggugauuuuuuuuuuauauugauauuucaguguguuguaugauuaucauuuauaugaucuaacuuuaauuaaucauuuauuuaagauuccuaacaacuuugguguuuugccccuuaucaaagaccagauacauaauguuaggucuuaaagaggaggugaggguuaaagaaagacacacacacacacgcagaaggagggcagcucagcagcaaaugcaggcuuuauguccagcauaaaaccuacagaagugggagaccaaccuaaugccagagcccgcugcugcuuauagccuggggcaauuuauagguaucggcagaagaggucugggcaguauggcuugcugcccagcaggacauugauaagauguucccaugaugaggcaguucuggcccuuguuccggcgggaugucguugugguguucagguguuuuuuggaccuuugucaagcaagauaggauagggauauuucuuuaguugggccuuuguuugucuuguagucaggugguuaggcaggauacuucucauggccugaaccccugugaaauguuucacuucgacaaaggucugcaaaauagcagggagcuuacaacauggugcaguuuguacuaacauauaugcuuacaucugcaaauagauugaauuuaagguucauuuuuggguuguuauuuuuuauguuggugguacuuauggggacuacauuugcaugguuuaaaauucaaaagguuccuaaaguuauaggguauuaagucuucucacucucaucuuagccuucaguucgcuucgcccgggguaaccagugucuucuuuguguuuucuuccagagauauuuguccauauauaaguaaauauguauuuauuuauauagagauauguagaccucugucuauuuacauuaagggagauuuuaaacuuggaauguuuuccuacacaacaagcauggaauuauuaguuguauuuucagcuuuuuuuuaaaccauugauaaaguuugcuuacagacugaauucucucaggcuugggaguagggacuugggugguacugauugaugaagaaaggcuuuuuuccuucccuuuuuugggcaugggacucucccuuugcucuauuuugaaacuggugaauauuuucuuugcuccuuuuuuuaucuucuuuuuuuuuuuuuaagaaacaaggucucguuaugcugcccaggcuuugaacuccugaguucaggugauccccuugccucagucuccugaguagcuaggaccacauacaugugccacugugccuggcuucuuugcuccucuuguucguguucuuuccccaauuuuucuagugcccaagucccuacucuucuacuaaucauaucuuaauccagaucuguccugucuccacaaaugcuccaugcuaccuaccaauguuaucuauuugucuucaucccacaauaaagauaaguaguuuuucaucaaguugaucucagcuagguguuaagagcaaucuuaaauaauuaauuuauauuuacuaauaauuuucagaagcacuuugaguuuaagaaauuguccauaugucauauuuucuaaugaguaucagaaauuuacuuaaauuaagguuuaucacuugggugagaucuuugaaaaugauuugcuaccguaaggcaugacugccuggccuguaaaucugacaaaacuuuuccuaaguuguggcuaguuuuuuguuuuuuucauaguuuuaagaauucuaaaaauauagaauuauuuagcuaccuuaggaaguagagaauaucuuauguuggggauauugcagagaggauuuacguauuaaauuauaguuagacuugauaccuaacagucccuuuuagcugucaaauuauguguuccuuucugugcuugagaacacacaggagcucccucaaguugucauuuuuuuuuuucccuccacagcuucaguguuaugacgugcacagccuuugacaccuggaugugggaggugucagaaggcauuaguuggaggguaggcaacauagugagaccccaucucuacaaaaaauaaaaaauuagcccggcaaaguggugcguaccuguagucccagcuacugggaaggcugaggugggaggauugcuuaagccuaggagguugaggcugcaugagccgugaucacaccacuguacucagccuggguaacagagugagacccugucucaaaaaugaaauaaaaacugacaacgacauuaacaggagaaaaccagaguuuguugaugugugcagcauauacauaugcaagagaaacucugaugaguaaugaaacggguaguuagaacuuggggcuuauaacaucuuaacaaagaagacauuuguugcaggacuuccucauuugugauuuaaucgauuuagucuuuuaggucaguucacugugauaucugauagaguaaaagucucugcugugagauacauaauggauauugcaaaauagggaaucugaguuaaaaaaaguguugaaauuagcacagaacauguucaguugaucguauaaauggaaaauguaaccuguaccccuuucaggcacuuauuuauuuuaaaaaguuauuuuagauauggaacauuauaacuuacaauaugaauucauucaguuaggcaauaucuucauuuagauagcuauucuuuuuaaaaaggaguuucuaaaucauuuccaucaguuuucaguaguucagauuccaaaagaaugaauguaggcuuugauuuuaagagcauagucuauauagaagacuuuauugugugcuucagaaaauaaagauguauuuuuuuuuaaguuuuuuuuuuuuuaaugugguaguggcuuggacuauucuuaaguaaauucaucaaaagcaauuuuuuuucccauuuuaauaauacaggcuaaauuuggccgaagauggaccaaaauuucaaagcuaauuggaagccgcacuguuuuacaagugaagaguuaugcaagacaguauuuuaaaaauaagguaagcagaauaucaguauccugguuaauaaugauaauauuuagaaaaaacuaagcagaaguauuucuuuaauucaggcauuaaagucuuacugguaaaaguuuuuaaaguauuuuauacccacauaguacuauacaaaaccucagaggauaucuucaguguuuugaguauugccauuaaauagguaucauguuacucuauuuaauuuuauaaaguuaaauggacaaaauaguaauugcucaaaaauauacuauaaagcaaauuguauuucaaagagaaaaccuuagagaucuuaucuuauuguuuccucuagaaaauaacuuuuccuuuuaaaauauuuguguuguagaaacuuuuaagaauuauuagagcuuacaggagguaaaugcuauccugacucugaaaucuguuaaauagcuaugaaauuuuuacaauuguuaugaaaaauugucugaaacuuuaauaaacugcaguguuaagaaagguuuaauugugaucugguuucuuaaucuuucaaguaauuugugcuauaugcaaccaugucguuuugauauuuagaauuuuuuuuuuuucuuuuuuuuuuuuuuugagacagagucuugcucugucgcccaggcuggagugcaguggugcgaucucggcucacugcaagcucggccucccagguucacgccauucuccugccucagccuccugaguagcugggacuacaggugcccgccaccacaccuggccaauuuuuuguauuuuuaguagagacgggguuucaccgugucagccaggauggucuggaucuccugaccucgugauccacccgccucggccucccaaagugcugggauuacaggcgugagccaccgugcccggccuagaauuuuuuaauauauccucuuugaagccuaggaacauaauuauauaaaauugguaagugucuugagugaaauuugauauuaucucuucauguagauaaugaguucuacccuguagguaagauuuguuucgguguugucuagacauaggugguaacuaauggaauggauucaucauacaucgauuguaugcuccaucuuucaaccaaacagaagcauuuucaaggcagcucaccaggguuuaguuaauaccucagaacagaauaaagcuuaacuugguuauucuuacucuuaggcuuccaagauacaugcuauguaucuuggagugccaguuuuacucaaagaccugggguagaaggauacauuuuucauauuguaacagagacuaguauauuaugaaaucaaugcaaaauuucaucugaauuuuuaaaauuauagacaggauacuuaaaauaaauagcagggauguuaaaagcuguuucaggcaauauguccaaaucucuuucccuccugcuacccuuuuauucucuacauaguaagccaguuaaccucaaauauuuaauccuggaauucugugugauacaggaucuauaaauaaccuguuucugagagcugucauaucucuuauguauguuagucauuuauaagacuuuuuaaaaacuucguagguaaggauuuuauuucauguuauauuugcucauucacuuucauuaucuuuuuuuguuguuguuacauuaccagauauuuaugucuguaguagcagguaugggagauacuuuuauggcuuaauauaaucucucuuuuuuucucaaguaucacauuaaaauauaaucucuauaauauaagcucauuaaauaagccugcaaaagacaguuuguuuucuguugucccuuauuuaaaugaaagguaguuuuaauguacucagugaagaugucagauagauuaaggauuauuuuagcauuauaagaaauaaucagcuacaguaucacauagucugagaagccuuuaaaaauauuucaauauauuguacgauaccuuaguaugauaguuguugguuuauuccauacaguugaucugagccaggcugcuguuuucaacuuaauauugaaaaauaaguaguaaauauaggucaugauuauuugauuaauaaaaaucaccagacccaugaauuaguuauauauuuauagaaauuuuaaauggugauccuuuacauuugaaaugcaguuguagucuaugguccuaccaccaugaacgugcccaaucuugucuaaaaugcaguuauuauaaacccuuuaaagaaaaacacauugccuguaaucccagcacuuugggaggccgaggcaggugcaucacaaggucaggagaucgagaccauccuggcuaacauggugaaaccccaucucuacuaaaaauacaaaaaauuagccgggcacgguggcaggcgccuguagucccagcuauucgggaggcugaggcaggagaauggcaugaacccgggagcuggagcuugcaguggccugggauugcgccacugcacuccagccugggugacagagcgagacuccgucucaaaaaaaaaaaaaagaaaagaaaaaaaagaaaagcgcauuagagguauaauguaccauuuacauguauucaguuuaauaacacuguauauuuauccuuuuuuguguguaccagugauuaaauuuuuaaaucuuaauauuauggggauuuuauuuugauuuuuaauaaggucaaaugcggucuggauaaagaaacaccaaaucagaagaccggccauaaucuucaaguuaaaaaugaagauaaagggacaaaggcauggacaccaucauguuuaaggggacgugcugaucccaacuugaaugcuguaaaaauugaaaaguuaucugaugaugaagaaguagacaucacagaugagguggacgaguugucuucucaaacaccccagaagaauucuagcagugaucucuuguuagacuuuccuaauaguaaaaugcaugaaaccaaucaaggagaauucauuacuucugacagccaggaagcucucuuuucuaagucuuccaggggcugucuucaaaaugaaaagcaagaugaaacacuuucaagcucagaaauuacacuguggacugagaaacagagcaauggugacaaaaaaucaauugaauuaaaugaccagaaauuuaaugaauugauuaaaaacugcaacaagcaugauggaaggggaauaauaguugaugccaggcaguugccuucuccagagccuugugaaauucagaaaaauuugaaugauaaugaaaugcuuuuucauucuugccaaaugguagaggaaagccaugaggaagaagagcuuaagccaccagaacaggaaauagaaauagauagaaauaucauucaagaagaagaaaaacaagcaauuccugaguuuuuugaggggcgccaagcuaaaacaccagaacgcuauuugaaaauuagaaauuauauuuuggaucaaugguaagaaagaauuacauuauagauguuguuuuaaaacgugauauucugaaguauuuuaauuaggccuauacagaauuuagaauuuugcuaguaaaucuagagaucacuacaguagggaagauuuaagauuucuuguaaugaaaaaaagcuuugguaaacauuaucaccuauaacucucauaacccaucuuuuugccuauucauuagauugugggccuggaauaaaagggauagacgauugcuuuaugaagcagucuccuaggacagcguuaggaagauauagagagaacaccacugcacgggaaaagggaaauaauucuuuccgguuuaucauguacuuugaguacaaagauagaaaaauuugaugacagcaguaguauuaaauguggccagauugcagaaacacuucuaaauagugaucuuaaaugcuuuuaacuuugaacuugugacaauaaugugcuauuaauuucuucauccaguuuuaucaggauacaguuuucugauagaugaagcuuauucucuagauugucaguaccguuuauuugaauuauuuaaugaagcuuagggaacaaaccccaaaauuucccaccuuacuagccuaauuugaauuuuuuaaaacagcuuaauuaaaccaucauuaaacauuuauaauugcuggcugggcacaguggcucaugccuguaaucccagcacuuugggaggcugaggcaggcagaucauuugaggucaggaguuugagaccagccuggcccacguggugaaacccugucccuucuaaaaauaacuauauauauauauuagcugggcauuguggcaggugucuguaaucccagcuacucaggaugcugaggcaggagaaucucuugaaccugggaggcagagguugcagugagccgagaucgugccacugcacuccagccugggcgacagagcgagacuucaucucaaaaaaaaaaaaaaauuauuuuuaaaaaucauaauugcuaauucuguuucagaagcuaucaaauuguauagggccaucuuuacagagagcuuccuaguuccuugagcagggguucugcuuuguccuuuguucucuuuuguauggaaagccuuccuguccuauugcuauuguuaacuuccugcuguaaccuagaaggguuaccaaaggaaaacaacuugcuauaauaaaucgguaaccuucauuuuacccacacaauauaagucuuugguuuuuaaagauggcuguauucuuaaaggaggagguuuguucuugaguuaucuuacagaugguggaggugcugaaaguacaacauguggguuagguuggcaucauaguaaagaauacuugcaaggaacaacuccugacuuuacauagugcuuuauaguuguuaaagagcuuugcuacaucaucuuacuugauuuuuuaaaacaauccuguaaaauaaugcagaugguauuauguuuauuugauaaagaaugauucugagaucaggagagguuuagggaccugccuuggauuauacaaccagucacugacacaugaaggacuucagucuucaugugucuguaaaucacucuuuuauucuacauggccuaauucacacuaaugacaaagacuaguuaaauuagauuucuauugguaucuacuuuuguuuuuggaaauaagagggugaauggccaaaauuuaaggaccuugaaaucauaacuaacucaaaaauguccauauuggucaggaguaguggcucacaaccuuuuuuuuuuuuuuuuuuuuuuugagacagagucucacucuuucucccaggcuggagugccuuggcaugaucucagcucacugcaaccucugucucccagguucaagugauucuucugccucagcucccaugcagcugggacuacaggugcgugccaccacgcccggcuaauuuuuguauuuuuaguagagacuggguuucaccacauuggccaggcuggucuagaacuccugaccucagguaauccacucaccucggccacccaaaguucugggauuacaggugugagccaccacgcccggcugacucacaauuuucauccccgugcuuuuggaggcugagacaagaggauuacuugaggccaggaguucgagacuaguuugggcaacauagcaagacccugucccuacaaaaaauuuuuuuaaaacuuaggcgcgguguugugugccuguaguuguagcuacucaggagacugaagcaggagaaucacuugagcccaggaguuugaagcugcagugaggugggaucaugccacuguacacuagccugggcaacagagcaagauccugucucuuaaaaauguccauaugaaugaucacuauauucuuguuacuuuaaucaaauucuauauuuguuacuuugaauuuugaauuccaaaugaggcagauuaauuuauauagguacuauaaauuacauggcaauaguuuccuaagucauuugccuugguucaugaaacugguuagguauugcuauuucauuauggugauuuagcagaacauugugaaagcaaaaauuguuuugaacaggaacucacauuuguucagaaauagaagagagugagugguuaggcacuggaggugguguuaaaaaaaaauagaagaguuaaaguuuugaaauaaaaagaagccugccagauuuguuuauagauaaagauucuuuucauaaaagcagaugcaguugauucccugguuaggggaauauuuuuauuaaaauaguaaccaguaccauuacugaaugccucccgaauaccauguacuguacuuaaaucaucuccaauccuuuugacaaccucguucucacuuuauagauaagaaaaaugagguucacagaggauaaaaaacuuuuccaggucacacuagguaaaggagauauuggagucugcagucuugacucauuauuuucacacuuccaacucauggccuugacccugacuuuucacucugcuuuggauguucuucccccauauuuugucaaguguugcuuucuugucucauugaaaucuggucgagggaaauuagaggcuuaucuaaaauaucucacauaucuccucccuuucauucucuugcccuguauuuuauuuucuuuauagaacuuauuacuaccacaaauaauuacauuuuuauuuguuuacugucucuucuccccucaacccccaugauaaugcaggcaacaugagggcagauuuuuaucuguuuuguuuguuguugaaucuaguucuuaaacaaugcucagaauauagaagguacucuuauuuguuagggggaaaagaucgaacaugaaucauuauuccaugaacauauuuuuagaguccuuaccauuuguucagcacugugcuagauuacugaguucuguuuaaagccuuuuacuuugaguagucuucaguuagcucagucuaguuuuuucagacuccuuugguuucuugguagccauacucuugccugcuuuauugcuuucauuuguacaauuuuguuucauuuucuugcaagacacacugaaaucucaacguuucuauggaaggugugguacccucccacaucacaaauuauuuuuacccucuauucugcuuagugaggccuagccuaagcacccuaucuaucuaaaguagucuaugccuguuugucccacucuauccccuugaccuucuuacuuagcacuauugcuaccugaaaguguaauauauaugguucauugauuauugacagucccucccauuagaauguaagaucuguaagguuagaaauuuuacauuaucuguguaucucuagugcuuagaacaauauauucauggaauaaaauaaugaucgaaugagaaauacccauguuauaugagauaucugaauaccuaaauuuauaauaucuauacuugaauccugauuaugucccuuccuuaaguaagugcuuuacucugacccccuugcuuccucauuuccaaaaugagaauaauauuaauaaaaucuaccuuguauaguuguaaagauuaaggauguguaacucagcacaauaaucuggcuuaagcauucaguaauuaguuucuacuaaguucuuuauuacucgaauuuuauguuguaccaucuagcaagguacauuaaguauauucaauaaauacguguuuuauuauauaaaccucuuauuucuuucauaaucuuugggaguuucuugauuuccccuuuggaaucccuuauaacgucuguuucuguuuuccacugagaguaagcacuuaauauuuguugucaucauaauuaaaaacaaauauaaaauguuuaagcauuuguaagauagcugauaauugaaagacacuguuaagcaaaauaagaguagaugaaucuaaguaauauauuacaaauuggaaacgucuaauacuaaaucuuuucuauauauuaucaaacugcucuuuguauuuaaagauucaauuugugucuguacauaaauuucugaauucaagguccugggauaacuggaaucuaugaauuuaacauuggggaagaaauauugcuuguaaaaaauuaugcuaauaaguuauuguaucauuuaaggauauuuuauuucagaaaaaaaguacauggguauuauguauuaguauuguauuuauuacacauuuauacauugaaagggguuaaaauuuagagauauuucaaauauugaaaguuuuccccagaaaucuuuuuucacguuuuuauuuauccaaaauaauuguacuucugucucuuaauuagggagauaugcaaaccaaaauacuuaaauaagaccucaguacguccuggccugaagaacuguggagauguuaauuguauuggacggauucauacauaccucgaauugauaggagcaaucaauuuuggaugugguaaaaauaaaaacccaacaacaucuuuuacucgacauuuuuuauccuuacagcacuuauucauuucuaugaugguuagaauucaaguaguuauagguauauagaauucagaggugcuguaacauuauuuaauaaauguuuuauuaagauuuuacuguugguuaaacuguguuuucauuugaccuacacugaaaauugagaguguaacuuuaaagguaaaauauucaaucuaaguaauagaaauaauuuaagaauacaguucuuuagcagauaaaaguaaaauuauuuuaugaaaagucuaauaauagcccauuuaauuugcaaauacuguauucaugcuagaaauacuaccuagcaauguuuaaauaaaggaaauaauuugugagccucuacacuuacaugugauaaaagcgucaaaauauuuuuuguggaagacaauuguaccuuaguuuuuuucaaauuuaaaguuaaugaauauacauauuuuaaaauauauucuacucuuuuuuuuuuuuuuuuucucgcucuguugcccaggcugaagugcaguggugugaucucugcucacugcaacuuccgccucccggguucaagcgauucuuuugcuucggucuccagaguagcugggacuacaggcgcaugccaccacaccuggcuaauuuuuguaugauuaguagagacggguuucaccauauuggccaggcuggucucgaacuccugaccucgugauuugcccgccucagccuccuaaagugcugggaucacaggcgugagccaccgcgccugaccucuacucuuuuauugaauuaaaaugacacaaccauucauagcuacaaagugauaagguacauaaaaccuuguaacccaugguuuaagaagaguauauucuguguuugucuaugaaagggagacaacuaacaagaagauuuucugucagauaugauuuucuuuuauauugagcuagauagaauuuaguuugcccgggaaucuguccuucauuucagugucuuuguuuucccaaagccuugaauauugagacuagcuuuucaggaaaacuaaaggauuuuugcuuccucagccaccaaaagaaaaauuaaaucauguuuucuguauuagacugccaaaguuagcaaacuacccauuuucuaaauauuccauuuauuaagauuuucuuauaauaacagcauuacuuuuaauuugaggggugcucaguagcacaucaaauguaugaucgugaaauaagagucauagaagccccacuauagucaguguacaugugucuuacuguuuaacaaaugaguuucacaaaauaauagaugguuuuaucuuuccugaauuccaauagaacaggcuguguauaauaggccacaaacaguugacaaaguacgaaucagagacagaaaagaugcaguagaagcauaccaacuugcccagcgucugcagucuaugguaagcagucaucucucucagugaucucuccacauugcugcuuacucuguuuagugugguuuacguacuuaccuugagcuguuuaauaaaugaccauuuaguagaaaaacauguuuccucuuguguuucaccuuagcaauucgcuuuucuggguuucauucaauuucauguugcuuucugaggcaaaaacaaaccuaaaaacccuuaaaauguacuagcaaacuugaugcagaagcauaauguuuuccuaaaguggucuugggaugcuucguuuuaauuuauaaaucuaaugugucuuuuaaaaauauauaguucaguuuuuuuuucucucauugauuuuucuuuuaaaauucuuaaccuuaagaaucaccuuuuuggaauaacuagacuuuuuuuuuauucuuggagucaguuuuauaauauuuuaaaauucguaaaucauacuuuaaaaauaaagugaccuacuaggagaaaaagaaacaucucgaggggaaaaaaaaacaaauaaaaaugugauccaacacuuuuuuuuucuuuuuuuuuuuuuuuugagacagagucucgcugugucacccaggcuagaguaugguggugccaucucggcucacugcaagcuccaucucccggguucacaccauucucaugccucagccucccgaguagcugggacuacaggugcccgccaucacaccaagcuaauuuuuuuuguauuuuuaguagagacaggguuucaccuuguuagccaggauggucucgaucuccugaccucaugauccgcccgccuuggccucccgaagugcugggauuacaggcgugagccaccgugugcagccgauccaacacucuuuauaaggcagagucauaauaugauccuguuaguuuuacuaauggauuaaauuaguaauaaauaagauaugaaaaagaaaguauaggugcuaaaauagcuguuuuucucagaguauuuaggcuauaaaccauuucuaucuagauuuacuaucuuaaagauguuaucaauuagaguugcuggauauggugcuagucauacacuauccuuuggcaacugguccauuuuaaaggccucacuauugagguuugcaaaacuggauuuuaauaauguagucaaccaacuuuguaauuucucauuauuugaucaacuaggccaccuccuuucuaaagcuggaaauaauaauuauuuugcuucuaguuuucaauauuauaccucuugcuguguguucuugcagauuuucuaccacaagugguugaaaaggaagccauuuucuugaugguucuuuuugaucuuaaaaauauuuuuguuccuacucgggagucugaggcaggagaaucacucgaaccgggaggugggagguugcaguaagcaaagaucacgccacugcacuccagccugggcgacacagugagacuccgucucaaaaaaaacccaaaauuuugucauaguguuuuagcuccuacaugaugaaaggaaauauaaaagcuaagaagaaaugcuagcaaaauacagaaaaucauuacugaucuuauuuuuuaaauagcccucuggugccaacacccagcccacacccugcccaccugcuacuggugcuccugcccuuaccucgccaucacugauuuauuauauuuguaacuagagugcuaacuauugaacauaaauuaauaaaguuuagucagucauugccagagguuauacuauuuaaauugauagauuaauugacuuuuagauaauuauuguuuucauuuuguguauuaaugugcuaugauuucuccauauuaaucuugcuaccuuuugcuuuacuuuaaucucaucgcagcguacaaggagacguaggguccgagacccauggggaaacuggugugaugcaaaggacuuagaaggacaaacguuugagguaacuuugaccuuucaaauggcucauccaugaaaacugguuuuuaaauauauauuuguacaucuuaaugucauauguauuguacuuguuucauacauuaacauguauguguucauucccauguuaauuugucuggaagucaccaguaaacaccaaaguagaaggcauugguggugcaguuaacuaggaguuuaacucauuucagaacuuggauucucugucucuguauucuugucucuaacucaagauaagggugucaagaaguugguaugcccaauucguuucauuaaacauuuauuggaagagguucugauauaccaauuaaaauauuguucuaagcauuagacauuagacacacauguguucuaaauauauauauuuuuuguaacagcuagugcaguagaauggauagaaugugugaauguguacguacuggcuuuguuacuuuaagcaacuacuuaaucucacagaaucucaugcuuuuuuaacuuacgaauugugaauaauaauaauaccucccucaaaguauuguuguaagaaagaaacgagauagacuauauaaagaugcuaguacuagguauucaguaagccuugcaugcacaaaguacucaaacuugaguucucuuuccuccuccgcauucccugcccucaacuucucaccugaguacuauucuaggcacaguaauuaguaauucauccuucccauaaggggcuuguauuucuaauaggaaagacaaaaccuaugguaaguucaauaagguuggucccaagaauuguaaguuucucccaaaggcugugaucagggcagguuucguagaguaugugggguauaaucugaucugaaggaucugcagaagaaucucaaaauggagaugaauacacuuuaggcugagggaacaaagcuggagacaugggaaaauacuagauauauucuggaaaaggugcauaguucauuuggacuaggguguaaguuggucguagaaauggaauagagauuuacuuuauuuuauaaacacuuauaaagggcuuacugugugucagacaaugucaguauuuuauaaacauuaacucagucuucacaauaauaccaugacagugguauuauuguuuacuuuuuauuauuaauuuuauuguucccauuuuuaaagaugagguaacugaagcaugaaagcuuuagaauuugccuagggucaccaagcuaguaaauaacugggccagacauucuagauccagaaucuguucuuaaucauuacucugcacugucucucaguugugaaagaaaacucaacacaguagaauaugguaaguagaaaugggaaauaaaagacucaggugauucugacguuuuugaaccugggugacugguaccauugauugaaaugggcaaaucaagagaaggaguaaauuuucaguuugggauggccgugucuuuugaaacaauuuuuuaaaaauacuguccagucuuucuacauguugguagcaaaaaggaagcccaucuauaucaauuuagucucucuuguccucacaugcccuucaauuugauuuuaaaggacuauuuuuauucugccucuuaguagaugauggacuccuuaaucaauuggcauuuuguuuuagcaucucucugcugaggaguuggcaaaaagaagagaagaggaaaaaggcagaccuguuaaaucuuuaaaagugccaagaccaacaaaaagguguaguguuauauaaaugugguuuuuaaacauuuaucacaaauggcuagauaauauaugaaaaaauauucaauagcugcauuauauuguucacauuaaguuuaaaaaaauacugcuacaauuuuuuagauuuuuuuuguuucacugauuaugaauuuggaagaccuugaacaaacauuuuaaauuuguucagauucauugaacauaugauccaacauauguuguaaaggggcccuguuuaggacagguuggucauucaacucuagacgcuauggacaggaaccuucaugaaaugacuggguuuucuuugggugguacuaauuguuagcaaguuguugcaugguuuguuguuuucuaaugcauguguaaucuaaaauuugagccuuuuaaaauuaagggucaccaaauaaguuaaauguuccgauuuucuauucccucuuccugcagaugccccauugaauagacuguaguuuugucaguguaccuuuuaaaagaagauauccaggaaugccacuagaucauauuuuugccugauaaauguccucggguaauccuuagguucucauuuauuaaacaauaauuuaaauaacacuguuagcuguauuuuaagcacuuuauauuuauuagcucauauagucuucaugacaacccugugcauuaguuaauguucucacucccauuuuauagaugaggaaacugagaggcauagagagguuuaauaacuugcucacgcugucaaguaguggagcuguugauuuuaaacccaaguguuaagcuuaagaguucauaccccuaaucauuacaguauauauuaccucucuaaaguaaaaauaaaacuuacacaguugucgugagacugaauuagauaaacuauguaaaaaauaguccuccauaagcuaggacuccucauccaguauccagauaauugauuuucugacucuaaaugugagacuuauauuuauugugauuuucaagucauuguucaaggucuucaggaucuuuuugaauccagauccacuuuucucauuuuagccuuuguagcacuguaucauuaacauuucaauaagcuugccuuuccugccauuacucacugauugcaauguuuaauugaauaaauguaaaccucauuguauauauuuaaacaacgaagacauucauucuucaaucagcuauauagauuaccacaauuaacgcauauaucuucaucuuauacagaaggauaaucauaucggaugucuuguuuaauuucagauaaaauauauuuaagucuuuaguuucuaacagauuauuccuaucaauagugucuacaauaaggucuacuuaucaugacuuuucaugaacucauuauuuuacuuagucaccucuucacuugguuaaggaucacaaaucagcuguuucauaauuuuuucuagaauuuuacuacuguucaacaucuaguuccuccuuuucugcagucugcuuuuuuguauugugaaacaagcucaauaauugucuauuucuaguccuucagcaacuuucccauucucugcaguuccucaacaaacacugacagcgguuccauauccgugguucuuaaguacuccaggauguucuuucugugcuauuuucucaucuaucuuggccuucaguuucuuuuuguguugauuaaacacuuucuaauuuaaaggucuuucuuuauucaacaaguaucuuugaauguguacuguauaugucaggcacgguucugaucacuugggauacauuauuaagcaaaacaaaauguucucuugaagcuaaccaucuaugguugaauggaaauggaauugcccugcucucuuccaguuguguuaaugcgaauguauuccuguguguuuuucuuucccugaagauagccuaaaaaaccuuuuuauuguucuuaauauaguucucaagccucaauucuuuacugacauuucugagauuuaugugugcuuuugaccuugcuuagguucucucuuuuucaccucuuuuuacuuuuucacuuuuuuguuuuuuuuuuuuuuuuuuuuuuuuuuggagacagggucucacucugucacccaggcuggaguggaguaguagaguggugaaaucauggcucacugcagccuccaccuccugggcuuaagugauccucccaccucagccucccgaguggcugggacuacaggcacacgccaccacgcucagcuaguuuugaaauucuuuuguaggggugggguuucaccauguuauccaggcuggucucaaacuccuaggcucaaggggucugcccaccucggccuccugaaguguuggaauuacagaugugagccacugcaccuggccacuuuuucacuugaagaguuuaugauaggaguaauacauuaauaucuuuaccagaacuguuugucauucauucauucaaaaaauguuuuaaguuccuauucuauagugggcacauuauugaacugacaaguguuuuugauaaacuuccaucuuucuugaaccuuuuuuugggucucaugacaguuaauuauauuuucauuggacuuuuugaaaucugcuuuuagugugggacauaugucugauaguuuauaguguccucuuugaguguuaaaggaaauuaagacaacagagcaacuuuaucucaaaguuccuggguuuuuuuuuuguucuuguuaaaucuaaaagaacagugcuucuuucgaaaggguuuauggaauuuccuacaaaacucucucauuuagacagaauuuggguuuagauuauugauauacacuuucagauuuacaaauaaauguuauuuuccuaaucuuguugagauuguauugaaaauuuuuuuucuuuuucagcucguuugaucccuuccaacugauaccuuguaauuuuuuuagugaagaaaagcagguacuauuuaugcauuaaugaaugacaguagacaauccccgcuuccccgucaaacaggaaaugcuuacucuuuuuccguaugugcaaggcauauguauaaaaagacugaaaaugagagagaauuucucccugcuggaauuuuaaaucauaauguuuuaaaagucuaguuugugcugagcuuugguuagugcugagaacuuggugggguggauaaaggagaacagggugggcauuccagguggggaaaacaaaaaucucuauuuuuaugcucccccguuuuguuuuguuuuuuauauuucaggagccauuucaggugaaaguggcuucagaagcacuuuuaauaauggauuugguaaggauaaucuauuguguuuacuuaguuauucugauuucuacucuuguguauuuuuauugcaggcguaagacagaguauggaagacguguauuuuggaucuuaacuguccucuuuuacaaggaaucuaaaaauaagucuuuucuuuuggagaaaagccaaacaauugcauguuuccauauuuuagagaaaauaaauuaaugugaguuuuugcagacuguuuaccaucauuaacccuauuuuaaguuucuaauauaugugucugccacuuuuuagaucacugaaacaaagcacaacuccuguaauuuggaggguuuuuuuguuuuuacuaaacuaccgauaccuccaacaguuuuuguguuugugaugucuuuguguagaaggauuuagagugauuuuuacuuuguauccuuacauaauaccucccuugaguagggagaguaaaugguaucuucauuuuguaauugcaaaaguagagucugagaauuuuuaaguguuugguugaaagcuucucagccagcagugaagauagaccugaaaucuuaguuucugugcacugauccuagcaucuaguuccucuccuaugcuacuuuauuuuauaaaagcaugauggcuauacuuacaaaugacuuucuuaugauaagugaguuuuguuacuuugucagguggguuugugcguuugggcuaagucugucuuguauuucuuuuagcaugcucauguuucuauggcagaagugauuggucuguuaggaggaagauacucagaaguugauaaaguaguugaaguaaguucucucuuuuaaaaaaauguuuuaguuauuuaguccuacuaccauaccaaauauuuuuauagaauucaguuaauauaauuaaaauacagacuuuaccuaugauauauaugagaauaugcaaauguagcaaguuauauauucccagaagugacuuaacauucuauaugccuagcgccuguuucuuuuuaccaccgagagaacauugccaggccuuggguccucauuaccuuuauuaguaaaaagcuacaacuucuaagaggccagaaacagguacuaacacuuuaguugaaaguuuguaugcaucauucuguugaaauuauugucauaaguaacaggagucauugaaagaauaccuuuguacagguauuaugugggcugaccuggaaaacuaaccauuauuaugaccuuguuugaguagaaaaaugcaugcuaaguuccuagcauauaaucagacuuuuggaguuuaagucauuugcaaguuaaaggcaacugugguauuguuaaauaaaagucuuggccuugaaaaguuuccguaucuuugaaagaauuauaacauuagaguaauagaauuaacaggauuuuaguauaaucauuugaggaucaaucguuuauaggucugugcagcagaaccauguaacagucugaguacaggacuacagugugagauggauccuguaucacaaacacaggccucagaaaccuuggcuguuagaggcuucaguguuauuggaugguaucauucucauccugcuuuugauccuaauccuuccuuacgagauauugacacacaagcuaaauaccagguauuacauguauauuuauauucuguaaaugguugcacacccccucaaugcucccuuuuaaauagauaaacuuuaaacauuuuucauauuacauuucuaauauucuuuauacuggggauuuuguuuguuuauuuuuauuuauuuuuauuauuauuuuuuuuuugagacagaguuucgcucuuguugcccaagcuggagugcaauggcacgaucuuggcucacugcaaccucugccucuuagguucaagugauucuccugccucagccucccaaguagcugggauuacaggcgugcaccaccacgccuagcuaauuuuuuguaguuugaguagaaacaggguuucaccauguuagccaggcuggucucaaacuccugaccucaggugauuggcccgccucggccuccaaaagugcugggauuauaggcaugagccaccacacccagccaaaaaaaaaaaaaagaaaaaaaauacauauacuggggguuuuaaaagaacaugcauuuuuuuuucugauugcaagauugauaauuguuuauguaaacauuuagaaagucaguuauuuuauuaaguacaaacaagccaugaauguaucacugguaaauacucccagagccuuuaaaaauugaugggaacaacuaggacagggacuagauacaacugaaguaauaagaaacauaauguauuuuuuauagcugaagaaaaaguuuuauucugggauuuuacacuugauaugugacuggguuugcuguaggguauuuguaaauuauuacuguauugauaagaauuacagauguaggguggugaauacaauuaguaaauauauucauggcaaauacagauuguguaggccauuuuauauuuuuaagggucauuuuggauuugguugaacacauuuuugccugaaaaauguaccgugugagaugaauaucuaaggcauuugauuuaguugcaguuuggaugugaacuuuuuuuuuuuuuagagacauagucuuacucugucacccaggcuagagugcaguggugggaucucgacucacugcaaccucugucucccagguuuaagggauucugcugccucagccuccugaguagcugggguuacaggcacgugccacuacaccuggcuaauuuuuuuauuuuugguagagacgggguuucaccauguuggccaggcuggucucaagccugaucaggcugaccugaccucaagcaguccgccugccucagucucccaaagugcugggauuacaggcgugggccacugugccgggccagaugugaacuuuuuaaugcaccuuuuuguuccugcuuuuccccauuagauguuuaaaauguuaguauggauaaauauuggcuuuugaauuuauauaguugaaacuaauuauauuuuucuugucauuguagaguuacuucuccagaggaggugcaaaguucauugggaugauuguuagucccuauaaucgaaauaaucccuuaccauauucucagauuaccugccugguuauaagugaggaaauuagcccagauggcucuuaucguaaguuuucaacaaaaauaacuuuauccucuuucuacucuuauuucuuugacucauacaaaucaaaagauuugcaacuguuuaaaauuauuuaaugcaagaguuugugcccucaacuagggaaucauuauuugggugccacccuagugcagccacccucuuccguuucuuaaucuccugcuauauucaaguccccacuuuuguuaccauggccacugggcaaaaggauugaaauauggagaaaaguuauggccaggcaguguguaugcuaggcacuggagauguugcaguaaacaaaacagucucuguucucaugaaaauuuuuuuauaaaugcagacuggcuuucucugugauggcaugcaaaugaaaaaaaaaaugaccaccagcucucugucaccucccgguuuaggguuaacaaugacuaacucaauuuguaucucucuuuguucccauucuaucucaggaaagaauuugguuggcauagaccaucaucugacuugauuccccugagguuuauguccacuuguaguccaaacauuucugggcggauagggaguuaguauagcagacuaggaaaaggaagggaguguggcuagaaagcaaauaaucagaggaaacaguaggcuaaauaacucuaggauauuuauucugucauuacuaccacugcuauaggucagguccccuggacacugccacuacaguuaccccacauuguacucuuccccauuagauuaugagcucuuugagaauaaauacuguauuguacccauuuuuucuauccuguuucuagcaugaggccuggcauaaaguagauacuaaaugaauauuuguuuaauaauuaauuucucuucauucuuaaugaucucucuuggaugcccuauauuugauguagauuuaccagcacugcccccauguuauuuacuauuaguugcuuuauucuuuauguaucugcaacacuuuauuccugccuucauggucacuuugucuuuuaaugcaauuuaucuauuuagcaaguccuaauaaauuguaugcccaaagagcagggacugugucuuauuugucuuuuuucucaaguagcaccuaauaaauugcuuugcaucuaggagguggucaacacuauggguuuuuacugaauuaauaauauugguauuagcuuuuagucuggaauguccauuuugagcauagcacauaauacauauuauucuuuagcucaguacaguuuuauaaaaagaaucgcaauuaacuuguucucuuuaaaucauuuuuaaaccaucuuuaaaucaucaucugacuugauuuuauaaucucacagacugcuagguuuugguaaugaaccucaauucugaugcuauccaguacaauagcaguacgugugacuuuaaauguaaguugauuagaauuacaugaaauuuaaaauuuaguucauggaauucuacucuggccaaaaugaaguaaaaagaacuugucugaaacuaccaaaaaacuggacaaaauauguaaaauaaugguauuuaaacacaacauuuagcagcaaaggaauacgauugcuaagagaugggaaacaaaugaaaagagccccacauuacccuagcuuacugcuuaagaggguuuucagauauggcacaagaaggagaaacccacccagagccaggccgacucaauuaaggugauggagauaaggagaccaagacagcugaguuugugagacagagccccaagagaacagaaagcagaauggagagugaacucuggagauuuguagaagaguaucccuggaguauuuagcaaaguacagaucagcacauguaugugaauaaacuagcccagaugggaaagaacuacuugaaagcauuagagggaacuauccaugaugcucccaugagcuaccauuggacagagcugucuuguaaaugacuuguccaugcuuaacacugcguauuagaucuuaauccuaggucuuuugcuuugcccuuagaaauccucuggugcaagaauuaagguuuucuagaagccaugggauaccuugugcuacaguacuuuuaacucaggucauaucuuuacaauaucucuaaugguuuaauguuuucuuuacuugugacaggcaggaaauauauuuagugaucaguuuucuucugauauuuuaguggauaaaaauauucucuauaaaagaaacuuauugacuuuaaaaguaccuuuuuuaacuuaaaaaauauucuuaaaaauaccaaauagaccuguauauaauuuguguguauguuuucauguuuuugcaucagcauagauugaaaaugcauuauuuaccucucuuuauuuucaucuucaacuuucauugagaguaggagucacucuacuggauucagaucccagcucugacauuuauugcuuauuuuaccuugggcagucuacucccucauucuccuuugcuacaucuguaaaaugagaaaaaauuacuaccuugcuuacaguagguauaugguuguaaggugugucaguaauauauguaaaguguuuagcaaauaauagguuuucagugggugguuaucauuauauagaugguauccauguuuaguaaguaaucaaagcaugucaaguaaaugacuguuaucaccauaaggaguuugcuuaauaccccguguacuauagugugucacucuucuuaaguuuuuggagaagaggaaaauugagcaauuaaauaaaaaagaucagucaucaucaucaggcuugcuguccccuuuccuuccaaacaccugaaaaaaugccuuuuuagagcauauugacauuuaagcuaugcuuuauuucauugugaggaaauaauuguauuuuuccccuuuuuuuuuuccaugccuucugauuugcuggcauuuuauuuauuccuuaccaugguagaaacccaguugaggcaguauuauguauaaguuaaaagcagaacucucgagccugacugccuggguucaaauccugccaaugccuuuuauaucugaucaugagcagguuaaccuuucuaugacguaguguccucaucgaaaaaaaaaaaaggggggggugaauaauggcagcuacuucauuuaagugauuucacauuaaguuuuagguggcacauaguaugcauuauaaguguuacuaugaugguaucagccuuugcuagugaaucagcugagcuuuuaaaaaaaugcuauagaugcauuugcaugggggucuugaaggauaugugaaaaauugcuaagauaacucaucguuugguauuuuuuccuuucuagaugaauauaugauguucaccccuugggcuucuuucuuuccuccagaguuuaguauaacaacuuugacucaaagcaguugcugccuccccagaguucauccuauccucuugucuagucuuagauuagcucuucuagggagguggaaugaguuugggcucagaagugaggcaaaccugcuggguuuuaacaucuguguccugccacuuugcuagccuaaauaugauuuuuaauguaucucagcuucaguuuucucaccuguuaaaaaaaaaacaauaacuuacagcauuguuguaagcuuaauaaccuguauauauauauauuuuuaauuaucacuaggauggcaauaugucuuaguuugucuaggauaaucccacuuuaaaccugcgguucaggcauaauuauuaauaguaccuucuuucauucaaaaagucucuugguuuaggugauaaauuacgugaucaucccaucauagugccaugcguagaauugucauguaaauggcacuuuuacucauuauuauuauuaauagcuuggcauuaauaugcuuaguggaccaaguacaaucgggcaauaaauauuuaaugaaugcccacuauguuuaaagugcuguucagcugaucugcaaagcuauggcuguaaaaacaccgaagggaauuuuaaguauaauuaaaaggagauuggagaguuaagaaauaguugaugacaaugugcuucuuuaugcuuuucuaggcuuaccuuacaaauuugaaguacagcagauguuagaagaaccucaguggggauuaguauuugaaaagacaagauggauaauagaaaaauacaggcucucccauagguauguacugugguuugagaugguugcacaucugcaguguugcucauuaaauuauguuucagagaaaacccaaguuaaauauaaaauugugauguauggcauccgugauaguuuauuaugaaacugauuaguuuauaguauucguuucaccaguuuguuuucauauuucuuccuacagcagcguccccauggauaaaaucuuucgccgggauucugaccugacuuguuugcagaaaguaagcugucuucauuuuaauugguuccauuguucacagauucugaagcuauucaucucaauguguuuucccaugaugccuaauacuuuguggauaauuuucuguauauuucuuuuauuacuuuuuccuuuggaaaauuaauuucuaggagauaauuaguaacguuuuuuguugcccaagcuugcacauagaaaaaauucuauuuuagaauaaauuugucaguguuggcugauuuuagcagauuauuauuauacacaauggagaacauuuuucuuauuuuauuaaauuugaaagugccauguuuccauuuuagccuuaacaauuggucauuuuuaagaaugaugguauaaaucuaacaauuaaauuuaaauagucauuuuauuuaacuuucuaauaggaaauaagaguuuugaauucugucaguucacgucuagguuuugcuucuguaaugauugaaggcuaguagaucugcaacauuugucuuuuuaaauagcaauuggggauagaaaauuuaaacauuaaguuucuuuuuaauauguuuuacuccuuucuguuauauccaguuuuuuguguguuguugaaaaaguaugugcacauuuccaaggaaauagacuccagcuagcauccucauuuugaaaugcagaauccuauguuuuuauguaccuagauuuuuguguguguguauacucaggauuauuuugcuuuguaaguguaacuacaaauggagaaaagucgcaaauacguccgaaguagaaagcaucacauaaacaaucucagguuugucuccuuauguaaaaucauaaaaguacuaagcugaguguuccucagcagcaauuuccuacauuccagcucugugacuauuaaacacaaguuaaucuucaaccauuuuuaaggagaguguuucucauuugagcauuaggaaaugugaggucuggaaagggacgaaauagugauaguaaugcaaacccucauacuuuuucuguauuuaaauauaaaacuuuucuuuucaacuagcuuuuggaguguaugaggaagacucugagcaaagugaccaauugcuuuauggcugaagaauucuugacugaaauagaaaauuuguuccuuuccaauuauaaaagcaaccaagagaauggaguaaccgaagagaacuguacaaaggaauuguuaaugugauuauuuuaaaguuaagacauuuuaaucuugacacaguagaucuuacuuucaaaguuauaaacuugaagugauuguaguuaacauuggcacagcuuugguauuuuuucucuauuucacaaaauccaaacuuugccacauaaaucaugugaaaaggaagagauacaaauuuguuuucauauagugauuaucagaguguucugcaaaccaggguccaccacgguguucuaguccuuuacugagcaaugcuguaggcugugaaacuaagcaaccuggucggcuuuacuguuguguucagcuugggauuuggacuaugucucuaagucauuucuucccugaacuagucauuuauguuccauugugguaucuccuauuucauuuaaaagcacuuccauucuuuccauauauucugcugagauuuguuuauggcuauaaaugagauauggauggguggucacugagauaauuaauaugguuuagaacuacugauuaauaaaucuaacaggagaccaggagaggcaugacaagaaaaucuuaaaaacaggaaaaacccaaaggagagaacuaaauuaccaguuucuaaucauagauacuaucuuccauuucauuguauagcaguaguaucauaagauaugccauuuucucagcuaucugaaaauuuuuaaccaauuuuacacacauaaaauaauuagcuucaauugugaguccacuuacauuaguaggugugauaaaaccucauuuaacuggaacauagguaaucauaacucaaacuuuuuuucuacugccuacuacuaggagaaagaggcaaaugauaauaaagcuggaauaaaucagagauuuaauuuuuaaaacaagccuuucaggacauguuacauauucagcccaguuucauaugcuuucugaaucuauaauggaggucagugaacuuuuuuaauguaaagggccaguuuguaaauaauuuuggcuuuucaggccacauaugaugucuaugagacauucuucuuuguguguguguguguguguguguguguguguguguguuuuacagcccuuuaaaaugauaaaaaccauuguuaacucacaggccucauaaaacauaggcuguuggcuauuauucuccaacccuugaucuagagaauuuuaaacauuagaauuuuguuuuacauuuguuaagcuuuacgucaucuucaaaugacaccaaaacucagaauuaugaucugcauuuaagccaauuuuaaaauaaaauaagcagucaaugcugccucauuuauugaaauucaguagauuuuaguuuauuucuuaguagucagagaauugauuuauagcuauucaccaaacauucuuacuaacguuuccuuauaucuaaaucagauugauucuauauuuugcuuuguuuguaaucaauagccaaugaagaauaaggaguauuggaagaagcagugagucagcuuuaggugaccugguucuugucucaacuuugugauuuggggagauacaguuuacuuucccugagccuuaauucuuguguaacugaagucuaacuuaacuucuuaauguccuuccagaacuaaaauuuuauuguucauucuaaucguuggacuacucuugugaaguuuauauuuugaguuaauacaguuuccaaauuaacauacauuuaaaaaaaaaaggguaguauuuuuccauuucucugugugcacuuaggauaaacagugaaguauagcuuauaaaacaauuaguuugagggcugagaguguaagaggaacuauaccaaaagucaggaaaccugagcucuuacccuaacucuguuaccaacuuugcugugugaccuuaaucaaaacacauaaccuggaccccaugcuccucaccaguaaaucaagggccugaauuuuauggcuuaguauucccuuccaagcuccgaaguugcgugauucugugaaaggcagugauugauuccuuuguacucaucuuccuuuugaccuguuuccucaugauauauuggggaacaaauacuaaaaaguguuuuauacuagcuuucuugauugacauuucccuauaauacugaugaauuugggugauggaaaguaauggaaauuguuaaaaguucugcucucaaaucugagucuccuugcccugugugccaauguuuaaccauauuugcuaaucuaagccauauugcgaggaucucaaggaugauacuugucaagaguuuggggccuugagagcacaguuuucaaaauaauacuuaguauuuucugacuauagaguacauuugucuuguaaaguauauuuuaaaauacagagaagugugaaguacaaauaucucagugcuacuauuuaaaaaaacacaauuaguauauaaauccuuccccauuuuuuugacaguauaauuuuaguauguuaaacuugguuacuucuuucucucuuccuccaucauuuucccugcuuccuuuuucuuuugucauauucuuaaaacaauuuugcaaccacagguacccacauugcuggcacuaccagccuugggcuacuaccgaggauaauggagccagggccuuguagaagcacagaggaagucuagaacugagggggccuaugauacaggaaguucaggaggcagagucucaaaggaacaccugccuuuaauaauguuuacagaaguggagaaaggacuaaaggacuuaaagacaugcaggugucuucauccugauucugucuuuguuauugcacaaugacuauaaaauaaugaccuaauuuuuuuuuuuuucuggcuuggcuaauggaaaucgacacuagcgcuuccccaguauuagacuuaaucuaauuccaaaguaacauucaagaaaagaaaaaccaguggaacaggaucaguaagcucagacucuccaucuccauuauuuuagccuugaccauucuucucuaauccuuuuaaauuaucuucaguuuccaguucaaguuacauugcuucaguuacaguuuguuugacccuguauucagagcugcauuaugauucuugugggcccuagauaguuuugccaucuuagaccccuucuuccauacaaaauuaaaagugauauuuuacaauuguaucuguaugaaaugaauguauuaauauuuuagauuaaaacauuuuguuuagaaguucaguuuuuucuuaugaggcuaaaaaaaauuaaaacauuuuugugggcuucuaaaaaacugugggccuuagguacugugccuaauggauaaguuggcauugccuguauucugaagggcaucauuggaaaaauagcagucauuauucuguccccuucucccaccaccacaguccuuggagaagccuuugccacuccauccaggagcacugcaguuuccacgguuauagaucuauagacuugaacuuacuuccuucccaaccuaacgaaaacucacaaggauuacuugggaccauucauccucaaaaaagauaggaggcagugguuuguuuuagucuucagauauuuuuguuuuggucagucccuaaucuguaguuuugaaacucgugccacacuugaaagggaaacauccuacuaccuuucuuuccucuccauuucccacaaacccuuuccuucaucaucacucccugcauucuuacuucucagcauauaaauacaagacccuucuuucuauuauuuguugaaagcuaggccuguaaaauagagauggacagaccaugcauguuuccaugaagcuauuuaaugcugcucccagucuucuguccauaccauuccuucccugccccuaggagugggguugaggucugugacaugcagacuguaagcacagucagaaccucugcagcucucaacccaacagaggagacuguggcuucaacaugccaaccugagcaggucuccucugcauuaccuuccucccauuucucuuccuggguccugaugaggugagcuggaggaaccaauagucaggaugcccuggaauugauguugcucuguuuugugcucacaaaacagccauguaacacaugagcaccugaguugaagccauccagucgcaagucagcagacagcaguugauggaauucucaguagaaauucaguaagggugcccaaauuuuauuuuuuuuuucaccuauacucuaccaauauaugguauuuaggaaaacuucuuuuauccaagcacaaagaaaagcacacacauuuuuauaaucaucugcuucaucaggguaaauaaauaauuuaacaaauuugaucagcaucucuaguuuaccaguacuuuaauauuaguuuucuuacaaauuaauguauuuugcaauauuuccagaaaaucacugugggagaauaauguaauauacuuuaggauauauuuccugaccuuuucuuaaauggcuucaugugcuauucccccaaauucugcuuucucuauuuucuuuuuuauuuaaccuauaauuauacuuucuaguauauucugagucuaucuucuaagccaccuuacauuuuuccuggaacaagggagggaauaaauaguugccuccacuaaaucaggaaaaaauaaaaauaucccaggggagcugugauuaugccaagagcucuaaacagaaguuugagaagguaaaaauuaaguuguaguaucugaguuguuuuuauuuucuuccuuugguguuuaugaagguauucauaagaacuuuaauuucaggggaaaaaaaugccugauuugcuauuuuugacauuuccucgucucuuaagaagucaguuaaauauguuuucauaguuuauauuccuguuucauagauuacugugaaacauguauuuaaaccuaugaauuauaaaauaguauuuagauucuagcgugaguuaaauagauuagucauauaucuuuuagauuuguggauuugacauguaaauuauguguuguguauaaguaaguuaguuacuaaacauauggcaugguuauugauaaacuuguugcuauuuuuuuccaaaugcuaucaguguuuguggacuuuuaaaaauuaguuugaauuuuggaauguucugugauaaaauguaauuucaacuauuuuguacauuuaaauaugccauguuguauaugucuguauuuaaaaauguuguaaauaccugcauuuuaagaauuaugaaagauuuuccucaaaaaugacagaacucuccauacuuaauugugacacauuauaagauaucugauuuuaagcuuuuggauuuuguucuaaaaauuaaguuuaaacaugcugaaaauuccauaaaaauaaaauuuugaaaauaaagugaucauuuggauuauuucuaaau

SEQ ID NO: 14024 - RNA, 4693 nt, Homo sapiens
auugacagggaggaccaucgugcucccgaguuaacaaggcaggagcuguggaugccugcaucagccauuccacccuccuccugcccugccuagagaacaacagagaaacgaaauuaaucuguaaccuaaaacccuuguaucugcccugaaaauaugucuuucuaauggaaaauuugacagaguguuccaucugcaaagagcauuuuauaugaaauggauaucuguguaacucaacugcugcuaucugguuaaauagcaauuaaacaccucaagacuccuuggaacuuucaaagauuacuugaaaaguaauuguguuuuauugauuaaauaauuugcaguggauuagaaagucacugaauuuuuuagcuauuccuucacaaguaaauuggucuuauuuagagacccagcguguccccaaccauguuuauauuuuaauaaucgccugauguuuaauagcauggcuggugguggaauuuaaugcuagauucguuccuuugcuaaauccuucuaucugguucuuucuguuucuauuuagacuuccgaaagcuacuugcuucauagauggcuacagaaauaggacccaaaaggcaaagaacacuguuguuaagagcucggucucuggagucagacaaaccucaauuugaauuccaguccugccacuuacuagauuugugccccugaaccugugaucugugaaaaggauauaauagcaccuaccuaauauggucauccugaaauuaaauaaguuagcauuuguacaauauaggacaacaguaucuagcuagcaauaauaauuauuauuauuauaacaguguaaguauuuacuaguauuuuuuauuuacuuauuuauuuuuugagacggagucucacucugucaccuaggcuagagugcaguggugcaaucucagcuuggugcaaccuuggcucacuguaaccuccgucucccggguucaagcuauucuccugccucaacccccugaguagcugggacuaucggugcgcaucaccacacccggcuaauuuuuguauuuuuaguagagacgcgguuucaccauguuggccaggcuggucucaaacuccugaacucaggugauccacccgccucggccucccaaagugcugggauuacaggcgugagccacugagccuggccuaguacuaguauuauuaagcccuaguuuucuaaucuauaaaaugaguguacagggaauaaaaccaucaacauaugaguauuaaaaacaucuuugcagccagaugugguggcucacgccuauaauccuaacacuuugggaggccaaggcggguagaucacuugagcccaguaguucaagaccagccuggacaacaugccaaaacacuguuucaaaaauuagccgggcaugguggugugcaccuguagucccagcuacucaggagacugaggcagaaggaucaccugagcccaggagauugaggcugcagugaccugugguuaugccacugcacuccagacggggugucagagcgagacccugucucaaaaaaacaaaaacaaaaaccaaaaaaaccaccaaaaauaauuucugugcuuucggagccuucuaaguaauuuccuacaaaggacacuucuggcagagcuuucuuggcuguuaucccuccauuauuaugcagauugaggucauucagugaugaaaaagccauggacaaauggagccaauauuggaauucccaaugaaggggccagagagaggcuggcaguggagggaugaguagaugccagaggcgggggaggugagggagugaagaaccaggugggaggauucacauaaggauguuggggaacggcacacacugcugcuggggcagucacucugcuggaaauagacaccuagaacagcagagaugggaaagaaaaaauuuaagacuuuugcuucgugcuaagaaugcacuucccguuugguauuuucucuagagaccgcagugaagguuuggauugcuuccaauuaacuuuuuucuccuuaacugcugauucuuugaacacagcccugaacugaggcugggccaugaggcagcaucuuuaucugguuuacagaggagucgugcccagguuguccuaggcacugaguaaggauggguaaaggacuuacccaggacagagucaauacuuaauugauguuggcaacuauuuuuauuguuaugcguuauacuuucccugcagccagaggcugcaagcaaagaucaccaacagaaguaugagcaguucucuggcacacuuuaccacaauaaaaacuccauuauuccacauuuaaacuggggacgcuggccacauucuuuuuaaagaaaccaucaauuccauguccuccaauaucacacugaggaccaguacaugagauuuguaaaggaaagcacuggguuaggagucucaaaagcagacucugaccuuggcccugcuguaugaggugggcaggucauugagccucaguugccccuuuaugggugcaaaugucguccaagacccuguuuuauauuucucuccucccaacaguagauaaucaguggacugauugaacauaaaggauacccaggagcacaaaaggggaaccuugauuugaaagagcccauaaccuggcuggaagaaaagaugugagcaaggccaggugcaguggcucaccccuguaaucccagcacugugggaggccaaggcggguggauugccugagcucaggagaccagccaggauugccugagaccagccugggcaacauggcgaaacccugucucuacuaaaaauacaaaaaaauuagccgggcuuuguggcgggcgccuauagucccuguagcuacuugggaggcugaggcaggagaaucgcuugaacccgggaggugaagguugcagugagccaagauggcgccacugcacucccgccugggcgacagagcaaaauuccaucucaaaaaaaaaaaagaaaagaugugagcagagucacuaauaaaagucugccuaugcuaugcuccaaaugccccaccauucugugacaccuuugagcugcuccguggggugauauaaaccugggugauauugucaauuuuggcaaugccuuuucuuaguaacuuugcccacauuaaagcaaaacaaaacccaggccacaacaauauauaaccuuccuuuguauuaccggauggaacacugaaggaaucccaucucuuucaagggaaaguugaaguucagagaaguuccuggugcacuucaucucuccugaagucucuuugauucaucucugaugauaccugcccuuccucuggcuggcaugcugccgaggcuggguggucaccaucuuugcuggacccacaucacacauguccgcuucuugucagacugaacuugccagaggguuagguggggcauugugaaauaauaacagcuuucccgccugaaaaaucuggaaacaucgcuuucuccacccagguucuggggaucacuuagccucaguuugguuuaaacugauuuuccugaaugugcagccugugcauauuugagccaacaaaaaccuuccucccaacccagaaggcagaugcaacagcccacgcaagcucuaaacugucugcaccugcaacucgagcuguggcacccagcugaugccugcagaggcaucugcugaauucuggaccagggaugaugcugcucggaugggagcugcccaaagagggugggugcaggggugccccccuguggaguauuugugccuacccuugagaggcuuucgcugaagugacccaggagggaggaaguggagcugaauuccuaggaaacauuuacuccaaauugugguuuccaagcccucuggacuguagcccaguucaggggagcaaaagacuuuguggcccacugaguccacucgcuccuacuuugcagugggagagaauuugguaguaacaaaggauuaaaggagaagagaaaacuaaucaaaguaaugcagcaaauacucaggacaacaaucaacagaaacuccuaaaaguaauuuuauaaguaauguaaauuaauagaguagaagcaguuuaaaaccaagagauugccgaugcugcguuguagccauuaagggucacgguugcgaacaccagaaccugcucuagcaggccuaucuauuuauaauagaagaggaauuuauuaagggauaugaaguagcugaacaucacgccaccaucuccccauagucacuugcuguaaauuccaguuucaaucuuggggaggugggucuucugagaaggaaauaaccaaguauaggaaggguguucacaaaagugcuggguagcugaagaaaagcacacaacaaaugucuucugcacuaauaccaaaacgcccuuccugagaauuggaauuccaccucuuaggcugggugcauacacaggaguuucgcuguauuguuuagugauggaugguggucaccuuucuuuacagaauagaaaaugaauauucucaguaaacucuucuaacacacuaauuuuuguuuauuaaugccaaggcuuauuaacccucaauaacucacauauuauguuccuaguuccuuauaaaaaugaauucccauguaauacacuugcuuguaagaauugaagagaauacacauauuugagaugcauuuuuuauucuuuuagaaacccuuaguuucuaucacugggccagggacucugcuuugagaauuauagauuucaagaauuga

SEQ ID NO: 14025 - RNA, 15687 nt, Homo sapiens
auucauauacauaguuaagcaguuuaaauuuuauugaccucccaguuuuuaaaaaaaguuaaauuuaaggucacaccucuaaguuugauguacuauauacagaucgugcagaauaugaguuaaacagauacaaauuaguccaugcccaaaaagauauacuaggguacagaaucaucuucauaaauacauauaaaauucuuguguagaagcgaacuguccagguuuucugagacacuucuaagugaaucaaggcacaaaauguacauacaccauugugaauacacacauucuagacuuugugccucugacauagcccaaggauuuagcuucaugacucuuauaaaacuaaauguacugaaugagauucugcuucuugggugaaaaaccacaggaacuauaaacaucauguagauaauuacuccaaaauauggagaauacaaauacgagcacuuuauuuuaaaaagcaaacacaaaagacugguguaaauccaaguguuuaaaugccuccguuuuggauaauuuaauuaagaaccgauacaaguuuguucccagaagcuaaugcaucacuagucucuacugaggaaaaugaguucuaaaaauuaacaugguuuucaguaauucaaauuucacuauuuauauaaaaaccuagagagaccaauaauauccaguagcuucaaaagauaagcuaaagauucuuugauguaaucaacuuuaccaauguuuguauggguguguuuaauauauacacaaggaaaauacacucacucuauaauuucuuauaaaauagcaaguaaggaguagaaguaggagauguagaaggggaaagagaauucagaaaguccuucucuucaguaacuuugacuucagaaucaucaaaaagcaaccacuuccccucauacuccuuuaagcuuugcacuacguaugaaauuuuguucucaaauccacuaauauuaaugccuguuuggucacuggauuccuuguuucuaucagauucaugggucccaguaguaucacuagucucagaauuucuauuuucagcaaacgcuguacuagcaaccuuaucaggauuagaggcuuuguuguauagcucauaaucugcuuugcucuuuuguccuccaagaaguccaauagcuucuacauuuuuuuuguucaaaacuuuacuuggcuguguauuuccaccaacucuaauugacacuucuucaucauuauaauucucaaccacaccccuugcuuccuccucauucaaugguucuggcuuaccuauuucacacauuuggucaaccacaaaauuuccuuuaucuaguucuaaacuguuaaggucagugacuuuaacagaagcaguguaaugcccacuacuaauuguaaugccacuaugcaucacaaccgcaaauaauccauagcugucguuaguuggcuuugugcuccauucuucuagugacaauuuaagaggugucaauaaaggaguguugaucuuggaaaguccaccaccauaacaaucaaaccuuugggaggaaaaaaagaaaagguuuccugcaguucuauuuuaaauucaaaauguuauaccccaaucugaaaccaaguaaaaaucugaaugaacccuuaauauccaguguucauauaucagaaaagcagaaucaaaacaagaccccaacuuugaauaauauuuauaauauaugcagaaacaaaaaaauaaauaacugcuaauauucaggcauuucuguggaagaaauaauuguauuuuuuccuuuauuuuccuaauuuugugcaguuaagaaaauaaaugguauuuuaaauagacugaaccggaaccaaaaauguuacguuuuggguuuuuuuuuuuuuaaggcagggucugucacccaggcugacugcaguggugcaaucauggcuccuucuggacucaagugauccucccaccucaggcuccuccuccucagccuccugaguaguugggaccacaagugcccgccaccacgccaaacuaguuuguguauuuuuuguagagauaggguuuugucauguugcccaggcuggucuugaacuccugggugcaagccauccaucucagccucccaaagugcuaggauuacaggugugagccacccacgcccagcccauuuuagucauuuuuagugugaaguuuuucucuaccaaaauuugggaaaguaaauaaaauaguauuuuauacuauuagcaaagggaagguccacugaauaaggggcuauauguuaucuuuugacauaaucaagugugagagagcuacugugaagcccucgugguaauuucaaacaagcaacuaauguacaaaggagucacacauacaaugacauuacacaugucagaaaaaaacagacuauccaaaacaaucagcauuuuuuuucaaacuguugaaagacuaguuugauuuccuggcuuaccuuaaaacuaggaagaauuuagccuuucccgccccuucaaaaaaaucuugauguauacaaaauuuguucccugcuuuagucaguucuacugaauucugcuacuaacaucuaagagggaaugaauaugaaaagaugaauaaagaaacuggccgggcaugguggcucacgccuguaaucccagcacuuugugaggcuaaggcagguggauugcuugaguccagaaguucaagaucagacugggcaacauggugaaauccugucucuacuaaaaauacaaaaaauuagcugggcaugguggcaugcaccuguagucccagcuacucagaaggcugaggugggagaaccaccugagccugggaggucaagacugcagugagcugaggcugugccacuacacuccagccuggacaacuggaaugagacccuguuucaaaaaaaaaaggagaagaaaucauacuuaauagaauauguauucauaucaaaaggauuuaaguuguuucauuuuuacagggaaacuguuaauaagaacaaaacuuuacugaagcaaucuuuacaaucuacuucauuucaguacuuuauauuccuacuauuacagcauuuugaacaagacuuaucuucuacagcagcucauuuucuucauauaguucuuauuuacaauacuuacuccaaaccacuagcagcaaagcacuucaaaugaauaguuauaacuucaggcauuuugucaaacaaaagacuucguucagcuucaguauaaugauggcaguuuucacagaaauauuuaucuucuccuacaauccuuucuacugaagcaaauugugaaauugcccaucucagggucuucauuucuguuuuuggcucuggagaaacuaaaaaagagaauccuuucacucaaauacuucucucaggcauucaaaaaauaaaccacaaaguuucagguucaaaauuagcauuuaauuucaauugaccgacccauuccuaaauaacuaaagagauuuuuacuuucagaaacuacuuucauaagugcauccucaacaguauacauaccuuuuaaauauauuugaucggccaaaaaauaugauagacagcaaaaacaaaauaagccuagucuguuuacauuuaauugccaacuuucaauaugugauagguaaaccugucucaugauuauuuccuaugguauuuccauauuuugugguaugcucuagacacaacaguggcucaauuauuguguuaaaaacaaccucaguaggccaggcgcgguggcucacgccuguaaucccagcacuuugggaggccaaggcgggcggaucacgaggucaggagauugagaccauccuggcuaacauggugaaaccccgucucuacuaaaaauacaaaaaauuagccgggcgugguggugggcaccugcagucccagcuacucaggaggcugaggcaggagaauggcaugaacccagaaggcggagcuugcagugagccgagaucacgccacugcacuccagccugggcaaccgagcaagacuccaucucaaaaaaauuaaaaaaaacccucaguagcucugaaagacucagguucccaaaaguacacuuauuaaagcauuucaguuuuccauucuaacacacucuacaucaaaaucaagaugucacaauuucccaaaugcuaaccauuuauaagugaagccagauaagcagaaagguuacauuagacacuaaaagcuagcuuuuuuccccucccuaauuacaccagcuacuauuaaacuuuguguuguuaaagaauuauaaauauuccaucaugguccacacaagacuccaauuuugcuuacuuucagaacucuccucuacuuuggaaagcucaucuucuuguacuggcacacugaugucuugaaaaucuucucuucuuucuguuaaacuuucacauuccaagcaacgcguccuuaauaccagcugaccuugaaauaauuucuccacuagcucaaaaccaauuuguucuucaccuaaaaugaaaauaggaaaauguaagucuauacagauuaguuucucauuauaguccaaauaaccaauuuuccauuuaaauaaaguauaucaugaauaacaguuccauuuucauagaucagcuuauuagcauuauuagcuuauuagagguacccuauuaaugaaauuuaaggucccuguaaagauaaaacugacuaugaaauuacugucuuuaaaagaagucaguuguaggccgggcacaguggcuuaagccuguaaucccaagacuuugggaggcugaggcgggcagaucaccugaggucggaguucaagaccagccugaccaacauggagaaacccugucuccaguaaaaauacaaaauuagccgggugugguggugcaugccuguaaucacagcuacucgggaggcugaggcaggaggaucgcuugaacccgggagguggagguugcagugagccaagaucaugccauugcacucuagccugggcaacaagagcaaaacucugucuccaaaaaaauaaaaaaaauaaaaaauaaaaaaaagucaguuguauuguaacucccuuccuacagacaccuccccauagaauaaacccagaauaaggaugacauuuuugguaaaacuauucacuauaucaauauuacacauuuucccugauaucuguagaucuggacaaaacuagguaaaaaucuaguucaaguaucguguaacuuacaguuaugcaccaccuaccaacguuucaauuauuuaacaauggaccgcaugugacaguagucuaugauuauuuuuacuguaccuauguuuacauaucuaugcuuagauacgucuuagauacacaaauaccauugugcuacaguugccuacaguauucaguaguuauaugcuauacagguuuguugccuaggagcaauaggccaugcaaagcuugccuguagcccguaacaaauucauaaacuuucuuaaaacauuaugagacuuuuuugauuuuuuuuuuuuuggcucaucagcuaucauuaguguauucugugugguguggcccaagacacuucuuccaguguggcccaaggaagccaaaagauuagauacccuggucuauaccauauaggcuaguuguguaguacgcucuagcaucuaguuguguaaguacaccgugaaauucacacaaugaaacagcacauuucucagaacauaucccuguuguuaagcaacacaugacuguacuuagucuuuacuuuuaaaauuucacuaaaugcaauguccuucaucaguuuaugucaaacacugcauaaagggaaauguacucuuaaauguacauuaaaauauacugaacuucccuacuuuauuauuauuuguuuuuuuuugagacggagucuugcucugucgccccaggcuggagugcaguggcauaauauuggcucacugcaaccuccaccucccggguucaggcgauucuccugccucagccucucaaguagcugggacuacaggcgugcgccaccaugccuggcuaauuuuugcauuuuuaguagagacgggguuucaccauguugaccaggcugcucuugaacuccugaccgcaggugaucugcccgccuaggccucccaaaguacugggauugcaggugcgagcuaacauaccuggccgaacuucccuacuuuauaagcuauaaauuaaaauuacuuuaaugacauuacacacacacacacacacauauauaugcauacaauauauacacacacacuaaucuaagcauagcacuuaaaacaccauaguucacauucaguguuaaauuuccuucucuugaaacaauuuuagccagagauuauauuguacauguaucuaggaagagaaaauucuaauucuguagcugcuaaugcuucuaccuaucaaagucuaagaauuauacuaaccuuuguuuauggguuuaacuucauuaacauuuacagguguaacaguauuuccuggagauucaaguccacaaccauuaguuguguuaucacuuucacacuuccccaaguccucuucaggaucacauucauuuucuuuagauuguccuuugacuccuugguuuguuguuauuuuucccagacuacaaaauuuagaaagaaugcuggguugcuuaguugcagacuuuaaccaauuuauuuuaacucuugauuucuuuugugagggucuuggacucucauuuucagaaauauacuugggaauuauuuuaggaggacucucuaauguaucacuuguagcuuuucuuuuugaucuaguuugucucugguucucuuccaaugacugguguuccuuggauaauuuaacuuuuuucuucauguuaccaaauucagugucacuuuuucuuuucccauuuccuuuugggaguuucucuuuaaagucuucagaaugccucauacuguccaucucuaugcuguuaauaccauucauuuccucuuucggaugagguauuucuucuaccuuaguagguaauucugccacauuuuuuacuucuucuuuuuuuaggaguuggcauguuucuugaauguuucccaaaauacauuguaauacuuccugugcaucaugcuguagauauccuucauacauaggguugaguucccuauaaauaaaaauuuccauuucaucuauucuaguuuugaagauacaguacauaaagccuauauagaaauuaauucauguaaggaaaaucauaaauuauuucauuuuuuaaaugucaagacauuuauucagcacuaauuuggaauuucuuaucuguaacuaaaaguaagaguaaauuguacccuauuuucauuauaauacuuugauccucuucuaaauauauuaauaacuaauacuuagauaaugcuuaccauacaccagguuuuagucaaaauguuuuuuaucuccuauguauacauuaucuucacaauaacccuaugagguacuauuaucaccauuacugacagauacaagcacuaaggcacagacagguuaaauaacuugcccaaggucacagaacuacuuaggaugaaaagccaguauucaaacccgcucuuggccaccacgcuacaauggccuuuuuuuuuuuuuuuuuuuuggagacaagggucuugaucuguugcccagacuggacugcaauggcgcaaucuuggcucacugcaaccgccgccucccggguucaagcgauucuccugccucagucucccgaguaggugggacuacaggugcaaaccaccacacccagcuaauuuuuguauuuuuaguaggggcaggguuucaccauguuggccacacuggucuugaacuccugaccucaaaugacccaccuaccuucaccucccaaagugcugggauuacaagugugagcugugaccggccuacaauaccucuuaacuaagguauagcaauauauugcaccuaguucuauuuuuaaacuaaaugcuuaagugauuguuuuaaagacuugcccuauaauuguauuugaauaaggcuauuuuauauguaaaguuucauuuuuaagaaaauaccaaaaagcaaucuaauccaguuagccaacaguucuccucuaaucacauauaaaaauagaauauuuggaauuuacaguucuuacacauauuuugaauauaguccuauaauucuuaaugugaaauccuuaggaccacgcauuuagaaauucagacauuuucagauucaaugauuauauggcauauaaguaaaauauuuaucaccgacuugauaugggaguacucuauaacuaaacacauuacuacuucuauagaagcauguaugaauauucacguuagagauaaauaugaaugacuauaaaaagccucauauaauauguucagaucuaacgaauuuagcaccaaauuuaugaaaaaaauuuccaguauucagagucucugggauauaaaggacuguggaccuagaguuucuacuuuccuugcccuuuauuccuguuucuucgcaugucauucuccuccaaggauauaaacaaguagcuaaauugaaacccuaaaauuauauuauaggcuauaccucaguguguuaagcagucgccuuggcugaguggcaaguucaucaguauauuucucuggauuuaagagaaaacuagccuggagcuguucaaccgaaaugauuaaggacuguaaacugcauaucaauucauaacuugccaaagaaucuucuuugcaauuucccugucaagaaagaaacacacaaaccaauaauuuuaugaacaaauuaaguaccuucccccuuugucuuugucucacuuaagaauacuagauuuucuaaguugcauaauagcacuaauuuuaagggauguacaaauaagccuuauuuuuuauuuuuuuauuuugagacagggucucugucgcccaggcuggagugcaguggcuugaucgcggcucacuggagccucaaccuccugggcucaagcaauccuccaccucagccucccaauuagcuggaacuacaggcucacaccaugacgcccuacuaguuuuuguauuuuuaguaaagacagggucuugccauguuacccaggcuggucucaaacucuugcgcucaagcaauccaccacccaccuugaccucccaaacugcugggauuacaggcaugagccaccacgucuggucuuuuuuguaauuuuaagaggaauuaugaauuacuauuuaugugaauuacaaugguuuuuuaauuauggaaguuaaagauuucuuuaaauacacuguauuuaaauuuuaacucaauuugaaaacacaauggguaaauaaguuguacauggguauaacauauugugauuauaguauacaguaauauauaguauacaaguaacaaaaguuugauacacagauuacaggagcaaacauuguaaaagggaauuaucuaguuagccaccuugaaagaaugaaaaauaauugccugacaauagcucgcuaacagagaaauaaucuuugucauccacccccccaguccucuucauuuccaggcaaguaaauuuccauuaauuuacuuuugcuuuuuacauuauuuucuguucuuuauuuuucuuaccuugucuuuuugauuggcuucauccuuuagagcuucuuucuuccuugaaauaauauuaaauaagugcuuuacuccagauuuaaaaccgggacaaaaauauaauaccuauaaaaagugagauugucuuaaguguuuacugaacaaacaauacacguaaaaucauuaaaacaacaucaugcuuucuauagagcacuuuuaacauguauuacccuaaaauucugagauuaaguuuugugucaaaauuuguucuccacuucaucaguaguagcccagugucuucccucauuagcacaaagcacugcaccugggcagauauugcuaagacuuuaagguuacaaggacacacaacacagcgccaacggacacacaacacaaugccaacguuacuuccaagggauaagacauauaucacacuguagcaccaggaaucagagaaagaaauuaaagguuugaccuuccacuuaaggucuacucaauuuugcuaucccaccuuuauuuagucuaucauuuucucuuaccccaaaggaaguuuaauaacauguaacuuauuauuuuagccuauucugguuuauuaacaaucaaaggcaaagacaguauggacauuaaaguccuccaauaacucaaaaacauuaaaugcuacaucaaucuuugccuacuaaagcuuuaugauauagcaaaauugucaauuuaccugaaguauacuauuaagauagcaaguauugccgagauuauucagucccacaaaugguaacaaguuuucucucuucucacaguuuauaggugaagacugugcugcaggaacaacuugaucacuaugaaauauagaagggagaacgauaaguaguuaucuuaaagaaacaaggugaaaauauuacuucuguagauuuagucuuuucccaaaaguuguauaaucugaaaaguaugugaaucuuguucagaugacauuuuaagaaauacaggcucaaaaauugcuauaugcccagaauaaaaguuuuaaaagcauuuaaaaacauuauuacacauaacaagccacagaacaauucccuuaaaaggauguuaauccuauuuuacagaguagaaaauugaggaacugagagacuaugauuuguuucaucuacuuugacauuuuaaucaaauaguuuaacugaacagaaaccugggaauaaacuaaccaugacaauauuugggagaggcugcacuaaguaagauucuauuaauaagaauucagaggaaagaaagucugugaagagaauuauauaugacuuccugcugguaaaaaaaaaaaaaauauguagcuaucccucacuuaaaaauaaaauguucagaaugugggugugggggcauugacauguaauuccagcuacuugggaggacugcucgagcccaggaauucaagaccagccugggcaacacaaggagaccccaucucaaaacacaaaugcuuuaaguuuacuauucuuuuacuucuuuaacaacaacaacaaaaaaaccacuagguccuuccaauauuuucauuuauuuuacgauugcuagcuauuauuacucuagcaccucaaaguauucagaaguaugaaugcugauaaacaaaagcuucacucucacaaaucuccucaacugguuauugauagcuauuaggaaauuaacacaugggaccaaauccaccuuagucacccagcagagugccuauauguuaaacagggaguaguacagacuccagcuagagcugcuggugguggaauaaaguauuccacuuuguucugauuuauuuucuguagcuaaauaauuuauuugcaucaaaagcauuacuuaaaguuuauuuuuauaauuugcaaucauaugccuccaacagguaugacuaguuacaugacuagaguuuaaaaugucuuauaacugucaagucuucugaaccaaacaaauauauauauauauauauauaaaaccuuuuaccccuacacagauguuuugcacuacaaauaaucaaauuuaaacucagaaagacaauuuuagucaacaaauauuucuccaaguuagucuaaauggcugagcacaguguuaacaugaguuaaacauuaucgaugugauuccuacggggaaccaccaguuuugcuguuccuacuauaaacugcuagauuugacuaagaaguacacugaagcguacuuuuuugugccgcuacagacuaucaagucagacuggaguugucaaccaaguucacugcugcuuuacuguagaauuuuuaaaguacagaaauguaagauacauacauuucagaugcucuauauucagaagcuuuuucuucauuuucuugagaaucugugaaauccaaagcucucuuaguuuccuuuuucugaaaaaacuuuaaggaaagucuguuuuucuuugaagggcuaccucuugaaaguccauuacuuucacuagguaugacaccaggcauuuuuuucuucaaaucccaaggagugucaagaguuaauuuauagaggaaaguuguaaucaccaauuauaucuguuaaucacagagaaaguuucauuaguuuuugguuaucaguuuuggcaacaaaaucaucaauuuugaaaacaaauuuaccaagggaaugguacaaauuagaaauuaacauuugaaaaccuaaugccugccaauaagcacucaauauuuauugcuuaaaugaagaagcauaccacacuguucuuaaagaacaaaaaacagaagcuacugaauuuuuaaaaucagccugcuauggauuaagggucgcauuacaaaauauccuauuuaguagaccuacaguaaaauaguauaaguaguaaaaacuuauuauuucaagggccggaagcgauagcucacgccuguaaucccagcacuuugggaggccgaagcgaguggaucacgaggucaggaguucgagaccagccugaccaacauggugaaaccccaucucuacuaaaaauacaaaaauuagccgggcgugcuggcgggcgccuguaaucccagcuacucaggaggcugagacaggagaaucccuugaauccgggaggcggaggcugcagugagccgagaucgugccauugcacuccagccugggccauagagcaagacuuagucucaaaaaaaaaacaacuuaauauuucauuauaaugauucauucagaaaauauugacugagcacuaccaccucuaauucucaaguacaagguaggaaaggaugaauggaaaaucaaaguagugcuggacgaugaguccucucuuccaaugccuuuucuaguuauuaacauggauauaugaaaauaaaguaccuaaaaagcuuauuaaagaauaauuugcauucaaggcauagagaugguguuaaguuauaccuaaaaccguaagugaaagauaaaacacaagcaaaguugagaccgugauaaaaaaaacuguucgaugcacuuuguguaaauccaauucuuaaugcacuagaaaccacaauacucguuuuccaaacuuuuuaaaaaacuuuggauuuuaaaaauagugcuuugaguaggaaaaaaagaugauuugguuugccauuugcaacuuucccacccuguuuuaaaguaaaacuugcacgugaaaaaaaauggcaacauuuguaggaguguaggaguuaauauuuucuacaucaggccuauuuuucaggacaugggaggaaaaauuaucugacuagaguauuaccauaaaauuacuuaaagcccaaaacuucagcaacgaguuucaaauuuaaaaugcagaguaauaaaaugaacuacacaagacucacucaaauuucauccuuaauaagcauuucacauggcugacacugaucuaggaauucauacugaacucagcacacugaaaccauuucugagacccaaaucaggaagcacuggaaagcugauccaucucuccauucugucuccaacuucacuuacucuccugucuaccuaaugcuucugaggaagcgcugucuucugaaugauaaaccaaccugcgcuaaguucucagggaucgccaagcauuaaugauucugauaaaagguuuuucucgagagccaauuuaauggaugacagaaacuggaucucaaaccgacagaguaaccagacuacacagaagggaagaaugauuaggcaggugaaauagcggaucgucagcuuaaucaaaaaaccaaaccuccuagccccucaaagcaaagcucacaccgagaauguaacauuuugccaggugcaguaucuuccuugcuauuucuugcuccuggcuuuccuuguaacuggggggcuguuacauccaaaauauuucuccuguaacuaaaucaacuuucgcagaaagcacgacgaaucgaccauuaucuguugacagcgugaacacucagucccaauaguuuuaaauucuuuauaagaugacacgacucgauuccgauuuuucaacaaaaaucuacaaggacaucuucgccaagguuuaagacacgcggcguucuaaacacuucuugaaaaaguguaagugaaagaaaaugcgcgguaaaauuucgcaauuaccgacacagggcaaccugcguggaaacguuucuuucuccccauccuucaccgcucucgggaacggaaagaaagcuggaaggacgagcagcgaccaggcugcccggucgggggaggcuggcggcggcguccucggcccacacccccgcgccgggcgcccucgccgcggaguuggccuauuuacgcccagcccgcaccugccuucucgcgucccggcggcggcaagacaggcgccacgcccgaggcacacacggcucccccuggcaggucgaccagggugcgaggccaacacggucccggggucuccccggcagcuccucucccgcgccggccgaacuugcccccgcgcccgggagccggccccuccucccaggcccuccuuaccuggucauggcccaaagcgaaguccgcggcggugacgccggcaaguccaacccgaaugagugugggugcgacaggugagucccugccccgagcccgccggguccccggccccaggaaaaucuggucggcucgcccuccccgcgggggagugaccauccgcucccaagagcgggaaccccgaccgccgcucgcucccgucuugcaccaacaccaacuacaucccgggagcggcgcccaucugcgcccgccccgggagagccaggagcgcaacaagcagcggccccgcucgccgaacgccugaaccgcuagggucuuuagcacuccgccaccgaggggaacuuggcgcguuuuccucagucucaggacccccguguuuuagccuccgcccgcgccagcgcugcgauugaacguggcguccuuugaaauugccgguuccagucuccacgcugcagagacacgaaaggcaggagccgucucgcgacggccacucgccccuggcacgcacgggcuccggagccagcugggacuguaguuccccaaaagccuaacggguuccacaguuucaaacaacgcaggcacagagccgggcagcucgugcggguccucgcugagggcgcgcgcgaggugcuagcggccuggcuggcgggcucgagccucacacccuuuuuuuaaccauucgugcgcgcgaguugagggaaaagcguacgggucgggagacgggacagagagcagacgggaugggccaccaccucgagaaggagcccaaauucaccaauccaugaugaacaauccccaaaaccgcgccucccaccgcccgggggaagccaaucagaaguaccuagaccaaagccaauuagaugggcgggagcagcaagcccaucuaauagcaaaaaagaagaaaggugggcuccagccaaucauuguucgacauacggaguguuccucaggcgcggugccccuccuuccgcucucauuggcgcucgagugcgcgcuuucgcugccgacuguuaaaaucuuguuuggcguuuuguuaauccucgacggugggacgccgcggagggugcggcuuccggagcgaggcccucgcgguaagccccgccuccguucgugcguacgcgcccgggcgggguuaccaagagagcagcuucggaaaauggcugcccggcuggacgccgccgcgcuugggcuuucaguucggagucgcggccacacuaggccuagggccauccaaugagacaaggcgcugccacggauaacaauacaugcucaggcgaaugcuguagagcugaggcccgguccucagccccugcucgccucauuuucgccuguuuaccucuucc

SEQ ID NO: 14026 - RNA, 2535 nt, Homo sapiens
ggcuccuaauuaaguuaaugauacacaagagacaacuaacauuauuuguucauuucauuuauagaugaaagauuacuagauaauaagacuguuuucuauagaaauauuauauuacagaguaauuaggagcuaaaucuagaugguaaaagcauuaggaugugucauuucauuaagaaaagaaaguacauacuauugggggcaacccaaaccauaguuguggauuguuuuuuggauagcagcuuuugcuuuauuucuugaaccuagaccaaaacugaacuacacaacugauaaaguucaaacucugaagagaucagaucuuugcuugggguacaauugcacaaaaugagauacagagugcuaaccaaaucacgacacaauggacuggaaauuuuagauuaauaaacaucuuccaauggaguacuaaauaacuuuuacaguuuuaucuaugguuauuuguuucucugaagauuuaugguccucgcaacagauaugcaucuuaucuuucacuuuccagauuaaagagugaugauuuuaaacaggcuucugacuggcauaaucuagaauugcagaugaucucaauuuuuuaaaaaaugcaaaaagugaacuugcaagucaaaugaaaaugacuuugcgcaugucggaugcagaagggaaaaaaucugcauacagcuaaacgagucugaucuucucuuaccaauccugauccccucguccuguccuguaucagccaggugcaaucuguacaugcuuauccaggaauuaaaauucuucaugcugcugcugccuuaauugauugaugcuaaaaguuuagaaaauauaaccuaaccagcuauuacaaagcgccuuuaaccaagccuucuccuuugaaagcaggauccucaauugaaacuggcagacugcauuuuuagguuucaagcagcucugucauucuacaaggaaugugucugccacuucacacgauagcuugagcugaaagacaugaacuuugaaucagagaaucaauagaacacuuaauggacaauuaggagaacagcuguaggacugucagagacccaucuguacacagcucaaacagcaagccuggacagggcccgggaaacaaaguacacugcuccagggcacuggccccaguacaaaaccucccuuucagcucucauuuaauguuaauauaguguucuuuuucauuacaaauuuuaacacguguagaaaauuauggaaauugcuuaagccauuugucaacuuauaucaugugaauugaucaauaaauuucacuacuuuguuguuaauguagauaaauuuuggcauuuaauuaagcuccagugaaaauguggccacuuuuaauuucagcagaugcugucguuucauuuguaauacauaacuacagggguaaauacaacccaaucaugaauuaucacuaaauauuuauagacaacauagcaauucagaaaauagacacaaaagauuuucacaaugaaacaauuacggugugcaaaagcugaaauaggucgugaugaacucuaauaggagucgugagcagaaucuuaauauuguagcuucacaaaagaauuacauauguauauuuuuccucucaugauccugucucuguagauugucucuagucagcagaaauaauuucaaauuauuuccacagaauuguuccaaagguuaaaagacaguucccuaaguauguagagguauauuaaaauuuauaaauuaaaauaaaaauguauccucucauauuuguauuuacuaaguuuauuuggacacaauggagaggcuucucuuaaugaauagaaggaaaaucuuaugaaagcuuauguugcacccaugauuuggauuugggcuauaagguuggucaaaagaggacacuggcaugggaauggaaacaagaugccagacaauggaaaaagcagaaugaacuuuugaggcuuccuccauauggccugaggggccccuagaugaaauccugguucugacagccagaagccguauagccuuaacccucugugacguaguuugacaugauaaacugcuauauaucauuugagggggaauaggcugccucuuggugauucugcuggugccuucagggaaaaggggauucgaaaucauauugcugucuuuacaguguaauccucuccauaacacccauacccaccauugucuaaaugcuucaguaagugggccuagcuaguuccguaaugacuacauuugcagcagaaaagcagacaugggugccuguguauagauccugcauaauuauauaaaaaauaaaguuaugcagaagcaaagcugauccccucauugcuauuuuuacaauauuuccaugucaaauugaccaucauggcugaggcaguuuggcacuuucuguuguucuggcagagggguaccuggucagagaagaugauucacuaaauucagacucuauuagagaaauuagaacuaagcagccaaagggaaaauggauagggucuucuugcuggaccaaauuauucaucuaaauuuccggccaaaauucucucucuggcucacucu

SEQ ID NO: 14027 - RNA, 1351 nt, Homo sapiens
agcuccagauaugucaaggauucuuaagcagggguuuuccaaucugucccuugaggaacuaccccugaggcaaggcgggcaggcccaagcugcgauguggagaauucgauguccgagcgaccuccucggaggagugggucgaguuaaauauaaccgcgcgaauggaauggcgcuaaaaauaaggcagcagcuggccuguccacagcccugucccgggaggggcgggggccccaguggucuugggcaggaaggccgcguccggcccaggggcgagaaggcugcggcguccgcagccagggcuggaaggccugggaggccgcgcucugugggccccggggccuccauucgggcugggucgcgggccuggacggggacuguccagaggcauccgaaagccaggccaacuugccuggacguaacaagacggaagggcugggcgcugagguccugccagcccggccgccagagggagcugagcgccagaggaggacaagccgaacccuucaggaggccgggcgucuccggagaccgaagcgccggaggacccgaggaggucugccccgcgcgcugcucuggagacucccggggcggguggcgcucggccuuuccgcucccuuccuucccacaagucccuucccgcgcgcgccccacggcccugcccgcccucccgcgucagcgccccaaccgucaagccagcaauugaaacguuuccaaaacggucuauuuauuugcucccaauaaaucgaucggcggugauuaaagaaucgauguggccugggugggcgagucgcuugaggggagggauugggggcuuucgcccggcgccugcagggaggccgagggcgggcgcgggccugagggaggcgugucccgcccgggccacacccgaggacccgacaccugggcuggcaggccccggcaggcagcguucccuccggcggagaggggcgcgcgcccgccgccugcuuuccucggccccucucgccuuucucgcgcgccggggaggcuguggccgccaguggcugcggagcugcucagaggcuuuuguugcuccucggccggcugaauggggauuuuguaaagcgggacagauaaaaaugagcagcaucauauuguuugacagaaugaucucgcaugaugaagugucggcuccgaagggggugaaaauggugaauuccuaaaaacccagcccugggcuccuccucgagcugccgguagccuggagggacccagcggacagccgggccuggccgcaucgcuccaaacggugucagaaagacuccggcuuucaaugccaagucauuuuuaagccccgauccuguccaggaccuuucuccucguggaugaaaag

SEQ ID NO: 14028 - RNA, 1369 nt, Homo sapiens
ggcggagcggguggaggaggcgaggauguguggccaaugcacgcggagugcaaggcaagucagugauaguaggaaaaacuguggggauuucacugggacuggagggggaggcaccgcaaaccgacccccaagugcguggcuggggugcguggaccucacaccuccaaggaaagucagugcucuugacgcggugaaucagcgaugcgccuccucuuuccucccucauuuaggccgccuaguugggagccgcaagagccugccugguguggcaggcacacggaacccaaucccugucuguccgcugcggccugggaggggagcgccggccucaccagaggaaggagcacgaggggaggaguuccgagaggaaauaauuagugaaauauuugcagaagaugcugggauguggauuuaauuccggauggacaguggugcuucugauucccucagucuguuuccccacccacgaucuccucuuuccuuggccuagacacaccaaaaauaauucaauaaaauaaaaauaaaaauuuaaaaaucuguaaacuugcuucauuacaggcauugagacacacagauugacuuucauccccauuagacaguuucccaggauauaacacuacucaucugaggcugggagcaggguaggggguggugacacuauccugagacgcccgccaaccuccacaguuuuucuuuaucuaaaugaucccgagguugcacacggcccuaaaacgcaucucagaguugauuuccguagcuccacagcuuuguggcccgcaggcuccgaaccguuuacaaugccgucuagacagcuuuccgcgaaaccgacccgagcugagcuggcuggccaucgcccaggacugcagaggucgcgucugcaacugccucagcaaccgaagugucggaagguccaaaaaaaaaaaaaaaaaaagcuaaaaagcggaaauuuacacauucaggaaccuccuuugcucugcuuggguugcccagcccuaaaggcaggggcccggggcgcagcgcuggcccugccgcggccuugguggcugggcccgcguggacuaguauguguggaugcgcgccggaggaugguggcuacagggcuccccucaccggucucgaaguagucuccaaaugagccuaauuucgauuccgccguccgcagaggcuagcucucuggacucccuccacgcugcuggucgcugccuccuacccucccucugccacggcccagccugauccguccauuccccggugucuccuuggaaccucccuggggaaggggguggaggacgaacaacucccagcugccgguuccauuuguugcgcuuuuuuccuucgacacaauaaaagucaaauuaauugauucaua

SEQ ID NO: 14029 - RNA, 330 nt, Homo sapiens
agggaauugucaacaaagggacgagagacgcgcaacuccgcuccgcacugugcgccagcauccccggggcacggagggcgcugcggcccgcccggagacccccccacccaggcuggauccgggcccuggggcccagggagcgggugggugugagugugggugggugugagcgagucagggcgugggccugggagcguccgcgggacugugcgacugucgcugcccugccuuccccgcccccucucccuuccgcccuucucccccccacuuugucacacuccuuagacagggacugggcgaccuagaacgagguucccauaucguguuuua

SEQ ID NO: 14030 - RNA, 2574 nt, Homo sapiens
ggaaacauccuccccgcgacgaaggauccgggugugcgcgagcaaaggagcgagcggggaguucuaggcccaggacagcaccuauuuccugcugguguaacagagcaccuucucucacuacucuggccauaccacccccgcgauagaggagcaacacagcugucucugugcgcuccggaucagcgcuuccuagauuucuagccggaucguuuggagaagggcucugcaucuuauuuccgguggcggugaggugcaguugccauggugauuagagaaaggccgagaucuguccagcugcggugagaggaacgcugaaucgccgaagagaauuggcugcgcuuccuuguuugugagcuagaauuagguagcaaacagcucgcugucucugucucuucgcucccucugucccucucugugcagcugcuucuccuuccucugcuuugucuacuucucugucauaaacauuugguccauguauguaccuaaaauguacauguaaaugcgguuuuauuuccagaggaauacaaaaauagagagauggugcccgagauuaccugugacgguauuucacuguguagggacggugacuggacggcuuucuguuuucacuuggcccuguagaagccuuaggcgcuuguuaacaguuuauuuuucuugcuauuguguggcugguuauuuauggagccguuugcugcaauguacucucuaggccccugucucagucucgggccggaguuuuaaguaagggagguuuccaagccugcggggggugcaauuauauguuuauuuaagcuuuaguuugguuucucgucacagaaaggaaaagaauaaaauucuggcacauuucugccuugggauuuccaugugagggaguugccuuguuuggaaagaauauuugaggacgauccuaaaauauacuuauauuuuaaaauugcuuauugcaaagugaaauucauucucccuuacuucuugaaacaguuuucuuucacauuugugaggagaugcaugcacacauauguguuuagaacucugaugcuuaauuauaguauuaccaauuugcaguaaccagacugugacaccacaucccugugggguccuucuaaaucugguguaauaugaaagugucaggcaggcggccugcguauuauaaauaggguacuucauccaugauaagcaauuauuaucuuucuuucccaaguguaaaugaucuauauaauucgaaaaggugcaagugauuuaggccuccugaguaggaaugcaaugaguccugaaggggacccuaccuguguuaucuuauuauugaacuugaaauauucaauuuauuagguuggagaucuauuuuuagaagucaaagcuggguagaguaauauuggaagcuguuagaccaccaguagaaucuaauaccccauaguaaccauuguucaguacuauauccacauuaacaaagaagaaacuguucgugaaauuuacggcuuuuugccacuuacugcuagcugggugacauugcuaccccucaauuuccucaucuguaaaacggacaaaaaaauaccugaccgcuguaauagggauaagacaagauguaugacaguucuuuaagcucuuauguacagaggugcuauacaaaccccaaauauuguuauuaauaaaggaacacaguaaaacuaugauaaugcuauaaauaagacuuuuaaaauauagcuauuugaaauguggggcugcauuauugagauguuaaugaaaugaucuuguugauccugcuguggaagaugggugucaacuaccacucauaucccgauucucauuauucuggaguuucucauuaucugcaguuuauuuagcacuuacuacgugucaagcaauauuguauaugcuucacauguauuaacugauuugcuccucuuaaaaaccugaugaagacugucaucugacuuucguauuuugagagaauagaugugugcucuuccuuuguucagugauucuucucuuguguauaucuuuguucuuuuggcuauuaucacauauuugaacaauuauauauauacauauguauauaucuaaaauuagaaauuaacugccaaaggcuuauucuuguuuaauauauaauacguccauauacaacuauaguauucgucuuuuacuuccacauauaaaacuuuuaauaucuugaucuuuucauauauguuauaaauuuucuucuauguauaaaaucuugauucuccucccuguauuugaaagacauggugacauuuguguuuuagugacucacauugacaaacacauuuuuaaauuauuuuccaauagaauggcgaucaguccacgaagcgaugcaacuuucuccagucagaaaucaacaccuucagagaguccucgaacaaagaaauuuccacuaacugaagaggaaauauuuuauaugaauuguagagcugccuacuuaacugucuucaaaagcagcuuggaaaacauuauuucuaaagaucaacuuuacuuagguaaauuuuuaaaauuuuuaaaucuuucaccuuuuuguugaaaguuaauaaauagguccgaaagacugaaauuagaauuaccuug

SEQ ID NO: 14031 - RNA, 677 nt, Homo sapiens
agagaggugcucuuagauccgaccuccagugccuaccaccauuccaagaugcuuuugcccagagcaucccaguauguaaggcucugcaauacagguucuauuugaucuccauacuauaaaauacugacaaaguaauaucauaaaaugcaaggaaacaguucuucugacaagcucuauuuccuccaucacccuccguguaaggacuucaacaaacugacuacuucuuagaguuacuaugcuaauucuaagcaaacccccacaauuuuguaauaaccauuggcuuauuuuucuucagccacagcacacaaacuguugucagauacgcagcugaaaaaauaugccuucuccauuucaggcauucucacuucccauuuguugagucucaagacccuccagcauauaguauacuaaacucuccaugaauaauucuaacagaugggccccagauucucugacccccagacguuguccuuccaauuucaccaucuacaucuaacugguucuuaugucaucagccucugcagucaaaacaaaaccaaccaugucccccaaacuccuugccugcccucuuuaauucuuaaaccaccucaucuaugggaaaaagauggauuuuuguuggguugcgacuucuguuuuucucaacaauauuguccaccagagguagggacacacagaac

SEQ ID NO: 14032 - RNA, 135550 nt, Homo sapiens
cgcggggcggggcggggcgggacgggaggcggugcgucgcugagcgcaggccgcggcggccgcggaguauccuggagcugcagacagugcgggccugcgcccagucccggcuguccucgccgcgaccccuccucagcccugggcgcgcgcacgcuggggccccgcggggcuggccgccuagcgagccugccggucgaccccagccagcgcagcgacggggcgcugccuggcccaggcgcacacggaaguggugagugucaccgggggagguggaggagccggggcggccgcggucggcaggcgaggggcgcgcagcccggacuggccggaggcgcggccaccgcucuuggucgguccuuaggcugcgcggcccgggcugcuccugagcgcagcucaggaccccgcggcucgggcggggaaggcggggauuuccagccccgcggagccggcgggcggcgaggaggucgccgggcgggggcccccggccgggagaagagcgguuaagccaggccgcccccucccccagcgcgcacggcaaguuuucauaaacaagcccggagcgcgcugucugacauccuguuuauaccaccccgagauacaggcgcgggcuggagggcugacgucccuagcuccuuguaccgcgaacuugaccgccagcucccggccgggguggcagcgcagaaagguuuucuucuucggccccaggaaggaggcugagggucuuagcuuuuuuccuuccuugcggucucagcgagggaaaguuucugggauuuggagcuggguguugggcguccgcgaacucgggaaacgcccccuccccucuuagguucuguuaggaaccaggccucagguagccagcgagaagugggaaaggagacccugggcgagaggaccagggaaggggaacagugggagagaacuacccggggaauugcgaaucccacuggaaagggacugauuaaccgaaacuggggcuggucucuggcucccucacuccaacuccauccgcgcaucgucggcgaccgggagcaucggaggacuaauagacacuccuccaaagucacuccccagggucccugggaugugggcuccuuggauguguguuuaccacggaacuucuagauaaaagaugcgauguuugccagguguuugugcacacguuuuuuggaggguuugcacuccaugauuuccuguguguuccuggggaaggggaccccguccuuccugccacucuucuuacuacguggcugugagcugccuucugccccugguugaguacaucgcuauacaugucauugacacuuuuccccccaagucauaggguuuuucucucacuggcaggaauuuacagugguauaaaauugucauuacuucuuucagggaguaaaacauggguaguuaagugaugagaauaaugcagagagagauguaaaucagggcguguuugguuuuggcuauuuuuuuauuuuuugaagaaaagauuugaguuaaauauggguauaggcacaguagauuuuguuuaagaugagcaauucguauugauugaaucuuuguucuucccuuuccaaaaccccauuauguguuguuucuugauuuugcuuuuggugacucugauguuuuccaagaccaggggauuauuuucauugaaggaucaauguguucuuuuguacuuuguggugaagauuaauggagaccaccaggguuccagacauuucugguacaauaugcuuuguaauguggagaaaaugucuccccuguauagauccagaucacauuuaaagaugugaagacaucauacuggaaugacuuuggacauuauaaauaggaauaaucauaaccucuucuuaauucuguauaucauauuaacuaagugcuuugacugagucuuaguuucugcaaauagauacaaaacuauguuuuuuuacugcuaggauugcagugugauacuccacacugaauacagccaguuuaaaugguuuccuccauuucauacuauacuaauuauuuacuaccauugggaaaugauuguagagaaugcauaaauuagauauagguaaaauaauucaaacauuuccuaaaauauaacuacauuucaguuguuguaauuuaggaucuuaacaugagcuuggcuaaagccauauacuuccgacugaaacaagcauugagaacguguagguugauacucauuuguguagagagaacaagagaacacuaagguauaacugcauagcaaagaccaugaucuguguuuucuaauucucagauuccucugguguuuuuuuccccucaaagacacaucccauuuuguauguccuuauguccugauaagauaauagcaugcuguuagaagauuuauugucugagaugugaauauucauacaaauaaauuuuucuuguucauuuucacauuuaaaaccauuauuuuaaguggauggggaauuggcuuauuaauggaaucucgcugaagaaggaacauuggauguucugugauuauuguggcucagugguauauggaaccuugucauugaacaggaguguuggaaggaacuuucagauuuuuuuagacuaguaaggguaugauuuugcacccaaugagauauuugcaguuucuggagacauuuuugguuguuacaacuugggggaagggagcggugcuacugguaggcaucuagugguuagaggcuagggaugcuacuaaacauccuauaacgcacaagacagccccccaucccaaacaaagaauuauccaucucaguagugcccagguuaagaaguccugcuuuggaauacugaguaaggagcaagaagaucugggcucuuguggcaaauuuuuucacuucagggcaccucuuuucuucauuugcaaaauggagauaaaaauauucucccuggucaucucgcagaguuuuggggggaagucagguaaauaaugcauggaaacugugacgugcuaugcaaaucauaacuaauaugaagaguauuuuucauaagugaaucauuagauuuaccgguaguugagggaaccaggguuaaggcaauauguugaguaaaaagccgccuguggaugguuugauauuaucgaauucuuuguuauucauuuuuugggguaaagguuuuuuuaguauacuuaguuuucuuauugucagaacauguacuuuuuagcucuauaauuucuuuaagcaaagguuauuuuucccaucauaacaauaaggagaauucacuauagaaaaauuagaaaauauaggaaaguagaaaauagagggaacaagucauucaugcucuacucgcuuguccauuuaagcacacucacauccuugccaauuucuuuucuauaagagcaguuaggauucagagaaugaugagagagaguagcuggugaccaaggaagguguuccuuguuucugugcccuucauuucuuucuuuuuuaauaauuacgauguaaagguaaauuacauuauaguaggcaucagagacaucgguucauuguuuuuauuauuauuuuuauuuuucgagauggugucucacucugucgcccagucuggaaugcaguggcacagucuaggcucacugcaaccucugccucccagguucaagugauucucgugccucagccucccgaguagcugggauuacaggcacguuccaccaugccuggguaauuuuuguguuguuuuuuaguagagaugggauuucaccauguuggccaggcuggucuagaacuucugaucucaagugauccgccugccuuggccucccacagugcugggauuacaggcgugagccaccgcgccuggccugguucauuguuuuuauacuuuccuugcugccuccaagccauguucucauucagcuuguuuccucucugcuucuuacucucccccgugcucagcuaggugugccacuguugcuuccugucucagaaacccucugguuacaugggauuucaaacagcugucauguugaaaugacuggguuucagggaccggaaacuaauuccugugaguauucuuuccucugaggugcaccagccuucuuggcaguuuaaggcgacaggaaagcauaaaacauuaagcucauuuccgugauaccuccacuucugaggguuuaugauccaugauucuuuguaguuggcagugggcacacauucuuccuuggugcucugcggauaaacugcccagucccgaggcaagaccugcuuuagaagcaaaaggauaauuucuuuuaagucuacucuggccagaagauagagcuggcguuuguugggauauuuuuaaucugcaguaacugaauuuauuuaacaguacuauucacacuagcauuuuauacauucuuuuauucauuuagcaaauacuuguugagcucuugcagugaaucucagagagugaauagacagacaacaaaacagguacaaaucuguccucguguggaauuuacagucuaguggaagacccugagggcauguucaguuuuacaguugcagacuauaugcauguaaaagaguaaaucuuugugauuguagaauguuuccuagaacccuucauggcacuccuuugaaguuugaggacuaggaaguagcuuccccuuguuaucuuucuuuuuuuaauguuacagauuaauucauucuuuguaugcacagacaucucuuugguaccuauuaagugccuggcagaaggauaagacauaguuuauauggaaauaaacuugguauacauggcuguaacacauugugggugaugcuguaguagcagucagaauuaagagcuccaggacccugaagagagcuaauuccugcguggagcccuugucaaaugcuuuuuugaagaggcuucauuugaguugggccuucaggagugaguaggaguuccuuuguuuuagggugggaaggaagucuaggcagagauacagugugagcaaggacauaaaagugggcauguacguggugucaguggcagacuuggaaguggccacuagauuagagcaaagacugcuugggagggagcggaaggagguagggcaggacaugcagguuggauccagauugugaagaccguagcucuuuccacaaauuugugagcaguguuagguuagggacugaggccucuguugaacgaaugaguggggaagaugagaagccauuugaaguuuccaagcucaagaauaacaucguuagcaaaugaagaccugaagcacugagaguucuaugaagggugagcuucaucugaccauugugcaacucucuccuccccaucccagaaaacgccuuuuauuaucugccauuuaucaacuauccagaagacuacuaggaaacaagaaaggcuucgagccaagcaagaugucaugaaguucauccaugcuuuucuuacaguggaauaaaaccuacuuugauuugcuuuuaauuuauaaagacuuuuuuuugacaguuuaucuaacugguuuuuaagccauuaggaaauuaaauacaagaaaccuaagaggcaagaguuguuaaguggaugaauacaggaagacauguucucagaggcaagcaguguuaauuuuuaucuuagaagugaauaaggaguuucuacugguuuaugacaaggagaaccaaaacucaaaagugaaacaaucuggggcauuuaguggagggcaaacaccauugucaacaagcuagcaauuugagguugcauuguuaaucacagcacaguaugguguuugguauugguaaugaucaucaagccaugaagaagaggucaaguuguugagcauaaaugaagugaaaguucacaucucuagcagaaaagggcaacuucagaugucucauuuagggguuaggagguauguaagaaggucugaggacaauauaagaagcugcuuucagagaauuucuguagacaaauucaaagaagagguuuucuucagggugaaacaccagugaggaaucuuugcuuuaacucagggaagauuacuuaagagugagcugcgagagaagguugacugugaaaccuaggaagaggagcugcggccgucugcauagaagauaguaauaacuugaagccggcuguaggagacuaaaucacaucaauuuaugguaccucugaguagaaaacagacugauugauugucuuuuagccuuguuuuguuuuuugauucugauagucuguuuuuggaggcucuggaucuacacuguaugauuugauccuagcugugaguuugcaagcaaguuacgccuguuuccuuauccauagaaugacaauaaagacaguaccuaccucugagguuguuuugaggguugaaugacuaugcuuaagauuuugaagugaugccagcaugagcugaaaaugugcuagcuauuuuuacauuuuauuuuauuuugagacaaggucucgcgcugucacccaggcugaagugcagugguguggucauaacucaagucagcguugaccuucugggcucaagcaauccuccccaccucagccuuccgaguagcaggaaccacagacaugugccacaauacccagcuaauuuuuaaauuguuuuguugagagagguuucauucuguuauucaggcuggucucgaacuccugggcucaagcaauccuccugccuuggccucccaaaguuuugggauaauaggcaugaaccaccaugccuggcuuauuuuauuuuaaugauugauaaauaggauguguauuuuaaaaaaaacccucaaauuauauucagaauguuuaacauaguagggaagaugccaccaguagauacaaaacaaaaacuaacagauauauucuauguuagauuucaguuagcaaugaguaaaucaaaaaagaaggcaguuucucaaaucuagaaggguuuauuacguagacagugccaaaggugcuagguaaauuagguuuuacucuuauuuuuaaggaaaaaugacuaacaaaggugcuuuuauuuaauuuaaagugccauccaagguauauaauuugguaggaauguauuugacuuucugggaaaguuaaugugaagauacuguguugaccucacugauucaguuuacuuagcaaguugugggcuauuggcagaggcaccauguauaccuguuuguaaaacggugucuucagaguuguguggaaauuaaauaucuuguaaaucagauaauacuccagggaguuuugcugguaaggaauuauaagaguuuaaagggacucucaaauauguauucaguuucuauggaaugcccuuuuacaguuucuguuuccauaaacauauuuugcuuuccuaaagcaagauuuacccaaaauguaaaagugugcaaagaguuggcccuuccuccuaaucauagauguguguuuuaaaauauuuuaaauguauuuccuucuuggugauguauauguuggacugguuucuugggucugggcauuauuuauacucaagaacaguuguugccacgugauuggaaaagcgcuauugaugucauucucaucccauaugcuuugacagcaaaggaguuagcuguaucuucccuugucuucccacucuagaaugagaaagacaagaaagcucccuaauuugauuuguauggagggggaguggguaggaaaguccacuucagcugaaaaggcugaccuguagguauuuaaaacauaaauuuaggucuguuauuuucacauacacuugguaacucagacuggucugaauauaaaguagaaauagcuaagaaccauuuguaaugaaugcaacucuuauuuguuuuuaaugguguuuuaaggacuuaaggguauuagaacugacaacaguuuauucaguuaagcacaauuuuaucuggaggcuugcuugcacaguuaauuugaucagguuguaguaaggcuauauaacaguuuuuuucaauuaugauuuaaaauaauguuuauauuguacuaagagaaaagauaacagaaaacaacucaaggaaaaaauaaucugccaaauaugugucuuuccagauaaaaauuuuguuauuaaacuaguuugguggaucacacacagggaugcggacagaugcaauauauauuauaaagaaagaaguacaauggcuuuuugccagguguaccugcaaacccauuuuagcacuaauucacauaacauagacuaaaaaguaauaugcuaaugucuuaauuuaauauucugacugauuuuguucaguuaaaaccauucuguaaaacuuaaggcaaguccacgaaucacaguauacggguuaucuuuuugggaaaaucauuugauguauggugguaacuccaaggaaccucauguuuuuacuuguguagaacgaccauucacuuggguugguuggaaguaggaagaagucagaggaggucauauuggcccaaacauaaauuguaagcccacuugaugugauuuaggaagcaggccaccuaccaucuacaagcuggcugaaauacaaaugcucuuagguuuucauguuuguuccuuuauucagcaacucucuguagaucucacuguaugugagaacaagaugggcuuggcuccugcccuuagaaaaguuccuugcuaguugaaaaaacaauucagcaauuauauuacuguuuguuacagugaugcugaguaccgggagagaugucagagguggguuguaagaaaagggagucuuugcaguacacuuuuuuuuuuuuuugagacggagucucgcucuuucgcccaggccgggcugcaguggcgcuaucucggcucacugcaaccucugccucccggguucacgccauucuccugccucagccucccaaguggcugggauuacaggcucccgccaccgcgcccggcuaauuuuuuguauuuuuaguagagacgggguuucaccauguuagccaggauggucucgaucuccugaccucgugauccgccugccucggccucccaaagugcugggauuacaggcucccgccaccacgcccggcuaauuuuuuguauuuuuaguagagacgggguuucaccguguuagccaggauggucucgaucuccugaccucgugauccgccugccucagccucccaaagugcugggauuacaggcaugagccacugcacccggccugcaguacacuuuuauacauggaaaucugaagugugaaagagcugugccaagagaaugaggaggauuuccagugagaggcacgaauaugugccaaagaccuauggugggaccaacacccugcagcuggugcagagagaacaaagguggaggcuggugaggcaggaaggaaccuggucaagcagggccuuaugugcuuuauuacuuuugggccuuauaaugcauuaggggaaguugaaguuuuuaagcaggguaguaacaugaugagauuugugucccaugaaaaaacggaaggaucccauccacucacuguugccccuagagcaccucuccucucuuuccucuuucccuucauucugcugccaaauaccuugaaaaccuucacuuccucccacccacucauucuuuaacccuuugcaaacugacugccaccucuacacucaugagacugcuuccuugaggucaccagugaccuucuugcugucacauuuuaacaccuuuuuucugcccuaguuaucuaaaacaguucaugcugcugaaaaccuccuuccuggcagaugucccucaacccuacuggugccuggcuucugagacacaguaaggacuuccuuucucuguaugucucuguucucuuuuugaguaucgucucuuucucucacuucuccuccucccccaaugaggauguuucuaaagguucugugaaugguagauuuauauguugcgaaaacugugcagaugacccacuuuugccugagcuccaguugucccuuuuuauuuauuuuccuuccucucugcuccuuaccucccccaaauacugguugcacaguuucagacacuauucaaggcacuggggacacuggggaacaagagaggaaaggucccuguccuuaaguagccaacagucuaagauguuaaacacauugauaaacaagauaauuucagguggugauaagugcaauagagaaaguuagcaagguauggguagugaaugcuuagguugggggguugggagaagggcuccuggucugagaaagugacauuuaaauucagcccugaaggaugaguaaugaguagaagccaggcagugcaaugaucuguaagaaaaauguacuaggcagaggggauagccagugccacgccccuucagugggaugagcuuuccauuucacacugggcugccuugcuguguguccuuugacaccucccauuuaacugcuccaagauugauaccgucuuucuuucugacccaucaucauaauaauggaugauuucucuguuuugguuaauaccgucucuauccaccacccugaaaacccuaggccagcagucugaaaacuuugugaggggaaagacaguaaacauuuucagcuuugagcacaguacagucugucacaaguacugaaucugcuauuguagcaccaauguagauauagacaguauguaaaccaaugaguguggcugugcuccaauacaacuuuauguauggacacugacauuucuauuuucacuuguaacaaaauauuuuucuuuuuuuuccaaccauuuaaaaaugcgucagcuuauuggcguucaaaaugggcagcggcaggccagauuuggcucacaggccaggaucugcugcccccugccuuagacuaacccugaucucucccuuugcuuuugccccaccccaccuccucccuaggcccuuucagggcucccucccugguauucguauucagcaccuuugccacucgcuguccccacugcugcagccuuccuuuggcuuucuuuaccugggugaucuaucauugcgcacucuauguccaugugcagacauuauuuagcucccacuuuaagugagcacaugcuguauuuaucuuuccgugucugacuacugaucacaagccuuuagaagccccuauugccuauagaaaacaauccaaacuccaccuuagucugauaguaaagguuccuuaugcuaaaaccucaguuuaacuuucuagcauacucuccuauuucucuccuucuacacugucccaaaauagauuauucauuauuuugcuuucaauguuucccaugcuuuucuguguucuuguucauuuaaugcacuuuucccgugcuucaugcuuuccaucugucagaauuccauagcuuucaaggccccuucaaaugucccuggucucuuccucugccccucccuaccccaacaagcgguguguauacacauaguccccugguggugugugauccucuguuccaguacgucguguucuggucugugcuucuguucuuuugcagacacaccuccacuaugcagucacgaggcccuugaggacaggaaccaucucuuucuucguaaugucaccuuucccaguaggcacacggcuguuuauugaauaaacacagauccuguguacacuugcucaaauuguacaaaauuugcaggagauucaaaguggaaacauuuuacugaagggaauucggucaaauuacauccuugauucuuguauaggugguacaguuuuguaaaggaucaucaaguauuuuggaagacucauuggcucugccaguggcuuagauaaauaaauucgggcaaguuauugaucucucuccucagagaaaaaaauugauguguuuucuuuuauauaaagagaaaaagaaaaagaaaaaaugugaucuguaacucauuauguuuccuugcuagaaagcucaaagauacguuauuugccuguuuuuaguugcuauccaguuuucuuacaauaaucucucugccucagucuccucaucggauuacuugucacauguguuaaauccuucuuuuaauugaugguucuguuguauauaucuuuuauauuuauauagguagccucaacucuccuuuuuuuggagagugguaauagaaauauaaauaauaaauaguugcccuuugguuuccccaaccuguggugacaacaagauaauaaaacagauacuuauccuauauaaaacaggcaaaaaggcuuugggacaauaugggaaucaugauguggguuugguggaaaacgagcaaagcaccuuguaaggaucuuguagucugaagauuaaggugugcuugggguaggucauguccucccagcucugugggauuuguagcacaucaucccacguggggaggagagugggcacgggcaugagacuauuuauuagcuuuuacugugucaguuguuggguuauguauuuugcauuugauauuuaauuuaaucuuuguaauagccagagacuuggaucuuauuggcaucauuuuccagaugagcagagcuaauaaauggcagaacuagaauucaaaucugaggcucucuggcauugaaaacaacaacaaaacauguuucuacucuucaaagagacuuuuucuccuggauugucacuuguccuuuucuuucucuuucucuccugacauugguauuuaaaaugagaaccuaggaaacuuguuucuucuaaccuaauguuuuugaagcaguuuuagguccuuggagaugugccuugaugugucuauacaauauaguauuugguauuguuagauauaaagaagaccugaggccgagugcggucgcucaugccuauaaucccagcacauugggaggccaaggcaggcagaucacuugaggucaggaguucaagaccagccuggccaacacagugaaaccccaucucuucuaaaaauacgaaaaaaagaaaaaaagaaauuagcugggcguggcagcacgcaccuguaaucccagcuacucaggaggcugaggcgggagaauugcaugaaccugggaggcagagguugcagugagcugagaugaugccacuucacucuggccugggggacagagcaagacucugucucaaaaaaauaaaaaaaaauuuuuuguuuuuuagguuuuggggcagggcaguuggguucauuuagcuguccuaaaguaaguuugguauauuuuugugaaauauuuaguuuaaaaguuguauugcuguuuuugacauuuuaagucagacgagauuuacuguugcuuuauauuaccugacuguuauauaacacguccuguguuuaccugugugggucugagcguaccagaugugguguuaugaaaagcgugcuggacuuggaaccaggacgagccgaugugaggcuguccucugccacuuacuagcucugugacuuugggcucauaauugagccuuauuuuuuucucaauuguaaauggacuguguagaccugucacagaggaaguuuugugaagcuuaaaugagguagaaccuacaaaauagcuucagacagugccugggauccagcagcauuuaacgaaaguuacccacugcuaccccaaauacugaauauugccagaaaaucuguaaaugauuacauaauguuuacaccuuuauaagugguaacuuuguagguaaauauuauucaaguuaugaaccucugauuuaggaaaccuccuuaugcaaaugguuggcuucccacuacagaaacaucaguaauaagauagugguuuagacucccaaaucugcgaccagucuguauguuugaauccuggcuuaugaucagucauagcugagugaucgugggcaaguuauucaaccgcuuugugccucaguuuccucaucuguaaaaggauaauaggauaauaauggcuccuaccuuaugggauugugaaaauuaaaugagaauguguguuuauguauguguguguuugucuguauuuguaccaauacccuauuggaguuuaccacuauuauuuacuguuccucuucucuuuuccucccuguguaaacagccccauaaguuaucuggaaguucccuaguaucucuuucuuaucuucuguuacuggaagacuccuuuuucuucugucuuuggucccguguuaguugcuucauuuuaauugaggcuaucuuguucuagugugcaauacauucucauugaucccuucccuauacauuucuugccuagacacuuugaaaaaguguuuuuguuuuggguggaaacugaacauuuucuaauaaugacucauaaacccagccagguguuaaggauacuccuauaucaaggaaaaugaaagcuauacagucucaagcaaaugaaaaaacuauauaaaaugccuaauuguuuauugaauguuuaugccagaaauucagaucaauaaacugagccuuagaaugguugauguuuaaagguacccggcuuuuaaguggaggaaccuagauuugaucaaagccagaccaaccuggcccuugguuucacaaucccuaagcucacuugccuuaauaaggccucuaggcaccaccucaagacuccaucugcaccccuuaugaaccuacacucugcuuucccucacacuccugcuuuugagauggcaaaaucacuuaugguucuuuuuggcugcaguaauguuuccugcuauuuuggcagggcaaauguauagcguuucagauacuuuauguguuaaauuggccuuuuguguguuggcuuggaaacuuaaccacauuuacugcagugugucugggggaaaugugcgccaaguuucaaacaaccaacugggaaugaauucuuuaaaaggcagaacuugugccuggcgcgguggcucacgccuguaaucccagcacuuugggaggccgaggcgggcggaucacgaggucaggauucgagaccauccuagcuaacacggugaaacccugucucuacuaaaaauacaaaaaauuagcugggcgugguggcgggcgccuguagucccagcuacucgggaggcugaggcaggagaauggcgugaacccgggagguggagcuugcagugagcagagaucgagccacugcacuccagccugggcgacagagcgagacuccgucucaaaaaaaaaaaaaaaaaaaaaaaaaaaggcagaacuuguuuauagcuaagggcugcugguguauuuauuugaguguguuaccugcauugguaugcuuuaagggcuucugugucaugccugaagcgacauauucuggaauguauacauuauugcacuuccuugguuaauuguccucacuguugcugaccuuuguacacugaaccacugccauuguguuuggcacguaguaggaacccugugaagagacuuauuuaguccucuuuaaagaucaaugguucuuuauacuuuucuguaugcuugauauauuucaauuuaaaaaaaucaguggaguaaggaaggaucaggcaacauugaaagaggaauauugccacacaguugccaaucugaugaaaauacugcuuaugcuaggucgaauugagacucugaaagguauuugggagccagacacuuaugagaauacauauugcuuugaauauuggaagaaagcaaagcagucaaacgaauuucuucuuggcuuggaguuuuguuuacuuuucucagguuagaauugauaguucuaaugguuuuaagaagucauggagaacaggcccaccaugaaccugaauauuugguucugaguuuauagccauugucuaguaaauacuguuuaaggguuauuagcacacaaugaucauaaaaucuuguaauacuuuuaagagguguaagaaauugaagucaccugagaauaccuccuucugauuuuacaguggagaaauaaaggaaucagaguguuuaagugacuugccuaagaccugucugggccaccacuuuagggauuguuuuuuaauccaucaucaugcuggauuuguuacugagcgauaaaaugguacagaagguagucacauagagaauuuaggaaauaaaauacucauuuguucaaauacuucucaggagguugagauauaucuauggguagaagauuuagagguuauuuaagagaaauuaggauugucuaggguccaccccuuaccguggggauucugaagggcagugucuuaugagagaagagagaucaaguuacuuggugagugagauguucuaggugcucaguccaagggcuggccggauggcuagcacugaacuuguguggauguuuguucaaacuaaucagccuacgauugguuuguuccuaagaaugauaaaacuuuguucuaguuuuuuaaauuguaauaauaauucuguaagcauuuaagaagaaugcuuucuuuaauguugacuuuuuuuuuuuuuugagacagagucuugcucugucucccgggcuggagugcaguggcaugaucucggcucacugcaaccucugccuccggguugaagugauucugcugccucagccuccagaguagcugggacuacaggcgcccgccaccacgccaggcuaauuuuuguaucuuuaguagagacgggguuucaccauguuggccaggauggucucgaucuccugaccuugugauccgcccgccuuggcccgccaaagugcugggauugcagguguaagccacugcgcccggccuaauguugacauuuuuuacuccuacacgaagcuguuauguuuuuacuuauucuuuucuagucuuuaucgauaauguauaaauauguacuguauuauguaauuuuaauugcuggauacauauaccugucuucuuaaacuuuuuuauucuauuuuaauagagucuuuguaauaaucauuuuugaauguaguauuuaguuguguuaauuuauuuuauuuuucuuaaguaaucuaugauagaauaagcuauuucuguuuuuacagaauauuguagggaaccuuuaaaaacacacaauuagcauuuuucugcugcuaauugcuuuauuaggaugaaugcauagauuuacugugucaaagguuauaaccaauuuuaugaccuuuaguauguaauucuggaaaauuaaacagaaacuuaagucacaaauggccuuaaacauuggcaggaagcugcugauuuccugacuguuguacaggcaacccacuggcaaguaacaugucaaauacggaccauuauaauuccuuaucauaaaggcagauacaguuuucuucaaaggacaugaaaauaauuuauuugcuuuugaugccuuuucucacugggaaaugauauucuguaagugcacaaugugcacuugaaugugaaguuguagugaggauuuuuauuuuuauuuuuguacaacuggguuauaauaaaggaaacaaacuuuaugucacuucuaggcugaugaaauacccuaguaaaugcaguacauuuuugcaugacuaauaggaguaggggcggggcuuugacuuuuacaucagucagguuaaaaucaccuguuugcugguuucccuaagacagugauguauugcccuuugcuuaacuuuuuguuaguugggaaauguauucuacuuugaugacugguguuuuucugcuuaguggggauauuuucugugaagccaggauaaacaauucuauaaugcaaaucugaacacaucacugccuugcuuaaaaucuuucacuagcugcccuuugcuguuaggauuaagucuauccaaacuccuuagcaugguaugaagagccucucauggucacagccuuccuuuccuuccauucccuuucuugcagucagcacuccagcccuucugaccguuuuuguuucuuaaauauauugugaucucucuuacuucuaggacaguaaguucuguagauuccuuggugaauauacagccuuagagacugcaagaauucugagcaguauuucuaaggguuagauuucccuccaaguaccauuaacauucugggcugccacauuucaagauuuacucuggagaugugagguggaagccauguuaaauggcuggaagauaguccugugggagagauaagcuuuaucauuuuauuuuuaccagguguguugcagugaguguugaaaagccuuccacaaaaaauagagucuucuuuuuuccccuguuaugauuaaauuacuggcugcuaaucuuucaugaugaagagagaagcccaaaagcaauuucagaacauggaucucaugcugauuagugguuauaaugauuucacauggauaguauuccuuguguuugaaaguuauuuuauuggugagaucugcgaaaucaacaaggcuaguuuaucuuugcaaaaacuugugacaagcuuauagcuacacuccuuggggaacacaguucacauuuaagauuuugccucaggcaccucuguucagcuuuaugcugugucuuucagauucuagauaugaaacugguuugacauuaauaccuagcaugauagcuuuuuagauacacucuuugcuugcauuaagucagacaaaaucugcagagccuagcacuaugcucaguauaugagcugcuuugucuguguaucuugguucauacgagagucaguauaccuaggcagucaguaaacagucauugauuagauuuggauuuaauaaauuuaagccuggccaauaauuagugggaaccaaaccaaggcaaccuauaguaaauggagcauugcaucgaagaucucaguucuucaaauaaggcacagauaaaggaucucuauguauuacccuccuguucuuggauuuaauuguucaaauguuucacccaaaaccucaauuucaggcuaauauuuaggcauucucuucuauguuauaccucagguaauuuggaaacauuuguauuucuaaaucuauuucuguauaaacuuucuaugaauuguauaucucucccucucuauauuauauaguauagauuuaaauugaaaaauucauuguucccuucagagguauaagaguauucuggcccagcuggaaauguuauguuaaauuugaaauucuacuaccuaaauuuuggacuuguguacuacuguuuuaguagagcuauaugauacugcagauaaaguuccaaaacaaucuguggugaaaaaauucuuguucagggaccuguuguucagugaaacugcuuuucuguuggguaccuguauucuuuuuugguuaaguuaaaaaaaaaaaaggauuuauuggccuaugucuuaaggggguugggggaggacccaugguucauggacuccaaggauauaaaggcauuccccuucucaguaagaauccugcuauucugcuuccuguucauuggucuuauguucugccacaaugagguuuuauccacaugauuugaauagagaacaguuggcugcuccaagaugaugucuguuuaucaaaucucccugaaagacuuguguuugugucacccuuggucuggaagguggacagugcaggcauggaugggggucaggugggacacugugaucuguaguguuaacagaaucaccugguaugagaaguuucuagagagauaaaaacagaugucagcuguaauauauugaacuggcaguuaaaaaauuuuuuuuaaguuguggaaaauaaacaacauaaaauuuaccaugugagccauuuuuaagcuuacaguucaguaguguuaaguacauucacguuguuuuacaucuaaucuccagaacucuuuucaucuugcaaaacugaaacucuguacccaguagauaauaacuacccauugcuuuuuccugcuagcuccugccaacuaccauucuacuuuuucuaucuauggauuugacuacucuggcuacuucuuauaaguggaauuguccauaauguccuuuuucacuagcauguuucacuuagcauaauguccucaagguuuauccauguuuuugcauaugauggaauuuccuuccuuuuaaaggcugaauaauauuccauuguauguauauacaacauuuuguuuauccaucuauguuguuggaugcuuggguggcuucuaccuuuugacuguugugaaugauauuucuaugaacauggguuugcaaauaucucguugagacccugcuuucaguuguuuugugaacugccacuuuuuuggauaacucucauuugaaacuauguucaucuuuuuuuccuuaaaaacugcccguaauuaacucuuuuuggugcccaguaaguggaaaauucagaacagcaaaauguuugcuuuauucaacaaacaccuucucaaaaucuagaaaacaaagaacauuagagaacacuguggaaguaaguaugauuguggguagcuggcugacguagaagauuuuaauuuuuacuaugaugcauaaauauguaccuuugcaaguuuuagcagacaagagcaugagguccgaucauagaccuaugacuuuggggaaguuaccuaaagccuugccagccaccauuuacuuauuugcagagaggggguugguuauaccugcuaggguuaauuagacuauuaaaugagauaacaugugcagaacacauagccagugguagguggucaguaagugguuuccucucuccuguauucuuccaggggaauagaagacgaccacugugugaggaucucuguauuguucagcucugaugcuccuccuacugugggugguagaucucccucuuaacaaggcuuucuuggcaagcauuuuuaaacuuuacauuuucuuauuuuuuuauuauuguuauugauauuuuguuuggcauagguacuguauugacaugguucagaaagcaaaccagggccgggugccguggcucaugccuguaaucccagcacacuggaaggccgagguggguggaucacuugaggucaggaguuaaagaccagcuggccaacauggugaaaccuuaucccuacuaaaaauacaaaaauuagcugggcgugguggcaggcgccuguacucaggaguaucccagcuacucaggaggcugaggccagaggauggcuugaacccuggagguggagguuguagugagcugagaucacaccacugcacuccagccugggcgacagagcaagacucugugucaaagaaaaaaaaaaagaaagcaaaccaguauaacaggguacaaauugagaagguuugcucccauuuuuguuuguccgucaacuucguucccuguuuccuuaagugcucuucucaucucuaggaccuauuaauguaaguauauauucguauucuuuuuuuuauuguacauaagguaaauauauacuauauacuauuccacccuuugcuuuuuucauuuuaccauauauccuccucucuuuccuuauuaguacaucaaguauuuucucgugugaauagaccaugacuuauuuaaccaguccccauguaagggacauuuuguuugcuucugcacuuuugcuguuauaaauagugcuauuuguguaacuuuguauguagaaggucagauaaauucccagaaguggaauugcuggguuaaaagauaauugcauuaauaauuuuuauuaauauucucaauugcuccccaugggguuaguaccuuuuuccaugccuugaaauuuacauauuuuugugcauugcagacaccucucaccccuugcuguauaccuucuuuugaacugccaucuuguuaacauggagagaacuggcaagugcaggcgauuccuucuuguguuucguaagggcuaguggacuguuggagugcuuuccaagcaggugccaggguuugagauuguagugugauaugcgacuagggguucugcccaucccgaugugcuccuguucccgucucaggaccugaggauggaauggcugaguguguugugagcccaaggugccaagugcuucucgggggagaaucaguugcucugugcauuaaagcaguauuggcugcugccucccuuccuuggaaguuuuuguucuguuuuuuuaauuucauaacuuuuuacaaaaguuauuccuauuuauugaagacuuagaauccagagaaaagacaaaaaucacuuggacucucacaaccuuuguuaauauuuucacgaauauccucucaaucguguguguauccccaacauaaauggugguuauauacugcauaauguuucauaaccuuuuuuuccauuugcuaguguaucaugacuauuguaacaucuuucaguagugauauaccccugcccccaacacaugcacauguuuuguguagauuucuauuggguggcuucaccgugauucuguguuccuggaugaacauuuauguuugucuuguuagucaacaacccuacgaugaaaauccuucuggcuaaaucuuguauguuauuauuguuugcuuagaauacauuucuagaauuagcaaacaauaauaacauacaggaauuagaacuucuaggucaaaagacauguacacauugcucuccaaaagugacauauuauuuauauuccuaaaugagaguaccacugucaucauacucaauuuguggauauaauaauuuuuuaaaaauuuccaauuuauuaguaaaaagugauaaaucuaucuuuuacucuguagauauuuaauuacugguacauuuaaacuuuuuuuuuuuuuuuuuuuuuugagacagagucuugcacuguugcccaggcuggagugcaauggugcgaucucggcucacugcaagcuccgccuccuggguucaugccauucuccugccucagccucccaaguagcugggacuacaggcaccugccaccacacccggcuaauuuuuuguacuuuuaguagagacgggauuucacuguguuagccagcauggucuugaucuccugaccucgugauccgccuaccucggccucccaaagugcugggauuacaggcgugagccacugcgccuggccuaaacuuuuuuuuuucaaguuugagaacucauuuuuuugauguggauugccuagucaagcccuuugcucauuuuauuacuggcguguuugucuuuuuuuuuuuuauuuauuaaagcuacauauguuaaggauauuaguuuucugucacauaugguacaaauauuuuuccucaaguuuacuuauauauuaagaaccuuuuguuauagaaguuuuauauuuucaugaacucacaucaaucacucauuucuuuauaaaggcuucugcuuuuggugucauguuugagagaccuuuugaugccucuaauucuacaaauauuuaacucuuagacuuaauauuugguauauuugucauuugaaaugauaggauguuuauuuuagucuaugauguaagagggauucuaauuuuauuauuuucucugacuauccaguuguccuaccacaaaaaaucaucaucuccccacuaacuugaaauccauguuuuuacaaauugcuuuuuuguuuuuuaacacauucgaaaauuuacacuaaaacucuauaaaaagggcauuagagucacaagguccuaucccuggacuguuuucaggcaguugaugccagugagacauugaagagguggucuaaccucuucuuagacuugguuucuucuggggauucacaccugaccaccaaucaggguguuauggucaucugaugagguaauagguaucaauucugaaccauuauaugggaaguaaucuuuauagugcuacuaauuaggagagcccagguauuccugaggaacuauaaccauagucaaaauuugauauaauaaaguuuaguuauugucuuuuggaagaauuaggaaaacuaaagaaauaacuucucugacuuuugaguuauuucccauuagccaaauagggccuaauuguaaauaauaaaaaugggccuguuuuaauuauuuaucuugacauggauuaaauauaguauuuaauuuccuuaaugauuaaauauagacagcaaauguaaugcuguacuuuucacaugacgcaauucauuuggccuuuuucuuuuuuuaaaaaaauuaagacaguuacuuuauuuagaacaggaaagugguguaagcaacugagagugugcccuguaauaugagagguucuucccucguucuacuucccaccuuaaaauauaauuuuaggagaaaaaaguaucuuauauuugguuaauuauguuaucuacgauuacaccuuuugcuaaggcaggcauggcauuugcugauguuuggcuugaagucuaagaauauuguccagauagaacaugcuaaauuguuacauuugaguuaauguugaauacuugaacuaacauagggaugccagaccacuacucuugauuuaauuagagauuuguacacauuuucaguuuuuuccauguaagaucaguuuuauuguuccuuuaaaaauauucugaugaaauaaucuugcaaaggaaagauaaccuagcaucaagucugcgauauaaaaacaaaaauaaaaugauuuucugaucaguuaucauguuuauuaccuuuacaaauaguguauuaguccuuuagagagccccacuaugcugccugugccaaaagugucauguauuguccuugaguaucaaagugguucauaccgguuaucuagcaaagggccagauugucucugcauaguacuuuucauccagagugaaaugaugauaaauucccacacgaaguauauguauaucuuuuucucccuggcaauucagauccauguguccucuauaucuuuuaugucaaaauaccuacuuccauccaagauauaucgaauuucaucauucaaauguaaauguuucucauaagacaucaucuuuuccucuaauuugguaauuuaucuuugcauauuguuauuauguucauccaggaguaguuucucucucuuuggauuuuuauauaauucuggaucguucuuguauuugucaggaacaaccaagcugacacagucgcuccaggccgacugggcuccagucgguagggcuuucucuagggcuuucucuggggaucuguaguguaaaccacaccugccuaaucuucccugcuucuccuagagaacacuggaaagucccaggggacacuggccugaccucaggcuuuuccuuuggucuuuagauucagacauuuccacuaaacuuagagagucaaguaccuggauucauguugaaaaucugauaguaguugacuuugagacccagguuuagucaugucaugugcugagcuuugguuucuucauuuucaaaauguaggccguuugugggaguuugaauguaacaucacagcucugagguucccuuuccauccccaguuucucugauagagcagaggacucugaaaggaggccaguuuuuuuauucuaaccaugggaaauuugaaauaauuguugacuucuuuugcuuauuuuuuuuggucccuaaaauauuugauuggucaagauaaaucaucuuuguuuuauuuuucauuucugauaauuaucagaauaauaacuggauaagucccagugaaagccccaacugaaagaauuuguagucauguugucacauuuuauauuuaaaaguguuucucuagaguuaaggaaugaauuuuuuuuuucccagauguggaugcaaguuacaauaaauucuuggcccuuuugaaccauuagggauuaaucauuuuggguuaaccauuuucuagauggugagaauuuauucuuauaauaaccacaaaacuucaacuacuuuauuuuauuuuuauuauuauuauuuuugaguuggaguccauagcccaggcuggagugcaguggcacgaucuuuggcucacugcaaccccugccuugcauguucaggugauucuccugccucagccuuccaaguagcugggauuacagguaugcgccaccacgccuggcuaauuuuguauuuuuaguagagacaggguuuugccauguugcucaggugugucuugaacuccugaccucagguuguccacccaucucagccucccaaaaugcugagauuacaagcgugagugacugacugcgccuggccaaaacuuuaacuacuuuaaugaaaaaauccgaaaauauauuuuuucuguucuugaacugaagcgacugaauacaguuuauuuucucuuuauuaaucauguucagcuacaaauguaauuuguguugagcacuguguuuauggagcauagcauaaauuggaguagaaagaccuggguuuaaauuucaccaccuacugacucuugccuacgaacaguaaacccgucuuaaccucauuuucuucauuuuuuaagaaauugaaauugagccaggugcaguggcuuaugccuguaaccccagcaguuugggaggccgaggugggcagaucacuugagccccagaauuggagaccagccuggccaacauggugaaacuccaucucuacuaaaaauacaaaaauuagccaggugugguggcacacaccuguaaucccagcuaaucgggaggcugaggcaaaagaaucgguugaaccugagaggcagagguugcagugaguggagauugugccacugcacuccagccugggcaacagagugagacuaucucaaaaaaaaaaaaaaaagaaauugaaauugguauaagcuaggucuucuguaaaugaugacucuuacaauagggauucccugcaggucuguugaguuauguguauuugcaugcacauguacacacacgguguauuuguuccauaguaacuagcuuuggacuuccuguugugccuucuauuguuuuucugucaacuuaccgguuuucucuccuugaagcuaucaguaugccuguguguagugccugcucucauaggauuuauagguuuguugacaucuaguuacuuguauuuuauacacagcucuaagugagaaggcuuggcaauauguaauguucgugaauauuuguaugaaauucagcagcauuuacuuuggggaacucauauuuuaugugugcuucaaaacaaugaaacuuagcacuauuacaacacaggaguauauuugcauccuggucuuuauuuauaaagaaauaguauugagccacccaguugggggauacacagucuaaguaguuauucucuuauuuuguuucugguucccacuuuuauugacuuauauagcacacauacaguaguggcauaauaccagcuggauuucagagugcagaaugaaaccaugugguuuucugugagauuuuuuaggccuuauauaggaauuauaugcaugacuaggaccuuauaaauuauguaucuacuaugugcccagcuccuaguauauaccuaauuuaauccuugaacaacucuuuuguguuacaugguauuaucccuguuuaaagaugaagaaaccaauauuuggauaaauuaaauaccuuauuuuauaaaugaguaagucuuuucugacuucagaguucaugcauuuuaccaguaagccaugcuuuccgcuuacugcaaacuagugacuccaaacuucugcaaacugugaaacuauugugaacuugugugaauguauggaaguuggcacugauuagacguuugaacuucuuuccuuguccuguguuaugcaugguaaucugccauuugcuguuccuagcuguauggucacccuuagagguaugaguugugcuuauauguauauguucaugccuagaucuguugcucacagaaucaucugacauccccauuucguugaaucuaggcagcaggguugauggcagccagaaaagugugcccugggggcaagaaugucuuuagggaaaaauauguuauugucuuucagauaguaguucuccaaacaguugcuccaacaguuccuaugaaaagauugcuugagcccaggaguucaaggcagcagugagccauggucaugccauugcacuccagccuggacaacaaagugagacccugucucaagagaaaagaaaagaaaaaaaugcuagguggaucuucaguuuaguucaguuaauuaaguauuuuaauuauuaacuauuaauuauaacauuaagaaugccaggggaggauagagacccgugauucuguuuuggggggcacuagaaaacaguuccugagacacuggugcugccaucuaccucuacccacaucauauccuuauguagacauaaaauauuaagagagacuucaugaggaggcauuucucaguuucuuuuguaaugaacucuacuuuuaguugagaaacaugaaaguguaugguuugguguuggagaacgaguuuacuuacuaguuugauuuacagugaauacuguucuugggauuuauaaaugguuuuaguauugagaaguagaggagauaaauaguucuggugucaagggaagcggagcaauaaaaugaagcugaaacaugaccauuaagcccaagccaaucagaucaucugugugccuuaauagaaggcugaugaucuugguucaggucuucacuuaguucauguaauaacauggaaucaagaguucagacaaguauaaaugcuucugggucuuguuuccuaacuaggcuuaguuuauaggccagaaagauucugcuacuauccuguuauuacuggggcagucauugaaaagagccuuucuauuauaguggacugaagacauaaaaucacacaguacaucuaaaagguuucaucaaaguuguucuuuacgaaagaguauuuuuuuauaucuuuguauaauugaacuuuuuuuuaaaaaaaacuuuuuuuuuucagccaugaaauuacauucuuucuuagccuuaaagacuuugacauucuccuuugggaggccgaggugggcagaucacgaggucaggagaucgagaccauccuggcuaacacagugaaaccccgucucuacugaaaaauacaaaaaauuagcugggugugguggcgggcaccuguagucauagcuacuugggaggcugaggcaggagaauggcaugaacccgggaggcagauguugcacugagccgagaucgcgccacugcacuccagccugggcgacagagugagacucccucucaaaaaaaaaagaagauuuugacauucucuguucaagaaacuuuuacagugagaguaauuuaguguaucucagacaauguuggagugaucgaugguuggguuuccuuguuccaagguagaauaucaaauguucaguugacuuguugauggaucaguuugaccucgcuuuaaggauaugucugaaaaacugaaauaaugaggucaacauuuuccagguuuuuuuuugucauucuaugaucgacuaagucugcuuugguuuucaguuacuaaucaguguuccacuaaugccuauuuagaaacuuuauuuugaaauaauuauagauugacaagaaguuguaacagagggccuguguuguauaauugaaguuuaacagugauacgcuccuuucuuucuagaaaggcuuucaauuuauggaaaaauuagcaaagguaaaagaugcucggcguuggaccuuugaaacuucuuucggaauuaguauuuugaaugacuccauacaacuagaauaauggcugaaauuucuauggugcuggucaggacugugacuguggcccgagcaugagaugauuuuccuggaaaccaaaaguacuacuagaaggagaagaaugcuguggagcucucuggggguuggagcuuaugccucuggagacuuugaguuuucuguggguguaaguuuugcaaaugguccugguagcccugaagcuagaguugucaaaguaacaggugguagcugggagccagcuuggcaguggaucagcuacccaaauagccaaaguugcucaaucuacaugagguccuguagaccaaacuggggguggggaggauuagccccauacaaauaguugauccuuuuuuuuuuuuuuuuaaacagucauuugaaauauuuucuguaaaaggccuaagcuuuaggcauuuaggaugauuguaaaugcacugcuuuguauucuuuuucacauauauuugauuuauuaauauaaaauugccauuuuuguacauaaaaauggucaaauauuggcaguuucauaugguacaaccuacuguuuucugcugucacauuggaaauucucaccaacgugggauaccauguuucaaagaaacguuggcuuagccucuucauuuauggaagaaauauagcacuuaugguguucuaaguagauuaacuaacuuaaucuuuuuacaagcaaaugagguagguagguccuaguguuuuccugcuuuuuaggaucacagagcuaguaagugguggagcugggcuuacacccuggcuacuggucacagggcugugcuguuucucagcucuuguguuuggccucaccucuccagucauacuugugaaaguccugggugucuagacaggugaugggugagugacauaagguaccucucuuugucuucaugggagaaauaacuggauuuccccaagaaugaauuaauucuuccacaauacaagagucuuagagguuuaacaaggauacuucuuucaaggugcccaccaauuccuaccuugcauuggagggugcacugugucaaauuuguauuuuuaucuuaaauaccaaauacucuuagaguccauccaugggccuguggaguugaggguaaauguagaggcuuauuuggccuaauaaugaaaguauggauaguuauugccauggaggaggagggugaauguuuuguagaguccauuccaaccuugaaauccugauucucugauaaacuuccaccucuccucuguugcuuaaucuuugaucuugagccuggaaggagaggaggcaacucagucaaugaaggaguuuuauuuaguaauugcacauuggccucuuccugccggaucccauauugacacuggaguaaggcuagaggcugggagacaaggccccaugggagcuuugugaaauggggaggggcaagggugugucccuggaccgucuguuuguggggcagcuguccuagguguugagacacacaccggucuguucuaagauguuccuacuggauccugucaguucgcccuccagcauuccuggauuuauugugcaccauuuauggcuccacaguccacuagaugaaauuguaaagacucaauaugguggcucuccagggacuuucccuuuucuucucccuuagcaucagagaugacccgucagcguugcaagcaguucugugguagcacaucaaguauucugucacagcaggaaaggcuggauaaacaucaagggacugccaagaccagacuucucauucagucugaguaggaggaaagaggacagguuguuggagaguugguuuaaagaugaauuaugggcugggugcgguggcucacgccuguaaucucagcacuuugggaggccgaggcaggcagaucacgaggucaggagaguucgagaccagccugaccaacauggcgaaaccccaucucuacuaaaaaauacaaaaauuagcugggcgugguggcacacgccuguaaucccagcuacucaggaggcugaggcaggagaaucgcuugaacccgggaggcggagguugcagugagcccugaucacgccauugcacucuagccugggcaacaagagugaaacucugucucaaacaaacaaaaaaaagaguuaugacuggucuuucucauuucaucugcugauggguagaggagggaaagggucagaaauauuucuuuuaauacccucucaguaugaaugaaugauuuugaccuaguuuagguuuuggucugguggaugugagauuggaauauaauuuguuuggcagggucauccccaaggaugucugaugcaucugcguucuuguucccauggcuagaauggaaucaagggagaagcuuccucauuccuauuucagagggagcagggagaguaguggugcauauccccacagccagaaauagauugguccucaaguaaauugguuugauaaguugauuaugaaucuuccugaaaacugcuguggccuuaggaacucuggaggguccuacuaguggacccucaucauucaucugaugagcacuuacuauguucuaggcacugacugugagaaauacaaaugaguaaaauauaaucauagcccccaggauagucuggugggugacauuuacaauacaauguaagcuaagguuguaauuaauguguuuaacaaaguacuguggcagcacagagaagagagugacuacguuuggaguccacaggacuucaccggaaagaugaggcaucugaccuggacuuugagaggaugaaccagaacucuguagguccaguagauggaagguuuucaaagaaugcaggcagacagagccuugggaacagucaagguugagggggcacucuuguggguccacaacccgagcuucucgccccucucauuucguaauggcugccaagcucuuccuucacuguuguuuuucuuuacugcucuguggauucauccugaugagucacgacaaccucugcuugcagugaugccacgucucccaguuaggaaacgacccugcucuucacugccugguuccuugguguggcugccuccagccuucagucuccccuucucagagcugugacaagagguucuuacagccuuaaaaauaaaaagcagcuucauauguuuugccuuuguguuauuuauugcaucauuuguugagcaaguuucccaggacuggagccggaggucauuugagagaugucuccugggauuccacugaaacucuuuuccacugaucccaauuggugaccaggaacaggaguugcuuuugguccuuuacaucucuccauguuuuccagcuuccuaagauacccuguccccuccugcauuuuggucagcacuuaucuuuccuucugcuuugugcuucuagugguucugggucacuuucugucagcucccaaauuccagagguggaccuggguuaggccauuggcuguaugucuuuuaguguguauugcuugagaaugcucauauuuauguaguauauuccguagugccugaaaauucuaaggaccacagcgauuuugaaugauucaaaguuagucacuucaguaugaaacagugugaauuuaaaggcaaacccaggauucuuugaaagcaaaaacuuucuuuagagcagcggcgugcuuggugaggcaaauagauugcauuuuguggugccagaaauagacaguucccuuuuuauacgcuacaucuuugucauguagucagagacaugcagauccuuugaagugaauucuggcaccacaauuuuguagagacagucaguguaguacagcaugagaagggcauacgaugugucauuugaauaacuucuguugaagagcaggcgucagcccauggcagagauugcugaggggauggugcagacgagaggcagguaguauuggggcauugugaaaacaugcgugaaaggccuuuuggaauccugcuuuuuggcaguguugugcaagucccucagaaauuuugucacuucccuuggaaacauguacaacagggauacgucacuuaggcagagacuacucaagggcugaaaaaugcuacacucaugaauaguuucgcugagcuggagauuggucacaucugaugucuggaugguggccauuguuguuaaaaauagcuuagaaguucaaaacggggguaggagccuuguguucuuuuuucuucccuggaaagggaaguguuuuugagcuguggaacuucgaguaaaaccuaacuucuuuguaccuuguuuugcucaucuguaaauggggauaacagugguacccaccuuaugggauguucaggauucaaugaauauaaaacauuuggcaugaugccuggcacguauagcuaccacugguguaguguuuaauuauauuuauuauuuuuucucauuguuacuguucuuuucuauuugagauuucucggagguucuguacuuguuuuaaaaguauaauucuuuccauggcuuuacuucccguuagcaguggcuuaauucuaacugggagaaaaaaccuuugauuugugguaauuuucuuaauucccuugucuuaccuuugggaugguggaguugggagggcagugcagagucagaugucaguggggaacagagauugugggcagucccaggcagaggcaggugccagcugggacugucuagugcccucucaauuauuugaugguggaauggaugauuauugcaguuugucaauaaaaaaaaacaaaccauagcguuaguguuaggaguagcugagugaaaguauaugggaauucuguguacuaucuuugcaggucuugaguaaaucuaaaauuauuucaaaaugaaaauuaaagccccagcaacaaagcaggauguagcaccaugcugacacuaguaaaugcuuaauaaacguuuguuggaugcaagagugagugagugaguuagguuugaacccaaccucgacacuuauuagcuagauuaccuuugguuaauuacugcuuuuaugaaucucagauuucuuauuuauuuauuuaauuauuuuuuugagacagagucucgcucugucgccaggcuguaguacaguggcgcgaucucggcucacugcaacauccgacucccugguucaagcgauucuccugccucagccucccaaguagcugggauuacaggcaugugccaccacacccagcuaauuuuuguaauuuuaguagagacaggguuucgccauguuggccaggcuggucucaaucuccugaacucgugauccccccaccucggccccccaacguucugggauuacaggcgugagcaaccacaccuggcccagauuucuuauuuauaaagugccaugaugucuaccucacaguguugguaugagcguuaaaugagauguaaagaaccugaucagaggauccaguuauaugguaaguagucuaaaguguagguauuauuauuguuaaagauauugugggcacuuuguugauugaauaucccccccccuccuuuuuuagagccaaaauccauuuaaaaaauacauuuagguuucuugcaguuuuuugcuguuaugaacaacacuuccauuaauaggauuaauagcuguauagcuagaucucuguguguguacauuauguauucuuaggauacauuucugagagucacauggguuccuauuuuuuggcucuuuuuauucccuuaccagagugccucccgauaguuuguaauuuuguaacaauuuaccauuaaagaacagaguuuugauaggcagagaugggagaguaggagagagggaguagccuguacacaaaaggauugccuccuuuaccccaaagguugaggccucugaaugcuggucugagcuccuagggaugaugccccuggagcguaguaauugccuaggauacaaccacucagccuugugccaccaugguaggacacccaccaugcuggguguccuacugccaugguuggggagggcugaauguuuucacccuguugcugggggagguggggacuuggaugagugacacccggcguggacagcuaccaccugcccaugguagaugaaaccuuacuuucgaugggaauggcccucccuucuuaugggaguuguagucugcauggagugcgguugaacaaggaugagcagguaauccagguguacuuagaauuugcuuccucugaauauuagaacgugaagaggacuuugagggaauccagcauggugguuuugacucuuugaaaaucaaggaacccuauuucauaucaaguccgauguggaaucucaguguacuaaagaguuuauuuuuuuuauuauacauuaaguucugggauacaugugcagaacgugcagguuuguuacauagguauacacgugccauggugguuugcugcacccaucaaccugucaucuacauuagguauuucuccuaaugccaucccaccccuagucccccacccccugacuggcccuggugugugauguuccccucccugcauccauguguucucauuguucaacucccacuuaugagugagaacaugugguguuugguuuuugguuccuguguuaguuugcugagaaugaugauuuccagcuucauccaugucccugcaaaagacaugaacucauccuuuuuuauggcugcauaguauuccaugguguauaugugccacauuuucuauauccagucuaucauugaugggcauuuggguuggauccaaguauuugcuauggugaacagugcugcaauaaacauauaugugcaugugucuuuauaguagaaugauuuauaaucauuuggguauauacccaguaaugggauugcugggucaaaugguauuucuaguucuagauccuugaggaauugccacacugucuuccacaaugguugaacuaauuuauacucccaccaacagcauaaaguguuccuauuucucacauccuuuccagcaucuguuguuuccugacuuuuuaaugaucgccauucugacuggcaugagaugguaucucaucgugguuuugauuugcguuucucuaaugaacagugaugaugagcuuuuuuccccuauguuuguuggccacauaaaugucuucuuuugagaaaugucuguucauuuccuuugcccgcuguuugaugggguuguuuuuuccuuauaaauuuguuuaaguuuuuuguagauucuggauauuagcccuuugucagauggauagauugcaaaauuuuucucccauucuguagauugccucuucacucugaugauaguuucuuuugccgugcagaagcucuuuaguuuaauuagaucccauuugucaauuuuggcuuuuguugccauugcuuuugguguuauaaucaugaagucuuugcccaugccuguguccugauuaugguuuuaggucuuaacguuuaagucuuuaauccgucuugaguuaauuuuuguauaagguguaaggaagguguccaguuucaguuuucugcauauggcuagccaguuuucccaacaccauuuauuaaauagggaauccuuuccccauugcuuguuuaggucagauucgucaaagaucagaugguuguagaugugugguguuauuucugaggccuuuguucuguuccacuugucuauaugucuguuuugguaauaguaccaugccguuuugguuacuguagccuuguaguauaguuugaagucagguagugugaugccuccagcuuuguucuuuuugcaagagauuaaucuuauaaguucagacuuguagguaucauaacuuauaagaaucauccauuuacuuacccuaaauaaauggauuuacaagagauuaauuuuauauguucagacuuguagguaucauaacuuacaagaaucauccauuuacuuaugguaaagucaagagaacaaugaagcugcuguagugagcacugaauuuuaacuuggguucugaguggcagucccagucaaaugccaguuucauuacccagguuccaucuggauuuaauuuuguuugcaguauagaaaagucugauuugcauggauaaguaauugcagauaagaauaguuugcuaauaccuugcaauuucaggauacucuuuaauuaaauugauccagaagccugaaagaugaauagggggaacuuuggucuccaaggagaaucacacuguuuaacaaauacuuucauucuuuauuacaaacugcaagacagaugauaauguauggucacucuuuuuauuacaaugcagccuguuaugaauucauuugcuuuugcauaacugacuauuccccugugauaagagcauaagccagcagaugugccugagauuuaccuggcauuuaacugaacauacugcaggugugcuauagcaguauacuugcuugaacaguuuuaaggcaccagacaaguacaggccugaauuuuuaaaaagauaauuccaguuuccuucagaaucagugacauauuuacaagauacuaauauaagcuuagaauuggcaagagcagcuuuauucugaggucuacaggaagauaaugugaacacauuugucaucaucagugugcuaaaauuuccaauaaaauuugaaucugugggaguuuauuauaaucucuaaaaucauuaauauauuaccuuaaaaauaaaauugaauacuuuuuuugcagaguuuuuuuuuuuuguuuuuuuuuuuuuuuuuugcagaguuuuauagcacucagaaccuuuugguugcucagaacauagcuugaaaauccugaucuuucacauauugcagccucaguccuuuuauaaaugaugagauucaggucuugggggugaagugacuuuccaaauguaauuccagaaguuacugggaaagccaagaggaagaguucuugggucucuuuaugcuccucuaagcuauuuuucucugcugagcaguuaggacuccuggagggggcaggaagcugugugcucaagugacauccuuucuuuaguuuugugugugcauauuuguguaggcacaugaaugcacucuuguauaccuacuaggugcagugagagcuggcuucagggagaaagggaaaugcgugauuuugggguccccagccugagccuacuuuuucucgcaguauucuuuguucuggaaucuuucucaucaccuuuuauugcauggaaacuuaaucuauucaggucccaacuuucaggcuucucugcucugacaaguacuagaggccaauaugauagacuagucugaguuaaaagguggcagugaaggaaccagcuaccccucccuguuuuuguauuaucauaagcaccucauggcauagaaugcuuucaccccaagcggcuguuucaggggcacuggcagguuuggaggggcauuguguuuugaauagucagugccuuuugugccauuaaacucccaugguagagagacccagccuuaagaaauaagacugacccuccauagggcugcugcuagucuauauauugucuuugugaaaauuagaaaacagcaucuugucugagugggguagcccugcaccagagaguguggccuggcuaguaaaaggcagauuggauuucagccaucacuuucuuaccucaguugggcauucuuggcagugcccaaccugcccaaccauaugcuguaguccugauucuaccugcuaucuuccagccaaauacaggggcuuuguauucuuuugcauuauacagauguguucauuguggcugcuuaauagacguuugaguugaucgauacucaucguugaccaaauagagagaauggcacuuugcaggauguuuauuuccugcuguccccauagcagcagcaaccaucagcaaccuguuaccuuaaggauucuauaguucauucauuuauuaauucaacagcuacuucuuaaauaccuauaauguaaaaggagacaggguaccaagcuacaaagagcaccaucuuuggagucaaaucuggguuugaaguuugucuuuucuguugauugucuguguaauauuugacaaauuauuaaacuuucugagccucauuuauucguucauuugcccacuuauucaacagauauuuauugagcauuucccuuggcuggaugaagauggaaaaaaaaggaagacagacgcaguucuuucccucaucucuagugaggauguggacacaaaacaaauacauggaucaacacauaacaauucuaggcugucauaagugcccugaggaaaagaaacaaggaugugcuaaaaugaauaggaccuggggaguggggggaggggacacgggagaccgugccagagagacagagcucuuucuuaauagggucgucaggguacgcccaucagaggugagcacauaagcagacccaaagaauggugaggaccuggccugcagagagcagucagggcugaagagucagcuuggacaaaggugggaaguaguugguauauuugaggacauaaaaauauggacuuggggcauaauggaagacaagguuggaaacagugaugaugauaacaguagcaagcacuuguuuaguuccugcuauguccagacacugugcugagugccuucacauacauuaacucuucuaaugcugaccaaaauacuacggagcauguguuacgaucauuguuuuacagaugaagaaauugaggcacagaugggauaaauaacuuacccaggauuucccagcuggcacgugguagagcugggauucaaacacacguguucugguuccagacugugcuuauaucugcuaugcuguagugccagugaaggcugggucaugccagaccucaguuucgucaucaguaaaauggaacuaauauguggauuaaacaaaauguguauagaauggcagccacaucaagucauaagcauucaucagguggacuguauaucuaguggugguggugguuguggucagcauuguaggaaaauacaggggugcauuaggaaguaacccucuagggaagggccguguauacugauaaucguuaauguaaggaggacagggguaagggcccugaggaaagugugugcaugaacagugcugcgauggcucugaagugggucaguuuguuccaccugggcaguguggagccacuuggggguggggggaggggauccugcuguugagucuggaaaaaugggcaggagucacauauacuggagcagguaggaggagcauuuccucugcaccaucaggugagcaaagaucuaguguguacucagaguuggaaaguggggucuggagacaauagcacuggccguaggagagaggcaggaacuggagugaagauagguuagagccagcacucacuggggcuugaugccauugcgaagcuuucaguuuaugcaucagggaaugugugguccugggguccacagcuugguuuaaagaucuaauuuggguaucuucucagcuuucugugacucuggcugagcagcagagaggaauuuuguuuuggcuuuuauuugauaugcuaucugucaucuaccuaaaggagccugcccaccuccuggguucauacagaggagagguaccacuauagugggaagcuuuaugaccccacuccuccagacaggugguuuuauaggugauugcaaauaacuggcacaggcuuggagcuagacagaucugggcuguauaaucugggcuuuaacagcauuugaccuugggucuuguguuugggccucauuuaguucccuguaaaguagggauuuauaccaugucucauuguuauauaaaggucaaauaagugcaugacacuaugugccugaagaacaugguaagugcucagaugauguuagucggaauuacuagauugcaugguguggaaggcccaguuacccacaggaagucaguuugaaccgacuaauugucuucucccauauuuuugaggucaggaagccuaaucaguuggcaggacucauuggagccacauugagauggauuuuaaagucauucccaggcucugugggacaucaggccaugauguauacacaguuuucuucuucuuguuuuauuuuuccuuaaggcuuuauuuucuuaaagcaguuuuagguuuagagcaaaaauuuuuuuuuuugagacagaguuucccucuugucucccaggcuggugugcaauggugcaaucuuggcucacuuccuggguucaagcgauuccucugccucagacuccuaaguagcuggcauuacaggugugcgccaccacacccugcuaacuuuuuguauuuuuuuuuuuuuuuaguagagaugguguuucacuguguuagucaggcuggucuugaacucuugaccucaggugauccgcccgccucagccucccaaagugcugggauuacaggcaugagccacugcgcccagccuagagcaaaauuaagaggaagguacagaucucacacuugcauaaccucccucauaaccaacauuucccaccagaaugguacauuuguugcacuugaugaaccuacacugacaucauuaucacccaaaguccauaguuuagauuaggguccacucuuggaguugugcauucuauggguuuggacaaauguaugaugacauguacccaucauuguaucacacagaguauuuucacugcccuaaaaauccucugugcuuugccuguucagccccugcugaccauguguauuugcuguccugguuuuagaucaucauuaugggguuggaaaaauagcauccuauaaagguguuuguggcuuuaagugaaugucagcaguucuacaguccuguccaguagaugccaucuuucaauuugcugaagauacugauucuguuuuucuguuacuucagaacaaacagaggaauuuuagaagaacuaccacccacuuccucagacuuacugagcaccugcuuaggagccacacauaguucuaagguugaugcaugacauacaaagacaagacccuacuuggccucauagcagagcacagcuggggcaguggacccuuguuguuugucucuuugaugccgggcuggguaccuuugacauuuaggaggucauggcuaggaauacuaggaauccuauaaugugcacagcaauaguccuguggauagaagaauuuuucuauagccugcaugacuuucaaaugucuccccagacauucuugcagggaaaaagccuguucauaauuuucugaaccuagaaccuguaauuccauuuuauguaacggacuuuuugcauuguuuugauauacccuuaauuuucuaggaaugccacuacuuuguaaauugauacgauauacuauauaagauacuacacuauuuuguuuguaacuuugccaaaagcuguuuaccauuuuuauaaaucacuugccaauguuggugugcauguauuugugucaucaagaauaauaugcaaguaucugacugcauuuauaguuauugcauucagaguuguucuguuguuguauuagacuacuucauuaugucuucugauguacucgugacagagcaauuacuauugaaauauauauucuuacagauaucuuuaaauucuuuauuuauaguuaggacauuauauuauguugaaauuguauauaguuuauauuauuuuugauuuucauuucaggguaguaaagggagagcauuaugacauaaauguuuuaaaaagcagcaggagucggggugggaggcguugggaaccguuggucugaugcacuggaaccauaucaguaagaccuggcaaagugcagagaaaucugugggggaaagaguuuaagcuucauuuuguuuuaagucauggcauguguggccuugauucuaaacucuguguuugaauaaaguuguuuuuggcuggugguuucgaaguuuuagaaaaugggaguguaugaguagaugugaagugguuacagugguuuagucacagcacccugggccugagaaucuuagccagagggacucuaauuugugacauagucaccacagcaaccaauggaaauguccccaugugaucugaaccaaagugguuuuggaguguuaaaaaauguguguuuaauaagcuaaaauuaucuguuaacuguuccaagggugauuuuuguauuuucaagcaugcacaauucuaauuaaauggcauuguguaaucacuuguggucucaguguaguuuauaaugaguuagaauaaugaagggguagugagacuggaaguuagagacgcagagagccuuucugcuuaagguauccuuaaacagauagguguuaggaccagcaaauagugaucccagaaacacaauacaauauuuaaugaagugcuaauuauguugcgugucagucauuguaggcugcaauugauggagcuaggugguggaggaggaggagguuggauugggaugggccuugaaggguaguaaguagaauguuaauggaaagaaccugcaauuguuuccuaccccaacuuuccaaguuauuauuauccacagagucacauuggcuuguauuccaaauuuacuuuauaguagcuaauaaguaucuuuuuuauuuaguaccuaacguaugauuuccacugugguugguccuugacaacaguuaggugagagcgaauugauacuagagaugcagaaauguaaggcuuagaagcucaaguguccaggaccacacagagcucauaaguggcagagccaggauuuaaacucagguuugacugaugucaaagccacuccuuauggucuuuuugauauuuuugcucuagagaugguguucaugauuagcuuguuuacuuaccaaccauuuucuauucagauuauaaagcagaucucauuuggccgagacuuggagauuuaaguuuuugauauguaaucuaugauugaauuuaaaugagguaugguuagaaaguuccagcccaguuaguaauuuagcaccuuaaagcauucaacaagcaugguuaaccaaaaaccuaaaucauacuaaauguuugaaguggugaacaggagggaauauuuuuauauuguuacuagucagcuuuaaaaaaaaauguguuuauaaacugagaagucuagguacaugacauuuauacuccugauguuugacuggcuuuggaaauucccacguugugacuucuuguaagcuuggcugaaugaacugacaggggauuccagcccuuacuguauaauuaaagguaaagauacagaaugcaucucucuaccuccaacuauuguguaguuaguuguagcuaccaaugaaauuaucaggucaaugcaaaaaaacccuuguuuuuauuuauacaggguacagggauggucugauuaguuguucucaaguaacuaacugggggguggggggcauuuaguaguguuguuguugugguuuuuuuuuuccauaagaacaaucaaaugaggaaacuaauagcacugugggcugcuuagggaauuuuugucacugaaagaacugcugcaagcccugugucucaggaagggugauggaaugucuaaauguccaucugucgggagaagauugaagucccuaugccgaucuacucugcuugugcaacuuugugauuugcagccaguuacuuaaucucucuuuacuguuguugacugaagucaugcuauagcugguauuucauauuacaaggacagaguucaagaauuaucuucuugguuggaaauggaaaggagguauaucuggagucaaguccaaauggguaagccaucucacucuagaaacucacuguacaaagggacuaagaagggaauagagaagcugccuuguuuauaaaagguugauccacucccaauaguauaaucacaacaauuucuaagagguuuuauuucaaccacuuauuuucuuaucccuagguuacacaucaguuuggugagaagagcucaguuuuugguuuuagaugagcugagugcuugucucaguucagccacuugcuagcugcauagccuuaugcaaggcacuuaaauucucugaaucucuguuucuuuaucuguaaaaugauuuccagugaccuacuauauacucuaguaggucacuggaaaucaguuaaguuaauagaugugaaagugcuuuguacacuucaaagggcugucuaaaugucuguaugagccugaaggauaguuguuaugcuuucaguuaucaguagucuagguggcugugcagaaagggagaggcgagggagucauauuuuugacaacuaacuugggguccuaugaucgaaagcccagaaauccucacuuagauuuuuucccuaaugcagcagucuugugcuggauuuuggagugugguagaaacauaugcuacacuuauuaaagggguuuggcacucuguaaugugggauuacuggcauagaagaugaaaugauaaaggaacaucucaucauauucagaugugugagucaugcacgcuuaugaguuacucugaaaaauggaauuauaauagaaaugggcaugaguucaacuuacauuauuuuccuuggcuuuagcaguuuucagguuaaaagucacuggauacauuuaacugucuuaaagcauagcauuuauaaaaagcuuuuagaacuuagacuguacaaaagcaccugaauuggaaacugugucucuuauuuuuucuaucaguaggauauuagggacaguuuugcacuggaccuguuccuguguacugccuugauacuuaacucagucagugaaucaguaagcaggaauauauggacuccuauaacccuauuggccuucagggagcuucauggucauuuauucugccugccuguuuuacaguggggaaaacugagggccagaaggguuccuugaauuauccaaggcccaagguuagguucuggcagaggcaggguuagaacucauucaguccacaccaugcugucuccaguguauaugugcuggaugagaaauuuuccacugccagcauuaauuuaauuuaauuuaauuuuaguuuggucuaguguagucuagucuuggauuaguuuaagacagagucuugcugugucgcccaggcaggagugcaguggcaugaucucgacucuuuccaaucucugcuuccuaggcuuaagcaauucucguguaguucucagccucccaaguagcugggacuacagguaugugccaccacacccagcuaauuuuuauguuuuauguagagaugaggucucgccauguugcccaggcuggucuugaauuccugggcucaagugauccaccugccuuggccucccaaagugcuaggaugacacaugugccaccacacuuguccuguuuauuccauuuaaauuacaguucauuuuguguaagccacuuuucccuguuuccgucaauuucagauuuggaaauacuuuucaaggauuauccuuaauacuacaucuccucuuuaugcuuaaaaauuuuguuugauucuuuaaccagaaaugaucauagugauuuuuaacuuucaauagggagcuacuuuuucauuaauuacuugggucauauuugucacuugauucuuagcacuuuuuucuuuugaugucguuuauuauuuauugagaaacauuugaguucuuacucugugccaggcccugugcuuagcaggugcuggaggugagaaggcacuaagugauggaaggaccucauccaagaacccgacucuguccugagaggaucuaggguguccgucaggccccaccccauuugacuuaggaccauuauuguuuuuauaguagcuacuugaaagacucauuaggaaaagucaugcuuuuguucauuucuguuuucaaccuagcuaaggagacauauauuacaaguaaauaauggcacaaauuggcaaaugaugaaaguccaggggauuauugccuagguagaauuuuagaaagaugauguggagaaauaggaacacuuuuacacuguuggugagacuaaacuaguucaaccauuguggaagacaguguggcgauuccucagggaucuagaacuagaaauaucauuugacccagccaucccauuacuggguauauacccaaaggaauauaaaucaugcugcuauaaagacacaugcacacguauguuuauagcggcacuauucacaauagcaaagacuuggaaccaacccaaauguccaucaaugauagacuggauuaagaaacuguggcacauauacaccauggaauacuaugcaaccauaaaaaacgaugaguucauguccuuuguagggacauggaugaagcuggaaaccgucacucucagcaaacugucgcaaggacaaaaaaccaaacaccgcauguucugacucauaggugggaauugaacaaugagaacacuuggacacaggaagagcaacaucacacaccagggccuguuguggggugggggaaguggggagggauagcguuaggagauauacuuaauguaaaugacaaguuaacaggugcagcacaccaacauggcacauauauaccuauguaacaaaccugcacguugugcacauguacccuagaacuuaaaguauaauaauaaaaaaaaagguaaaaggagccaggugaaauuaauauccuauuucaacauguaaucaauaugagaauuguuuaugagauacuuauaaauuuuucuucuucgaaaaaaaaguugcugccauucaagauggucuuuaaagaagcguaguauuugauuacuggagaggauaagguaauugauuuuuuuucaaguuucaguuauuuguuaauguaaucuccaacacauuauaucaacaugauuucauguaucuaaaggagaaauauuuccuaguuaaguggaaaauagugcagcuagcuucuggaagaucuucauucuaagcagcuuuauagugaaacauuucauuuagaaaucuggaccaucuuucuucaguuuacuguaauccacauucacugaguagaacuuguauugcucauuggaacccaguuuauuccagggcccugggucauucuuucuggcccaacuaacaucuggauugaaaugccagaugcaagacauacagugcugcucugguaccucuagcuccauuaaauacaaagagggggaucaaacucaguuccuuggccugaccaaggaccugguggagcauguuuucagcaagggcaucugauuuaaaaggagagaacuagcuuagcugccaggcccuugacuaaguaguaucucagaauaaaguaauugaaaauuaaugaguaucuacuuagggucucuaaauauauuuaauuuucuauggagggaacuuuuuaaauugaaaaauguaucaacauagagaagacuauguaaacaguauguguauaguuagagaaaaauaccuauguauccaccauucagguuaagaaagagaacauuacugguaucuuagaaaucaccugguaguccccuccacugcacuucccucagagguaacagucacccccacuuugguauuaaucaugcccuuucuaccaguguauauguccccagagcaagcauaaaccuagguguauaaggaaagggcagugaugccaucucuagaugaaggcucccaggagaagagcuucauggucucugguugaauucauuaccccugugucugaacagaaacucugggucaagucuggauccagaguugagagguugcagggacccuuuugggaaagucaguggaaaagaucaugaaugaguugugggaaacagggcuucucauaguuggagguaccuagaagacugcagugggcccagcuguugggagccugggaggaguggagucaagaggaaugugcugcuccacccuggcuuauguccagcucucaggaauaggccaaauggaauacuucugcggggugaaauagucuucugcugauucaggcagcaggacacagcaggggaacaggaauuucaucagugcaugauuaagaaaaaccaaauuccauuaggaauuugguccaggcucacccaggcauucuacccucaaugcagucuacggggaucuuggcagugacugcccucaacauaaguaucccucaaguugcccugcucacauggggauuggucauccucugaggcuggccacagcuuuuguguugagaccgcucuguucugugcuccugggaguucccuucacuuccucuuuguuuaaucuuuauuuccuguguuggagccugucuccuguuauuuucagaaggaugcauagcaguuuguuuuuugagaucuuugaugucuaacuguaucuugauucuuccuucauacuucguugauaauuuggcugguuauagacuucuggguuggaaguuguuucccuucagaauuuugcaggcauugggugccugucucuuuccuuggugcagcuguuaaaaagccugagaauauucucaauuuuugaucuuuugaauguagccuguuuuauucucuuuuggaagcuuuauagacccuuguuuccaauguuaugaaauuucccaggaaugccccaaacaggucuuuuucuccauuguuuugaugggccuuuccaaccuggcaacugguagccuuugguucugggaaaucuuucucaaaugguuuugcugaugauuuucuccccuccacuuucuuugucuuuucuuuaggaauucagacaugugacugucuggauugcccccuuuaauuuucuuaucucuuuucuccuauuuucaaacuguucuuuucuaaccuauuuccuaaacuuuuuuuuuuuuuuuugagaaagggucucacucugucacccaggcuggauggaguucagcggcagaaucucggcucacugcaaccucugccucccgguucaagcgauucucccaccucagccuccucaguagcugggacuacagaugcaugccaccacaccuggcuaauuuuuguauuuuuagcagagacaggguuucacuauguuggucagggugaucuugaacuccagaccucaagagaucccccugccucagccucccaaaaugcugggauuauagucaugagccacugcgccuggccuuuuccuaaacauuaucuuccaaccuuuuuagcuuuugaaaauuaagauauuauuuaccuacagcaaagcuuaucaaugcuaaguguuccuuuggcuguuuugacaaucauauaggcuugugcaguuaccacccuaaacaaaauauagaacauuucuaucaaccuagaaguuccguagggcccuuucccagcuguguuuucauuucuguuauuaucuuuuuaauauucgagagcuccuuuuuucucugaaauguuacuuuaaaaaagaaacauuuuauucuugauucacaaauaaaagguauucuuuuaucuuucugaagacauuaauuuuuaaaguuuucucucuguguaauguuuucucugaguugcuuuuuucuaucuccaugucugcauuagaggcuuuccucagacauauguuuaccuuggcuguuuguuuaugauuaaacuuggaggaaggcugagcaugugccucgggcuugugaacuuugaacgucacuaagagugagccauucauuggggaacucccagccucugugucuuuaggucaguccuggugagauggucacauuccucagaagacaguauuccagucucucaccuggagggcuagggacuggcugccagcauuucuggagcugcagggaagagggugaaggcuguagcauccuggcccccagcacucagcaugugugcagaugccgucuuucugcgugcccagagguucccaugcuucaccugacaucucuaguuacaggacccuuugucuuauccuuuccagaaacuaaaccucuagauauguguuuccuuauaauaaaauagucacuagccacaugguagccacuuaaauuuaaauuaacauuuaauaaaauuaagaaaucgguuucucaguuacaguagccaucuuuuaaaugccugguagccacaugugacuggcugccguacuggacacagcacagauacaaaacguuuccauuauuguggaccauuuuacuggacagugcuggucuagacuuuugcuggggcagaggaguggccaacgggauucuuuuucucaaacaccuuucucuggcccucuuucuucaccccaguuacuggugcuuccuuccaguuccugugacuuuggagacuucugugguauacguuaauuugguuaucagcuuuugccauugucagcuugggauucaguauuuguggauuaucgaagucaauuuuuuuuuuacauauccaacuacuuuccaguuuccaaaguuguaguuuucuccucuucuuuuccccuuacauauuugugaauuuggucuuaaacagaaaagccaugcuguauuuauuauacuacuuuauauauuuuaaaaauauguacuauauuuuaguggaguuucagaagggagugaaauuggguauuucuguucaaucugccauuuuagcugggaauccugccucauuuaccuucacaauccuauaagguauauaugugguuauucucauuuuauagugaagagaggcagguaaaauaauugacucaaggucacauagcuaguaagugggauuugaaguuggaucagacuuaaaaaaucagagagcuuuuuuuauuaaauaguguugugccuuaucuuguauugaggaaagacccacccaucacacguuccccaaguugcaauacuauaguuauaguuguguuuuaaauaccauguguuuggcugggcacaguggcucaugccuguaauccuagcacuuugggaggcagagauggguggaucacuugaggucaggaguucaagaccagccuggccaacauggugaaaccccaucucuacuaaaaauacaaaaauuagccgggcaugguggugcacaccuguaaucccagcuacucaggagacugaggcaggagaaucacuugaaccccagaggcagagguugcagugagcugagaucacgccacugcgcuccagccugggugacagaugagacucugucucaaaaaaacaaaacaaaaccauguauuugcccagauacuucccaguuauccuuacaaccacuuaauaaaagaggucagccuuggauaguucugucucagaaagguucuuuucuccucagcuguuuauuucguuguuuugggacuuuacaaccucuaaacuuuguguuagcuuuuucuuuagcaguucucaaaguguuuagagucagaagcauuccauuguuuaacuuaaaccuuuuauuugaagcaucuauggucauucucuuauauuaaaauuguucccucuucauuuaaccucacuuuccauaaggcagcgaguagaucguguuuauuuuugaaucccuagugccuggccccuugucugagguaggggauucauaguguuugguucaacaucaucuuuuauuuggaccauugcaguugcuuccaaacugcuggucucugccuucugucagcugcucucaaaaugaccugacauuggucuuucucaaaaucaacaaucacuggccuccucuaaccugcauuguagagucuuggcuacucagcauggucuagaggguugaccacgccugccucuguccacugcuguagccccaugucuggccacucaccccccaacgcacccuccagugcaccaaugugcacuuugugaaaggaccacuacaugcucucaaacuugugcucuuauuucugccagaaaugugcuaucuccagucccaccuauuucuguuauuuaauaucuauuuuucugcaaaucccagccccaggacauucucugugaaaccucgucugauccacccuuauauggaguuagaagauuauuuuugcucccacacacuuccuuucaauuccucccucccucccucccucccucccucccuucuuuccuuccuuccuuccuuccuuccuuccuuccuuccuuccuuccuucuuuccuuccuuccucccuuccucccucccucccucccaaauggaaucuugccauauguauuauucugcaguuugauuuuucuccuuaauacgaagcuuaucauguuguaacuauugaaugauuagucaguucuauuagugucugguucauaggaauuauuaucauuguaugaccaauuucuagcacagaggcuggcacauuguaggcacacaaaaauuauuuauugagugaaauugagccaugguguugagugaguccauggcaguucacuugccauuuauugucuuugaauucugcugucaguaggguggucauauguuccaguauaugccuauuccuauuuucccagcauaguuaugaauaguuccugauguuuuaauaucuccuaguugguacaguaaauuauauggacaccccagccugggcaauaaggcgagacccugucucuacaaaaaaauagaaaaauuagccaggcgugauggugugcacgccuguagucucggcuauucuggacguugaggugggaggauucagcauugagccugggaggccaagauugcagugagccaagauugugccacugcacuccagcuugggugacagagugagaccugucucaaaaaaacuuauauauaauuuuuauauguauauggccacccuaccaauuaaacagaucuaaguggaagcucauuuuaccuuauccaguggaacagcuagagaguaauaaauauuugggguaugagguugcauuugaaacauugaauccaguuucuuuccagccagccaaucagcaaagccccaaaucacacacuggaaaaaauuaccuuugaugcaucuucaaagccuaaauguuucauguuccagaaggacugcugauuccuuuuagaaguacuuuuacaagaagugguuuaccuuucagaaauggaccuuuuuuuguuguucugccgcuucccagcaguaugaccuuggcaaaguucucccggaauguaaaauggggaugagaguaguccugcuuuacaggguuaauguggcaauugagaucauucauguagagugauuagcauuguuaguggcauaguaagugcuuagcaaauaucagcuuuuauuauugguguuaugaucgugaccauuacuaucuuuugacauagacuaguuuagaagacguugguuauggucuugaaaggagugacuaggaucugccccacagcuuucugauugcaauguguaugcccuuaacugccugucaaugcaggaugcuacugcacuguagaggauggaaaaagaaaaucaguaagaagaaaucauguguggguugcaaaggagagaguagaaugacauaacugugguugcuagugagucaggggcuagcugugucuaccuuggaaaucuugggugggucagauuuggauugacauuagaacagaugggccucagaaucaccuggagaguucaaaaaauugucuacucuggguuccagccucggagacccugauggauguaggguaaggauuggaauucauauauuuuuaaaaagcucccagguaauucugauacacagcuggguuugagaauuacucgauggagugaccauuuauuaccuaauaauucuguaaagcauuuccugaucauuugcuauuuaauguaaggcagaugaugacauaggggucagaaaacagaggaagauuauuggagagccugaauuaauggaauuaaauuuuaugagaguuuugaauuuaagccugucaugaaucuguguuguuguugucuaggauccuugccuauauuuagaucauuugaaaugaaauaacagaaaauugugaaaucaggaacaaaguccuguuagaaauguaaaauaaucaaaauaugaaccuagcuaugcuuggauuuaaaacugaaagguagauauuuucuccugacauuugaaaauguuuucaacuuuuauugcucuuacuggaaaggagaaagaacuuagcuaggugcauaucauggauacuugacuggguccaggucauuacuuagaugauuuaauggaagggcauuggguuaggagucaguagaccugcguggagucucagcucagauacuucucuuugcaaaaccugaguuaguuacuucagucaucuuuuuggcauguauuuacauaucuguaaaacggagacaauguuauuggccucuauccggcaugauauuguuggggguguaaugaggacauguaugugauaggaauguaaagcugugaugaacacagagagugaccauaugucucuguuugccuggggcagccccaguuuacaccuguuguuggguauaauuauugauagcacacucuuuaacucucagguaucccaguuuggcugauaaauuauauggucacccuguauucauaacacccaucuauuguuuacuauuaaucuuucgaaguaggaagguuuucuggccucauuccuguggccccaaaucccucaccaaauaaguauuucuuagaugcuuucugguaguuuucuucaauuuuaugugaauuucaucucuccaacuacauuggucaguagauaauaauuguuuuuuuuuuucacuccugaauaauuuucuuguuuaucaugguauuagcauuuuaaacauucuaauugcccauuuugguuggugcaucuuaagaaaguaaauuugaagugcaggcagaggacagaggaaccccagcgggaaauggcuuuguggaaguacacuaaaaaugaagaguacaguuuguuugcugauguucugacuugguguuuuggaaucuaaaugcccuauguugauuuuuuuuuuuuuuuuuuuugagacagagucuugcuuugucauccaggcuggagugcaguggcgcaaucucgacucagugcaaccucugccucccagguucaaacuauucuccugcgucagucuccuacuguaaucucaguagcugggacuacaggcgcucgccaccaugccuggcuaauuuuuguauuuucaguagagacaagguuucgccauguuggccaggcuggucacgaacuccugaccucaagugaucagcccgccuuagccucccaaagugcugggauuccaggcgugagccaccacaccuggccauauguugauauuucuaaguacagcguuaacucuucaaaguaauugggaagaccacaaaagcucuagaugaaauuucaaaucucccucuucccccggagaaauuuaagaacuaccaucagaaaaacuuuucauuccucaaauaacauuuucuuuucccuuuuuugacaacgagagcaaugcauuugaucauguuucuccccugcuuuuuuuuugaccccuaggaaacucaaagccaaauucguagcccauccuuaaugucuauguggaaagcaguagacuacaaauaacuuuccacuagccuugacuuuuugucccguauuacaaucuccuuaguccuggauuuuaaaaauacguauuucuguuuuauucaauguguucuuauaaacugccuuggaaucuuguggguuaaguuaaagauuaaauaaauaacgaauauaaagaugguaucauaguuucaacauuauuuucaugaaauuguuugaaauuuagaaggcacaagcuuuugugguacagagaccuauacugccugagagucaauaaagaauauacucuggucuaccaucccacugaggaggucaccucccaccagaacagggcuaaagagagcaaauuaccuccauauguugccuauuaaccucuuggacaaaugauugguaacacuuaguguaugcaggugggaauaagagcaagcgccugucuuauuuuuuugagacccugucuuauuuuuuugugugauggucucacuguuguccaggcuggagugcagaggugcugucacagcucauugcagccucgaccucccaggcucaggugauccucccacuucagccucccaaguagcugggacuacaggcaugugccaccacaccuggcuaaauuuuuuuuuuuuuuuuggagagaggggguuucacuauguugccuaggcuggucuugaacuccuggccucaagagauccucuugccucauccuuccaaagugcugggauuacaagcgggagccacugugccuggccuagaagaucuguuuucuuuucucugaauaauucuugugacacugucucucccuccaucucuuucuguuucuuugucauuuuucccagcuauccuuuuuuccuugucuuguccucuucuccccuccauccuaaaaccuuugaucacaagcuaguuuccuuuccacaucaucugcuccccucuacuaaacgcuauuucgcccccaccugcuuucagcugugcuugccucugagccccucuuucaccacggcccagauggggugcacgugccagcuucccugucagcagcucuugugagcagcaacugcugcuaacaagcuucccgaaaacuaggaaaagagauacaccauuaaauaccaagcaguaauuuggagacaaaagaaaacaucacaucugauuggaaugccuuacguugcauccagauaguuugguaggaaggagaaauaaaaauguggcggauagcuagcauaaugcuagauagcaguagcaguagaaucucaguucuucugucuuuuuguaauuagcucguucguucguucauucauucauucauucuuucacucagcaaccacuuaucugugucuguuauauugccaguaguguuuucuugggucugggcuuuuugaugauagagcuuucugagaccugggaccuggccugggaauuuaguauucgcuugcuuucugggcuggagaaagacugccucuaauuauacaguuucuccuaugcauagagguuauauucauaaauacaguguacacugaaucuuuauuuuaacaagggguguguguguguguguguauguuugccaugaacauacacacaguauauucuaaaaauugugggcauaugcuuccauuuuaacaagcuugaaauacagcaauuugaauaucugauuaagauuauucaaauacuauuuuacuaguaaaaggaauaaaaaccugaagacuaggcaagauagaagacuuaaccaucugcuucugcucugggguuuuugggaccuucucccaaaagcacuaauuuaaguaaaacauaauuaauauauauauuuuucaaucuacguaguaaaacuuuuacuaauuggaacaaaugagaaggaagacuugccugaacauauugaaagcugcacaguagaauauguaaaaaggaauggcacaaguggaaaugguggcucaguagagagccccauaucauguugagaugaauaaggauagagcugaauagaugcaucauuuugagagggucacugccgugagaguaaguaccagaaaaacuagccuuauaagccuuauauauggcuuaauagagguuuaauguuuaagaauuugauaagaauuacuugugauuagugcauuaaaguucuaaccugagcaguacugacuugacuucucuuuauauuaccaauacuauuuagagauaaauggguauuccuaaagugucugaaauguucugucuguuaaggaggucaguagucuacuuugucacuuuuuuuucuuuaccaguuucauuuuuggacagaugguacaaugcucuauacacuugugagcaugucucaaguuccauauucgaaaaauaugauuuaaaaguguuuaggcuagugagaauaacagaguuaagagucauaauuguauuucaauuaaugaauacaguuuuggugugagcugggucuacuuugcuuuuuaguaguccauauuacuugauaguaaagagacaugugcguuucaguaguauguguuuuauuacacuuggagguaacuucuguguccuuucaggggcuccaccuauaaaauuagggagauccuggcaugucagggcugaggguacacucauaacacaucuuguuuuuuuuaacuuuaaguucagggguacaugugcagguuuguuauauagguaaacuugugccaugcauguuuguuguacauauuauuucaucacccagguauuaagccuagcacccauuaguuauuuuuccugauccucucccuccucccacccuucacccuccaauuggccccagugugugauguuccccgcuguguguccaaacauaucuuauuuguaugucuuauugaaccugggcucagggaggugaaaggauuuauuauggcagagccuuuaacggguccagcacuuuuucuaaauucuacuuugcuguaggucugagaaaagcccagaaguuuauugugcuagaacaauguuauucucucuuucagaaucaaaaccuuucagaacccagccuuuucauuuucuaauagcuauuccucccuaaaggaugccaggaggaauauguaaguauauuuagauagaacguaugcauacaucuccaugucuuagaaacaccuccacuuccaaccccauguacuguuauuuucauuucagaacuggaauuaggcuguggaagcaucugaauuguuccccucccuaucaucuuuucucuuuuuacaaauacaguuuuaccaaaacaaacccaguuauaaaggcauuacuggaaaguuuacuguacuuuggauccauaaauauucuuuuuuuuuuuuuugugcuucuccucacuguuaagagaagucugcuggacaaggaguuuugaguaugugcauuuaguggguagauagugguaaaaggaaaaagaaaaacaugcacuggcaugaaagguaguaguauacacuccuccguuuuuccuuuaaagcuuuaagagguaguguggaauagcagaaacaguccuucccuauauuucuaaagaucuggguucaagaccuggcuuuugccauuuacuugcucuaugagucauaucaccucucugugucaauauuuauguauucacucaccacuuauugagcuuugucugucauacacugcagauacaacaaaacugucacagcccugccuucuugaugcuuauguuaagacaaugauagugacugagaauggcguaguagcaguguagguggcgagaaaucgugggauaugggacauauuuugaagcuaaagcugauagaauuggugaugguuuagaugugggaugugagagaaagaugugucaagacugacugcugggggguuuugcuucuacaacauggugaauacuggcauuuacugagagagugaaugcuggggaggagggaggagguguguguugauggugugggaauuccagguugcuuuuuauauagaugaugguuuggaugccuguuaacuuccaaguagagaugcugaagagguaguugggauuuuuuuuuuuuuuucuuuuuugagauggaguuuugcuuuuguugcccaggcuggagagcaaugguguagucuuggcuuacugcagcucccgccucccagguucaaacaauucugcugccucagccucccaaguaacugggauuacaggcaugcaccaccacgcccagcuaauuuuguauuuuuaguagagaugggguuucacuguguuggucaggcugaucuugaacuccugaccucaagugauccacucaccuuggccucccaagguaguuggauauuugagaucggaguucugagauagaaauuuggacauuguuggcaugcauguggcauuugaaccaugcaacagggugagaucacuucaguagauagagaaaaagugaagauugaggccugaguccuugggccaccgacauuuggagacugagaagugggggagcucccucuggccucugagaaugagaaugcuggaaccugaccucuuuuccucauuuagguuguuuguagggaucaugugagauagguacacauaaacacacaucaaaaacaacuuagugcuuaauugcaugacuaaauauaggaguaagggagguuacauggauaaaucacuuuuucacuugauuuuucuucugaaagucuauuuuaugggauugggugaggugcgugcaaauuuguuauauggcagagguucccaauguguagauguguaaaugugggauuuaagggagugaagacagggaggguauuugggaaauuuuacagggggccuacuguacaauaucugcuuucaauacgauuauuucuuucuuuauuaguccagaaauauauauagcaguaggauccaugagcuauuaccuuuaacaggauucucauacuaaaaaaauuuaacacugauauuugacauauguagagcuauguacauuuauaaaaacauguaugcauucuaaaugugaaucggauacaguugacguugucugcuuuuguggacagauaucugcuuggauucccagguuuucguaagcuguuugaacuuguuucaucucagucugcucugccccuucucugucaccguccucgcacuggagaugaggcaggguuuccugaacugugggcucuguucugggaagacccuguagccagcuccuagagaagacuugcagaaagaugugggaugagaacaggaagaucaaguggguugaaggggaaaaaacaagaaggccgaggcaaauaaaggcagaggaucauuugggagggaguugaggaaaggggccuccacuguucccuaggugaccauauuuucucucccucuuuggguuauuuucuuugugccuaccuguuuuaucagaauugcaaggauuuuucccagguguuuggguuguugaguaguagguaaauauaacuuuuuccgggcauuaccuucuggaauaucugcuugaagguaaaauugcaaaaauggcucauucuccccuacuuuuaugaacacuguuuuagucuaaucuuauuauauugaaaucuuagauuuuaucccaugcuuguguuuauccaauuuuauaggguguguguguguguauauauguguguggggaaugugaauauaugugaaugaaugccuuuucuagagaaucugguauauuaagucaucuacccaagaagaaaagucuucugagauugaugcugucagauaaaucuauagaauuugagaaaugaaagagagcauagagaacaucugauccggacuuuuccaaauguauauuccauuaaaaaagaagugccuuggucugaugauuuuuuugggaguuggagacucacugcauuuauuaacuaugaaaggcuuaagagcucuugcuguuaaaaauauuauuuaacuauguuuaaccaguguuucuccaauuuuuucacuauggacccucauuuuccuucucucucuuuuuagaaggauauguacauagaacaguuacuaucauugcacagaaguacaagauuccagaaaacauaauuugggaaugcuaauuuaauucuuaccuucaaauugaaugcgauacuucauuucuguugguuuguguucccauauguaguaugagcagguugaaugaauuaaucaauuacugugucacuccugacugugacauuuucugguucugauucguuaaaucaauauuuaaaaauuauaucuguuucuauauuaaagaaccuugucuuuuuuguuccuuacuagaaccauagugucuaauacagugccugacacauaguagugucucaguaaauguuacugaacaaauauauaccuguuagauucagagcacugaacuagcuaugucuugaggcugcagagagaaugaucuuguuuuugcucucaaggaacuuguagucaagucauuaacuuuccuaagagcauggaaugugccauggagaggucccaaauuagagcuugauugugauaaucuauaggacaaagauagauuggacauuauuucugacccugugucagauguguggauuacaacacagcuggguuauguuaacauaacuuucaugacaagaagugucuuucaguaauagucacugcagcagccacauagucguuuuaucccuggcaaagacuuuaugaugcuaucagcacuaagagauuggagcuaguauuauucccauuuuaguagauaaaagagcuaaggcucagagauuuagagacaugucuaaguugacauaccuccugacugaaaagccagaauuaggacccagguaugugauucuaaaccuugugcacuuauccacuaggcuuccuguccucucaccaauacuaguaucuuucauugucucauuuguauuagaagcucaccuugaacaggcucagagaauuacacauuuccagucuucauugugucccugcucugcucccucuguccccaugccaugagggcugcuuucuuuacagcugaugugcuagcuagggugaguuuuggagcagguaauaaaaaguuuacagacuuugggccagaugcgguggcuuacaccuguagucccagcacuuugggaggccgaggccgguggaucaccugaggucaggaguucgagaccagcauggccaacauggugaaaccccgucucuacuaaaaaugcaaaaauuaaccaggcgugguggugcaugccuguaaucccagcuacucggaaggcugaggcaggagaaucgcuugaaccugggagguggagguugcagugagcugagaucaugccauugcacuccagccugggugacaagagcaaaacucugucucuuuguccuuaccaaccauguuggcagcauccauauucuaggcugcagauaggagaaggaauuaagaaaacggggcaaagaccuuacaguggucuccaggguagaagcugccacacaguacuuuugcuuuuauccuguuggccaaacuuacucacauggucauaucuugccgcaaaggaagcuggcaauuguagucacuauugugagcauucuugugcacagcuaaaaauuacuguugaagaagaggaaggacaauggcauacaaucagcugucucuuccaccacugcguauuggggucuggugcccauucacuccccucuucugacuuuuggcuaguagcuaauccuuuucccuguccuuaccuuuauccuuuaacucccuucuuccuauuauuuaaauguucucaagucucuuccaucuuaacaugccauaacacacacacacacacacacacacacacucucucucucucucucucucucucucucucucacaaauucaugaguaaaggcaccauguccccagugcucauguuauauacucagauccuugugcagggcauaguacauagggguuuuucaacaacucuuuguugagagagcaagugggugagugaaggguugaaacauuucccucuauccuuuauccucggauugacagagagaugcugcugucugucuuaacaucuauggcacaaaugacaggacugaugauuuuacucccuuuagugcugaggaggcuguuugggaccaugaaguaguucuagaaauguaucgugcugagaagagcacuaaagggaguaaaauacacaucaguucugguuuuguugcuuacuagcuacaaugacauuuggcaaauuauguaaugucuuugagccucaguuuccucauuugaggaagugaagacuccauugaccucacaaugauuaaauuagaaaacugugauaaagaauacaccccugauaauauuauuuuggcuucuuauggugauuuuuaagauuaaggaguaucaucaucccuauuuuauuucucuaaaauaauauuuaaaaaaacguaaaugcccuauacaauagaguauuauuuggucacaaaaagaaugaagcacuggugcaugcuacagcauggauccccugaggacauuguguaggugaaagaagccagacacacacauuauaugauucaauuucuaugaaaugucuagacuaggcuaauagaccagugguugcuaggggaugcgauaggggagaauggagagugacaugggguuucuuuuugggguggugaaauguucuggaaguagauagugaugaugguugcacucuuuugagauuacacuaagaaccacugaauugugcaccuaaaaaauaaguuaaaaauuuaaaugucauuauagggcauuauaauuauaaguaagagaauacuuuuaaaacugugucuaaguuuugguucacaguuugucaaugauucuucuguaacagaaaccaacaucugguugguuuuuugaguuuuuucaccugcuggcugaccuuacuugacauacuguauuagacuuucuuuaucuuuccaggccuacgcaacucucagcacacugggaaaucucagggcaugguguuccauuagaaagaagaguaagcaugugggcuucuucguggguaccaugaugggagagaauagaaaauaagaaguuaaauaauuccucgcaauucuguuaggcauauaaacuacacauuuaauauuauaaaacaguuuuauaaaugcacuuggucuauggugucugcauggauuaggugaguacuucuggaaggagguggggauagucagagaaggcaugcuggggaaggaaauguuuaaacauuugcuucuuacacagacauuuauugaauaucuggcaugccuuaggcauuguuauuugguguuguauguacccagauaacagcugcagucccugcccucagggugcucaaagacagcgaagacagaugauucuacagacaguuagggagcaggauguaagugcuacuccaaagguaagcacaggacucucugaacgccucacuugggaaaugggagaagucagggaaaccuugauggagaugauuccugagcuaggaacugaaggaugaguggggacagcaaaggcuuggaggacaaagucaugcuggauuacaggaacugcagguaacucaguacguuuggaguucagggcacaaauggggaugagccaugagaaguugauuacaaguagccuuguaagccaugucaccuaagagaguaagaaauaaaagaguuuuagagcaugauacuuccagauuagcagucuagaaauaagacuggcugcauuguagagacuuggaauagaagcggacgagaaugaaggcagaaacuuucaggagauuguugcaguaauuugggagauaaguggguagagacaacagaguuagaacagagacaacagaguuagaacgauuagggcuugcuccccaaguggauauggucgcaguuccuaggacuccaagaucucuguccacuucgcugucucacuucaugucagucugaccccagccugccuucuaagucuuguuuucuucucuucaugaaaugcuuaagucuugugcuuacuguccccagaacucgcuuggugauuuaaugucuguuaccuuugauuacaccuuuaucuucaccuagaauggagcucaucuguucccuuuaccuucuuagaucucugacuuaugaauccuuuggaauaauuccaugcuagaaugaucucuuuguccucugaagucauagcacuuaauaucucuaucagucaaugacaaauaauuauguuuugccuugucacaucucuuaauugcuuugaauugcuagucaaucuugagccauugcagcagguagagaggugaauuggcucuccugaauuccuacucccagcccuaauuuccuguauaacccagggggaaugacuuuucuccccucauuaguguaguaacacauauuugaugcagaacacuuagaaaaucucuaaaagugugcaaaaugaaguaacuacuaucacaaacaccuuggaauacucacagguaauuauucuuguaauguccuccccauccauuuugucaccguuucuuuaggauuacaugugugcgucuaugcaucauagcuaggaucauccuauacaugcuguuuuucaauuugauuuuuucauuaccauauuguaagauucuugugucaaaacauaggagaaucuucaaguccaaauugaaaguggagcuaaauuguucucagggagaguuguacagaugaguauccccuaucugaaaugcuugagaccagacaauuuucagauuucagauuuuugggauuuuauaauauuagcacuaugcuuacccauugagcaucccaaaucugaaaauucaaaauccuccaaugagcauuuccuucaagaaaugugguagucaaaaagucauauuuuggagcauuucagacuucagauuuuuugauuuggguugcucagccuuaccaaaaacugaauagugacuaucucugggaggagggaggggaacuuuggcuuuucagugauaucuuucuauaauguugaaugugugcauuuaugaugagucuaaaugauuuuuagaguugucacccauaguuuauaggugacaguaauuuauacuucuaccuaauccaggcuuauauuuacauuuaaaaagaaguauaacaccaacuuuacugacuagauagauaaacaauuuuaauuuacugaaauuucaccuuuucaccaugauuauagguccuuuuuccauuaguuguuuccauuuccuuugcugucuaaugacuuagauuugaguccuagguaauaaauacaugugaucuuucacaagucacuuaguguuucuaagcuuuaguuugcuuaugaguagaauaagaggaaugauacuucaaauuauugugaggauugagaucaaguauugaaagugcuuuguaaauuguaaaaaguauauaauuauugauuuuuuauugauuuuuauauuagucaauggucaugagcaguuaagccaacuuugcuuuuuuaaaaauucauuuggagaaagacuaaaaaggcagaggugccuucauuaauauuuauuuuggugcaaugugggauccaugagauuuggguuugugccacauuucugcugcuaauuauuagcuauauauacagcugaaaugcacugaacaagcacaguuuuggccaggcccagaaauguucagggagcaccuggcuggacauacaucagagagcuuggugaccugauaaagcauucaugcaagcuccuggagacuguuuaacuggaugacaguagaaggaaacuauuuaugcaaauuuugcuaacugaaguucucccacacccuugaguccacauuucacaggcuugugagauggaaaugggucaaaaucagguucuaauaaucucuuugucaucugcagucaugccugagaaggucugauauggucuucugaaucaucaagggaagguagaauuucauccaacaugacuuuugugcauuugcuguauucagcucccuggaaacauaggugccuuaauuuuaucaguuauccagaacacugaauucuggauaauagaggaacagggcuguguaaacaacucugcugaguaauagauggccuccuggccucugguuucugacucuguauucccuuuuauccaaggacaagauguuacaaaaauaauucagagugacucccaagggcagccccgugaacuugcuggucccuccgacugugcuagcagaggaggaugagucaccagcagcagaauguugacucucccagugcuauuaguggaugucccagccagacgcgacaaccaggaagacaagcuuugggaaaguucuuucugacucauuaacaucaugauuuacacaagaaaaccucuagcuucucauuuuauuuuauuuuuuaaagaaguuuccuuuuuguauguguguauagcgagguggggcaaagguauggaucccucaaaugaauauucaaauuagcucuuacccauagcaguauuugaacuguuugcucaguuaaauuuuauuguccuuucucaauguacagugccuauauauccaucaaagaguagcagauucauuaagaaucuuuaaaaagaaggacauuauuuuuacacaguugaauuucagguguccuaugcccaugccuuucccaucauuuccuaugugugagaacccccaccccacguagcacaccuucacauacuggggacuuuccacuugaggaauucacaugaaucuggggaucugcauucuccuuggguaguauccccucagaagaaaauccagacuccuuagggggcauuuguagccugggcccaguuuuccuccuuaccucaucuuuuuugguucuacacaaaccuguuuagucuucagucaagugccuuacccuccggcuuuccuccuccuccuccuccuccuccuccuccuccuccuccuccuccuccuccuccuccuccucccucccccucccccucccccuccccccuccuccucccccccucccccucccccccuccuccucccucguccuccugcuccucuucuuuuuuuuucucuuuuucuuuugggaugcagucuugcucuguugcccaggcuggagugcaguggcacagcucacugcaaccuccaccuucugguuuaagcgauucuccugccucagccucccaaguagcugggacuacaggugcucaccaccacaccuggcuaauuuuuguauuuuuaguagggacaggguuucaccauguuggccaggcuggucucaaaguccugaccucaagugauccacccgccucggccuuccaaagggcugagauugcaggcgugagccaucgugcccaaccccacuuuccuucuuuugcuauuucuucauguuucccuuauuuggaauguuguccucacucagcuccuguuuucauccuguuuguaucccaccuucuucguagugauaguaguaguauugcaugccugcugugagccaguuuuccuacuguguuuauguauauauuuuuccaagaguuuaaaauaagccuguaaaauaauuaugauuauccuuauuugcaaaugagaaaacagucauagaaaguuaaaaauuauucaaagccagcuacuaaguggcagggcugagguuuuccugagccugaacauucaaccccaccaugcugguuuucccugccguccucuggauccgaucaaacucacuacaccagccccacucuuagaccuucuccagacgugcucuuuucgcuuggucggguguguccuguguuuggcaaucagucauguauuauuaccuugcuaugugcuuggguugcuaauucuucuuuggcgauauaucuuuuguuguuuucuuuucuucuuacugagcugugcaucgcaggcuuuacacaaugcguuuuuguugauuuuacuuaauuaaugauguccuggaacaagugaguuauuucuccuaguuauauuuagcccaauuaguuauuuacauccuaccauaauauuugccuccacuaauugcuaaguagucuugcaaauuauccuucagucuucuuuuucuaugcuuuuauuccugggaaggaaagacaaaagaagcuccguggcuggagucuguaguguaucccauccccugcaaagaaaccaacagaaaaauuaaguggaaugaccaggcauugccacuaaauaguuugauacuuugaaauggaugccaguuuggcuaaauucaaguguugucuguuagacaagggcuauucguaaaagaauugugaauguaagcaugcucuggacugugcuucaaggaugcaaaaaagugucauugagacugccuuccuaugugcagagugggaaaaggagcauuuaucuugagaaagaauaacugcaucugaucaccguuuucaauucauugauagggaaauacaauuaaagauuccuaaccuauuucaggauacccaucuaccaucuaaaucuccaagacuuggauagcuuccccguucccgaguaguuccccauugacaggcaugcacugaacucuucauuuacgauaaccguuguuuccaugaaauacacugaaaauuuugcacaguugcaagguacacagaauggauuuugaauucuuuugguuguacgaagcaucccuagaugugaucaugaaguuagacaccugggacugugagaaaauaagucauguguaagaagagugguuuggcagaauuuuaaaaauagaccuuccaugcuuuguggguauaguuucuacauauucuagaucuuugugguaccauuauauggcuguaggagguaaccaacugaagagcuuucugggaggagaagcuuauugugaaaugaagacugugcauaugcguuguaugggucucaguccagcuguuuguauugaaacaucauaggcuauacauugugagaaaagagaaguaaucuugugguaaccaaagaaguuugaggugaaauaugucucacuguuucauauucagcuggggaaugucucacuguuuuauauucacuuucuuauauuugcugaaauaaaaacaaaaauaagguaaauuugauuaguaguaaccuuguuggguccuuuaaaacaguguuuuucaaacuguagucuguuaaucuuuacugggcugugaaaucuguuuugugggucuuguuuagcauuuaaaaauguauuaaauauaagaaaauguagaauagaagguagagggaauggcacauaguaaggaucaauaucuuuuugugaaacuuguaugucauauacacacauguguacuacaaaauauauuuuuuacgguggaucauggucaaaaaagacugcaaagcuguuuuaagcauggcugucagcauagguuccuaggauaucagacaaugauguguaacccuagcuggauucuuggcugaaugcuaggggaaacuggggcagacuggggaggagugagagguggcacaguggcuccagaggcgcuguggugaccugccgauccugcucugcccugaugcugcugccgccuuggugaagacuaagugcauuacucauuauauggauaggguucgcugagagcucugccagcaguuuaagauuggagucuuuguuggcagggcaguuucaaagcugaacauaaaaacugguuacaguuuuuugguugagggggccaaguguaggggggccauguagagaaagauuuuucuugagauuuccugguuuuuuuuuguuuguuuuuugagacguagucuugcucugacaccuaggcuagagugcagcagcaugaucuuugcucucugcacccucugccucccggguucaagcgauucuccugccucagccuccugaguagcugggauuacaggcacccaccaccacgcccggcuaaccuuuuuuguuuuuuguuuuuuguuuuuuuuaguagagacgggguuucaccauauuggccaggcugguuucgaacuccugaccucaagugauccgcccaccuuggcgucccaaagugcugggauuacaggcgugagccauugugccccgccucguuuuguuuuguuuucucuccuaacuuacauuuugaggcaauagcugaguaccuuuggugcauagacugaaauggacauuugccauuugggggguugucuagcauuggaacccccuuuguuucuagaguggucucccauuguugcuguggaagcugaaggaggugcagacacauaacugagggcaaacuagguucaaccucuucgauuccuccucgucaggacuuugaaucuggagggaguggugcaaacauacagagguggcuugagaucauucauggaagcagcagaguugggaguccaguccuggugauggcuggugaccgguggaggcugugcgagcagugguguccuuaucaggcuguuccucuguccuucugucuuucccuuaaacucauuuuacccuuagguaagcagagcugguuucuguugauuguacccaagaacacugaguggauauaggaagcauguuagauuugugucugcccuaaaugaacuuaguaugugacaggugagaagaaguaggugaaugcuugguagacacaaauaguaaaauuuagcaagggguggaaggauucaggguuguuuuccuuuguauuccuuuaaauuauggguaccuucaagcuuugucagaugacuuaucagcaggagauucuaugucuuuacauugugacauuuuggaaauacauguuaauaaaaaaugagcuauguuaggugcaguacaaaaugguuucaaacuuuuauaaguuaggguuuguuuuauuuguuucuuuuuucaguuuuaagcuuuuuaaaagccuugcgcauacucacagaaaacugauuuccuaaugggugugagcauuuuauuuuagcauuaagagauuuagggaaaucuugaaucaucaucacaacaacccuguaaaguagauacuucuauuauucugaggaaacaaacucaacagagguuaagaaacuggccuaaggucucagacaguggguguuagagcugggaucuggacccagguuagggugacuccaagagcaggcuuuuaacugcuucuauaaggaacuuuggagggcauccaauacuuuuucauuaugcaggguuugagcucagagagguuaagaggcuugcucaacaccaggcagguccuaguggaucugggcuggaacaugggccucuuucugacuggugggaagaagcucucgcacaagcucuguuccucuugcacccuccccuccuuuccuugcugucugccuuuuuccugcaagauucuuccugucugcauacucuuuccugcacaauugugcuugugauuuuccuucuuccuggccuuuauuuuuauuuuuuuuaaagaacagcuguaccuuuccucucucuuuuucagucuucuccauuucugaaaacugagagcagauuccucucuccuuaauccccucucagcccaaagcauggcccuuguguccucuguuuuugacucccaugguucucagugucugucucucagcaugcccucacagccucuucccugggguucccguguauauguuagucuugccagcugucaguagauuguaagauuuuuggcaugcucagauguauuuguguuacuucuuuggauuccccugaagucccacaccuugcccaaggcagagugguaaauggaaaggggagugaggcuacagcugagaaauguguuugagaccuaucucaccucucacuggccaguugacugugggaacgccuuagccgagucuucccaucugaaggggcugugaaacucgaaugugguuuagaugugaaagcccuuuuuaagccauaaagugcuauauaaaugcaagguuuuauugugauggcacaagugcuucagaaguauuuuugggauaaaugauuaaaaagcacauauugugccugggugaguugguucaugccuguaaccuuaacaauuugggaggcugagaugggaggauugcuugagcccaggaguaugagaccaccuugggcaccauagugagaccccuuucccaaaaacaacaacaacaaaaauuaacugaaugugguagugugcaccuguuaucccaccuucuugggaggcugaggcaggagguucacuugaacccaggaggucaaggcugcagugagccaugauugugccacuauauuccagcgugggugacagagcgagauuccaucccccuccaucccccccaaaaaagcacauacuaugaagacaagccauucuccccaccccgccauguuuugaguguccauuugugccaccaagucuuugacccugggguaaggauauggauggcuucacuaaaucuuauauucauugcucuuuaauaagauuauggauguguuagugguaauuaguuuaaaagaagaaaaaguuuuuuagaaaaggaaaaguaacaaagucucuugguacaauguggcuuuuagaaagacacuuacugacuuuaagcaaaguacuguauuuacuuuuaucaaaaacugucucucacugaaugcaggcuccuugggagcagugcgaagcaccgaaccauugagcuggcauugauuauuuaaucaucccuaguuuauuguaaaugaagcagcacuuacgguucugggguauuccuggaauugcugcuauaguuagaagugaguuauucuguguggcaggaguggcauauagaaaagccauaguucugacuuccugacaggaaaaauagcagauuuuguauuuauaugaugucguccuuuuggcuggaauccaucagcuuuacaguaucuugugaugcuuucaucagaacuguuauuccacgucucagcauagcaguggggucccaguagcaauagauacaagucauuuucgguggcucuaugggugugaagccacuggcaguuucccuggcuuguuguguagguuaggcuguuaggaggcuuccuguucacauguugcuaggacuuuccucucacacuguggcaguggugccagggcagagcauuaguagugggcaggaacacagggaaggcuggggccaugcagugauuuuuuaaaugacaguccuuucagucuacagaaggaagaguguuggaguaagaucagucuccugggugguuguuagacuaugaaaaguacuaaaaaaccagagaagacagugguguugcugauggggacaguuuagagcaguucuuccccacuguggaacgagcaggguccuuagaaucaguagucacguguuugacuccuggcacucucgcugauuagcguaaaaccucucaugcuuuuuaugagaauuaagugcgagugccuaacuccaggcucaagauauugaaaugcuuaguagauauuguuuuuuuuuuccuugacuggaacuguauauuucaucaagcuguaaucaguuuaacaaauuauggucaaaauaugagugcuuacugcaugcuaaacucuguugggcauuuuacaugcauugacugacuuaacucuuaauagcccagugagauaaaugcuauuuuuaucuccccacuuacaccaagaacauugaagguuagggauauuaacuaacuugccuaagauuacaauagcuagucgguggagacgccagaauucaaacccagguugcaaugacuccagcccgugcucuuaacugcuuugcugugucaucugagcuuuaugaaaugggguuuugauuuguaucuaggcuuuugcucagaaucccuauuuagacuuugcucuucgaagcagauucauagcccacuuuaguccugugccauaaagacuauuuuauauugcgucaauaccuuuuuguacacuuacacaucuauagccucuugcaaaaagggcauuguagguacuugaugaagaguuuuugaaaguuguuuguuuuuaaaaagagacaacaucuugccauauugcccaggcuggacucaaacuccuggggcuuaagcaguucuccugccucaacuucucacugaaagauauuuuuaauccuuguaccaacccucuaggcaggauguuuccucuuagguuaauggguagggaaacuggcuuagaugaaaaugacuugcucauggucacacuugcuaguauagaguuagugggaaccuacacaccuuggauuacugugcuuuuuuucauugcauaauguugcuuacuuuguaccuucaucuuucauuuacagcuguuaccgaacauacuucuugaucaccuaauuugugcugaggauaaagcacuaaauacaagacaaaaaaaaaaaauccugaucuuccuguaguuuucauuguuguguuagguuuccuuaccaacguuaagacugcugccugcugaaauaguugauuaaggcuuaagauuuuuagucuuaaaauuucuuaagauauuaagaagcugauuucagggcauuuucuaaauuacauauuuuucuuucaguuuuucugaguucauaccuuaauucauaaacauuuuaguuguauuuucuacuucagaaaucaaaagguuugauuccuuuaaggcaaacacaaaguaauucauuguaggugugaugguuucuuuuauauccauaguauuuuaauucuugucauugaguuucacugucaaccagucuguuuuuaacgguaaaaaucuggcaguggcccuuggccaaaguggucucauucugaugaucauauuuaugaacauuaaaauagucuauuuuuauuuccuuguccacuauccaaaauguguguucuucccuugcgcagauaccagucuuucaaaagaugcccuugaaaauuuaagagaguuccaguuuuuucagauagauuucuggaauuuugcaucuuggaaaaauuucugacauuuuaucuauugcagugaggcuuuguuccaacccacagaauugugucuuguuucuuuuauuuuuucccuuguugagaaagugucagauauacuugucuuuuuuauaagacugugguaaacugaagcaauuugaguaacccacaaaauuucccugauuuuuuuuucauguaaaacagcaccuacaaaauugagcuacaaaaguaauccucugucaccaaaagaaagguauuuucuuucaaauccuugacaauuuuauaaauaaauucggguggaagaauucacugcuaucaccaaaaaccuucugauuacucuuccugguccuuccuguuuucuaagugucuuuauauucauuugaguugggaauugaacccagugaaucauguucuuuuuaaaggguauuuugugauugcuccuggugaaucuuucuagcauugaugauuuuuccuuuuguauauugcagcaagaaacuugaauuuauuucuuggaauuauccaaaguguuuauuaauauaaacugaucuugcuccuuuucuacuugcucuaaaaauaaucagcuagaucacauugucugguuuauuuuagaagaaauauuauuuggaugaagccauuacacaaaugcuguagcacacacacaaaaaaaccgcuugucauccugaaugaggacaguugucauuucauauaaaguggaucagcagccuuagguuuaaagugcuuagaacagugccucccaugucuucuaagugcuauguggguguuuucuauuuuuaucaucagaauggcaauucccugagaguagagauuuuguuguuauugaaucggcauucaaaagcaucacaguuaaugcauauugucuugaaauucuguugcuguucuuguuuucucgaagaguuuaaucucuaggcuaagcaucacaaaucuauaccauuuuacuguuguguucaauaauacuggaggucaguuugaagauuagguauaaugugauugcaauguaguauugcuugcagaagagacagaaugauuggaaaaccaaacuccccuugauuacugguuuuuguagaauucuaguucuaaaagaaucuuagugauuuuagucagauccuugaaucuuacaugaggcuaagagaaguuccaugacuccuaaguugaaguaacacauggucugauagugcauauuaaaaaacuuuuuaaguucuggccaggugugguggcucacgccuguaaucccagcacuuugggaggcugaggcgggcggaucacgaggucaagagaucgagaccauccuggccaacauggugaaacccugucucuacuaaaaauacaaaaaauagcuggacguaguggcgcaugccuguagucccagcuacucgggaggcugaggcaugagaaucacuugaaucugggaggcagagguugcagugagcugagaucaugccacugcacuccagccuggcgacagagugagacuuaggcucaaacaaaacaaaacaaaacaacaacagaaaaacaccuuuguaaguucuaaaaagguuuauaugguagcccuucugaauggagccugggccugguggaacuuacaguucucuuccuguccuaaaaggcugaguugugacccuuuccggguuugaggcaugcuuuucaguacuccccucuggucaguuuucacugauccuuggcagcugguaacgguaugcugugaggaaaccugggguagacaggcuccagacaugcaguuagcaagcacugccuauggacuggcuagugcuguugggugcccaaguguaaaaaggaguauugugagguuuuccuguucaagcaacgggagagacaagccuagcuccuuucugcuauaggaccuuuuuccccacacaugcugauccuuuugcugagacugcuaucuccguuuuggcuucaugccccaccuccauggacauccauugcaucuuaacucaaugucccuucccuccugagccccagaccagaucacauucccucuauuuuauguucucuacuuuuccuucauagcauuuuagcucuuuguaaugaccucuuucuguacaucuuaguuugauuccauucuucccauugacuguaagcuccacguaggcagggaccguauugcccuuguccuuugaauuagcuuaguuucugcagagcuguuugaaaauacuuguugaaagagugaaucucuucaacaaguauagcaucugaaguccugcuuaugagcagaagcaaggcauuagcauguagcuaguuucuaagugcuguucugaggcagggcaggguguuuauucacauaauuaaaacaauugauuauauuaauuuuuaaaaaacuuuugugcagugauuuuaaucuuguuaaaauuggccauaccaaaauagccaaaucaaagucaucacaaucaaauucauacuugucuccccugccgggcuuuccaucauuacuuuuacuuaagucuuacccacugcagaaagccuucccaagccagcccuugccagugucagucaccagagcuaacaacauccugacgcacucacacuauugauuuuagguugcuuuuguguuuccauuugugcugucuccaaccuucuauuguaaggcccuguggggaugcuggccucguggccucagagguaacccaucucccucucccccuucgcugcugcccuguaaugccugggacuaugcucuuccuaaaacuggauucugauaaaauguguugaguggccagacagaaaacugaggugauaaucacuguuaauuugagaaccaauuuugaaucaccaagguugguagcuuauuauuugcaaaaauaauuggauucuacuguuaaagaauuugugagaagcaacaaggaaagcuguuaaaauaauacaaagcucuguguguguguguguguguguguguguguguguguguguguagacaagguuggggcgggguaauucuagaaggaaugagaaauuaaagugcgcguuuuugggugucuuaaacuauuguucacacaaucaggagaggggcuguugauggaaaaagcacacaaucuucauuuacauuggacaggacacuccauaucgggaagcaaaaaucccuggcuuccuuucuugaugcggugaaguuaguauccucuuugauguuugcacccuaagaugucucucuguccucucgauguccuaggccauuuuuuuguuuuguuuuguuuuuuuccuucuuccucucaaaugcuuuuucuugccugcuuaugguuugggcugcuuccuuaaugaaaaugcccucuuauuuucagaugcaauuaccucugccacugauuuauuuauuuauuuuugucuuuagcgcuucucugaaguagcuuuggaaaguagagaagaaaauccaguuugcuucuuggagaacacuggacagcugaauaaaugcagguauguagauuugcauauuuuuaaaaaaggaaaauaucuggcuuuaaaaaaauugaugaaaccguguucuugaggcuguagggcuauuggugcuauugccuuuaauuuuuugaaauugauguauuuauucauucccaauguugaguaugcugguuaaaaaaaaccucaaauacaaaaguauaggagguacagaguaaaaguuaaacuucccuuguaaucucuccuagauguucaccacuauuaagaauuuauuguacguucuucuagauuuuaauaugcaugugcauaaucauauuauacauguugugcauaugcaugaucauacuauccauauuaugcuuuuuucauuuugcagaauguccugugcaucuuucuguguugauucauaugcagcuuuauguuauccuuuuugacagccacauaguaguccugccuguuuuguuuagugaguccucuccuacuggacauugucaguuggauuuuuuucuuauuucuuuuuuuuuuuugagucggacucuugcucugucaccaggcuggagugcaguggugugaucucggcucgcggcaaccuccgcuuucccagguucaagcaauucuccugucucagccucccgaguaggugggauuacaggcgcaugccaccacgcccagcuaauuuuucuauuuuuaguggagacagggguuucaccauguuggucaggcuggucucaaucucgugaccucgugauccgcccgccuuggccucccaaagugcugggauuacaggcaugagccaccacacccagccgauuuuuucauauuucaaacaaugugacauccuguaaauauauaauuacaugcauuugccuguuuauuuccuuagaguuagagggugcaacacugucuuuggauucuuccccugucacgucuauaaagacucucaaggacaaagguuuaucuuacauuaugaagcaggcuuuuagcuacucuguuuuccaucacaguuuuucaaugugggaugggguuagggguucagugcuggguuuucaaguggucuugcuuguugaucugaauuucaagguuaauuaugaacuaacuguuucaggcugguuuccagaagauucuggucuucagauuuauuuggaaauuaaacaguuaaaauugaauaccucucaguuuguagcauugaggcauaucugguuaaugucccucuuuucagaaucucuccucaccaggggagcuaauagaccaagcaaaugaauuuggugaagagaacugugacugcugucugcccuguaugacuuuucuuguuugggggagccuccuugggucauucugcaagcacccauuauguguaagccucugugcuucuuacggauauagagaaaaaugacucaguucuuaucucaaggaacucacagcaugugcauaagaugcuuaaauuuccuguggcuagugcagugggauaaguuuaggagcaagaagcgagggccuuagggaaugggauggagguucagagauggcuuccugcaggaggcgauaucugagcugaauucuaaagaaaguugaaguuugccaugcaagggauaagguagaaagauauuccuauagaggaaucagugugagugaaggcaggagggugagaaguagcauuggguaggggaggauacaguaacacugacagccuuguggguuucaagcaugaagcaagaagcucagagugauagaagauaaggugaggaaggcuggccggccagaugauggagcagggcucuguuucagagucucagaauugcucuguagauuaaugggaagcccuuggaggaucugguauguguuauggagaaauuacuuuagggguuuaagugaagguuggcuuggcagacaggaagaaaguaguaggaguguggggucagcgaauuaguuuguagcccauugguauugggcaagaagaagaaagaauguguagggcuuucccucauuucuuuccuccuuucuggccuugcccaaggcuaaguugcugagguugguucuuuggcccuaggugcucucccuuuggagggugcuuaugugaauuacuuacuuacgcacuuuucaccaggguuuucuaacuguuccaaaguaaggccuccuccugcccuccuggugcugcgucaaaguccugccgcuccuccuggggugguaggaaccaggcuccauucauuaauuguuauggcccuuccaugugacuuaugaacaugaauuggucaucauuuugugugcagugucucagguggggaugugaagagagauaagauacgguucaugcccucaccaugcuugcuuuuuagugggagauggacaugaaauuaaaaugcugauucuugccauaagucuguucaaagcuuaugugauuccaguagaaacagcagcagaauuuguaacuaauaaucaguccuuuaacauuguugguuccagaaugggcuacauuuuucaauuacaacuugggugcaaauggagaaaauaaauucaggccaugucuaaaauuauucugauuuuugaaaauauggucugaccauauuuucaaaaauacauaauuaauaaauuacaauucauuaauuaguaugcauaauuauuuuccaugguuucaucucuuaugagaucugacauguuugguuuccaggaagggaaggggcaggggagagguacguauccaauaccaacaccaaauguuucugcuuuuuuaccuucagaacacucccuuuugccauaagaacuuuuagcacauagagugaccacauagucuuguuuuccuuccacaacaguaucuaaauauaaaagaggacugcaaugccauggcuuucugugcuaaaaugaggagcuccaagaagacugaggugaaccuggaggccccugagccagggguggaagugaucuucuaucugucggacagggagccccuccggcugggcaguggagaguacacagcagaggaacugugcaucagggcugcacaggcaugccgugaguacuggcagcugcccagggcuggggguuucaccaacacacuaguucagaagaucugggggucucugccccuuguagcgcugcugggcagaaagaguuguggacucuggagucagguuccucccugccucugccacugccacuugcacgugaccuuaggccagugauucuaauucugaggguuucgcuuuucacuuucuucaucugcagaguggcuucuuucugcuccgucacuaaugaacuauaagauaccaggggaugacgcuugacuucuguggauccaggcucaguucucauuuccccacaucuguacaauuggaauaauaucagcacuagaugaggugcuacguaaaacaccugggacuaagucccugcucagcaaguagcguaucucaauaucuuaauaauuauucgaaacuucuccuaaaaaguuugaccccuccuucugcugccgugacugcccucccaugcauggugcugaguugaagugagaagcugaguguugcuuuguggcuuagucaaguucccaaguugugaaaaggacgaggcucucaacaacacaagcuuuuuuuucuccuuucaagugagaguugucuuaaaguuagccuguugcccucagaaggugggaaaccaaagucccuuucauccuuugaacuugaggacauuggcaguuuuugcuugccugauuuuaaaugacaaguuaaaucauagaaauuaaguuaaaucacagaucuaauccacuuggauugugaugaugguuguacaacugaguaaauacacuagaaucuguugaauuguacacuuaaaaauuggugaauuuuauaauauguaaauuauaucucaaagcuguuuuaaaaagguucuaucaacucguuuuaugaugaugaaguagccauuuaugaugccguacagccugaucccuacuuuacuuaucccaccuuuaacccucagaacaacucugaggggauagguugguuauuuuaagaauugcuuaucuuguuaguaguacagcuuguuuagaaaaccuaccuucuuucugauauuugucuuucugccuaaaaucuucacacaccagaguuucaggaaaaggggagaggcuuaugguauggggaagagcguaguaggcucuuacugacuaaaccugacacagaauaaaaugggcugagguguauagauuauuagugggaaaaauccaguaauauugucaaguuauuuugacuaggccgcaauguguacaaauaaccaucuuuagacagcagcuuuaaguguguuuguaauuaucagaacaccuagauguaaaucagugguucuaaaguuuuuuuuaaggcuuuguuuuuuuguuuucucccuuuccccuugagauuugguuuauauuguuuauucucuucgccaagcuucuugccaucagcacagcagguauaaaccucacucaguuuguaagcaaaggucauuguugcagagucauugggcugcuguuaaugagggaccaaggagcugcugggaaagagaugagaggagagagccugugagucugaggauggacacagucgcuggaccuccuauaacucugggcuuagggucagccaguuuggggugucgguuucuagccuaccuuauagaaaaugaguggugucucuucuguaacuggcucaacagaauauugcagaaacucaucaauuucagaaauacauacugaaugccacagguucuuguagcucucacuguuacuacagaaagugauguuugagggcaguauuguuuucuuuccuguuuuucaccucugugggguaaaguuuuguuuaguucucauugauucacccccucaguagcugugucuugguuugauucucagcucugcauuuuacuagaugaguaaccuugaaucauacuaaaucucaggagaccacagauucuuugucugcaagauggucaaaauaguauuuaccucauuagauauuaggaggauuaaaggguaauacuuuuuuuuaaauuuaaaauuuuaauauuuuuuagagauggggucuugcucuguccccuagacuggagugcagugguuccaucauagcucacuauaacugugaccuccugggcucaaaagguccuccagucuuagccucccaaguaacuaugacuacaggcaugugccaccaugccuggcucauuuuuauuauuuauggaggucuugauauguugcccaggcuggugucgaacucuugaccucaagugauccuccugcuuuagccuccugaaguuuugggauuacaggugugagccaccaaacucagccaaaaaauuauuuauuuauuuauuuauuuguuuguuuguuuguuugagacagagucuuucucugucaccuaggagugcaguggcaugaucuuggcucacuacuaccuccaccucccagguucaagcgauucuccugccuuagccucccgaauagcugggauuacaggugcacaccaccacgccuggcugugggguuucaccauguuggccaggcuggucuugaacuccugacuucaagcgaucugccugccugggccucccacagugcugagaauauuauaggccugagccacuuugcccggccaagauaauaaauuuagagucuguuugccugaugccugacacuuagcccucaguaaauguuaguauuauuguuuuacuacucaguacuuuuauauaaagagauaugucuuugaucuuucuguuuauggguaguaauacuguuagaaucagaccuguguuagaauuacagacaguuccaugguuaaaauaaguuacacuucagauauguaaguguuggugcacauucaaauguggauaugcauaaagaaaggcuggguuuccagcccaguccacaaaagccacuuuaugaaugaaaaucuauagcauauuugaauuauuuguccuaauaauacugaauccaaaagccauuugccuauguucccaaggaaaacuucccuuuacaguuuaacuccauauucucgguuuauaagaaagacuauaacuucugaaggguaacuguucauauugcuugagaagcauggauugagguguucaggagagcacuagauagcugccaagguaucuguagcuucuuaacucagugucugcguuggagagaguccccgccugggugugcugggccagggagggggcccugucagugucagucucacugcagauguccgauuugggaaacaagugccuauuaccucauauucucccagguuuuuugucauuuaaguuuaccucaucuuaguuugaggccuggcugcuuaugaaaauaucaguaauagcugauuauuggcagucauucuccccccaaccugccuauguuucagguucauaaaauuuuaaucaugggcguagaagugagugacuucauaaucucccuggucuuucccaucauucucuuauugacggaggcaacugguggaguggagaggcaggggagcacuguugggccagcuuugugaagccauauaucuucuugcuaguugguuacuaaauaaaaaauauuugugauaaucauacagaguacuuaagaaguauauuuauuauuaaugguaauagauuuuaaucacugacaaaaaucacuuugguuauuauuuauucuaauaugcauuuugcauacuacugccaggaauuuguuugcaugucugauguauaaucacgagcguguuagaauuguuuaagugcuuucuguaggaaacagauggaagauuuccccaacucccagaguguuuccgauuagcaaagugcacaucaggcaggaucugugaaccucucagauagggguuuuuuugaagcuggauuugauaaggcucugugacggauaccuguaaugagaaauaucaucagaguuuuauuuuuaaaugaucuaaauuugguuugccaggagcuacagugcauauuucuggggagucauaguucuugaugauuaugaucaaaacagccugaccgaaccuggucggaagucuguuugcccuaagaggauaugagugacccagauucuuuguggaugagagaguuccuuaucuuugcauauauuggguuuagaaacagauggccaaauguauccgccuugauuuucugauguguuuuuuuacuuuuccucagguaucucuccucuuugucacaaccucuuugcccuguaugacgagaacaccaagcucugguaugcuccaaaucgcaccaucaccguugaugacaagaugucccuccggcuccacuaccggaugagguaugggaaguacugaccugguaccugccuggcucccucugcacugagggacaguggucagccuggagcccugagucacuuaccaagaaguauuguagucauuuuuguaauuuguaacuuuuguauuugcuugaugugagaaaggacuucuucaguauuuggaauacaauucaagaugaguuugaucaccuuccucugccacauuuuagaaaagaaaucuugauaaggcagaggauauuuugaauagaauuaguguccuacagcagaguuuuucaaauggguaaucauaguuaugaauuuaauuuaguggauucacaguuaugaauucaauuuaauuuagugaauuuaagaaaaagaaacaggagacgauacuaucagcauauauacauaaccuaaguauauuuuuuaaacuuuugagauauauauauauauauauauauauauauauauauauauauauauacacacuauauauauaaaggucaugauauaaaauauuuuucuuacuaaaaguugcaacuaaaaagcucgagaaacauugccugaaguguuaacuagaaauucuagguuggccuugcucucugggaguggauguuuugacuacuccuugaggauuuuuggcuguggagcuguaauuuuucuucugaugggcaccugccuuuucucccauauugcagacuuugagaaaugucacaggugacacagacagucaguacuucaauagcugcagucuccugaguuuguaaacauauuuguucaguaacuagaauggaaaauauguuaguuacauacuugcuaagcagaaguuaauguguguuuagcaguggagauuauaaauaggguggauccuuuuugaaaagcagguuaacuuacagagguauuaaaacaguagauaagcucagaugcuaauagaaugcagggauuugcuagaaaagcccucugaaaucucggagacuucacaguaucauagcuacuauuuuugggagaauuugguggaguugucaccauuacacaaugacugggauguuuuucucaguggacacugaaccagaucuaacuuucuuugauaaucauccuagggcugacuuuuuccucuucuuucuaugcuuaaccaaagucucaccuggagaggaaagcugugugccguggagauuucaggucccagcugagccuucuggcuauuggcuuuguuuuuccacauguaaucuugcuuuuuguggccuggggauuggcugugugaucagcauugaaauggguuguugcaguuugaagucuggaagggguaugucccuggguucuaauucuuucccucuagguuucuguacucagcucagagucuagaaugguagcuuuuaggauuggaaaagaccaaaguuaccuaauucaacucuuucauuuuuuuuucaguggaaaaacuaauacccagaaaagggaagagaguuaacccaaaaauuacaucuagugaauugucugauuagcuuuacaauugaggcauuguagagcucuuugaggcauuagucuugguugucugagugccuggcuauuaaaggcugucuuugccuguucccucuuucuguuagcugccuggaagugcaggguugcuucacuuuuagcaccuugacucuguaccugacauggugcuucaacaggauauugcuuuguuaccacaggcccuuugaacuuggaaaaaaaaaauaccacccuaagcuaaaacauuugccugaugacaaacuacaaagauuuugaaaccucauaaucucaccacuaaaggaggcguaaaugaaaauaaauguuggugaugauuucaguggaguaccaguuuuacuuugggaaauauucuuguauuucaauuaucguuuucuguuuuuagauaaugcuuuugauaguuguuggguaaucauaguuauccucagguaucucuccucuuugucacaaccucuuugccccguaugaugagaacaccaagcucuuauauauauaucuuagcauaagacaaccauauucuguauuccuuuucaaaaaauauuuucuugcuuuuuuaaacaauugaauuucacaguccauuaaaacauuuuauagaagccuaaagagaguuuguuguguauaauaucugcauauaaacuuaaaauaugcaguuaucuguacauaauuuucucaaaaacuugcagugcguagcucugauugaugucuauuugucuuuuuuuucuuucuccuuucuuccugcuuuguuccuccacgucauuuugaaaaggaauauaggcagguaucauucuacauuuauugaugucauuuuuaauuuuuuuuccauuggcaugcuauaguaucuggaauuuuuguguaccagguuugaugagcaccuuuauaauuaauuuuaaaaagguguguggaaugucugucuucagugugucuucaagcuuggucuuaugggugauagggaggguacugauucugguagucauggauuuaaaauuuuguuaauauuuuugacaucuuauuaaggagaaagcugccggccuuauuuuaggcucccucaucuucuguuuaccuuuagccuuuguuccaguggagaagcuacacauuauguuuggucuccucagccugaugcugucugaguaucugaccuaaaggcuuccaagacaaagauggucccacagggcucucagcagccuggaagaauaucguuguucagaccagauugaagauuguguucugcccagagggaguuuguugggcccucaucucuaccagauccaaggacuguuucucacagagacucaguaggauguggaagaagaaggccguggcuccguuggcucagggaacaucugccuuuuccccuccugccaccuccccuggcaguggagggugaccugucucucuccuuggcaccucaucagagauucuucucucuuggacaacacccuccauccucggaacccuuuucuuuccuuaucucgggaaaccuuccauauuguaccuacuucucauucucuuauuacugccuuccuccgccaucaaacagcauuuaccccuccuguuggccauucugucagaaccccucuuugaaccucuguagcugguucacuccuuccuuccugcuugucccagggagaggaucguggcuaaguucuccugggcacguguucuguucuacccuugaagagcagugccaggccuggguacagcaugaguggcagccucccugccagcugauagcccuagcuuuccacugucaccagcggaggguaagggaacaguccagcagcuucagaggccugacguggcucaugcugcccguggcucugcagaugugugauucuuucugugugugagagagacaccaaagcccacagucaaauucucagucacuuucguaaauuacaaggaagaugggcuguauagaaucauugaagauuauaaaaauguugguuuuuaccuuuaaaguaacuucuuuguuuauccuuuccauguuaauugcuacucccugaguuuauucaucuuuuguuuaucuaucaagcauguguucaguagcuguuagguaccaggcacugggauucaguggugagcaggacagcugcagccuuugcuuccgugcacagcucacggcauugcucgaaugaugccacaggcaucugcuucucucugccgcuuccguuucuaucuuccauggggcuucccucccaggagagcgugccucauaugugccuggcuuucguucuuugcucugccugcuuugcaugguccaggcucuguagccuggcauuuaauuauucuguuccagcuucccuuccuuggugcuuuuuccccuccugccaccuccccuggcaauggagggcgaccugucuccucggcaccucgccagagacugucauauguccaaggacaacuuauccuuuaagcacagugccuagagcacacacuuguuaggggcccauaaaaugucuaauuucacuuaaaaucagaaaacauaguugagaaauauaacuuguaauauuuuuuauggaggaagggaaaaguguuuagggccuauggaagucacaguguaguccugcuugugauacgugccccauuguguguugcuggauaguugcugcuggaccugaccgguugcucccagagacaggaacucacagaguacgagaaacaugccugagagcccuccacaucucaggcccuaacucagggccuggcuugucuuaggcucugcaaacauagcacagugacaguuguugaaguguagcagcagcuuuuugcagggaaagagggaguuguauuuauugcuucuccaugacaugguucuuuucucauuaguucaugggcaagucaagggaaagagaccuagguagcagcugagucuguagccuacagauggccugggcuggcuuggcucagucacuucccuuagucacuuccacacauuccagaaauuguguuuuucuuacaggugacagaggaaguuauauauggaagguaggguuaggggcaccaacccccugugcaauugacaauccaugcauaacuuugacccuccaaaacauagcuaauaauaauagcccacuguugacuggaagccuuaccaauaacauaaacagacuaguaaccuguauauaucuuauguauucaugauguaccuuuuucugaaauuaaaaaaaaaaaauuucugugcuacacaguucgucaguuuuuucaaacuguugcaaaucuccaaaaaaauuuucaauauacuuauugaaaaaaaaaucuguguaugaauggacuucugugguucaaacccaugcuguucaaggggcaacuguaguaguuaagagaacaggcuuuuguaguuuuaggucaccuagccucuuggaaucucaguuuuccucaucuguaaaaugaaugaaaccuuccuuguagaguugcugugaagauuaaauaacauaauauauauaaagugcuuguuaacucguuucaugaugccuguagugguguuuggguagcucucuuuuaaaauccuauucaucauguaagauacaccaucaguugaauagcagcaaucugggaaguaggaaacacugccacguaagcuguauaucuugauugcgugaugaaacuaaguugcaggaauguuaaaaugucaaucaaauuggucuuggauucgagguagaaugggcuuagcaguguggcugaugguaagcgugcagggagcuguggucagcauggaguuccagucagcagguguuucccuauucuggaagcauagugagaagucagaggagcugucuuugugaucuucgggaagucacuuuagcucccugagucauagaggaggugcugaugggacacuucucacgcagcgcuaguaagaaggaaagagauggugaggggcuacaaggggcaggguugucugccugcuucucagggcacuucagccuccggcacugaccacuguuggugagccaggacgcccugcccacaucuggguccccuuugccacaauuggcauucauuuuccugccuuccagguucuauuucaccaauuggcauggaaccaacgacaaugagcagucaguguggcgucauucuccaaagaagcagaaaaauggcuacgagaaaaaaaagauuccagaugcaaccccucuccuugaugccagcucacuggaguaucuguuugcucagguaggaaguuugggcccaggagaagcuggaguuugugggaugggagaggcauuguagagcucagacccccugcugcagcugaacuugguggugcuagagugcuuuaaggccuguucuggguaaguucuugccacaccuggacuugccccaagugaggagaaaaaaggcagcauuucagcuuuccaagaggcugguuauccagcuugugggcuuuggggcuuccuuucuuuccuauuccuuuccuuuuccccaccuccuaccauuuuauuuuucauccguauuaauagccuuaugugcagaggucagagggaagcucugcuuguuagaagauguaauucaacagggcugaagaaggcacuucucagcagccguaguaaugucuggggaggaaggagauggccacucugucacuggugguaggauagaaagauuagacgcuagaaaaaaaacaaaagagaagguagaaucaccugaaauuacauuuacucugagauugcuaagauuuuuaguaguaugcuuccugauuuuaacaugcaaauuuagauacuguauagauuuugaaaauauuuuaugguucauuuuguuuuguaaacugcuuuuuuauucaucugauuuuuuuuauuguuuguccuucaaaugucaauuaaaauauugaucuucguuguuuuaaugacuuuguaacaauucauuuauucaacaaauauugacuggaugucugcguacuauuugccucaggcacuuguaccugcuaagaugcuggagaugcuggagugaacaagacagacauggccucugcaugcaucagauguacaucaaguuagaaaacaagcaaauaaaaugauacauagauaauacguaagaaauuauggaaaguacugugaaagcagaagcuugcaauagagaauauggacagggggguuugaaugggaagaccuaauuuaaaucauaugaucagagaaggucucucuaaggagguaacauuuauaaugaauccugaagaauaaaaaggaaucugcaauucuaagagaggggugggggacuauuucuuccauguagagugucucagcagcagcacuacugaccuuuuggcccagaugauucuuugcugugauggccugcccuaugcauuguaggguauuuaccagcaucccugccuccacccaguagaugccaguagcacucucuccuuagcagugaugaccaaaaaugucuucaauauugccgacucuccucucagccucaguugaaaagaucugauguagagggaacagaaugggggaaggcccugagggccaguagagcugcaaggagagaccauguggcugcagaccagaggagggugauggggaacgaggcuggagaggcaggugggggcagauugcauacacagagccuuguaggagcuggcaagggguuaugcuuuaacccugaguguggugggaagccauuuggaaggcuucauuuuauguauguuucaagucgaugauucuuguuacacguggaaagcagauugugcuggguccaagaguacacucgaaacauacaagcugagagucugcagcaaugauccugggagagaaaaugcugguuuggccuaguguagcaacaguggcaguggagcaaaaugaguagaucugcuguucaucuugaagauagaauugauaggauuugcuguugaguuggauguggaagcugagagaauuugaggaaucaaagaugaugacuggguuucuguuuugggugaugucggauggauaauggagucauuccccacacagggaaggucuugggggaagaggguggggaaggggcagaaaucaggaguccuuuuucggagaugccugugaaacauacaaguggagauuucaaguaggaaauugaguaaugaggcuggaguccagaggaaaagccgucauuuauuuaacuuagucacccguuccuggacauuuucuguuuuucucguuuucccuuuuaugcuauuacuuuauagucuguugugaacaacugcauacguaggugguccuguacacguucuguuuauuauuaccuuagaguauaccauuaugugugagaucacacacguaucaguauaucugugucagaguuaugucccacuguagggcuuuaguuacuaauuguccauuaucuccauuccaucuaugccuuagaacugccauagagacaacagagaaaggggacagugcacagccccaggcagauacuguguggaaaaaaagaaaaugaacuggccauuuuuagauggucuuuuuggauucagcuucccaguuuuguguauccauagcugagauuuauucuuuaccuuucccgggagcagagguguaaaggaagagugugccauacuugaagaauaagcauggcguuagauugaccuuuuggaggcucaggaauaagugacuugagguagcuguacagugaauguuuacaaaaaaaccacaggccaacaggacaguuucagguuuuccuuugcucuucacacauuacuggcauagaucauuguuccucagaaguuuuuggaaugucagugaccuuuccucaccugagagaaacaagauaucccauggugaaaagaagagaaacgggagcagugggagcccuccauccaaaaaccauuaaucugaaguucuucagggaaagagagcaucucacauaugcaggaacacuucucccaggcuuugugccugcccugcuccaagcuggagaaaggcuuaagaguucacacuuuaguguucuauguacuuuaagucauuugaugaaaaccgaauguggcuguagcacggcauugaacagugguccuggccaggucuagauuuaaucccagccuaccacuugcuaagcccugggcccccaggguacucaauucuucuacuugacuugggguuuuauaacugccugacguuagauacuccuagucauuuauucuuuucuuucuccuuagaguggaaucuccaggagaucaggaacgugguuuaguuuauugcuguuucccuagcaccuagaauaacaucuagcccauaauuaguucucaauaauuaccaaaugaaggagugacugaauaggggcuguuuacuguuuugugccuuagauuccucaucuguuggagaugacgauguuaacauccacguuguaagguguuaugaggacuaaauaaaggagccaagcacuguguggcagcacugaggcaggguuuaaucagugggagccggcacuggaauuaucguuuucacucuguacaaagcugggcugggcacugcugguuagccuuguuuuaguuuuuguguuuaaaguucccguuaguucuuagaaugcugugcaccuccaucaguggggggguauauuuuggugacacauuucacuaugggaaacucgaacgguagaugugggaaaauguacauguggugaugaugcacugcggaacguuccccuuucccuagagcuacaccagaauggagggagagccccaucaacucuguacacccagcuccuagacaaggccaucuaagcauguuuguggaauucaugcaugaucagaccucagcccagugucaccuucccuugcucuggcgcaguccaggccuaguacacaguguuugucagcgucacuucuauggcgaagggacuucguaugucuguacuguuccccagugccuggcauagugcucagucaauguuuuguuaaaugaaugagcgggggagaacaucuccugagccccuucacacccaacucuguuuaaaagagcucugaugcuagagaaacugccaaucugauucgucucguugcugugcugcguuucuaggcggccccucccuguguaguagccuucuugucaagaucaaaaacgggugggcucucaugguuucucccccuugcuccuagggacaguaugauuuggugaaaugccuggcuccuauucgagaccccaagaccgagcaggauggacaugauauugagaacgagugucuagggauggcuguccuggccaucucacacuaugccaugaugaagaagaugcaguugccagaacugcccaaggacaucagguaaagcuucccacuggcugaagaauugauugugaggauggugguguuucuacauguucuuacacauuucagcuuaauuacugccaggguuuggcugaccuuugcucucuaugaaacccagaucuuccuuagaauguuuacuacauacacguagccuaauuauaauugugucuugauuuuggauguuggcugcuaaucucagaaauuugugcuugggugaaauuucugagcugaggaugccaauaaaauuaguggcccccaggccuucuccguccccuccuugcccaugguggacacugucgucuaucacugcauuuuuuccuuuuguuuuggacccaucuuaaaaauccuucucaguacaguucuguaagcagcuacuaccaucccaagccugaacucugaacacguuacaguaguucacuacagagcuguuaauucuaaugugagaauugaucaacuacuauuaaauaucucaagaaaauugcauuuacuuaaaaauaucguuugagaucaagucucugugaaggaauauuuaaguucuguccaucuaugacauccaauaguuuuuuuucaccagugggcuauuaggauggucauaaaugaagacagucucauuuugaagaagggauuucguagcugcauuguuugugauaggcggcgugcgucuucucauuagguugcugcuuguuucuccuugcgcuugaccagagucuagagcagaucacagcuugcuccucagugaugcagggauugagucgauacugcucaacugcugcuuucucuuuuuucuguggccuucacuuuggguacuuccucuuuauuuuuucauaagcuaaauugaaaaaugacaguucuucucuaauucuguuauauuacauuaaucuaaaagaaaaauaacauuuguugaggaugaaucccaaacuucacaauuuucuacuguucugaagccacuccaugcggcagggaugacccggggccaggugcugucucaguccugggaguaacaagcagaucagucuccgcauuuggcccccaguggacuuguucuuuguuucagggguacucaacguucuucuuaacauugacucccguucuagcaguauaucagcuuguuuagauucuguuuguuguagauacucgcccacuagcaccuggauagguaacuaaucuuucagcuuaccuguugaucuuuuaaauaauauaucugauucauauucacauggcaaacacuaagucuuuuguauuaauuagcuuuaguaugucuuucucucucucucucucacucucucucucucucucuuuuuugugggggugcuuggggggacggaguuuugcuguuguugcccaggcugaaguacaauggcaugaucuuggcucaccgcaacuuuggccucccagguucaagcgauucuccugccucagccuccugaguagcugggauuacaggcaugugccaccauaccuggcuacuuuuauauuuuuaguacagaugggguuucuccauguuggucaagcuggucucucacucccgaccucagaugauccgcccgccucggccucccaaagugcugggauuacaggcgugagccaccgcccccagccuuucuuucucauuuuuaaaauaaaaaaugugaucuguuuagaaaaguuauaaaucagacaugcaaauagaacauacaaagcauuucucaucacacaaaaugacaauugcuccuaacaccuugcagaccauuuucuaacugaugcucaauccuaguaacaguguguagaugugaguacuaaugugcacaagaauggugaagcuagcaagcaaaaauguagaugcccugccuuggugacccagaaaauugggcaauacuuguagcaauucccauuucagugaaaucuguggagcaugugcuuugcuuuucuuucccaguuucuauucaccugcaucuccuuaugauggucaucuucagugcuaacuccaucuaacguccucugggaauagaucucccuuucccauuuggcaacauguggauucauggacuuagauuuguuucuaaacuauuuucuccuaaccuguacaugaaaaggagauguacuuuucuacugucuuuuagcuacaagcgauauauuccagaaacauugaauaaguccaucagacagaggaaccuucucaccaggaugcggauaaauaauguuuucaaggauuuccuaaaggaauuuaacaacaagaccauuugugacagcagcguguccacgcaugaccugaaggugaaauacuuggcuaccuuggaaacuuugacaaaacauuacggugcugaaauauuugagacuuccauguuacugauuucaucagaaaaugagaugaauugguuucauucgaaugacgguggaaacguucucuacuacgaagugauggugacugggaaucuuggaauccaguggaggcauaaaccaaauguaaguggcuguuggcagucgaucaaagagaacauucccgugucacauagcguaugcuguuuauccuucuggagucaucugucugcauguccaucacucccauaggcugaguuuauuuaggagaccauguaucauucauauuuuauuucaucccuguagcacaaggucuaaauaaguauuuauugaguuauguagagaaauauaacaacauguauaauacguaguaguauaauaauaauagcagauaguuccugaguguuuaccaugugccaaguacuuuucuaaguauuuuauaaguauuaacucauuuauuucuaaaaauaaaaaaaccuuugagggaaguauugcuauuaucuccauuuuacggaugaauacaaagaggcacagagaaguuaagaaauuugcccaaggucauaacuaauaagcauuugugccaagaauugaacuuaggccucuggcuccgugaaauugacuaauugauuuugcuuuaugggagcuucuuuaugagauauuuauuggaugaagaaauagagcagaguggcuuaagagcauggguuuuagacccacgucgacgggguucagauccuagcuucaugacuuauauggccuuaggagaguuauuucaccuuuaucagcagcuaaaaauuacuccucuguuaaauggagguaccuacugucuaacucauaagguugugaagaaacuaaacggcauuuagcacaaagccuggcaauacaauaaauguugaauaaauuauuauagccguuacaauuauuauuacuguaauuaauaauauuaaaguaaaugugggugggugcaguggcucacaccuguaaccccagcacuuugggaggcugaggcaggcagaucacuugagccgaggaguuugagccuagccugggcaacauggugaaacccuaucuuuacaaaauauaccaaaauuagcaggaugugguggcacgugccugugguccuagcuacuugggaggcugaguugggaggaucgccugagccugggaggucaaggcuacagugagccaugaccuugccacugugcuccagccugggugacagcaagacacugucucaaaaaauuaaauaaaugaauaaaauaugagacucauuuucuccuccuguuuuauucucaugcuaaaacaauaaugcuugauacuuacugaggguuuucuguauaauagguauuauacuauguuaguuagcacuugucuaaucucagagaacccugugaagauguaagcuauuucaugaauaaggaaaaugaggcucaaagagaugauguaacuaguuaaguaauuggcagaggcaggaacuuaaccuagaucucuggucuccagggcucaugcgacacaaaauauuuucacuugugcagauauauauuauucaguguguagauuauuucaagcaugaaauucgugucuucucuggaaaaucccgacuugaguacuguuacaaagucaagacgauuggugauaggagaaagcucauguucagcucagugguaacugggaagaguauguuaucuguuugugucagagcauguguaguagucuggaagugaggagaccugaauguagaugcaugucuagugagcagugauuucccuuucugaguuuccgugcacauugcguauuauauaguuuagacagugugcucauuaaggucucuuccagauaugaaagcccaggauucccugauacaacccaguucuuugguccuaacccugcaggugccaacucccccaauccugcaaguccagaagagcuggcuuucucuuccuuggaccuaggcccugcauagguuucccagcagcacugaccuuuuaccaauagaaaaugaagaaagcaacuuaacccugucccuuuuauguaucuuaucagguuguuucuguugaaaaggaaaaaaauaaacugaagcggaaaaaacuggaaaauaaacacaagaaggaugaggagaaaaacaagauccgggaagaguggaacaauuuuucuuacuucccugaaaucacucacauuguaauaaaggagucuguggucagcauuaacaagcaggacaacaagaaaaugguaaguuugucccagaagcucuuaagucuggaucuggugaugagagggagaauugcugaguuccguucugcagcacaugauuuucagaguuccuguccuaaagagaaaacaggauuuucuuauugaagccaaaaaguuccuauuaccaaggcauucucaguguuuuaaaguuacaccgauacauuccagugccuuucuuuggucucagaaaugugaaucugccuuaggauuugcuucccucccaaauacaccucagcaucaauauuuaauucacaaagcuaguggauuugaaggaaaagaaaaccagcgaaugucaguguuuccucccaaggguucuggcacggccucucugcugagcugaagugcaaagcaggaagccccacguugcccucaggcgagccucggccacaguggcagucaucgauauggugucaggcacaccccagugacucucggacagaggaaaggguguuuaaucucacuuccucuuuuuugguaucacuugaggacauaaucuaaacaagcaggaagugggaacucugccaaaauaaaccuguuugugucaggggaagucacagccaacaacaugcagagagagcggcuggugagacagcuagcacucuuaaggugaguggagccaacaccaggaaaggccacauucugccaaaauguggcagauacugugucacaaugauaacgcucagugcugaggaagagccuggugauacgguuuagggcagacagucacucucuuguauucagaauaacuugucuuucugauauaaccuuuuggaaaacaguuugguaaccuguuaaaagccuugaaaauauuuauauaucccucuguucaggaaucuagagaaugaaucuaucuuccagaaacaaugugagaggcagguuaugguuuaugaauaagaauauucauuccaguaguaauuaaagugucaaaauucugaaaauaacuuaaauauacaauaauaggagaauaggaaaauaaaucacaauuugccugagaagcagaauauuagaaaaucagguugcugaauuuuuuaaugaccuggaaaaaaggucaggggaaaaagcaggauauaaaacuuuaccuauagaaugggaccaguuuuguucaaaauaucaauagguaugcauguauauacacaugcucuuagaaaaauaaauauuaacagcuacuuauuuaugguggcauuaugagugguuuuaauuuucuuauucuccccuccuuuuuuuuuaaacaaaaaacuuacauuaauuuuauuagaaaaauauaguaaaaacaaagugaagagggagaaguagaagagcucagauggauguuaauggaaagaugcgaaauggagggagaaaagaagaagugcuguugauggagcacauccuggauaucaggccccguguuauaugcugcauccuggauauuaggccccgugucauaugcugcauccuggauauuaggccccgugucauaugcugcauccuggauauuaggccccgugucauaugcugcauccuggauuuuaggccccgugucauaugcugcauccuggauauuaggcccccugucauaugcugcauccuggauauuaggccccgugucauaugcugcauccuggauauuaggccccguguuauaugcugcauccuggguauuaggccccguguuauaugcugcaucguggguauuaggcccuguguuauaugcugcauccuggguauuaggcccccuguuauaugcugcauccuggauauuaggccccgugucacaugcugcauccuggauauuaggccccguguuauaugcugugccuguaucuuggucugucuuaguccuuguaagaaccuuaggggacugagcaucagcucuacuugaaaugaggaaucugagacuaaucaagaggcaugggaucuugcacagggucacucagugagaaaguggcaggcacuugcccagcucugucugguuccugccugugcauuuugccuguguugcuuuggcuucuaaggcguuaucaucccccagagaccccgaagggagugagggagaggcugacauguccaugaucuggcucuucaacgugguguaugccuggugcacauuuuaugagccugccccauccuguccuguccugguugacacagucaagucuagcaccaacacaaguuggugcacccaucaucuaagucagagcucacccuggccacaugggccaaugacucuaugccaagccacagugcuguggagggagcaggaggagggcaggaagaaagaaauacuugauuccuccauuaguuuguuuuucuuuaccacgcuagcccuuacugugugucagguacuuccuauucugagcacuucacaaauaccaccuauuuuaauuuucaugucaacccuaugggugaguaugauaaggggaaacugaggcacgaagagguuaaguaaccuguccaaggucacagagcuguuagguuaaagcauuugaaauugccaauauuugaccauuuugaccuauaaaaaugaugauuccauaugcauaacccuacuagcagguggagaggcugcgauuugaacccagagcagcuggcucuagagccugagcugaggguugaccacugcuccaugcugccaguuuagaaucucaugcccucguuguccccucccagccaugggauucccaagcccuuuaaucaggcagugcuuugaagaaacccugauaccagcauguugucaagucagaccuucauguaucacuucucucuacaucuccuuggcaucccucauuucuguuuagacuccuguucucaggaaauguaagugcagauguggucuuacuuaucauguggcugggugaggggcugcccaggccagccugccccuuguucagagcaucuugaauuugcucuucagggauauccgcaggugggugccuggucacacccgcaaggcagugugcucagugugguuucuuuuuucugaagugccauuccuauggugacccugcccucuccaggccuccuuccucauagccccaggcaugcuuccuucggcauuacagcugcacuaggccccugaccucccuccugccgaguggcuugucuccccugcuccuuuuucccuucacuguccucucauuucugccaccugccucuccuuucuacagggcuaugaaagagucauuuugcccuuuuuugaagccucagaugcuuuuuaauguuuuuuugugagucaaagcuccaaaucauggcuuuugcauaccuucccuugccaggaaauguucuugauugaccugauaguuccugucaaaugggcagucucuucagggaucaaugaucaggacaaaaguaccccaaaucuacaacacaggugucuuucagaacaccuuccuugauggaaauccccucccuccucuucuccacaggugccuuugccucuucccacucugaguaagacacucugcucucuccaacucucagagcucccuaggcuuaaucuagcaaacucuucacugggccugggauuauuccuagauuaaaauccgggaguuucaccuucuagagcaagucugcuaugagaugaaccacacugccucuguuucuuuucuccuaagcaggaauaaugccgauuuagccauucaccguugagugccaagaucacggugcaugcuuugccccuucccaccuccacuuuugugccucugccaccuugauucaggcuuccucuucucccaucuggacccaggggacagcuucucugcaugucucccugccugccacagccucccccaccgcgucacccccaacacacacacacauacacacacacacacacacacacacacacacacacacacggacccaggggacagcuucucugcaugucucccugccugccacagccucccccaccgcgucacccccaacacacacacacacacacacacacacacacacacagagucaucugauaguuugagauaauagaugggaaaauguguugaacagugaaaguccuauauaaaugcaagggggaucgggcacaguggcucacggcuguaaucccagcacuuugggaggccaaggugggagaucacucgaggucaggaguucaagaccagccuggccaacauggugaaaccccguaucuacuaaaaauacaaaaauuagccaggugugauggcaggugccuguaaucccagcuacuugggaggcugaggcagaagaaucgcuuggacccaggaggcggagguugcagugagccgagaucucaccacugcacuccagccugggcgacagagugaaacuccaucucaaauaaauaaauaaauaaauaaauaaauaaauaaauaaauaaauaaauaaaugcaugcaagggguauauuuaguauugaugaaaagguuuucccuuugggguucccauuggguuauaaaaaucuucucacugugcaccucccuacagagucagccacuuaagcugauagagacaugauguaaccgugggaauuucuucucucucaacaggaacugaagcucucuucccacgaggaggccuuguccuuugugucccugguagauggcuacuuccggcucacagcagaugcccaucauuaccucugcaccgacguggcccccccguugaucguccacaacauacagaauggcugucaugguccaaucugguugguccuagaaccuuaucaguugccuuuggugugcagagagcccguguuuuagugauggggcaugucaucauuguuuaggucaggccaguugaccaugcugccugguacuuguuggcuguccuccuuuccucccugcuguccaagcucuggucaggccuuccuguaaucuccuaccauccucuuugcagcagccccucaaugcugcuucuuuacuuggaucucucuucauaguuuaacccccucaccucuccauagcugaucaagaaguacuacacuuucugauuucuugcugugucaaacaaugugggcaauucaagaaacacugaacacagcugagcgugcugccaugugccuguaguuucagcuccuugagaggcugaggugggaggaucacuugagcccaggaguucaauucuagccugggcaacauagcaauaucccaucucuaaaauauauaaaagaagaaaaagaaagaucagaugaugaucucagcaucagacaguguaauaaauggaauugucagucagcuugucccaaggugccaggugaacaguggggaccgugaggguaauacagccuuaaggccagaaggggcugugugggaugccuugucccaccugcaucucagaacuggcagccugugcugaaguaccucuggugaugggcaaugugugaggcagcccauggauuggagcucugacugugagagaugugcauaccuuucugauauggagcuguaguuggcuucucuguaacuucugccuacucacuugaauucugccuuuugagacaacagggauucuuuugacuuucucuuacauaugacagcccuucaggcaaaggaaaacagccagcugcuguguuucuucugagccucucuuuucagaccacagaauaucuggggaagcaucucuucugccaccuuucacaugaugugcuucucaccuucuucccucuuccggcugccuuguggacagguagcuuaguagucacauggcccuggccuugagaggcucacagacucauagggaaacagacacacaaagaauggcagagcaagggguugagcauuugaaaagcgucuucugccaaugucccagccaugguugugcuucagggcccaggcacucgcucuucccuuggcccagaaugcccuuccuccagaaucugcacagccuccacuuccuucaggugcuagucagauaucaccuuauccgugaagucuuccuugaccaccuuauauacaaucauaccucuuucccuucuccaucccauacauguuggccacugcacucuaccuuauuuuccuucaguggcaguuguuaccuccugagauacuauguuuauuuacauaacauaacauuuguuccuggucugacuacccucaccucccagaauaugagcuucccaaaggcuggggcugcauugcucacugcuuucuuagcacacacagggucugacacauuguaggcccucagugaguauuuguugaaugaauggauauuucauguuugaugggaugcugacauuccuugccuaaagagccugcucagaguagguggcauucaaaucugauuaaaccaaagaaucaaugauggcuugccaggccuuaaagcacggaaaggguaccuagaugagaggucagcacaugcaaaggcauggcgcaguuagaaaguacacaaugucccugucucucuaaaacacacgaaccauggcggcccucucucaccagcacuuagcaagcagcacucaccucaugcagggauguauucagucaguauucacugcucucuacaugccaggacucacugguccuggggauacaaagaaauguaagacaggccuguuccuacuaacaucuguccaguccucacugauguauucucucagugugagcccauggugauacaacaauaaacaacauggccuccaguucccacccccaugagguuugugcuuccacugggcuggcuagggguggaggggaggcguggcagaugcucaucaccagccuccagagaggcucuucugucuugagcuggagaugaugucuguagggaaugcggggacaagcagggcucauugccuugggcaggagucugaguccucuucucaaccuuggagacuccaucgguccugaggccacucgguauuuccgcuacgcucauggauggcaucagaggggacuuuaggaucccaggcagggcagauagugugauggggcuguuaagacuugaggcagcucaggagaguggauagcccagagguucaaaguccuguuuggugugagcucuuucucccuuugccuacuucucccucuaguacagaauacgccaucaauaaauugcggcaagaaggaagcgaggaggggauguacgugcugagguggagcugcaccgacuuugacaacauccucaugaccgucaccugcuuugagaagucugaggucagucaggacacuggcuuggaccaggccauacagccaugagguguccaguguagccugguucaggagcugcugcagacagaaccacccuuggcaggguggaacugaaaagccugggucucugagaagaucccugggaggucaggcaagggccccugcucucaaaaggagacugcuccccaguagccagaccccugcauccucccccuguagggcccuucuuccuucaugggacccaugguggggguccaccauggcucuggaagacagaacaugaccagaaaaccaauucacacccaacacuuggaaaguauagugucauuauuuagagugguuuauuuagacucagugccaccaucaucucagacccagagcuaugccugucuacagcauucacugguacaaaccagcgcccaaaugccacuucauccacauggccuaacacaguuuuuuccaaaugguagcuucagacacuuuaacaaauugccaccccaucuuagaacaaugaauagagaugucuuuuagugauugaagcguagcugaagcuggggaugaugugagauacauucugagggcuaagauauucaccagaauuacugacuuugccucacuagaccacaaaugccuuuguuauucauguaauuaaaaaaacuacaaaguggaauauuuucaaagacagugaguuuuacaaaacacuuuacaucaguacacuuuaaucaguacugguuaggcuccacaugcauggggagaccugggacacggaggggccuuuggcacggaggguagacgcaggaaggacagcuuauuggcgaaccccuggggcuggacucagucaagagugggaggaggaaacggcagaaggaaccagcgcugccaaguguccugggugaugcaaugcaggaacaccaccaccugcccaggcucuugcugaacagcugggccucggggcuccguggcucagagccugucagguucauugccuucccagaaugcuugccgucuauucaucagucauuggaggaaguuuaauguguuuacgauggaggggugcaugagacagcccagccuccuccugaaguggaauuggccugugcaguaccaagaguguccgugacucccuaacaaugucacaucacccggggaaaacagcagucauagaaaugauuacuuccaccgcacacuguggcccaccagacccugugccaagcguuguaccuacuugugcuuuuuuaagccuuguaauagccauauuagguaggugauauuaucccauuguacagaugaaguaacugagauuuugaauaucaucuccuaguuuacagcuuauguaagucuuucuggcccucauuguuuaccacuaaaauaguuuaguuuguacaaaaagagcccaugagggaaaacugcuuauaccuccuaucuggcaccacagugucccaaaccugggucagacacugaacaccagcucccagugugguuuuccucaaguggagacauggccuggaagggcucaguuugaggcuguuccuugagaaguugugccaucauaauuauuaccucauauauaauaucugcuggacuuuauaaagggcuuacuaaguuuuucaauacaccauguuagauaauuguagcaacaauccuaugagguuggauuuucaugaacuuuaucuuacaggugaaaaaccaagugacgcuuuuguagaaauagcuacugugucugcuguaguauuaacucccuuuuaucaaugccuucuccuggaccuuguuuuauuauuuaguuaguuguugguuggauuauuuauugauaauaaacuuuauuuuugaauaauuuuagauuuacagaaauguuacagagauggugcaaaauuacucuucaugcagcuuccccuaauguuaauaucuuacauacccaugccugaccccauuuuaaacauguaauuucuggucauuucccgaauagcaggugcagggugcccagaagcaguucaagaacuuucagaucgaggugcagaagggccgcuacagucugcacgguucggaccgcagcuuccccagcuugggagaccucaugagccaccucaagaagcagauccugcgcacggauaacaucagcuucaugcuaaaacgcugcugccagcccaagccccgagguucgucucccugugccagagccaggcuguaucccaucaguaaugugcugagacccagaucgaccaaaacacgcugacugacuuaaacaaaguggacccuccccacaguuucuagguguuuuuuauugaguuuaauuacacuucugugcccaacucacauccaaucccuugagugugagcauuuucuguagaagaggcauauaccuuucucagcaucucauuaggcugcagaaagaggcaugcucagcauuaguaagcagaaaaucacuucuuucuuccuuaagauaaaaugccuugaggagucuccugucacugguuuauuuaucugagagauauuccuggcacaucuuuugugggccaagaacuauaucagaugcaaagaaucagaaaugcauaagguccagucccugcucucuggggguuucccagccuaaugcugauguuacagguaaaugaggccacugcaguuugugauggguguuuuaacuaacauagauaucauacccuggagucaaacagaaagggauggucaaaaucccugaguuccguggcacagggggcugccuggaggaggcagcucuugaacugagugugggaggaugagugggagguugccagugcggucagggcaucucggcacgugcaaacagaggcaugggcgggggcugccaugaaggugaagguggaaggaaggugaagguggaagggaggggcaggugaggcugagcuuagggugugggggccuugagugcuaugccauggagcugggucuuuauccugcaggcuguaggggccagggaggaucagggagugaaauggauccaagggggagccacucagcuguuucuuguuaagccucuugaauggcgucacugauguucugcagguggauuugucucuuagaaugugaggacuggaaagacacguagaggucacacagucaacugucucauuuuauagaugagaaaauugaggcccagaagagcgaagugggucucaucaaaggucagcgucaaagaggggcuugagugccaggccuaaccugagugcccuagcucuugagaacgguuuauuuugcugcuccucaccucaagaugcugcccuucaugcgucagguucuucccuuagaaggaggaaggccucaaagaaggagcagcacgauugccacugaggccccaugagugucagaggaagacccucugaggagucuuuaucugggacacaucuuguucuuccaagcgaacguguccauaaacccucacaccaccaggagugggcagaggaagcagcaccaggauagaaagggaccuggguucuugauguuugaaucaguuuuuggucucagcaaggggcuugucacugaacuuggugaaagaggagggacuuguguucuugaucagauagggguuccugccaggcucagagaauaacugcagccuuuguuuucaugcuugaggauuuuccgcaaagguaaaaacacaucugccacuuggcugugagaccucagaguaaguucaaaccuuaaagcccaacagcccuauuuauucacagcaacacacuggaacgaaccccaguugaggcuccugaaacucagugcugaauguguuuccuguugccuuucccaccugacugugaacucuuaagacaggaccugagucucacucaccacucuaugggcucguggggaggacagugcccagcacggagucagcgugaauaaugccugucaagugaacagguagcaggagcugcuggauggugggugccuacuguggcccaggcaguuuauguaccuaccucauuuauuucaucuacacaguagcuuuuuguagauauuacaaaggugaugaaauugagacuugagaugguaagugacuugcucaaggccauguagcuaguaguaucgguaguagguagaacaguaguaauaauuaauaagaacggcugcuaucaugugagcagggcuuacaguuugccaggcguuguuuggagaucuuucauguuuuaagucauuuaguccucaaaauaacccagaauauguuguuaucccaauuauacaugcccaagaucacuuagguagaggaugaguggggauuugaacucacguugucugacuccaaguccagugauuccuucuguaccacugcccccacccugcccaggucacacugucuuuggaaaggugcagccaucagccuaggacuuuagagcaggcaccaauucuccugaccuugggagaguaagaauaaggccugugugugaggccuccuuacauaggucccccaaagcucucucucuucccuuugccaugugcaaauuagagaaguggggaaaucgugaaaauuagacaugagaauauuguguuggguucuucagcuccucugcucuccuaaccacgggguuuugauagccagacccugaucuggguuucucacuugaaaaugcaacuaagaaacucuucaugggauaaauaaaaagcaaagugaaaaagcaggaggccauucagagugggcgugacggcucagcaggucccacaucucuaguccuguguccuguguccagcuccacuacccaucucccacuccagaacccugaugauacaggaagaaugaugacagugacuaagauguaaugccagucauaaucacggcggcaaccagucagggagcguuuuacuccauaccgggcacugaaggcagccguucccuugcgucaucccauucuuccacacgguaaccuaugaaggacacaacuguggcccccauuuuucuagugaggaaacaccuucauggaggcacuguggcuucccccauucacauuguuaacccuggugccauguucccugaagugcccaugcaaagaauaguccauaaauggcuucgguuccauccgccucucauuucccaaguggcucugcugccuggccucuugccuguggacaccagccacggggccccuucuugaugccuuuucuccugaguugaguugagccugaguugccucugaaucggauuuuccccagguaacagaguggagucaggaaaaugguauggagggagcagccucuggaaaaagagugcccagguugugagaacaaggggagccucucccugagcccuguuucuggcacccacauuuguucucccgauuagggccagguauguugugggaaggguagagacgagagcaucucugacuucagugugaauccuaagauuacgaacugccuggccuugggccaauuacuuaaucucucagaaucucuguuuucucaucuauaaaauggggauaagaauacuguguauuccacaggauugucauaaggacaaaggaguuaauguguauaaugcucauagaacaccggcuggcauggagaaaacagucggaauaugugagcuuaaaaaauuagaaaggaaaagaaugcccuguccugagggauagcagggauuagagacguggcccugugcagggacccggcgcucagcagccauugucucccagcggugugugugguggccuccauggguugugccuggcuguucuacagauguucuuuuaggaacuuccuucuguuacaguccaggaaucaggacuggaauggcuacauuuucuccccuaacuuguuauugucuucuagugcaggaaagaggaagugaagggaaaugcauguucguugucauuuugcuaauauuccugcuucaguuaauaaaauugaugaaaacauacaagucuucagagauucccagaauacuuucccugcuagucagaaucuggaagguccuuucuugccuuaugauaaccucguuccuugcaguagcuccauagcgggaaaggugauuucuauggauuguagauuuccuggccucgaggauuuuguaauguguuggguuugcuguuugaaucaguagaaucugggggauagucuacuuaaaccugcauauugagggggcauuugguaagcgccucuccaugucaggcacugcugguaccacgagcuucagacagggcacuguuaugggucuccugcccugaucuucuggcucaaaaccagcguuuguucaccuccuccucugguucccaucaugcccugggcccggguacugcuucuuccuuccauagcucucauccuuuagaaagacgccagucauucauucacucauuuaacaaauaauaauugagugccuacuauguaccgggcuguggagguggagaagaaaauaagauagacagucucugacuucuuucaguuuccagucuuacauuuuaaauuuuaauuucauuagggaaacuguuucugaccuuucuuaccagaacagaucuugccaugccaaccuuggagcaccacacaccuguucuuuagaggagcugaacaaauuguagcuuuccauuuaauuguuuauuugggaguuuuggcucugucguuacccucugagcuccuggaggguaggagccauaugccuauugaauaagcacuugucgaaugacugaagcagcaagcgcccgcacaccggucccacggccccggcucagcagacguuggcugucugagagcucggaucuugggugcugugcucagacucccccaaucucuuccacagaaaucuccaaccugcugguggcuacuaagaaagcccaggaguggcagcccgucuaccccaugagccagcugaguuucgaucggauccucaagaaggaucuggugcaggugagucacggcugcagggugugggccagcugugguccugccuccccacgauggagcagcuuggggaucugggggaaggaaggcuguguuuggggaaaucuuaguagaaaaagaacagggagacuuuccuuugauggcaaaagccguacaaccauugccuccauccucuucacccuugcugaugcuccucagagacauguuuugagguaagugguuuggucaggcuuugugggguuaccuagaacagcagggaccuucuguggugagcugaagggguggcagggcaggagguggcucuccacaggggagcauggccaucacaccucgcugccugcagcaggcugugugauggagcaccuccagaguucaguccugcacuuucugaugaugcuuccagaaggagcagagcucaggaggagagaacacagggagggaacaagaggacaugcacacucugggccugaaggagaacuaucuugagaaacagaucccagucuuuggaggccuuuuugcccagaaucuacaggcugagcggggagcccaggaucuccccaggggcugcccuggagcuguugcugguggugugaggcccagggaaagcccacuuucuguucugccaccgcuccccagcccuguugcauagggccacgcguugggguaucagggagauggugcggcagccuuggagagaagcaagcacggggccacucaccaccucgggagauggcagcgccuuggagguguuggagggugaggcggaagcugccugcugugaaggagccuggggagaguggcacucggggguuuguuacuuuaccuuuuucagugaguccccgagauuguuggauggggcuugagggaguggaaauccacagcuaaacugccucacuucccucgugguacauuucuucaccaaaggcccaucauuguucucuauuccucucguggugugagagcuguguccugagauuacagucaccagagccacaguuucauagccucuuuucuguguagaacuugacauagucuguggggccugccucuuuucccuugccucgagccuccaagcagguaaccaccauccuccaugccuuccacauccacuuagccaacagagaucaagcauuacacgugcgaggcacgauugcugcuucagcaggcuccugucuauuuugaggggguaaucacguuagcaagagucaaguuccaaaguagggaaguacagcaggauguggaccuaaucuugagaggacggagauagcuuccugggggaagcgguaucaaagcagagucccagaccaggcacagcggcucacacaguggcucacaccugucgucccagcgcuuugagaggccaaggcgggaggaucgcuugagccuaggaguucaagaccagccugggcaacacaaugagaucccaucucuacuaaaaauacaaaugaaaaaaugagcugcguguagugguaagcagcuguagucccagcuacucaggaggcugaguuggaaggauugcauaaggccaggaguuugagguugcagugagcuaugauugugcugcugcacucccgccagguguuagagcgagacccugucuggggaaaaaaaaaaaucagggucuccuccuggaggaugaacucaaguagcuaggcaagguggagggaacagcaucagaggaggaugaagugggccauaugggccuuugugggucccugcagaauccugacagcauggugucaugacuuggccacgggaagagcaauuauucugaaagcauauggcuuuuacgggauguucugggaauacagcuucccauaaccuugauggaucacuucaugacagaugcagcuuuaaugaauagccaaagaccuugccaggauacagcagacaggguggaugcaucgccauucggcucugacagauaacaaaugguggcauuugugcaaauuaauauaccugauuaacaaugguguauguuccuaugggggauaagacugauucccuagguaucagugacagucccuuuucugcauuuccaggggguccucaaauaauagaauaauggaucuucaguuuacaaguuuuguggugcuaaugucaacaacuugacauugccuaaguuucgugaaucccauuucgauuuccaaauauuaagaauuuuaaaagcagaauuauugcaacuugaacuggaaggguccucagaaauagaucaugguauggcuagggcuuugcacggaucaucucauucaguccuccugccacucaucuggggguauuguucccuuucacaugucaggaaauccaggacacaucaccccaggcuccaccuucaucuucacauugccaucuccucugugagguugccagggcaaaugcagguguacuuugcaccacuaauuuuaaauccuagcgugcaugcacacacaugagcacacacacuggauaaauggaugggaaacagaugguuccagugugagaaacugugccuaccugugccagagggcuucagauaacacauggauccaccagauggguuucuacgcauccccccgugugccugagucuguaccaggagccuccaucccuguuuccugguuugauucuuaccacagcccuaugaggucaguaccauuauuaccuccauuugcagaaagugggcagagauugcccccaugucacauggccagcggguaguagagcugggauuugcaagccucuucacaggguagcacagccugugaguagaggagcugccugggggcuccucucuugagucuucucuggaggccuggggugggacccauguggcuggcuguugauggcccuguuugcaguguccugacauguuaggacuguguuuuggccaaaggcuguuccuagggguagaaagcaaggagccguuuagggaguaggaggacugucuccuggggcccagcaaaugucaccacuguguuuggccaaauagcuuguuguuuucucuggaggccuggggaccacgagcuggggcagggagcccucuugccuuugccccaucccauugauaguccauguucccauugaggacccauucccagacgguccaucacuucagggcacagagaggucacccagccuucugcuucuucccucagggcgagcaccuugggagaggcacgagaacacacaucuauucugggacccugauggauuacaaggaugacgaaggaacuucugaagagaagaagauaaaagugauccucaaagucuuagaccccagccacagggauauuucccuggcaagugucuuccucugaacuccuccccuccccucucccguuucuggagccaguggaacacaauggguugagaagaacccuugcccuucuuguggcccagugguuuucaaacuugccuuuuacucagaauuuuuuucuccacauaugaucuuaguggacccugcauguagaguaagugagguggguugaacagcuccucacacucagccugugcccucccuuccacccccaacccccaccuuuccuaaggacagguccagguggcugugcuguggagcccuaggacucuggccaaaugguucaaaguuccugauacaguccauggcucucaccacacagucuggaaaacgaaagcccagaggaguaaaaggacucacccaggauucuacagacuauuagagugacacagucaaaucuugagcagagaucggcugccuucauuuccccuuuguuccagcauagugcuaaauauggguauuucccagagcugaaaggaagagagagaggugggcaugaguauccagugggaaaauucuuagccagcuucucccaccagcccugcucugcauccuguuagguuuucuaaauaaaccucacaucccugccagguuggcccagagaacaaggcuuggcagugccucuggacagccaaggccagaggauugauguucagggccugggguggcgacaguggugagcuuuccuggguccacuggcuuuccccucaacagagccccuggggagcagcccccuggaggcuggccugagacauuccuauguccugcucgcccacaggccuucuucgaggcagccagcaugaugagacaggucucccacaaacacaucguguaccucuauggcgucuguguccgcgacguggagaguaaguguguucucuuucaaagggguggguggccuggcuggggagcuugggugcuguggagaugguggaggcucuucccacccucacguugcccaggcuucuugccuuucuuuuugcaguugaggagauugagggacugagcaggucauuugcuuaaguuaauaguggagguggaacuaaaaccaauugcuuuucauucauuuguguaauguuuucuugucaacgcuggccaagaacccuacacugugcuagaccugggaggcugaggugagugaaaugaggucaaggccacaagagucaggcccaaggagcucugggcaggugagcgaggugagcgcaccccacaagcagcaagacgcuggcuccucgaauggacuggcuuccauuuuaaccacaggcaggcuuggcccuuucuugguugucaagccacugagccggugggcccuugggcugcugcugcacacugagauggagggguggccuuggccucugaguuccugacauguaaguuuggaagaagagcgauuuuuuuuuuaaccccaagugacuucuucccuguggaauccaacaaugugagcuguuccguguacucacacaggaguccuguugagagggaaguuuugccgugugagcggccugaccucugcaucacaguguguuguagaacagcagcagugguggcgguuguucccagagcccuuguucucugugucaggcccuccgccaaggcuuuccaggccuugugacauuuagccgccaucuguuauuacagaugagggaauugaggcucagagaagugucacuugcucagugccaccguuuagaagaagagcuugggguugaacuuggccuuuccagcucugaagccccugcaccauugcaccccccaaggauaucuguguacucugaggccgaguaguguccacugaaguggacugucguaaggggaugaaggagaggaccgugccacagaccagguuccagacauggcuauuuuuaugccuacagauaucaugguggaagaguuuguggaaggggguccucuggaucucuucaugcaccggaaaagcgauguccuuaccacaccauggaaauucaaaguugccaaacagcuggccagugcccugagcuacuuggugagaauguccugauguccauaauggucccaccagaaaccagaguguccugggagggguggcaggaaggaggugcuagccaagcagcuagaggggccuguccuuggguuccauggggccagggcucugugguugaacaaaggugugccuggugcuuacugaagauggucguuuggggccguucccugugcucacaugaguucuguuuagugggaaauguuagcacgucagagggccgacuugcauacugcagcauauggauggcaaggcugaaagcagugcaguacguguugagugaaugagugaacugccagcaucuaguagcugacguguggagugcucaccaugggucagcuguucaggcguuucacagauucuaaucaguaucaugcucacgaagcccaaugagauacgugccacuauuuagccacauucagugaugagggagcuggagccaaggggcaccugugaugugccuaagucacacagaugauuggcagcagggccaggcuguccagaucuggcuguagcuggggguaggaagagaugaccugagggaccaggguuggaaauagaaugcgggaaggagcagcuuggcuaaacuugaccuuuuuacucugcaggaggauaaagaccugguccauggaaauguguguacuaaaaaccuccuccuggcccgugagggcaucgacagugaguguggcccauucaucaagcucagugaccccggcauccccauuacggugcugucuaggcaaggugugucuccccucucuucccucuggccccaccccgagucaggggcaagucagcagagagaagggcugggcugggguuggucuccuuuuagagagucauuuuuuuuuuguauuuuaguagagacgggguuucaccauguuggccaggauggucuugaucuccugccuucucuuaaguccuugaacgagcccccguucguccuccugcccugggugauggcccccacccugggauguuuugcugauccuaaggccagggcuucagaagccuggcuucacacgacccuccuggggagcuuggaggcagggacccaucugcuggcugugacccagacugauguaucagaagugcuggugguggcuuggagggcugcacgccugcaggccccccgcacagggccuauguggccaugggccauguuugggcacacugcuugaaguaguuccuucauuggcucacuguucuggcugcagugacaguaauugaaucccuaggagaucccagaaacugcuccaucagugugucuguugucuuccagaaugcauugaacgaaucccauggauugcuccugaguguguugaggacuccaagaaccugaguguggcugcugacaaguggagcuuuggaaccacgcucugggaaaucugcuacaauggcgagauccccuugaaagacaagacgcugauugaggugagcagguguuucccggggcgugaggcaagugagggcuuucaggugcucgugggcuucccaggaguugucggaagccuggcacugugggaagagaugggcauggguuugaaucucuucacgggccuacugggugugugaccucacaaauguaacugaacuuccgugagccucaguuucaucaucuauaaaauggggauaaucaguaacuacuuguaggguuguugugaagauuaaauaaugcauauagagugacaggcaugcaguacaagcucgauagauguuauaguauuauuuaucugagauuuuaagugccuguuauucagcaaaauuaccacacaaauacguauggaguuccuauuguguaucaggcaucaagcuugggaaaagcuggagguucacuauaaaauaagauacaggccuugccuucccuugagggccuuaggguaugguagggaguuaggcuaaaauaacaacgguaagaauuccagaaagaauaccugaaagugucacccuaagagcccugcaaauuagguaggauggugucauuacccucauuugacagaucagguaacugagacucagguagccccacuuaccuggguuccucagcuagaaugcaaaacaggcgagguguggaccuccuccaaaucuaccuguggaaaaaguggagacucuaacuccaaagggguaaaguaguaaaaaucacaaugaaagaccauugucccuucaucucagugacugcaauuggaaugugcuccuguuguuuagagggggcaggcaucaguuucggcugugagagccugguuucagugcugugucgggagccuggguaguuuggugugccuggccuugagugucuggaguggggaaaggaauaacagugaucaggugggaaaggccauuuggguucagauuuuuaaagucccugauuccaggcugcagaaccuacauuuuacuggggguggcaugggacaaggaaggauuuggguggaggagggaggggcuuggaggucggccuugggauguucuucuggaugcaguagcugggauggacagaggagagaccuggagggagacaggggccccgagucucucagcaaugggagccccauguccggaaauggcagcggaaguccagagugcagggugggagauauugaagagguagaaccuuuaugacuugccaguuaaugauggugcaggacuugggaaaggaucuuaaacccgcagggaaaccaucagaucuacagaucugcuauuuggaauuuucagccuaggcuuuugggaaauucauauuuauuuuuaacuuccuuggauccuuggaaaugaaacaacauacccuuugucaucagucaguauuuauugagcacgugcugcguacccugggcugaacagcauacagggugguguaaggaaggacccgugucuuuaauaaaauaggggucucucuccaccuaaguccccuuggguuagauggcuuuucugcaggcugcacugacgcagggaugugugagugacacucaaggacaagagcaauucucagcuccuuaauuccaguccucccuccucccuguccucuggggccugcccaccccaccccaccccagggcccacggggaccagagaggaacuuaguacccuuggaguccagcuaugaaguagaaacuggaaugcagugguuucacuucaucuuccaaaaguagcauaaguucuuguuucuaaaauuuaaaguaauaaacaguugaagaaaauuuuuaaaaugaaacuauuaaaaaaagaaaacagcaaucacugcauucuugucaucccugaccacuguuaacacuuuggcauuuugucuuccagccuguuuguaucucucuuuuuuaaacaaaauuggggccaugcuagauagaguuauauaaaauucugaguuuuuucauuuaauacugagaaugcuuuccugugagauuaaaucauaauuuuuacaaauuuaauguaagaguuaauuguuuuguuuaauuuacuugacuaauuuuauauuuggcauuuaaguuuucaaauuuccaguguucugucuaauucugcaggaaacauccuuguacauaaauauuuguucauaucugauuuauuucugagucauucagucauugaaguuaaugcaucagaggguuugaagaaucugaagauuuuuguacauguugcccaauuguauuccagaaaggcugcaugccuuuacuugaaugaagcuuuuugggacugggcuauagugcccagucuccuugaauuuggacuauucaguauuaggacugugauuuccccuugcaagaauaaggcagcaguaacaaacacuuacgaaaucuaccuguaaguggagauguugagaaucgaaugaggaauuggcaauuccaccugaccuggggcugagaaguuuguaggugguuccuuugguuucuuccaugugccccucuuguuuacagaaagagagauucuaugaaagccggugcaggccagugacaccaucauguaaggagcuggcugaccucaugacccgcugcaugaacuaugaccccaaucagaggccuuucuuccgagccaucaugagagacauuaauaagcuugaagagcagaguaagaccugccaugugcugcuuuaacccagcuuggggagaaacaggagccuggguggcaaucccuggcaaucgacugccuuucacucuguuuucuuuucucuucuguuagauccagauauuguuucagaaaaaaaaccagcaacugaaguggaccccacacauuuugaaaagcgcuuccuaaagaggauccgugacuugggagagguaaguuacacccgugcugcuugcugcugauggcagagcccuccgccauccacagcgccacucucugcacguacagcugcucuccauucuuuuucauucuggggccagguccaugagcgaaagcaccuuacugcauuugggggccacuuucaucacaagggauugugucuuucuccaugugacacacggcacggacggaaugcacgucccugccugcaugcacgacuguguaugcacacgggacucugggcagcucccuugagagacuugaguuuucucuacaggacagaagagaauggaaagagggagagaugggggaguagguauagauaugguggaauaggaaaauccuugccucugacuuucccgggcauauauauccuguaagcuucucucuuuuucuuuugcccccgagagacagggucucgcucugugucccaggcuggagugaguggugugaucauagcucacugcagccucaacuucccaggcucaagcaaucuuccugccucagccuccugaguagcuggaacuacaggcacacgcccccaugcuggcuaauauuuuuuauuuuuuauuguagaaauggggucuugcuauguugacuaggcugcucucagacuccuggccucaagcaaggaggccucccaaagugcugggauuauaggcauaagccaccauacccagcccuguaaggcucuuuagagcagggauagguuuauugcacagaaucccaaaauagagugucagcguuucuuuggaccuuaaaugggaguuuccaaacaguuaauugugacuagagaagcuacugagauuugugucuuuauacagauuuucuguagucugguuaaugaaacagacuugauacaucuccaggaucugcugugugccagccacugugccaggcauugucagaagcauggcauccuuaguuccccccaccguccccgaggccaguuucuguaugcagcgagugcaucaggagccagcuccgauuuggggacuuggccaccacugucgcugucagguggcuuggcuggaaccugaucucacgucuucuaaagacuccucaugcauuugcucuuuucagccaugcuguggggccuguccuguaacgugagcccagggcuuuuagagaacggcaguuguccugcaggcccagaaauaaccuucauuuccuguggucauagaaauugggauugaugaguugguucaucgucaccugcuacuuugucuuggcucaguaacugaggggacaguuugugaggccaagagagcgagggggcuguagugagcaaguacaguccaggugagaggcuucugccugcaaggccagacagcgagaaccccuggcccucaggggaacggcugugaggagcaagacuucuguguguuccguggccuacgauggggcuucccugauaacagcacaugcaucuuucccuccagggccacuuugggaagguugagcucugcagguaugaccccgaaggggacaauacaggggagcagguggcuguuaaaucucugaagccugagaguggagguaaccacauagcugaucugaaaaaggaaaucgagaucuuaaggaaccucuaucaugagaacauugugaaguacaaaggaaucugcacagaagacgguauguuaugcaaggcugggguccgguuuaaagauuuggugacugucuagggucauaaaggccagugcaaaacaggcacuccguggccuuaccugggcgucugacaugcuagcuggugguucccacacacucucaaggcuuccaagucauaugucaaaucccucagcagcugcagggcuccugaggaggccacccaggccccuccauccaggggcugguuccagcacugucucuccacgucacuugcacuuaugccuuaugaaacugauuccuacucuaccuccacccacuuccuguucugauccaauacuagccaggguauuucauuuucuaguugucuaaaucaaaguggcaaguaauauuuacuaauaauuguaucuuauuugcaagccagcaucuacucaugguagugaaauugacagcugaugauaauuuuuuuuuuuuuuuuuuuuuuuuugagacggagucucgcucuguggcccaggcuggacugcaguggcgcaaucucggcucacugcaagcuccgccucccggguucacgccauucuccugccucagccucccgaguagcugggacuacaggcgcccgccaucacgcccggcuaauuuuuuuguauuuuuaguagagacgggguuucaccguguuagccaggauggucucgaucuccugaccucgugauccgcccgccucggccucccaaagugcugggauuacaagcgugagccaccgcgcccagcccgauaauuuuugaaaacagucauuugccugugguuuacagagcacucugacuguuaucucagugagugcuuaugccugugagguagguacaccauuguuaccaucuccauucacugcugaggaucuugaggcauaagaggucaaguaacaugccuguaaugaaggggcgaagcuggcgucaccucagggccucugucucauauccugugcccuugccucucccaugguucccucauuuggcagccucagacugauggauguuuuuucuaaacaggaggaaaugguauuaagcucaucauggaauuucugccuucgggaagccuuaaggaauaucuuccaaagaauaagaacaaaauaaaccucaaacagcagcuaaaauaugccguucagauuuguaagguaaaaaauaaagacaucauguuacagauuaagacaucaggcacucuguccuggguaauugguuuguaauuugacucuaaguggguaaguuuaugauaauuauacuguuuguuuuucucugcauuauuuagaugaaaaguuagcuucuacuaagaaaguaaacggauuuaaauaugguuauuuuaauguguauuuauuugaaucaguuuguucuuaauauucuugcauaaaagucagaaccaaaaaaauugucagugauaugugaaugaaaugacauuucuauuuuuucugaugaagugauagauaauacaaucuaaagugacuuuagcaaugugcuugacuuuuacuucucucucucaggggauggacuauuuggguucucggcaauacguucaccgggacuuggcagcaagaaauguccuuguugagagugaacaccaagugaaaauuggagacuucgguuuaaccaaagcaauugaaaccgauaaggaguauuacaccgucaaggaugaccgggacagcccuguguuuugguaacugaaucaaaccacuagguuuuaucaaugcuucauagaguuuacacuguuuuaauaggcccuuucuggcuauauuaaugugucucauuccucuggccugacucaagguuagagaagguuuagaacauuuggaauugauugauauuuaucuucaagaaacacaccuuucagccuguuucauugaaagcagccuauauaaaugacugagcuucauaugacaccgucuuccaaggaaugaaagaaaucuaaccaccagcucaacauuccuagcuuuccaggagagggcauucaucugaugcaguucuuaaaacugugagcagguggagagaaucuaguuccuuucuuaaacacauuccugcagagggaggcuguaggacagagugggcauugcagauucagggaacuccuggacagagcagagcaaaaccuacgggagaccuggcugucucaugaaucaccagagguucccagguuagaaggccacacacuggcuacaaccaugucucagccgggaacacuguccaggggagaggcugcuuacaucucuaccgcacccugccacguaaccacauaacgacauaaccaaucagcacuccccuaggugcauccuacauggacacaaacauagaccucucccacuuauggagccuaaacuuacucauucauucauuuaagaaaaugcaucaagguccugcuuugugccaguacuggagauauggugaacaaguaggccgaguuuagaguuuaacaggcuaggcagccaacggcauggagcaggaaacauacagaaggguucgggcuugguuuucuggaagucgugaguauucagaagaaaccugaaagauucaugcggguuuagacagacgguugcuagacagcaugcgugacuaggaagaaugagacaagagcagucgauuucccaggaacugaaccucagugaggucagaucauggaauaggagguuugcaggaggaagcuugagucauggagcugggacuucaucucaagaacaaugggaugcugcuggagaguuuaaggagggagacuuuguuuuaaaaagaccaccacugaaugaagggaacaagauuggagccagggagucuggagccagggagucuggagccagggagucugauuuggcugcuucaacagcucaggccagagcuagugacagcaugaauuaggacagggacugggagagugacaguaggguuugagagaagugaguagguucaaggaguauauaaggagauugggugcgguggaaugccuucauuuuuggcuugggcaagugggugucauucagcaaaguaggcaaugcuggaagaggauuggacagcgaugccacauugugcagugaggccacugcugucucauuuagagccugcaggcaaaucagaccuggggcucaucauuacacggccaccuccucccauacccugagagcauguucucagugaaaugaagagcacagacuuggcguguuauuuuagggcagauacgugcuaccgagagccuguaaaggauaccguacuauaggucagaugugcaccauagcagcguauacaugguauguguaaaauauauaauacacagucagaugcuguauuaaauuauaagaaaaaccgaagaggugauuuuucaguuauccuguaaugucggauggagugugccucccaggaaaugaaguuuuguguucugcuuccuuucaagguaugcuccagaauguuuaaugcaaucuaaauuuuauauugccucugacgucuggucuuuuggagucacucugcaugagcugcugacuuacugugauucagauucuagucccauggcuguaaguccuacuuuucucuucauuugaauccaguacccauuuaaaauguguccaucccucugcuugguuaacuuuuguuuuuaaauggaauccaaugaauguauuauaauggaaaaugucacuuucccauuaacuugguuugcuacuugacaguuauuugugaaucucuaaagucuugcuuucacaacgagcccggaguucuauaggaugaccuugacucucaaggaucuuaucuguguagagaugaagggcaguuuuaugggaaaaugagcaaguuaagugggguagcacuggguagggaccagccuugucugugccuccuucauuccuaaaucagaucauuuucuugggaacagacuccuugaccagcacaagcacaaggagugguugguagagucuaagacacugguuagagacagaucauugaaagcuaauaaggauuuuggauuuuuauuuaaaguuacuaaggagaaaagccuuuuuauugcuacuuaaauuuccaguugauuguagaaauuucaccuuaaucuguuuggcauuuauguaaauacuugcaaaguuaaacguuuuguuugauuuuauuuuauauaguuguuccugaaaaugauaggcccaacccauggccagaugacagucacaagacuugugaauacguuaaaagaaggaaaacgccugccgugcccaccuaacuguccagaugagguaucuaugggccacgucacaguaauaacacuccauuucuauuauguuuucgcagcuugaguuguccagcaauggguagaggggagagcgaggaaaugaugcagugaaguccuuguaaaauaguuuucugaagcugaauuucacauaagauaacugagaaaucgccuuuggggcuagaugauagccaccaguuagguucagagcaaggauucccuccaaaagccagccccucuuuauccacuugcuugccccagagggacagguuuugguguagccuuagugugacaaauacauauaauugcauuuuuuguguguaaguuuaucccacuuauuagcauuuauaauucaguuuucuaagugaauugagccuuuaauacuaaacucuugagacuguguaagacacacugaacaguaugagucagagagugaggcagccagucuggaaaguucaagucugaacugagauucugcuucacccucuaacugguuuacaggaaugaccuggauuuuauugcagccagucaacccuugagcuucucaaauguuaaaauauuauuuaugaacuagaguuguaucccauuuucuguguuuuaaacuauucaaauacucuuguuuuucuagucuuuaaggaaaagucauugcauuuccaaaauuauuuucuuacucuugauauuucuguuauuuuuuaaaguucccagaucuaacauuuuuacuguuguuacuucuuucuuuuuacagguuuaucaacuuaugaggaaaugcugggaauuccaaccauccaaucggacaagcuuucagaaccuuauugaaggauuugaagcacuuuuaaaauaagaagcaugaauaacauuuaaauuccacagauuaucaaguccuucuccugcaacaaaugcccaagucauuuuuuaaaaauuucuaaugaaagaaguuuguguucuguccaaaaagucacugaacucauacuucaguacauauacauguauaaggcacacuguagugcuuaauauguguaaggacuuccucuuuaaauuugguaccaguaacuuagugacacauaaugacaaccaaaauauuugaaagcacuuaagcacuccuccuuguggaaagaauauaccaccauuucaucuggcuaguucaccaucacaacugcauuaccaaaaggggauuuuugaaaacgaggaguugaccaaaauaauaucugaagaugauugcuuuucccugcugccagcugaucugaaauguuuugcuggcacauuaaucauagauaaagaaagauugauggacuuagcccucaaauuucaguaucuauacaguacuagaccaugcauucuuaaaauauuagauaccagguaguauauauuguuucuguacaaaaaugacuguauucucucaccaguaggacuuaaacuuuguuucuccaguggcuuagcuccuguuccuuugggugaucacuagcacccauuuuugagaaagcugguucuacauggggggauagcuguggaauagauaauuugcugcauguuaauucucaagaacuaagccugugccagugcuuuccuaagcaguauaccuuuaaucagaacucauucccagaaccuggaugcuauuacacaugcuuuuaagaaacgucaauguauauccuuuuauaacucuaccacuuuggggcaagcuauuccagcacugguuuugaaugcuguaugcaaccagucugaauaccacauacgcugcacuguucuuagaggguuuccauacuuaccaccgaucuacaaggguugaucccuguuuuuaccaucaaucaucacccuguggugcaacacuugaaagacccggcuagaggcacuauggacuucaggauccacuagacaguuuucaguuugcuuggagguagcuggguaaucaaaaauguuuagucauugauucaaugugaacgauuacggucuuuaugaccaagagucugaaaaucuuuuuguuaugcuguuuaguauucguuugauauuguuacuuuucaccuguugagcccaaauucaggauugguucaguggcagcaaugaaguugccauuuaaauuuguucauagccuacaucaccaaggucucugugucaaaccuguggccacucuauaugcacuuuguuuacucuuuauacaaauaaauauacuaaagacuuuacaugcauaugccuuuuaauauuaagauuucauuuucaaagcauuucaaacaauuugcuuacauagaaaaauaacaguauaguuuuggggggaggaagggguggguuacgguccuuacuacuaacaaacaaacaaacaccacuugauuugcacuucuucacuguugugcccagugauugauaacggggcacaggccaguauggauggcauguccacugugcuguaguccagacaccuuuguuuguuuguuuuaguuccuucaaccucuuccugcuuugacugacugacuuuuugcagcucuguugcaaaauucaccaucuuuccuuucuucuguuuguuuguuuguuuguacuauaguggaggugugacuaagcauugaagaggcugaaugcaacaggaaaaugggaaagagaagugcagggccugaaaaacccauuagucaucugcuauaucacugaaugaugccuaauucuuaucaguuacuuauagguaguauacuuagaaauuaccuuaaacuuucuagcugucagucauuuuccaacagaagcuaguauaugcaauaaauuagaccaagugaaauucuuuacaaagcauacaacauauguaccaauucuagacuucauaauuaaaacaggauauccacaucauaguuaaaaauaacaaguccccaaagugacgagauauuuaaugaucugauuucaaaaagccccggauugagaucccaaauucccuaucaauuaauuacagucuuauaacauaaacaaacuuagaaauuucuagauggcaaaagguuucucaugcauuuaauaccaaggucuucaagaaauggugaugucaaaagucaucauaguccauaaagauaaaacuucuuucacaaguaaauuggguuaaauaacugauuuuucacccuaacacacuaucaaaaagagugagagagaaagcagagagugagguauagcuuauuagcucaaaaugguuauaaauacugugacuccuuaagacuccaucagaaagugcaguauugacugcuuuacuauacuauauuguggaaauaauagggcauuuagugaucaaaauaggccccauucuagucauuagaucauuacuagucuacgcuaugaaaugagcacagaaacccauguuccuuuccacuuacaagucugucuaaaggcuaaaggucugucuuuaggugaauugaaaggaauaguugcuauuagaauuagugcuauuagaucagggaucagcaaacuauauauaaauggccagauacuugaaauuuuaggccauauggucuuuguaggccauacagucucuguugaagcuaaucaguucugcccuuguagcguaagagugccacagacaacacguaaaugaaugagcauggcaacgucccaauaaaaguuuauuuauggacacugaaaucugaauuucauauaaauuucaugucauaaguuuucuuuuuuccuccaaccauuuaaaaauguaaacauuagucuuagcuugcaggcagcacaaaagcgggugguagaccaaauguggacccaggguguaguuugccaaacccuuuuauuagaucaccaaaguuacuuuucuuaaaauaccuucuauuuuucacagaagguauaaaugguaaacaacaucuuaaagcaucgguaguaguggauaccuuggauaucacugucacucucuuaccggguuuaauuuugcauggcuggugugggcguaauugagugugcauguagagcaucuuuauaauauuaccaucagcacauuugguacuugcacccuuguaguucuaggaaaaguccuaaaaaucuauaaaugcaauuacuucuagggaaaguaaauugaaaugcacauuggcuuauaagaaacucauucuucuaaggcucaggaaacaacacuguuucccauuuauugcuucaaacuucuuuuauauauggugucagaauuauucccaguccuaaaucaaggaauauuggaacauuguuaguuucuccaauggauuguaaguuagcacacugauuaagaugcaucugacucuaguggaaaauguccucaauugaugucucuucuuauugcuauuuuuuauuuggcauuucugccugcugcacaacacaguuccuucugggaaacuauaaacccguauuuaaaggauauggcuaguuugaaugaaguuaaggcagcgaugaacagc

SEQ ID NO: 14033 - RNA, 3813 nt, Homo sapiens
auucuugcauaaaagucagaaccaaaaaaauugucagugauaugugaaugaaaugacauuucuauuuuuucugaugaagugauagauaauacaaucuaaagugacuuuagcaaugugcuugacuuuuacuucucucucucaggggauggacuauuuggguucucggcaauacguucaccgggacuuggcagcaagaaauguccuuguugagagugaacaccaagugaaaauuggagacuucgguuuaaccaaagcaauugaaaccgauaaggaguauuacaccgucaaggaugaccgggacagcccuguguuuugguaacugaaucaaaccacuagguuuuaucaaugcuucauagaguuuacacuguuuuaauaggcccuuucuggcuauauuaaugugucucauuccucuggccugacucaagguuagagaagguuuagaacauuuggaauugauugauauuuaucuucaagaaacacaccuuucagccuguuucauugaaagcagccuauauaaaugacugagcuucauaugacaccgucuuccaaggaaugaaagaaaucuaaccaccagcucaacauuccuagcuuuccaggagagggcauucaucugaugcaguucuuaaaacugugagcagguggagagaaucuaguuccuuucuuaaacacauuccugcagagggaggcuguaggacagagugggcauugcagauucagggaacuccuggacagagcagagcaaaaccuacgggagaccuggcugucucaugaaucaccagagguucccagguuagaaggccacacacuggcuacaaccaugucucagccgggaacacuguccaggggagaggcugcuuacaucucuaccgcacccugccacguaaccacauaacgacauaaccaaucagcacuccccuaggugcauccuacauggacacaaacauagaccucucccacuuauggagccuaaacuuacucauucauucauuuaagaaaaugcaucaagguccugcuuugugccaguacuggagauauggugaacaaguaggccgaguuuagaguuuaacaggcuaggcagccaacggcauggagcaggaaacauacagaaggguucgggcuugguuuucuggaagucgugaguauucagaagaaaccugaaagauucaugcggguuuagacagacgguugcuagacagcaugcgugacuaggaagaaugagacaagagcagucgauuucccaggaacugaaccucagugaggucagaucauggaauaggagguuugcaggaggaagcuugagucauggagcugggacuucaucucaagaacaaugggaugcugcuggagaguuuaaggagggagacuuuguuuuaaaaagaccaccacugaaugaagggaacaagauuggagccagggagucuggagccagggagucuggagccagggagucugauuuggcugcuucaacagcucaggccagagcuagugacagcaugaauuaggacagggacugggagagugacaguaggguuugagagaagugaguagguucaaggaguauauaaggagauugggugcgguggaaugccuucauuuuuggcuugggcaagugggugucauucagcaaaguaggcaaugcuggaagaggauuggacagcgaugccacauugugcagugaggccacugcugucucauuuagagccugcaggcaaaucagaccuggggcucaucauuacacggccaccuccucccauacccugagagcauguucucagugaaaugaagagcacagacuuggcguguuauuuuagggcagauacgugcuaccgagagccuguaaaggauaccguacuauaggucagaugugcaccauagcagcguauacaugguauguguaaaauauauaauacacagucagaugcuguauuaaauuauaagaaaaaccgaagaggugauuuuucaguuauccuguaaugucggauggagugugccucccaggaaaugaaguuuuguguucugcuuccuuucaagguaugcuccagaauguuuaaugcaaucuaaauuuuauauugccucugacgucuggucuuuuggagucacucugcaugagcugcugacuuacugugauucagauucuagucccauggcuguaaguccuacuuuucucuucauuugaauccaguacccauuuaaaauguguccaucccucugcuugguuaacuuuuguuuuuaaauggaauccaaugaauguauuauaauggaaaaugucacuuucccauuaacuugguuugcuacuugacaguuauuugugaaucucuaaagucuugcuuucacaacgagcccggaguucuauaggaugaccuugacucucaaggaucuuaucuguguagagaugaagggcaguuuuaugggaaaaugagcaaguuaagugggguagcacuggguagggaccagccuugucugugccuccuucauuccuaaaucagaucauuuucuugggaacagacuccuugaccagcacaagcacaaggagugguugguagagucuaagacacugguuagagacagaucauugaaagcuaauaaggauuuuggauuuuuauuuaaaguuacuaaggagaaaagccuuuuuauugcuacuuaaauuuccaguugauuguagaaauuucaccuuaaucuguuuggcauuuauguaaauacuugcaaaguuaaacguuuuguuugauuuuauuuuauauaguuguuccugaaaaugauaggcccaacccauggccagaugacagucacaagacuugugaauacguuaaaagaaggaaaacgccugccgugcccaccuaacuguccagaugagguaucuaugggccacgucacaguaauaacacuccauuucuauuauguuuucgcagcuugaguuguccagcaauggguagaggggagagcgaggaaaugaugcagugaaguccuuguaaaauaguuuucugaagcugaauuucacauaagauaacugagaaaucgccuuuggggcuagaugauagccaccaguuagguucagagcaaggauucccuccaaaagccagccccucuuuauccacuugcuugccccagagggacagguuuugguguagccuuagugugacaaauacauauaauugcauuuuuuguguguaaguuuaucccacuuauuagcauuuauaauucaguuuucuaagugaauugagccuuuaauacuaaacucuugagacuguguaagacacacugaacaguaugagucagagagugaggcagccagucuggaaaguucaagucugaacugagauucugcuucacccucuaacugguuuacaggaaugaccuggauuuuauugcagccagucaacccuugagcuucucaaauguuaaaauauuauuuaugaacuagaguuguaucccauuuucuguguuuuaaacuauucaaauacucuuguuuuucuagucuuuaaggaaaagucauugcauuuccaaaauuauuuucuuacucuugauauuucuguuauuuuuuaaaguucccagaucuaacauuuuuacuguuguuacuucuuucuuuuuacagguuuaucaacuuaugaggaaaugcugggaauuccaaccauccaaucggacaagcuuucagaaccuuauugaaggauuugaagcacuuuuaaaauaagaagcaugaauaacauuuaaauuccacagauuaucaaguccuucuccugcaacaaaugcccaagucauuuuuuaaaaauuucuaaugaaagaaguuuguguucuguccaaaaagucacugaacucaua

SEQ ID NO: 14034 - RNA, 5348 nt, Homo sapiens
cugggauguuuugcugauccuaaggccagggcuucagaagccuggcuucacacgacccuccuggggagcuuggaggcagggacccaucugcuggcugugacccagacugauguaucagaagugcuggugguggcuuggagggcugcacgccugcaggccccccgcacagggccuauguggccaugggccauguuugggcacacugcuugaaguaguuccuucauuggcucacuguucuggcugcagugacaguaauugaaucccuaggagaucccagaaacugcuccaucagugugucuguugucuuccagaaugcauugaacgaaucccauggauugcuccugaguguguugaggacuccaagaaccugaguguggcugcugacaaguggagcuuuggaaccacgcucugggaaaucugcuacaauggcgagauccccuugaaagacaagacgcugauugaggugagcagguguuucccggggcgugaggcaagugagggcuuucaggugcucgugggcuucccaggaguugucggaagccuggcacugugggaagagaugggcauggguuugaaucucuucacgggccuacugggugugugaccucacaaauguaacugaacuuccgugagccucaguuucaucaucuauaaaauggggauaaucaguaacuacuuguaggguuguugugaagauuaaauaaugcauauagagugacaggcaugcaguacaagcucgauagauguuauaguauuauuuaucugagauuuuaagugccuguuauucagcaaaauuaccacacaaauacguauggaguuccuauuguguaucaggcaucaagcuugggaaaagcuggagguucacuauaaaauaagauacaggccuugccuucccuugagggccuuaggguaugguagggaguuaggcuaaaauaacaacgguaagaauuccagaaagaauaccugaaagugucacccuaagagcccugcaaauuagguaggauggugucauuacccucauuugacagaucagguaacugagacucagguagccccacuuaccuggguuccucagcuagaaugcaaaacaggcgagguguggaccuccuccaaaucuaccuguggaaaaaguggagacucuaacuccaaagggguaaaguaguaaaaaucacaaugaaagaccauugucccuucaucucagugacugcaauuggaaugugcuccuguuguuuagagggggcaggcaucaguuucggcugugagagccugguuucagugcugugucgggagccuggguaguuuggugugccuggccuugagugucuggaguggggaaaggaauaacagugaucaggugggaaaggccauuuggguucagauuuuuaaagucccugauuccaggcugcagaaccuacauuuuacuggggguggcaugggacaaggaaggauuuggguggaggagggaggggcuuggaggucggccuugggauguucuucuggaugcaguagcugggauggacagaggagagaccuggagggagacaggggccccgagucucucagcaaugggagccccauguccggaaauggcagcggaaguccagagugcagggugggagauauugaagagguagaaccuuuaugacuugccaguuaaugauggugcaggacuugggaaaggaucuuaaacccgcagggaaaccaucagaucuacagaucugcuauuuggaauuuucagccuaggcuuuugggaaauucauauuuauuuuuaacuuccuuggauccuuggaaaugaaacaacauacccuuugucaucagucaguauuuauugagcacgugcugcguacccugggcugaacagcauacagggugguguaaggaaggacccgugucuuuaauaaaauaggggucucucuccaccuaaguccccuuggguuagauggcuuuucugcaggcugcacugacgcagggaugugugagugacacucaaggacaagagcaauucucagcuccuuaauuccaguccucccuccucccuguccucuggggccugcccaccccaccccaccccagggcccacggggaccagagaggaacuuaguacccuuggaguccagcuaugaaguagaaacuggaaugcagugguuucacuucaucuuccaaaaguagcauaaguucuuguuucuaaaauuuaaaguaauaaacaguugaagaaaauuuuuaaaaugaaacuauuaaaaaaagaaaacagcaaucacugcauucuugucaucccugaccacuguuaacacuuuggcauuuugucuuccagccuguuuguaucucucuuuuuuaaacaaaauuggggccaugcuagauagaguuauauaaaauucugaguuuuuucauuuaauacugagaaugcuuuccugugagauuaaaucauaauuuuuacaaauuuaauguaagaguuaauuguuuuguuuaauuuacuugacuaauuuuauauuuggcauuuaaguuuucaaauuuccaguguucugucuaauucugcaggaaacauccuuguacauaaauauuuguucauaucugauuuauuucugagucauucagucauugaaguuaaugcaucagaggguuugaagaaucugaagauuuuuguacauguugcccaauuguauuccagaaaggcugcaugccuuuacuugaaugaagcuuuuugggacugggcuauagugcccagucuccuugaauuuggacuauucaguauuaggacugugauuuccccuugcaagaauaaggcagcaguaacaaacacuuacgaaaucuaccuguaaguggagauguugagaaucgaaugaggaauuggcaauuccaccugaccuggggcugagaaguuuguaggugguuccuuugguuucuuccaugugccccucuuguuuacagaaagagagauucuaugaaagccggugcaggccagugacaccaucauguaaggagcuggcugaccucaugacccgcugcaugaacuaugaccccaaucagaggccuuucuuccgagccaucaugagagacauuaauaagcuugaagagcagaguaagaccugccaugugcugcuuuaacccagcuuggggagaaacaggagccuggguggcaaucccuggcaaucgacugccuuucacucuguuuucuuuucucuucuguuagauccagauauuguuucagaaaaaaaaccagcaacugaaguggaccccacacauuuugaaaagcgcuuccuaaagaggauccgugacuugggagagguaaguuacacccgugcugcuugcugcugauggcagagcccuccgccauccacagcgccacucucugcacguacagcugcucuccauucuuuuucauucuggggccagguccaugagcgaaagcaccuuacugcauuugggggccacuuucaucacaagggauugugucuuucuccaugugacacacggcacggacggaaugcacgucccugccugcaugcacgacuguguaugcacacgggacucugggcagcucccuugagagacuugaguuuucucuacaggacagaagagaauggaaagagggagagaugggggaguagguauagauaugguggaauaggaaaauccuugccucugacuuucccgggcauauauauccuguaagcuucucucuuuuucuuuugcccccgagagacagggucucgcucugugucccaggcuggagugaguggugugaucauagcucacugcagccucaacuucccaggcucaagcaaucuuccugccucagccuccugaguagcuggaacuacaggcacacgcccccaugcuggcuaauauuuuuuauuuuuuauuguagaaauggggucuugcuauguugacuaggcugcucucagacuccuggccucaagcaaggaggccucccaaagugcugggauuauaggcauaagccaccauacccagcccuguaaggcucuuuagagcagggauagguuuauugcacagaaucccaaaauagagugucagcguuucuuuggaccuuaaaugggaguuuccaaacaguuaauugugacuagagaagcuacugagauuugugucuuuauacagauuuucuguagucugguuaaugaaacagacuugauacaucuccaggaucugcugugugccagccacugugccaggcauugucagaagcauggcauccuuaguuccccccaccguccccgaggccaguuucuguaugcagcgagugcaucaggagccagcuccgauuuggggacuuggccaccacugucgcugucagguggcuuggcuggaaccugaucucacgucuucuaaagacuccucaugcauuugcucuuuucagccaugcuguggggccuguccuguaacgugagcccagggcuuuuagagaacggcaguuguccugcaggcccagaaauaaccuucauuuccuguggucauagaaauugggauugaugaguugguucaucgucaccugcuacuuugucuuggcucaguaacugaggggacaguuugugaggccaagagagcgagggggcuguagugagcaaguacaguccaggugagaggcuucugccugcaaggccagacagcgagaaccccuggcccucaggggaacggcugugaggagcaagacuucuguguguuccguggccuacgauggggcuucccugauaacagcacaugcaucuuucccuccagggccacuuugggaagguugagcucugcagguaugaccccgaaggggacaauacaggggagcagguggcuguuaaaucucugaagccugagaguggagguaaccacauagcugaucugaaaaaggaaaucgagaucuuaaggaaccucuaucaugagaacauugugaaguacaaaggaaucugcacagaagacgguauguuaugcaaggcugggguccgguuuaaagauuuggugacugucuagggucauaaaggccagugcaaaacaggcacuccguggccuuaccugggcgucugacaugcuagcuggugguucccacacacucucaaggcuuccaagucauaugucaaaucccucagcagcugcagggcuccugaggaggccacccaggccccuccauccaggggcugguuccagcacugucucuccacgucacuugcacuuaugccuuaugaaacugauuccuacucuaccuccacccacuuccuguucugauccaauacuagccaggguauuucauuuucuaguugucuaaaucaaaguggcaaguaauauuuacuaauaauuguaucuuauuugcaagccagcaucuacucaugguagugaaauugacagcu

SEQ ID NO: 14035 - RNA, 9898 nt, Homo sapiens
gucacaaaugguuuuucucucccuggccccucuucucucugugguagguagguucaaauuacagccuaaccucagccaucucuguucucuuugcucaagcauaugggucacugcuuuggguuccuacaccagucagacauccacaggcucccagauacagacaugagccuaggaugagguaauauacccgauuaggcucugagccuaaaacacguuccaugaaauuaccugagccuuccuugcacaguacugugaucuaagaucuaacacauaaucaagucaugcacuuuguuucuuauuugcuauuguuacauguguacaguguccuuaggagucuacagggaagagggauaauuggcagagauuggcauuggcagaauccuggguucuccaauaaccaccuuucacccccagcaguacucucuagaguaagauggagguugaagaugugugcuguuaaauuuccuaauccuggcuggguauaguggcucaugccuguaaucccagcacuuugggaggcugaggugggagaaucaauuaagcucaggaggucaagaccagccuuggcaacauagugaacuccugucucuacuaaaaauuugcagguggguggccugagccuguagucucagacucgggagguugaggugggaggauugcuugagccugggagaucaagguugaaguaagcuaugaucaugccacugcacucccgugugggcaacaaaaaaaaaauuuccuagucuuucaugcacgugaugcuggcuugguguuuacagcuucguauuccugaaaucgauaugugccagauaucacugcagacuaguccuuauuugauagaaauaaaauaauuuacauuuuauuuucauguaaaugugacagcagcagcaauaacauaggcauucaguaaauauucuuuugaauuaggccagauccuaaauauccugaaagaaacaugacaugucacuaucuacuccuucaagacaaagauauacuuuuuuucuuucuucacuucaguaagcuggucuacaaugauggacuuuuauuuaugcaacaauuucaauacuguucaacauauugggcuuuuuuuuucucccuguaaguagaaucugauuuugaaaucuaguaguguacugacaagugccaagcuguucuaauuagguuaccuuucacauuuauaaaaaugguacgaaguucucugaauaccauuccagaaauacuaauucauacuuaccuauuuucagucuccuaaagguuccaaagaucuuaauauauguucacucagcacaacauggcugcaccaacaacuaccccauguuacaaaacaaggcaaagagaagcagaauaacucucccuaugccccgggagaaguaugacagaggugcaggguaagaggguuucugggucccagccaccuguuucacauuccucuuucaccuucuuucuuccuggguacggugaggcuccucugauggaagguaagauggcugccauccuucaguuaucacaguacuguaccuuuagaauagacagcaucagcacugugauaacugagccagggcagccugucagucacugugucggucaacggcauccuuucugguggcugcauuacucucucugaaggcuccccaugaagugaaggacuaaaagaucaccuucugguuggagacgugaggaggcagaagaaaaagaaggaucagagcccagcaaguggugaggcugaaauauuaaaaggcccaguugaauuaaauuagaaugaaagaugaacacaugacuuauccauauuaaugaggaugaacaacugcaugauuagguuuucacucuaauacaucaaauaugcaguaagcuuccagcauauuucacagcuuaucucuuccaugcauggauucacugacugugccucccugaccucaaucauugauuuuucauauauauaccgaggaacuacuacguucuaaagcccucuucuagauguucaggaaauaaagauaacuaagacaugauuccugucuucaaagugcucauaaccaaacaugacaauaauacuucauaucugccaaacauucaaaacugcucuauauguuuucucauuugguuuucacaagacgcuauggggcuggcaaugaauuauucauuaauucaucaaaaaaggauucuggaaauagauuagauauuauuaccccauuuuauaggcagaaaaaaaaaaaaaaaacuuaggugauuugccagagaucauauauugcuaaguuauggcgaacccauguccagaaccaugucaaaugagugaacacagugcuuuguuuucucuacccuacccuagcuguccaacuccaucaacuggauauucaguuuacacaaacaaaaggauuucuaaaaacauuuacuuuuuguuuuaguuuucucaguaacugagaucaugaagcagaagcuaguggggcuuuauaauuaagaagaaaaaugcacauuagcaaaaaugacuuucauuccucuugcucugagugcuaagaauguacucaaauuaguaacauugauauuuuucacuauaguuuaugucaauucuauaccuauggugauacugacaaccuucagaauaccuuuuuaaaaaguaauaauaacauauacacaucacuugcuuuuaaauuaucuguaccuuugagacguacucugaagucauuuuagggaugauucuuccuuuuaauaaaaaguacaaaagauucugaaauuggaauucaggcaucagaauaucaacuuauuaaaaccaugauucacuuggguuuuuuccaugucauaagguuucaaguuauuucaauaugaguggaacuugacagauauuugaaaaauaauuauguuuucauuaggcauuugcucaauuucaaagacucauuauaugcauauuagauauuagcacuguacuucaaauaagucagguagaugaaucaauucuuuagaucagcagaagucagaaaauaaaaguacagugaaucuaacucaacuauuaacuuuacguacuaugaaaaugaccuuaucuucagaaaagcaacauccaaugaaacaauccaccuacacacaaauuaaaaacaacauugccuaaaaugcaaaaauaucuaaaaauuaaggaggucaucaucuaggucuuagccaacuguaauacagaguugaaacacgagagggcaacgaagauuaaagaaaaaaaaaaaaucacaguuggaucccauaaccuaagguucuuggaaauaguugcacauuuuuacccgaauuauaaacaucugcuacgugaacaaagauacugugauuauuuuagaguaaaauuuuagauagcuguuccacgaaaaaggauaagauuaucaacuaauauuucuugaccacaauucugucagcuuuggaaaacugaauacuuacccugaaacacugaagguuggguaaguauggagacaaauaaauaauccugacauauuuguaguuauuagacuguucuucaccaaaauauuagugugauucaaugucuaaauaugaaguauaaagacgaaggaaguguacugcaaaguugaaauucacucuacuagccaucaccaaaacccaugcaacaacuaaacauuuuugguaaaguaaaagauacuuccuuuuucuccuuauuuuucucucauuucauuuuuuuaccuaaauuagaaaaaaaaagaagccaagcaucccuaauaacaagcagcaaauugucauuauucugugaaugguuacuuaaauuaauauucucucagauucuaaagcaguuucaaggaagaaaaauauggguuuucaaaaugguauuuuuaaaauaaauguuucaaaaaugugucuugcuuuuucuugaaaauguuuauaaacgugcauuuuugaaaauuuaaauccaucagaaauauuucuucuucaacauguuucgucuaagaacugaacugucuaaauuuauaaacaagugacuacagguacucaugcuacaguaagaaaaaauaacugcauacuaaggaagagagaaaacagugauguaaaaugcuuucuuccaggacccaaacugauuuuaaacuacuucuucuauguuaaaaaugauacaacuaggaacaauuucuucauaacgcauauaccaaauauuaucuacaaaaccaggcacuuauagaaaacuggcacaccaaagaacuuuuaaaauaacguggaguacaaggccaggcaugguggcucacaccuguaaucucagcgccuuaggaggcugaggcaggaggauugcuggaauccaggaguucaagaccagccugggcaacauaguggaagccugucucuacaaaaaauaguaugagcagggccaguagucccagcuacuuuggaggcugaggugggaggauugcuugaacaugaaaggcugaggcugccaugacugcaccacuacacuccagccugggugacaaagaccuuuucucaagcgaucaaucaauguggaguacaaauaaaagcacaaaaaacaugcuacaucccucauauuuauaaacuaagaugaaaauauuguuuuaaaccuuugaauaucugauuauauauuaaauaacugaaggcaccguaaguuguuggccaagcagaauauuugaaaauacuuuuaaacuauaguuuaguguauuuaaauccacuggucuuuuaacuagugugauuuguuuuccaauuugaaaauuaucaucuaauucagugauacuauauaaaauggccaaauuugaccacacugagauguuauaaacugucagcaaaaguugcucaaauguccaauacugcuuugucacaaguacacagaauguauacuugcauuuuauugcaaaacuuugcuauacugaguuuuuaaaaacuaauuugugccaaagauugaugagguggcagguuacagaauuuuuuucucuuuuauggaaaaagaaauaggcagaaaggcaagaaaaugucaaggaccaccgcccuauacaaaguuagccccaauucucaaagagaagcauuaacugagagugauuagagaagaggugucaucauuuuacugacuuugagcacuggcccuaauuaaucucaugcuauguaacuuuauaagguccauguggacgaaaaaaaaacccuauggacacgguaacaaagagaagacugagcuuucuuccucauguugaccaagaguuuaguccaaaaaggcuccaggagacuaaaaauuuauaaauacaugacuggcccauauauuacauuauaugggccucuccccuucaaacauguacucagcacaaauauuuuuaguccaacuguauacuccacaguuaauuuacuuucugauuuugcucuacaucacauuucaccacucucaccccccggauuuuagauuuuaugguuugcucacaagucaguuuuauaugccagcuaacuucggaaugauccaccccuggcuaaacaucucuaaaaacccugauggucuccaauuaaucuaugauugccuuauuacuacagcacugccauuugaaaaugcugggucucagauuuucaaauucccuuaauggacagcuaaaggagccaauaccaaagacuugcaaugaccuccaauucuacagccuugggcuguuccaggaacacaauuacacuccacuucccugcagguuccacccuucucgaagcuucuauuccuacaucuguaaaaugaacacauuucuacuaacuaguaacacaugccacaguggcacugcacucauuaagugcuguguuguauacugcaauuuaauuuggugcuguuuauaucuuauuuccucaagucaacaggacucuuucuaaaaaagucagaaacuguuuuacucaugucccuucacaacacuuaguggucauuuccacaaaaugcuagcucaacagauacuugauugauugauuaauugaugaaccucuccauuucucagggagccucuaaacaguuaucaacaagaguauguuuaauuccagucucugucuauauggucuuaggugagguguuuggcaguuugucaucuauaaaauaaagggauagcaccgaauagcuccuaaguuccuuccagugcaauuucugaaucucauuagacaaaacaaaacccaaagacagcacuaccucuauucacguuagcauuguacuuuuuuuggaggaaaggagucagcagccuugugggcccaaaugccacgaguggagccgugauuugguggggagggggacagaaaguagaugaagcaaagaaaaaauaaauggaagugagugacagaugaguagaaucacuaaaaugccaccaggugucacaauuguuacuuugccacacauuguuuuccgguaccuuuugcuauguucaggauccuuuuacaaaagcagcaauagccggguauguggguaucccaauuuucccaugacaccccugcuagccguucuagaacccuggacuuuuacacuaaucucccuaauauaacaguaauaauguaauacuugggguccccaaucaucacauggaacacagcaguggaaaauagaaacacaaacaugaaauaacaauauuucauacagucaccacuuuugaaauuaauccauggggcuaggcacaguggcucaugccuguaaucccagcaguuugggaggccaaggcggauggaucacccgagcuuaggaguucaagaccagccuggccaacguggggaaaccccaucucuacuaaaaauacaaaaaaucugccgggcgugguggcacacaccuguagucccagcuacucuggaggcugagacaagaggaucgcuugaaccugggagguggagguugcagugagccaagaucgcgucacugcacuccagccuggaagacagagagagacucuaucucaaaaaaaaaaaaaaaaaaagaaagaaaaaaagaaaagaaauuaauucauagaugaaaaggaguaaugcaggccugagcuguccaaugaaguauauaaugcaagcuacacauguaauuuuuaauucucuaguagccacacuaauaaacagguggaauuaauagcauauucauuuaacccaauauaucuaaaauauuaucaucugaacauggaaucaacauaaaauuaaugggcuauucuacuuuuuuugcauucuuugaaaucugaagauuacuuugcacuuacauaucccaauucuaaauuuucaucaaaauacuuaauuugcguuuggauuucaaaacacuuaguuucaaaaguagaugcguaagcucaaguauguuuccaaauauaaauaagcuuuccaauaacuaaaucaaguuaucaaagucuaaaauuaaauaaaauuuaaaauugagcucuuccucacccuagccauauuucaggugguuaauagccacguggcuaguggcuaccauauuagggcagguauccugucucugucaccuggauucuuuuaaacccgaaccagaguaaaagauguuaccccaucaaccagaaagucaucuuacagcacccaccaagugcucaaauuauaccaaguauuuucugcuccacuuccaaucuuuaaguugucaacacuucagugauuaucguuuauuagguagcccuuccaaaagacugaguauuuuagcucagagaggaaagcauaucucaauucagggacugaauggagacacugagugagauucaaagacaagaaguuaauuuccaagguagagguggaaaauccugacauccuuacuucuuuguccaggguaucagucaccuacaaaaguuacaauuauuguuuaucacaauuauuguuuaugagccucucaacuuacauacucacagcagcugucacugcauccucagguucucugucuucaagugcccuccuagcuuccugaaacaaccuucucuaucuagagcagauucugcagagaggccccucuuuaauucauauucugaaacgugcuuguuauuguugacguacaaaaacuuaugaauaauucaauaaaugaaucuugaaccauccuauuuaucauucaguggucuagguacccaacucuagaggaaagcuuuucugaaauacacgguaaguaucccccaacccucccucaaaggaaccaauuaugaacacuauacagucuucucucccuucucacuccccaugucaaaguucauuguguuccuccugcagcugauuuaaaaguugaucuuuucaaggagcuggauuccuaagguaguucuauuuugagccuucuuccuguucugaagcuaaaguuggaagggcuuagguggugaugucauggaagggagacuguugguuuuuauaggagggucuucucuggcaacucuggggaugcucaaauggggaaaacucagaguguuacuuuugaucuuuuccccccuccuucccuuuauagaauaucagcuauuccuuagccagcaagaaaacaaguucaaauaagccugcaaacagauuuacauauuuuacaugcuaaacaucuaauaaaugaaaagacugagaaaaagaaaaaugccucacuguaaggaacagagggugacaaccucuuucuccaccccucuccccaaauaucuaucacagaacaaggggcaaagaggaggggagggucgacugguaagcagaauaaagggauuauaaagcuaggaggcuuuuagagggaaacgcuguuggaauauucaggacaggagacccuugggucccugcucuuccucuguguuuuccucccuuuuggaaugguuagacuugggcugggugugucuucugcuugggaggcguuuuuuuuggcgcuggaaaagcaaaaggggccaggguggggccuggggaaagaaagccagagacaggcugcuuaggccuggcucuggguuaagcuuaaggggaaaauaaagggggcuacggagggacagcagauuccauuagaagacccagaggggaauaaaaaacagcgcacuggccaaagggggucacuucucucucucccucaaccuaggcccaggagcuauuugcugguuggugggggacagguccagagggaagagaaaaucccaaaacaucugcagaucacaacuugccgggggaaaggggggcuggggacagacaugccaaauuaaaucagcaggugaaagcagcaauuuuuggccaaugcugggauugcggagaggacuaacuaagaacccuggagagcaggggauucccugguuucucagcucaccucuccuucaaagcagggauaagcacagguguggucuuucuccaggaagguggcagcuggcgugcggguagcagagugagggaaagaauuccucgcacaggaaggcagggagaagcccuggggucagcugcggccaggagccggcgucuccgccaaguccccucccccuuccugaaaaccgaccuggaccagcacaaauuacagcaaagcaccccucuccccaauaauguuucuaauaaaagaaacagacucucaugccuauauuaaaaaaccacgagcucuagcugauggaaauaaacaggugagcccggggagaagcgggaaaacacugggaaugggagaaugaagggggagaaggcguucccgaacgugcagagaaaccgaggcuuccccgcccucccuccacccuccuccccuccggccggggagaaucugcguggcagggugcaagcuaaaaaugccacugacggaccccucuucccgccccgugcccguucucccuccuaccccagacuccagcgucccggccucgugguagcgcccgguccccggcgccgcgcggggcucgcccucucuccggaccgccgccgccgcggggacuccggucuuccucucuucucccucccuccuccuccuccuccggcaccgccgccuccuccucuuagacuccucccgccggauccuucauguaaacaacauccaggcucuauuuacagucgccgc

SEQ ID NO: 14036 - RNA, 163271 nt, Homo sapiens
uucuaacgugauguuucauuuugaggcgguagcacggugugaguaaacaucgucagagucuagggcucuggaauuucuuuagcgcugugugauugugggcagaugccuuacccucucggaguguggaguguaugguuuguaacagggagauaaaacgggugagagcccccuaggacuccuguguuaauaaagggugcuaacggugccccccgagugagcggcgcgggcccgcgcgcacccgcacgccucgggcgccaggcgccgccgugugggcggagccgggcagccuccccugucggcgccagccacggcucccggccccaagcuccgcccccggcgcgcaucucccagcagcggcccggcaccuggcagacgcgcggcggcggcggcgagcgguggcgcucggcucgggcgaccgcggcgggggagggcgcggcgcaccgaugggcgccacugagaagggaggccagaagagccggaagcuguuuuccuugcggcggccguggaaggcgacccggcggcuguggaggccacgcucagcucgccaggcggcgcagggugagugugggcgcggccggucgggaccuguuacccugaggcaggggcgcagcggcggcggggccguccccggcggucucucgggucgcguucccggcccugggagccuggaugccuaggcgacgcccgaacccgacccucggucgcggguaccgggaccgcuggggaagcgcaggggcugaugucggcacagucuccuuuccucuagccccugcucguugcuuuggcucuggacacagggaagccacgguggcgcggcgacacagccucacugagguuagcuuguccccggcccccagcaccuggccuggcgccugcaaugcagugccuacugggggaaugaaucagaacccgaggcucccuucaagguccucccgcccuguacccaccuccucucuaccugccugcggugauuucgaagcucucgccacgauaaacuauuuccaagcacacucaguccuguccucgccagggccucaacucacagccaaucacugacucacuccauucauucauuccacaauuuuuaucgagccccuccaucugccuuggccggagaacacgaugggcaaagcccggaucuuggaacuacuucuagagaggaagacagacauuacacacgcaaaacagagaaagcccgguacacauugcuaugugcgcuuagagggaaucagucugcugacagaggaaaaaaggcagguccccgagcuuccauggcaggcggacugggaaggccucuccgaggcauugcaagucagcggagacccgaggacugacuaggaguuacucuagcgugaagccgaguaauagagaauagcaaguggaaagguucccagagugccugaauugagcaaggggaaagagagggaugcagggccuggaucgaggucugggcagaacaugaagaggaguucggauuuuauucuacgugagcugggaaaacacugaagugugcuaagcagggaagugaccugaucugggggcucccggcuuuucucugucugcaguguccaugcucgcaucucagccugccggauuccuacccuccugccaagacuagcacaaaugcagucuccucgcugaaaucucugugguuccugccaccuguaaccccuccuuuagcauuucgucaccuguagagcguuugucacuguucaucugguauuaaagauuccacauucucauccauuucaucuuugcaucccccacgaggcuaagugcagggcuugguacuguguagauacugcuuaugaaugugucuugucuuguccuuuuugucuguuuccaucaucugaggauccuuccucugggggguugacaugccuuauuucuaaaauggccgaccggaugcagggcagagccagauugcaccaggacccugccaucgauauagucccccucacccacccccgguguuuugaggauuaaauaaauuaaugaauuaaacgaguuaguaguuauaaaguguuagcaccuauuaagcauuauaaaaauaaauuugaaaaugaccagcaauaauuaucuuucaaauauuuauuuauugcauuggaaacaagcuuuucuauuggugguuguuagggagacucugcagcuugucauugucaucuugccggcuuuuaaguauguguuccuacuuuuuaaaagucagugcaccaacaaaauucuuuccauacugucaucaagaacuauugcugaggccgggcgcaguggcucaccccuguaaucccagcacuuugggaggccaggcggacggaucacuuaaggucaggaguucgagcccagccuggccaagguggugaaaccccgucucuacuaaaaauacaaaaauuagcugggcgugguggcauacaccuguaguuccagcuaccugggaggcugaggcaggagaaucgcuugaacccaagaggcagaggcugcagugagcugagauugcaccacugcacuccagccugggccacagagugagauucugucucagacaaacaaacaaaaagaacuauugcugaaacuuaauagggccgaaggcugaccacuuuuuaucaugagcuugaaugagaucgaugauugcaacaaguauuccuugagugauaauuacaugcauaguguuauuccagauguugugugaaugcuuacaaaagaggaauagaugaauauugccacuguaguaacuuggauuagaauaaguguucuaguuuuauaauuuuuauuuuaauuuuuaaaaucuuuaaaguuccgggauacacauguaggauguucagguuuguuacauagguaaaggugugccuuggugguuugcugcaccuaucagcccaucacuuagguauuaagcccagcaugcauuagcuauuuuuccugaugcccucccuccccugcccucaccaccacgggccccauuguguguugguucccucccuguguccuuguguucucauuguucagcucccacuuauaagugagaacaacugguguuugguuuucuguuccugcauuaguuuuauaauuuuuaaaaccagaucuuuagugccuauacaaccaucuccgcuucugcguuccugaccuagcguuuacucacagcuucccagggcucauugccaucccacaccucucuuuucuuagauaggaucuuggcugcucacuacauuccucuacuaucuaucuuccccuucccccauaagcccuggggauaaagccauuauaauaucuaauguuacaugauacuugacaucuuauagaauaguucaacuacaggauuuuguuuagaucuugacaauacuccuggaaggagagagggcagauguuauguauuucccccauuuuauauauaagggaaggugaaacaagcggcacuaagugauaugcuggaggucaugugacuggugagugucagacucaggccugccuaccuauacaacaugcuuucugccacaucucccuccacacaugaaaaaacauguuucaauagcuauacucauggaagagggaaguaaaacgaauaaauauuaugcaauaaaucuauaucucaauuuuauuugauuuuuuaaaguuaaccugaauuucuuaugaugauguuaacaucacuuugggcaucuagaaucauacacuuugacaucacacaggcuaugauuuaaaucugccacuaauaaauggcacauuaauaaacugugugauaucagacagcauccuuagucuuucaaaaauggaguuauauauuaucugaaaaaugaggaugacaauuccuaugucauguaacugugaugauuaaaugcauuucugguacauagagguucacaaagggcugguuauuuuuaaauuaauauuagguuuacuauuguauguauuaauauuaauaaaacaaaaccuaauaugguugaaaaucuagacuauucuuagaaaauagucuagaaaaccuagaaaagucuagaaauuauuagcaaaccauaauauuaauauggcugaaaaucuggacuacuauuaguauacuauuguuaguauagaauaauaauagucuagauuuucauaagaguccagacuacuauuagucuagauuaaugcuuagucuagauuucaaccauaugaucacacucaaaauauguuuaaaaguucagugugcucugggaagcaaccacagcuggaggcuucuuugaggaaguuaacccuucugggucaaccagaaggucuucugcagcagcauccaucuuucuaccaccuucuucuuuuucaucaggaggcugcaggggagaaggaacauagcuucuagggacuccugucaucuuuucaugcuaacacuguguccugaacauagcagacauucaauaaauaugucuggaaugaaagauuccuuucauuuauauauauuuccaaagagaaugacucugaaauuuacacugugaacauuugucacuaaaaauauagcauaaauaucuagaaggacaauuacugcaucaaaguguauauauauauauauaguuuugauuuugagagauauugccaaguugaccuuuguacauuugugcuaauucaguuucugccaacaguguguaagcuccccgauuccuuacugaauauggucagacuuuuaaaugcuugcuaauuugauggguaugaaaugauauuccauguuguuuuauauugaauuuucuugaugaauaaugaagcugaguaucuuuucacaugaauauuggccauucuugugugaaccuuugugaaaggccuauugaugucuuucucauuucuuuaacuuggguuuuuuuuuuuucuauccauuuuaggaacucuuuaaauauucuggauaugaauuauuuguugguuuagaggucuaaacaacuuuuaaaaauguacuuaaucaugccaguaguucuaaaugggaauaugaacaagcugugcugaguugaaauuaacccuccaaaugcuuccguccauuccagagaaccauauuuuacucaaauaucaaaguccguagguuacagaaaagggagcaaaugacaaaagcauuuuaugagcaguagacuucucuagcccuugaauuaugguagauaacuggccuugaguuccugccaccagaaauucccuccucuaaacccuguggugguugaggagcccuuuccugagcugugguauucucugggaagacacagguuggaacuagagucaguuuccaucaguagauaguauuuugcagaacaauuuacuuggagaagaaagaggacagaauuucugucacgucgaucagugguuuauucucucacugccauugucuagccauaugucccuaaaaauaagccacauugaauggauguaaugaucccuacccagccuauuccuaaggauauuagagagaucaaaugagaccauaaaaaugaaagggcuguguaaauacaagguuuguuagccaggcucugggaaguaaccaacacuuugucagagugggaaaaccucacugacccacaaucuuugggucuguggcucuggcccuucuccuaccaccuguucugcauacaggugcaugauuguagagagcugugcuucuccaagguuggucuccagaccagcagcaugagagcagcagcaucagcaucacucaggaccuuguuagaaaugcaaauucuaggcccccaucucagagcuaccagaucacaaacugaggggugggaggauggggagggauaggaggcuggaaccuggaaauguguuuuaauaaacucugcaguaauucugacacaugcuaaagguugagaaccacugacuuaguaggaugagcaaggguuuuacagccagcaaauguggguuuaaaucucaacucuccuacuugccaacuugugacauguaaauuacuagaccgucuuggguuuccaaccucucaccacuaaaaggaagaccgagugugguguagcaggugaagccacucuccuuccuucccauuuccuuuacaggacugugugagaaauaaaugacaugacgauucuggacucugcuguguuuagcugugugucuccuuuggcaagucuccuugccucucugccucauuuuucucaucugacaaaacaaauggcaagaguuaaugugugcauugcuuuugucacacuaugugccagccacugucuuaaagaguaugugauuuuauuuuauucuuacaauaaaccuguuuuacagcuuucauuuuacacauaagaaaaacugaagcagagagagguuaaguaacauuuccaaaguuauacaacuaguaaguugggauucaaacccgggaggucugcugugaguccuugcauuaaagacaaugcuugccaaguaauaaguucucaaaaaauggaugaugaugaugaugauaagaaaauagccuggcauauaguagguacuccauauaagccaugcugcccucuucuguggcuagcccuaauccuaaacaucuauccccuccccgcaguaagcacauuuucuuuuuccuucucaccucuuuucuggccauuugggugcucugagcaagccagacagaggcuuggcuggaugcagaaagaccaaaugugguguugcaggugaagccacucuuugggaaugaaugacuaagcuagcagaagcucuagacaaguuauugaaagaucauuucaucugccuaauuuggaauauauauucugggucucugcuuaccuaucaacuaaucaagaauuaaaaugccucaaaaguuccaagggaguguaaaagcuuuuuuuuuuggugcccaguuuuuccucagaguaaaauuugcagcugggaaaguuuaauccacaguaugacagcaguguuuuuuuccuuucauuuuuguuuuuuugcucagacaauaaaaagccuuauucccuuucaauucaggguuucacucguuguucuugaaaauucccuucaguuuagcucucaagauggccuugcuugcugagcaugagucacugguuuagugacucagaguggcaucuaacaagacaaggaugugcaggguugucaagggacuuaguggccaguggagccugccugaagcuuuuccuaaacccaguuuuugagauagagcaucuuuuccauuagcggcuguuccuaaucauccucaguaccaguuuaucugaagcuuggggucugacagagacauugccuuguuguggaaagcucuagaauccauccuuguccuuaacuggauguggccuugagauuuacugugugacaggacaagacuucugagaguucacccagcucugcuuggaacggccgcagaaucaggaggccugugcuucuggaaauauggugucaggagggaaaauaaagccucuuuuuauuugaugaggccuucaaaccucuuucaacuuuaggagaaaaaagaucaauuaaaguuggauagagaaacagacacaugugaugaagcaaauauacccaaauauacuuggauauggggcccacuguacaauucuuucaacuuuuugauauguuugaaacuuuucaaaauauaauguuugguacaaugcagauaccccuagaaaugacuacacuuuugaaaacauuauuccuuuugcaauauaaauggguguuuuccuucccuucucccacuucuuuucuacuccuagcauuggucuuuuuaaaauuuuggucuagggagccuucuugauuaaaaagggccuggaauaguuagaaagaaugaauaagaccuaguacuugauagcacaacaaggugacuagagucaauaauaauuuaauuguacauguuaaaauaacugaaagaguauaauuggauuguuuguaacacaaaggauaaaugcuugaggggauggauacuccauauuccaugaugugauuauuauacauugcaugccuguaucaacauuucucauauaccucauaaauauauacaccuacuauguacccacaaaaauuaaaaauaaaaaaauuuuaaaaagggccggagugagggugguuggugauuggcuauuccuuuaugccaaagacuucauauucuucuucauauguaauucucacaauaauccuacaaacuaguuauuaauuucuguauuuuaugaggaaacugaagcuuaggggaauaaacuugacccaguuacaagguaauacuacucaucuuacagcauuuauggagcccuuacuugaugugucaggcuuuguguuaugaaccuuaaaccuauuaacuuguuugagccucaccaagcuguggaagguggguaccauuauuaccuccauccugcagaucaggaaauggaaacuuaagagaggcgcagcaacuugucucagcuuauauuccaggggcugguacauggcagggcccauguuugaauccauucucuuuauuuauuuuuugaggcagggucuuggucugucacccagggucuuucuugcucuauugcccauggcucacugcagccuugaccuaccagacucaagcauccucccaucucagccucccaaguagcuggaccacaggcucaugccaccaugcccagcuaacuaaaaaaaaaaauuuucauagagacagggucucacuauguugaccaggcugguuuugaacuccuggccucaagcgauccuaccaccuuggccuccuaaagugcugggauuacaggcgucagccaccucucccaguccucuucugcuuuagagcucuugcccuacuauucaaauccacgcuuuggcauuucuuugccuacuuugguaaauuggcauaucuaguggaagccucuugaccugaggccacaggcuccugaggacagagaauguuuuguucagcaccgugucauuccuaguguucauagcagugccuggcaccaugaauauuauugaauaaaagagugcaugaaugauggcuucucaccaccuacucccucaccuucucagccccccaaagugcuccucuugggcacauuuuggcuauccuggacuugguccuuggagauaaagaugccgguuucucugaugugguuuagccaaugucgcauuugguggccaguaaggaguuguaaugaaggcagauuuuccuuauuggucuuaagcugucaaagacagcagaaagauauuauccacugccaaggaaagaugggaaccaaaaacaaauacuuaaaguuucccaaaacuuucaaggaaucuuccagcuguggcaacaagaaguccuuaguagccaugaaagcucucacauuauagcuauguuugacucuuggguugaaguaaugaacaggugaacacugacaauuaguccucuuaaaugugcccaagcaguugguaauuauacccugcauuuauuuaguguuuuguuuacaaaauucuguucucccuuuugaugauaugaacagcccaguacauauauaggacagcuaugauuauucccacuuuacagaugagaaaacugaugccagagagguucugucauuugcccuacacuacgcagcuaauaaaagguagagacaguagagacaggucuucaacccuuuuaaugccuaguccaggaaauuuuuaauaucaauauugcauuuaacucaguaauuucugaggaugaguaacaggaagauguauuccuuucuguugcucuucuuccaauuuaguuagguuauguauuugagucaguuagucuuucuggauaccaguuugcuaaucuguaucauggggaauaaacaccauccaucagugaguaugcaugaagcagaggagacugggaggguucagaacuuaaaaaacaauuucugagugaagcuguuuggaagagacugugaugacucuuaccuauuauccauaaaacaaauuaaauggcaccucccuuggcaacccuaccuaaaauggcaccccuguuaccucauuaccauguuucauuuuucuucacagcauuuauugccauuuauuauaugucuauauuaccugucugaauccucccaccagagugcaauaaccaagaaggcagggaccugaaacccuaagagguggaauagugccuggcacaaauaaccacguguugaauaaaugauugaauuaaugaaugaaucugagcuguggaaugauucaaaguaaguuugaauugaaugacugaaagauuuacuugaauccuccuugcuccccaacagagggguguuaugguuuggcauccucauacauauuccuagucugccacucaauggcuuacaaccagucacuaaagccuccuugaguaucaacuuaggccugggugaaauggguucaauaaccuguguccaugcagcagacacagcccauuauauugcccuguaugccucuguacuguaacagccugugagcagcgugaggaccgagggcugguccugugcacuguuguauccccaguacuuagcauacagccugguccacagagagguaaaauaaauguugaaugaaugaaugaaaguacagggcucugaauccuccuccaaagcugacuuaccaucugaaaauaaaccuggugcauggcacagacauuccccuuucaauucagagaugaggaggcgcuaaacaguugguucccuauccugagggaaggaaaggcaagccucggcuccagauccgguuccaugccauguuuuggaauuuguguuuacgucugccuucauccccauccuuuccgcuccagcauaagcaaaauuauaaccccgcacaccgacuugcaugcaauuaucauagcccgagugcuccuccguugagagacuucgcccccgagaccgcugacugugaaugacaaaucaaaagucaggguugcagaaucagccggacuuuccugcucauuugcagcagagggaggaagcagagaaugaaagauucugaaaauaaagguaaggggcggacugcagaaagauggcuaagagagggcuaaaggcuaaaagaugcuagggaugcgaugucacuccacagacauauuuaguuuguauuaauggcuaguuuaaaauuaccauaccuauauuaacauucuaguuauauaauaaacaugaugacuuuaaaaaaugacuagcuucuaguuuccaaauauugugucauucagcuuuccauuuuuauaguccuaaauauaacccuauuuuugcauucuuaaucuuggcugaguaacacagcuuucauagauuuccuuagacuagcucccagauuuuugauaauuuuauuuuggggguguucacaauaguuaauaaugaauauacagguuuucaaugcauuaugagaauuggaauaucugaaauaauugggacuuaaaacaguuuggguucugaaggcaaacgcugacggagaauccuuuaaugaacauuaaucuuuuuagaagcgcuccauggggagccgucgcugaccuucagaacuguuuaucuugcaaagaaaugcugggauguaaacuacccccacuccaucagccuccacaccuuaccucccccucaccucccaacacucuaauucuguuagagggaugggggaagagagaaacgaauuuaaauaaaaacucaaaaaaggaaagggcuaaccgaaaaaugagccaaccaaauuuuaaguucaacaacaagcauucuggaggauucugggguuuuaaauucggaggcuccuuaaauauucugccgcaguugggggaggagcgauggaccccuaggucuccggaggcuacacguguuccccgaucccguuuccagggggagcccuuccuuccuauugcgcuggucgugcuccuggcccgcgugcccaggaagggcgcagcggagucgcgugcccguccgggcggaggacgccgucuccgcgcggcggugccgggccccugcuuccggaacgcuaauuuuaggguucgccggccccccuuucuuuucacccgcuuuccgugcgagccgcugcgcagcagucugcgcuucgagugcgcuguguuuuaaggaggccccggcgcuugccccuugggcucgggggcuugggugcgcaggugggggcuggcacgcagcccguugggcagguuucgcgcagcgacccuccccacgccggagcuaaguucuuugggugagacgugcaacaacgcaggccccaaagcucucugcgcgcagcgccgcggggcuuggccuucuccaguccucgggagucagccaccgucucuggcuuguuauaggauucccaccucguggugggcaaugauauauacauauucaacauuagaaaaagaaggaaaaaaaaaccccacucacaaucuaaugccaauggagagaaugguauuuuaaucuacgaaacuguaaugaaggcucuuaaacaaucccacuuuccauaauugaggcuuucaaaagggccagguagcuggugguguuuguauuaacaucucauaggcucuggaucauucacagccacguauugaucuaugugguuuugacguuuaaauuuuaaugaagcagccuuaguggggaagaaaacagcuaugcaugugccugguaagggggaagaggaccuguucacuccuguuucuaagccagcaucuuaagaguagguauuaccugugugugaaaucaaaguauuuuaaaauuaacucuaggaagaauguuggauuuuccuguguuguuuucagugguuggagaaaggguuucuggagagaaaaaaaaaauugcuuauuugccaagucaugcuaggccauggacaugauuuagaaaaaaaauuaaagcugcuugaauuggaggcccagguuaagguuaauauucaacauuguuugaaauggaaacacuccugguuucucaguguaucaguguguuuuaagcucagauccccagccuuuuucuaaggagaguugguauuuagaauuuuuuuuuuuuuuuuugagauggagucacgcccugucgcccagguuggagugcaauggugcgaucucggcccacugcaaccucugccucccagguucaagcgauucuccugccucagccucccgaguagcugggauuacaggcccaugccaccacgcccgguuaauuuuuguauuuuuaguagagaugggguuucaccaucuuggccaggcuggucucgaacuccugaccucaggugauccacccgccucggccucccaaagugcuggaguuacagguaugagccaccgugccuggccgguauuuagaauuuuuguuuuacuuuguacugggaagagccuuggguugggagucaagauugguaggcucuggcuuguucaguuauaacucauuugugaccuaggacaggacucuauuucuuugggucucaguuucuuuaucgcuaaaauggagagcuauuagacuagauuccuguuuuucagauugugaguggugagaaagcaacuuagugagucuuaggcaacauuuuagaucgaugaaauagaacagaaacugucagaaaucauugcacauagcagagguaacuacuguuuccugaaacuucuguuauagauauuuaucuuuaugcauguggguauaagccguauucugacaucacaucgguuuuuuuuuuuccugugaguuucagucaaagaaguuugaggaacacugaaauaaaucauagcucaguaaugguuuucaaggagucugugaaaugcagcuuuauaugcauauauauacagacagagagagagagaaagagagagucaauaguuuuccucagauuuuuaaaggauucuaagacuccaaauagguuaugaauuacuguauuucuaaggucccccaggccuuuuccaagccuaguucuuugagagcaaaguaucccuuuagggcugcugggagauggguauguguugacagagaccagauaaguguauggugugaggugguguguguguguguguguguguguguaggugugaccauagcaaccagaccgugagagccauuccugggucccaaauuaccaguugguguccugaauaugagacauaaaaacacuaaaaauuagagucucuguguugaaaaggaccacaacaaaacuauuaaaauauuaugaauuguuuggaagucaauucuuuuuguaaagacugaaaaagagaaucagguaaaauuauaagagguugauggggcaaagaaaucaccaggauguugcagguucagaaagugaauuuuuguaagcuaccaucacaugagugguucaguaaauguugacuugugccuuaagaacugccugccugccuuuuccaucuuuuuaguucaucuuagggacaauucagugagguuuuuaaauacaaaagacauuguguaacauugaucuagcauaucucaaaauguuuugcaagccaggaaaaagaaauuaaguauaaggcaacuaaaaagaaaauaguugagugaguuaauaaguagauauuggcaaacaugacagcuaauuauaacaauaagaaccauagcuccuauuuaauuaacaacuguuaugugaaaagcucucugggaggugcuuuacauauugucacaacacugcaagguaggugguauuuuauucugaagaaauagauuaagaauuuuguacagggauacauagcuaguuaauggcagagccaugauucaaaaucaggucuuuuuuuaucuccaaaaccauucacaugguaggcaaguacuugaaaauaaguagcccuguacucuguaaaauuacaguuuuuaauaaaauugucaacauuuuuagaauuaacuuaccuauauaaaaagggagaugugaaccuuagaaaaugauggcuuuugacuaauuuuuuagguuguuuuuauuuggaaaacagauauuuuaacucuucaaauucagcuccaaauuuucuuuuuacuaaguucuuugaguauguuaugcagcaaggucuuagaggcacaaaauaauaagaaugaagacugaaaauuugggugaauuuuuuuuuggucuauaagaggucaaagaaaauaguucucauuccaauuuuucuguuauuuuucuagauuuuauuuuaaaauggcaaacauggcauuuguuuagcaaacaaaguuacacauaacauuuuaauaguaggauuuaaaaguugucaugacugggcgugguggcucaaccugugaucccaacacuuugggaggcugagguggcagaucacuugaggucaggaauucaagaccagccuggccaacauggugaaacccccucucuacuaaaaauacagaaaugagccgggcaugguggcaugcaccuguaaucccagcuacuggggaggcugagacaagagaaucgcuugaaccugggaggcggagguuucagugagccgagauagcaagacugcacuccagcuugggugacagagugagacccugucucaaaaaaaaaaaaaaaaguugucuaugccaaugguuccugagauaacuuuucacuggaaguuauuacaaaaucuaauuggguuugagcagggucagauucagacuuuuaggcucuaaauauuaaaaaauagugugguguucauccuccaaucuguaauucaaaauaaguguaaaaaaauuuuuaaaaaguugugauuuuucuuaaacaucuugacuacuuugauacuuuuagagaaaacucaaauucuuucaaggauuuuugucacugcugcaugugacugggugaguuggugaaaugauacuuuagcuggggugaucuguaaaugacugagugacuucucaaagcuucagggguagcaugugguuaagcugggauuagagacuggucuaugccagugguaaucaaugggucugguauugcuuuuugggcuacacacuggaaaucugcagguauguuauuugauggucauaugauugaggggcgcugccauuggcagaaacuagaaaugauagugcccuccgguguucugggcuguuccauucaaugaugaauuagcucauguccugugcaauuuucaaauguuuugcugaagauguaguaaaaccuucuauacuuuucugggcuuagaacauaaauugguuucacuguacacugaaacuuccaggauuaaaaaugcuguguaaaucuaaggaagauuauacugaauuuuguucaggaaaucacuuacccaaagcaaugccacuuguguuuuagacaccaguacaacacaccugaaucauaaaaucuauauacaagugcaaguagcuaccuacuuaauuauguuuucuaauauagucgucugagcauuugcauauugaaauacauguugcuuuauuguaaauaacuuauuucacuucucuuuuacauuacaguugaaacguauauguauauauauauacauaugcauaguuuaauuuuguguuagguuauuucaucuuuaaauuucauuuugagauacuaaacaagaaaauacaaaauauuuuuauauguuacucagaguuuaaaaaugacuugauuuuuaccccugaauguuuuaaaauaauuugaaccaacauuaaaacuuuuggagacuauagguucaauaagguauuuauggcuucuuuaauaaagauuagagcagucugcaacaaugagauugagcugaguauaaauuacccucuuuaaagggcagauauacuggguuauaaggguuauaaaucucuaaaagugauguuacuggucguugauuauuuuuaugcuauuguuacugccacuuacauuuuuauuuuuuguuuuacuauuauuauuuuugagauggagucuugcucugucacucaggcaggaguucaguggugcgaucuuggcucgcugcaacguccaccuuccagguuuaagcaauucuccugccucagccucccuaguagcuggaauuacaggugcacaccaccacacccagcuaauuuuuguauuuuuaguagagucaggguuucaccauguuggccaggcuggucaccaacuccugaccucaagugauccgccaccuuuggccucccaaagugcugggauuacaggugugagccacuuggccuggcaaaauuuuuuuaaaacauuuuauuuauauucucucagcaggacaaucuuccuagcauaacuguugagggccccuccagucucagguuuugaccuuguuuuuuauuuuuuuuuauuaacuuaaaaaacauuauuauuuuuucauuuuuauuuuugacuugacgauaacuguauauauuuaugggguacaaugugauguuuugauagaaaucuacuacauuuuggaaugaucaaaucaggccgauuagcauauuuaucaccucaaauauuuaucauuucuuugugaugagaacauuuaaaauccucuuuuaguaauuuugaaauauacaacacauuauuauuaaccccagucacagugcugugcaauaggacagcaaaacuuauucuucuaacuguaacuuugugccuauugaucagcauugccccuuucccugcccaugcccccaccucccagccucuaguaaccaccuuuugauucucuaauucuguaaguuuggcuuuuuuagauuccacacacaagugagaucauaugauauuugacucucuguggcacuuuagaauuucauuuucuaauuguuuauuccugggauguagaaauagaauugauuaggccgggugcgguggcuuaugacuguaauccuagcacuuucggagguggaggcagguggaacaccagaggucaggaguuggagaccagccuggccaacauggugaaacccugucucuacuaaaaguacaaaaaaaauuagccgggugugguggugugugccuguaauccuagcuacucgggaggcuguggugggaggauugcuugaacuaggagguggagauugcagugagccaagaucacaccacuguacacuccagccugggcaacagagcgagacuccaucucaaaaaaaaaaaaaaagaaagaaauagaauugauuuuauauguugaccuuauuucagugaccuugcuaaauucacuuauuaauuucaauaguuuuuagauuuuaggggccuuacuauguagaccguuuauuuuucuguaaauaaugacagcuuuuucuucuuucugauccuuauacuuuuuccccuuugucucauugcacuagcuaggaucucucuuauaauguugaauagaagcagugauggugaguauucuuaucuuguuacugaucuuaggggaaaagcuaucacauuuucaccauuaaguacaacauuugaugugggauuuauauggacacuuaaaaauuagauuaaggaaguuaccuucuauuccuacugugcuaaguuuuuaucaugaaucaguucugaguuguaacaaauauuuuucuguauuaugugcaucauaugauuauuuuauucuguuaauauggugaauuucagugauucuugaauguuaaaccaacuuugcacuuuuggaacaaacaacuucguugugauaucuuuuuauauauugcuguauuugacuugcuaauauuuuguugaggauuaucuuuguccaugagagagauuaaccugugauuuccuuuuguuguggugcccuugccacauuuuggcaucaaggauauguugaccuuguaaaaugaauuaggaaguauuuccuauuucucuauucccuggaagguuuuugugagauuagaauuauucuuuaaaugucuggaagaauucacuggugaagccauuugggccuggaaauuuuguucuuggaagguuuuaaaauauguuuuuuuguuuguuuguuuauuuauuuuacuuuuguaaagaugaggucucacuauguugcccaggcugaucuugaacuccugaccucaagugauccugccaccuuggccucucaaaguguugggcuuacaggcgugagccacucugccuggcuucaguuguuuuaauaguguauguuauucagauuuccuauuuuuguguguguuuuaauaaauucuguuuuuuuaggaauuuguccauuucaucugaauuuccacaugagguuuucuuuauauucucuuaugaucuuuaaaauguuuuuagguggugugguccuguccuuguuuuuuauuucugauaguggcauuucuauuuauuguccugguaauucucacuuauuuugaugcaauauugucaaggucuuauacauuugaguagucucuguaaucuuuuacugguuaauuuuuuguauuauacauuuauuuuucaucucaugaguucuugcuuuugucuuuauuauuuccucuuacacucuuuggcuauaacuuaugacuuauuuuuuaguuuuuugagauagaagguaucuuugauuuucagcuuuucuuuuaaaaaauauuuucauuuaaggcuacacauuaauauccuuuaagccggccaggcgugguggcucacgccuguaaucccagcacuuuuggaggccgaggcagguggaucacaaggucaggaguuugagaccagcuuggccaauguggugaaaccccgucucuacuaaaaaauuacaaguauuaguugagcacggugguaugugccugugaucccagcuacucgggaggcugaggcagaauugcuugaacccgggaggcggagguugcagugagccgagaucacaccacugcacuccagccuggaugacacagcaagacucugucucaaugaaaaaaaaaaucccuuaagcuauauauauaauauccuuuaagcauagcuuuuguguacaccugcaaguauuguuauauuuucauuauuuaguuuaaaauauuuuauacuuuucuuuuugauuuuuuugacccauaagguaguguaacaacauacuuuuuaauuuuuaaacaguuggggaguuucuaguucucuuuuugccauugauuucuagcuugcuuucacuguagucagagaauauauuuuggaugacuuggaaauguuuuagacuugcuuugugacccuucauaugaucaauuuuuauauuuauauguuguacuuaaaagaaugugcauacuaagauaguuugguuccauguucuauauauguuaauuauuucaauuuguuaauccugaggugcggaucuucuguauccucacugauuuuuuucucauucuguugguucccaagagagggcaaacucuuccauuauaauuuuagauuugucuauuuuuccuuuuauauuugccaauuuuugcuuuacuuuguggcucuguuauuaggugcauaccauauacaguuauaguuguuauaucuucauuaugaaaugucuuuccuuaucuugagcaauacucccuuauaaucuaccuuuuugauauuaauguagcuauaccaacuuucuuuguguuaauagauacaugguagaucuuuucccauuuguauacuuuuucuuuuuuauuauuauuauauauuuuuuugagauggagucuugcucugucauccaggcuggagugcaguggugugaucuuggcucacugcauccuccgccuccuggguucaagcgauucuccugccucagccucccaaguagcugggacuacaggcgugugccaccacacucagcuaauuuuuauauuuuuaguagagacaggguuuugccauguuggccaggcuggucucgaacuccugaccucaggugauccacucaccuuggccucccaaagugcugggauuacaggcaugagccacugugcccagccuauacuuuacuuuuuucuauacccauauauguaaucuguaucuuuuagaagcagccauaagugaauuuuuaaaaaucuagucugacaauauggucuuuaguuugaauauuuaaaccauuuaauauaauuauugauguguuaagugcuauagcuaccauguuacuccuuguuucuuauuugugucccaucuguuuuauauaccacuuucuuuuggauuaaucaagcauuauuuuuaacuuuccaacauauucuuuacacauuuguuuucauuuuacuuuucuuuguguguaugugcgugugugugccugcgugcgugugcaagugauuaccccagugcuucuuauauuuaaucauguuucagacaauguuaggcgcuuagaagacuuuaacuccauuuacccuaucuucucccucaccucacuuucugccuuuuguauuauuauuguauuuuguuuuaauuauacauuuauuaaagccccauaggacacuguaaugauuguuuuauggaauaaauauucauuuaaauuuacccacauauuuacccuauucauugcuuuucauuucuuucggauuuuuuguguauucccucugggaucuuuuccuuuugcaugaaaaaaacucccuuuaggauuucuuguagugcauauaugcuagaaacaaauauucucaguuuuuaugaucuggaaaugaguugauuuugucuuugcuuuugaaggacaauuuuacuagguguauagaauuauggggaagcagguguucccccagcacuuuaaaacauguuaucccauugucuucugguuuucauccuuucuuggaaaagcaggcugucagucagucuuauguuguuauuugguguugcaucuuuuuucuucggcuguuguuaagacuuuucucaauugauuugguuuucaacacuugucccaggugugguuuucuuuguauuuauccugcuugggguuuucaguccuucuugaaucugugcggcuugagguuuuuuguaauucucauaauucccugccauuaucucuccaaacaguguuuuguuccuuucucucuuucugggacuccggguaccuuuauguuagaacuuuuuacccugucccauauauuccuucauuuucuguauacuuagcccuuuucuuucuuuuuuaguuuuguuauuuuuuugcuggccuaucuuagagcuuacugguucucucugcuauguuuaacuuguuguuacagaaccauuaauuucuuaauuuuguuuuguauuuuucaguucuagaguuacuauuagauucuuuuuuuuuuuuuuugagacagagucucccucuguugcccaggcugcagugcgauccuggcucacugcagcuuucaccuccuggguucaagcgaucuucagccuccugaguagcugggauuacaggcauguaccacuaugccuggcuaauuuuuguauuuuuaguagagaugggguuucgccauguuggccaggcuggucuugaacuccuggccugaagugauccgcucaccuugaccucccaaagugcugggauuauaggcgugggccaccgcgcccagccucuauuagauucuuuaccaaaagagauucuucaccuugucaucuguuuucucaaauacauacaucacagucaucuuaaaaaacuuugcucaguaacuucaaugugugggccacuugugagucuuuuuaucucuucuguuuuucuucuugguugucuuucuucauaugccuggcaauuuuuuauuauauguccaguauuguguaugaagaugcucuggaugaugucaucuaccuguugagaguauuuuuccuacucuuugucagaaguagaacagagaucacuucaaucaggcacucagucuaauuaaggcuguuuugcagacuuuuaagguuuagucuacuucugguucuccuaaucccaggccccuagggaaacugacugagagucugagauguuucucaccaccccuuccccuugacagacccuaaacucuaauuuuugucucucuaauacugugaacuugcugaaaacucuacucagcaaaauguucauugugcuuuucauuugcuuucucguuggcuucuuagccucugcucugggcagcugagucaggaauaucugaaggagaaaacuccugucaggcugugaguuacucuaggauaugccuuuucaguccuaaacuccacuuuuugucucugcagcccuugaaacugucuaaaauucugcaggcuucucugugucuuaacagcugccccuugccuggcuuuucagcuucuuaccccaugcuaagaauuggcauauacccuaaauaggaaaaugggcuugcagaaagucaggcucaccucagugagccuccccucucuccaagaucugguuccucaaaucguggcugauuaguagcuuuccuauuacuucacacagauguuuaaaaauuuuaucuggcuuuucuaauuucccucaucagaaccagucugcuacaaccuacucuauuaaagcuggaaguuaaacacgucuguuuuuuuuuguuuguuuuaaguggauuauguuaaaaaauaaaaaucacaggccaaaaaccaagguaacaaugucauuuuaaacauguaaauuuaauaaaggauauauguugauuuuuaguuacucuuucuugccuuauuaaaagcuugucaguaccuuuuuucauauguacucugaaauucuuacaaauauauguugcuuuguuccagagaauauguguacuaaaagacuauaauuuuucugagucugguucuccauucaaauguuuuaauacuuuugugauuuuaugauuuguaauugucgacucucaccucccaauucaacaugauccuaaaauguacaaaauaauuugaaugauugaguuucaaaaaguuuuagaaaacuugaucuuguaacuuuuauuccaaagcuuuguugagggggagaaguacaggcuucugccuuuaaggguacugcuucacuuuuggggcaaaaaagcaaggguuuucaaagggggacuugacaugaauggcaugcaggggagggggugagccagugggggucucaaugacuugcuuuggugcuuuaucuaccaggugguugagcuggugcccucgcgggcagaacuaggugguaagguggccagagucuugagauacucuccaagugggagugaguuucaucaugggcauacuuuagguuauaauuuguuaucucucgaggcagucuccuggucgaagagacgucuggcucuggagcuucuaaguaagcaagagcuuccaaguaagcacacagauaagcuugcccuacagggagugucuggugaaggaaagguaaauguuauaauugcauuucuaaagagcuaaguaggaaguggggaacaagggaaaaggaggaaacagaaaagaagaaaaaaguauuuuuuaaaaaaguaauucuuucucuuagaaaaagguggguacuugguuacagucuaaacccuuuaccguggcugaguagguauuuuuucagccucuuucccagguugcgcgcugcguuuagugcugucauucucaugugcuucaugucacugccaauguguucagccucucaaaugcaagcuccguucauuuacucauucaucucauauguuuuugaucacuuaugugcucaggucuccuuuuucaaaucaauauuauggcaauucuaguaaaugaucagggaaauuaaauaggucaauucaugugacauaguucugaaaggcaacagagugauugguggaauuguggaaauguuuuucacauuucuccaaauuuucuuuuaaaaucagacaaacaaacugacacuuacuuuucagucuuuucagauauguuccccaacucugacucuaguacuugaaaauguacuaaguaagagggcuuugggaugccagaaauagucuguuacuuaaucuggcugcugguuuuuaaaccaguuugugaaaauuccuggagcucagcacaugguuuguucacguuucaguaugucuguuauacuuuaauaaagaaaaugaacuuuuuacugauagaguaacaaagaaagugccaaagagaaagaaagcuugagaaccucugaucaaguucagccucuucauguuauggacgagggaauugaagcuugggaaggaaaaauuaccuggggacugggggaaugucucauaaccaggacuuguacucaggccuucugacuccuaguucaucugacuuuccuaacucauugaucaggaaagggguggggaagaaucuggcaugcgcuaacauuggagcugggcgacauucucagaaucccagauguauccugcgagucagcacuucacucccuacucuuucugcccuccuccauccccuuccccauggcaguuuaaaaacagacacuuuuauuuccugcaaaccuggagauacuuguuucaucaccuaagaaucauuugacugcauaugcugagaaaaagggaaauucgugccugugaaaucuaacaagagcccagcacaagguauguuugauccucuuuuaaagccauuuuuaguuuggugcugugugguuuaaauuuagaauaacauuucuacaacuuugggggaggggcggugaugguggcgugcagagauugaacccagcugugacuccugcugcugugagauaaaugggaaaaucugggaaccaguguuaaaaggagagggcucuuuagagagguagcugcagggaaggggacgugccuuaauugggauggggguggagguaaggccaagaaacagugggagcugucuccucccccucuugcccugugggaucugaccuacugaaaacagagugaagacuauuucugaucugguuuggaaauccagaauuuaauauuaaaauacacguuaaauauuucaauaaauaaauauuaauauguuaauauuaauguuaagucagaauguuaaaauauacaucuaauauauauacacauacaugcacaugcaugcacacacacacagcuuggaauugguagugucauccuggcuucauuuuacauucucaaaggcuagauguuggguuuccagagugcuguuucuucugccugaaauacauuuucucuccuauuugccuggcucaguucugcuccucuuuccaguaguagcuuccucugacucuaggucuccuucccacucgcugccuauaacaaguuuccagagcauccuguguuuucccuuuugugucacuucccguauuuuuaauuauuagaugaaauuugggcacggcauauguccuuaauacauagagaaaagaagagaagacaaggagucagggaagauaaaagaaagcuacccuuggaucgcuucuuuuaaacuuagcaagguagacagguuccuuaacuucucugagccucaguuuccucacuuucaaagugaaaauaguaauaccuaauaagguuguugugagauuagaaccuaauaagguuguugcgagauuagaaauaauauauuaaaggcaccuagcauaauaucuaacacauaguagguacucaguguaacauaauuuaaaauguauauauacucuuaaaaggaaauuaugaaaauucagaaaagcacagagaaagccugugaaaacauucauugucccgucucuuagagauaauugcuguuaaauugaguggauucuuuuucuguguguaucuuuauguaucuauauaauguacugaguucagauuauucauauuuuuuuuucacuuaauaugacggcccaaacacucuccacauuuuuagugucuguaaaauacugccauguuauauuuuguaauaauaacugggccuucaguuauuaaaagaagauuuagaaacugacacuugauccauucaaacucuacuuuuaccaggacaauauguuuacguguuaggaggauaauucauaucccuggguaaacaaaugauguaguggacaaggugcaaaaggacuccucccuccauuccuucuucucucucucuuucagccuuucuugcuuauuuccauggauaggaggguuauuuugauuuuuaaaguaaugaggcaacuaggugaaaugaagaaauccauuggccuggaaguuaggaggucagaaauuuuccuucuuacaguccagucacugacucacuuuaaggcagucuuuucauuuuuuggucuaauuuuuuucauuuguaaacaugggagaaguggguuuuauuagagagauuuucagacugggcuuuucugagugaguguuagaguucuguggagauguuuuuucauauuagguagauuuccucucaagggaaaauuacauggcuaaaaaaaauuaaguuucacguuucaaauuuuauuuuauuuuuuagacagggucaugcucuaucacccaggcuggagugcagugguguaaucuuggcucacugcaaccucugccuccuggguucaagcaguucuugugccucagccuucuggguaggugggugcucgccauuacacuggcuaauuuuuguauuuuuaguagagacgggcuuucaccauguuggccaggcuggucucgaacuccugaccucaagugaugugcccaccuuggccucccaaagugacgggauuacaagccuuagccacugugcccggcucaaguuucaaauuuuaaaugaaaucucaguggacuuuuuccuuuuuuaaaauugagauauaauucacauaccauaaaauucaccuuuucaaaguguacaacucagugguuuuuaguauauucauaagguuguacagucaucacuacuaucuaauuccauaacgcuuucauggaaaccauuaauagucgcuccccuuuuccuccucccccuagccccuggcaaccacuaaucuauuugucccugcggauuugccuauucuggacauuuccuguaaauggaauuauaguauguggucuggcugccuucacuuagcguagugguuauaaaguugaugcauguuguacccuaaguacuucauuucuuuuuuccauuccuuuuaguuuuuuuuuuguuuuguuuugagauggagucucgcucugucacccagacuggagugcaguggcacaaucuuggcucacugcaagcuccaccuccugcguucacaccauucuccugccucagccuccugaguagcugggacuacaggcgccagccaccacgccuggcuaauuuuuuguauuuuuaguagaaaugggguuucacuguguuagccaggauggucucgaucuccugaccucaugauccacccaccucggccucccaaaguucugggaccacgggcguuagccaccgugcccagcccuguuuaaaauuuuuauuuuacucauuuauuuauuuugacacagagucuggcccagucaccagggcuggagugcaguggcacgaacauggcucacugcaaccuugaccuucugggcucaagcuguccuucugcucagccacccgugaagcugggaccacaggugcaugccaccaugccuggcuaauuuuuucauuuuuuuguagagacaaagucucacuuuugcccaggcucaagugaacuccagggcucaagugauccuccuuuguuggcccugcaaagugcugggauuacaggcaugagccuucacaccuggcaccauuccuuuuuuacagcauuuuagaaaaaauuuuuuucaaguuuggaaaaaaaaaguuuugucaggcuguuagaauucccguagcaguagaaugcauuaucugcaguguuuguugagaugcaaaaacaauuucaguacuucagacuuuuaaauaaaaggcucuauuuaguucaugugaaaacuuuuaaagcucugcccuucccccuuaaagcuaagagacugauauacugauugccagucuuguuuuccuccucuggguuuaggggaggggauuagggccagacuuucauuggauaaagguaguugaggcugggguuaggcucuuuucagaggaaaaaucaagauauuaaccugucaccagaaggaggagggauggaugguggguggguuaaaacaacagaugucagguguacauaacugggauggacuuuaucugcugcacuauuggugcaaaauccuuuccucuuaugugucuccugguguuccuaaggaaaguauaaggaagucaccugcaguuuguagggaaugagcuauuuacucaugcaugaacuguguucucuaguuaaaaagggauugaaaagaagaacaauaucagagucccuauccaaauuaugaacuccuugaggucagagauugugucuugucacaauuauaccuccaguguuugauauggaaccuggcauacaugagucauucagugaauauuugugagauuacuugguuuuuugccuuguugacuuaagaaaacuuuuuauuuugaaauaaucauagauuuguccgagagauuccaaagaaauguacaaugauauccuaugcauccuucauccucuagccucccugaauguucacaucuuauaccaccauaguacaauauaaaagccaagacauugacauuugcacaauccauagaacuuaagguuucaccagucacacaugcacuaguuuauguguguguguuuauguuuguagcucuaugcuauguacuaugugaauacauguaaccuuaacuaaugaccacggugaucaagaugcucaaauaucaccacacacucucuugcauuaccccuuuauggccaccuccauuucccgguccuuaacccuuggaaauuuagucuguucuccaucuuuauaauuauguuauuucaugauuuuuuccagaaaugaaaccaugaagguauccccaagauugccuuuuuuuuacucagcauaauuucccugaguugcauccaagucguuggauguacaacaugcaccaacaguccauuccuuuuuacugcugaguaguauucccuaaaauggauauagcauaauuuguuaaaauauuuauccauugaaagacauuugggugguuuccaauucuuagcuacuaggaauagagcugcugugaacaucuguguacaaguuccugugugaaaguaagucuucauuucuuugggauaaaugcccaauagugcgauugcuggauuguaugguaaguccauuuucaauuuugaaagcacugccaaacuauuuuccagaggggauauaccauuuuaaauuccaaccauuauuguaugagugauccaguuucuccauauccuugccagcaauugguauagucacuauuuuucuuuuuagcauuugugguggguguguagugauacauugacuuuuugccccuucuccuaccaaacaaauauguuaaguuuugaacucagcuucccaacucucaguggccuggucugugauuuccauaggccucuauacuucugaccuccuccuaccuccaugaccuugaccugacuucucuuucuucucuccccagccugggucccgggguccccuuuuuaccucagaaucgcuuuaucucaauccugccaucuucccaaugccuggagaaagucacaaaagugcucuccacugcugccaggccucugauguuacagcuccugggcaguccuuuccuuuaccucagugaugucacccucccacuucugacaggcucugcuccauacagugaggucuucucucagagaggaccuuaccaccucucaacaagagugagacuguucagucugaagccccucagcaucuccuuucuccaucucugccuuucuguuucuugcagaagccaacuccucaugugugcuuauguucccagagagccuccagcuccccaggguagggauuuaucagaggagucuauuuucagacuucccuucgucuguucuccuuuuccucagaguguccuuaauggaacacccacaccucuccucuaguacugagucuguugaaucaggaucucuggagguuugcagggcggagagucucuguuuuuaucagucuccucaaggccuccaguggggagucagauucagagacggcugccucagggacccucugggccccucuucuucacacuaccccucaguaguguuuuccccaaauuuuggagaaccaaauuauuuuguucuggacucacuguuuuuuguuuuuuuuuuugagacggaguuucacuuuuuuugcccaggcuggagugcaauggugcgaucucggcucacugcaaccucugccucccagguucaagcaauucuccugccucagccucccaaguagcuggaauuacaggcacccaccaccacgccuggcucauuuuguauuuucaguagagaugggguuucaccacguuggccaggcuggucucgaacuccugaccucaggugauccgcccaccucagccucccaaagugcugagauuacaggcaugagccacugcgccuggcugacucacugguuuuaacucugugguuuuccaucugguuccugcauuucugcccagcuccuuuaaauuuauauuaauaauuguaauuaucagguugcuuugguuuuguagucuuauuggcuccugcuuugcagugucaucaguuucaucuuuacaaacucugaugcucuaacuuucuugcauaaacagcagcaauugcucuucuuuccuugcacagagguaggaguguucucaauaugaccaccaucugguuucccagccuagguuuucacaaaucuccuauacaugauuuauguggccccugaaaugccuggcguacaauugcucagaccauguucuuuuuggauuuuguuauugggccucaucuuauugccccugccuuagaaguacaccucccaauucagucuuuggucaacugaaauuuauucuuugucaaagacccuuucccacaguuuauucccugcaacguuuuaugaauuguugccugaacuagauguucgguucuaacaauauauauuacacaugaugccaagcacuguucugagucauggucauauaaggugauugggaaaugauccucacccccccaccaguguucccaaccauuuuucccuucucuagucucccauagcuuucucuccccgcacuaugauuguuuuuucauuuucagcuguauuuuagguuuuuuguuuuguuuuguuuuuugagaaagagucucauuccgucacccaggcuggagugcagugcugugaucucuguucacuguagccucuggcuccuggauucaagugauucucgugccucagccucccguguagcugcaguuacaggcauguaccaccacaccggcuaauuuuuguauuuuugauagagaugggguuucaucauguugguaggcuggucuucaacuccuggccucgagugaucugcccgccucggccuuccaaagugcugggauuaaaggcaugagccaccaugccccacuuuauuuuagguuuuugagaggagauaauuugucaaacccagcacucugccuaccacaaaaguugaugugcaggauauauuuacggaauaauuuaacauaucccucuaccucccugccccagcaacuuggaaggucaaugaacaugugcugaauuaaccccacucuugcuguguguguauucuucucucauacaaccaaaaccuaacuuuuguuaauuaggguucagcauuagccauuugaauagcagaauucuaaguuauguagaacaguaguuauccuuuuuuuuuucuuuuugagauaggguuuugcucugucacccaggcugaaaugcaguggugugaucauggcucacugcgaccucaaccacuguggcacaauccauccucccaccucagccucccgaguagcugggacuacagguaugcacuaccacaccugguuaauuuuuaaauuuuuuguggagacagggucucacuuuguugcccagguuggucuugaacuccugggcucaagcaguccuccugcuucagccuccuaaaguguuggaacuacagguaugagucacugugccuggccaguuauccuuuuuguuuguuuguuuucuguucaccuacagaucacuuuuuaggguugaaaagcccaugugcagaagacuacaacagaaaagaugguaggaguguguugguuuuggaguaacucuagugaggugaugaauguaaauuuaaaaucuuaaguauacgaaacagguuacuaauacauuugagaaacaauaaaggugcugcuuauuuaucuuuuaccaugugcuagaauugugcuaagugcuuagcauauauuagcucauuuaaaccuaguacuaauccugagagguauguucauuauauugaugaaggccuugaggaucagaauugugaaauaaccugcuaaaaucagagagcuaauagauaguguagccaggauucccauauagguuucuuugaucccacaacccauguuuucuaugcuguuuugccucucuagauaaaagcagaaacucucacauuguaaaguuaaugcuuaccuaaaauguauauuuugaaaguuauuaaacuuuuacugacccauaugaaaaugccuaagucagugagugagugaaggaaugaaugagugagagaaagagugaaugaaagaauaggguagauuggaaguaccauauguacuagucugucagauauccuaauacacugaaaaucagauauuuguggugguauauuugugggaaaauuaucuuaaaaggauuaaaaguccauuaaaaaugcaaacaaaugaaguagugguaauguaaaaacauugaggggauaaugagcuuauauacaagauuuuuaaaaauggauacuuaaaaguucaucagucaguagaguaauaagaugcuguuguaguucauuuuggccucacuuccuuaucuccuucuuuaaaaguccuuccucaguaccucuugaguagugguuauuuauuccuauuacaauguauuuccuuucauuuauuuuaucuuuuuagacuuuggagacuagguccauuuuauuaagcuucaagagauugaaugaagaacaaucacucccccauuuaccuaccuccauuuacuuugccauuuaaucucuuuuauuuauuuuuuugaggcauggucuuagccuguugcccagaauggaguacaguggcgcacaaucagggcucacugcagccgugaccuccugggcuccagugauccuccugccucauccucccaaguaggugggaccacaggugcaugcuaccauaccuggcugauuuuuguauuuuuuguagagacagaguuucaccauguugcccaggcuggucuugaacuccugggcuccaacagucugcuugccuuggccuccuaaagugucgggauaacaggcaugagccacugugccuggacuaauuucuuuuaaaagggugccauuacaucccaugaagugcugggaagaacacugggggucuuagcacugagaauguaaaugcuuauuugaauucuguuuucaguguaauacucagccuuguacucugccugguguuccccuguccauugaaccucuuguugcccucuccagagaauaaaucucuagucuucuguugggguuggggaauggcaacugcccaucugcauugucugaggaaggggaucugggggucugucuuaguauugccuucaccugucuacauugccaucaaauccugaguccuuaggggauuccacacuguaacucagcuugccagguuaggauuuagcuuaauucauucuguuuuuauuuucuaaaauuuguugcuguuuucucugaauucauaagaaaguuuuaaaagguuugaaagaaaagcaauacagagaagcuuaacucuaacaugaaaaauuuauaacuaauggcaacauugggaaaaagcaagauuggcagcauaugaaaguaagaacauugcacaaaugggcauauuuagucagaauucuuaggagaugaacugcuaaacaucgguuucagaauccuacauaaugauuugugaguguguguaugcccaaagaacauugaauuuguaggcgaaauuuuaaguacacagaaaaguguaaagcauuuauaaagugaauacacuguguaacuagcauccaaaucaaguaacaggagguuacuagcaacccagaagccccuuucuaguuccugacaacccuccaaccucuacuaagaauaacuaaugacccaauguuuuacacuguagauucauuuuguucauuuuugaauuuuguauaaauggaaucauuuaguauaugaucuuuugcucucauuuauuuugcccaaauuuauguuugugagacccauugugugguaguuguaguucauucuuucucauuccuauauaguauuccauuaagggaauauacuaauuuaguuuuuucauuuuggcagacauuuccaguuugggucugcuaugaaaaguacuacuaugaauauucccauaugugucuuuuggugcccaugugaacauauuucuguugguuauauacauauuucuguugguuauauauguuaaaaauuacugggucacaugguaugugcauauugagcuuuaauagauacugccaaacaguuuuacaaagugguuguaccaaguuuuacuccucucagcagggugugagauuucuaguuauuccacaucuuuaccaacauuugauacugucagucauuuaaauuuuuuuuuuuccccaagauggagucucgcucuguuaccuaggcuggagugcaguggcacgaucucggcucacugcaaccuccacuuuccagguucaagcgauucuccugccucagccuccugaguagcugggacuacaggcgcgugccaccaagccugguuaaucuuuuguauuuuuaguagagacgggguuuugccguguuggccaagcuggucuugaucuccugacuucugauccacccgccuuggccacccaaaaugcugagauuacagaugugagccacugcaccaggccagucauuuaaauuuuagccauucuaguuaguguaucugucacugugguuugcauuugaauuuucaugaugacugugagguuaagcaccuagucauaaguuuauuggguauuuguauguagucuuuugugagaggccugauuaugaccagcacuuuuaucuagacuuucccagccaccagaaccauaagauacaaauauguauuguuuaagcuaucuggucuaugcuauuuuguuacagcagccugagcuuacuaaggcagaggggaagugcuauuguaccaguaccaaacauaggccuaagagcacugugucauuguuguuuuuuuuuuuuuuugagacagaguuucauuauguugcccaggcugagaugcaguggcaugaucugggcucacucuaaccuccaccuuucggguucaagcaaaucuccugccucaggcuccugaguagcugggauuauaggcgcccacugccacacccagcuaauuuuuguaguuuuaguaaagaugggguuucaccauguuggcuaggcuggucuugaacuccugaccucaagugauccacccgccucggccucccaaagugcugggauuacugguaugagccacugccucugucugagcauuguauguuaaaacaacacacguauauaucuuacaguucugguggcuggaaaagucaagauaaaggugccagcagauugccaaauuuucagcugcguuuucugccuuuuuuguacugauuuguagauuuucuuagagauuuauauugaguccuuugaauguauguauuggaaaaaucuucugucaaugugguuuauauuuucacuuucuuaauggugucuuuggaugaaccgaaauucuuuaaugcagucuacuuuauugauuugcuucacaguuccuacuuuuugaguacuguuuaagaauucuguuugcgucaauaucgugauauuacuuuauguagguuuucuucugaaagcuuuguuuuagaguauauugauuuuuaaaaaauuuaaaugcauuuguucacauaucagccugaucuauugaaaaacacuuaaacacuuaaauaagcuuaaauaauaacuuuuccacaaacuaucuaugugaucuucggcaaggcaguuagcauuuuuuguuguuguuguuuauuuuuaaauuauuaccuuuccuauggugcugaagggcaguuagcauuugaacuuaauuucuuuaacuauaguaugauaauaauaauauccaucuuagaguauuguuguaagcaucaugacuaucuaaauguuagcuauuauuaaaaagucagcuauuagcaaagacauuuucagagacaauuggagauacuuagauauagauuggauguuagaugacaguaaggaauuauuaauuuuguguuguguaggaaaauguccccauuaggaaaugcaucaugaaaaauuaagaggugaaguaaaaugucucaauucauucuuuaaaaguucagcaaaaacaauaaaaucccaaauaucuagauaaagcaaacuugcaaaauguuucaaauuauugaauuuuuuguuuguuuguuugaaguggagucuuacuuugucacccaggcuggagugcagggcacuaucuuggcucacugcaacgaccgccuccuggguucaagugauucucuugcuucagccucaugaguagcuggaauuacaggcauacaccaccacaccuggcuaauuuuuguauuuuuauuagagacgggguuucacuauguugaccaggcuggucucgaacuccugaacucaagugauccacccaccuuggccucccaaacugcugggauuacagaugugaaccaccaugccuagccaaauuauugaauuuauacauuagauauguagauauucaucaugugaaauucuuucagcuuuuuugguauguuugaaauuuucauaauaaaauauucaaggaaaguuaguaaugaaucuauagcauuccuauuauuuaacauuuucuccaaagcuaaaggugcagaaggaccuaauuaaauggauuugagucacuuagccuguucugccugggaaaggagauuaaaaugaauuuaaaauaaaaugugaacuauaucccugcauacuugagugggauaaagcugagccauaaaaauccagguuuuacuggguguagaaaaaaggagaaggugaggaagggguaugagauguacugagugcuguuaagggucagauacucugcugggugcuguaaauaucaccuaucauucauaaagcaauucuacgagguaagcaauauuagaaaaguuugauaugaaaaguuugauagaaaagcuuuggauaacuugacuaacacaacuaguggauaguggagugaggauuuguacccagaucuguguuuuugcacacagaucuguuuuugcuuuucuucuuucguuccuacuuuccucucucccucccaccguugucacuuuuuucccaccuucacucccuuuccuucguucuuccuuucuuucugacuucuuuacaaauguuuuuauuuuuuauuuacuuuuuacuuuuugagauggaguuucgcucuuguugcccaggcuggaguacaauggcgcgaucucaacgcacuacaaccucugccucccagguucaaggaauucuucugccucagccucccgaguagcugggauuacaggugccugccaccacaccuggcuaauuauuuguguuuuuaguagagacgggguuucaccauguuggccaggcuggucuugaacucuugaccucagaugaucuacccaccuuggccucccaaagugcugggauuacaggcaugagccaccgcacccggccugguuuuuuuuuuuuguuuuuuuuuuuuaaugaauauuacgcuuuucauuguagaaacucuggaaaacacguuuguauuaauuuagguuuugcuacauaauaaaccaccccaaacuuuuuucuuuuuuccugagacagggucuugguguauugccuaggcuggggugcaguggcaugaauguggcucauuacagcuucgacuuccugggcucaagcaauccuccugccucaguuuccugaguggcugggaccacaggcacacaccaucaugccuggcuauuuucuuuaauuuuuuuuuguagagauggggucucaucauguugccuaggcuggucucaaacuccugggcucaagugauccuccugccuuggcuucccaaaguacugggaauauaggugugagccauuagacccagccaguuuuuuuauuuuuuauuuuuauuauuuuacacuguguugagauaaccacccccaaaauuaguggcuuaagacagcauacauucaggucacaauucugcuggcaguaauuuaaaugggcucagagggcaguucuuccagucugggccaaccucagcuguugucauuggggcucacucaaacguaugaggcaucagcugggaugucaggaucagcuccuccauguggccucccauccuacagcagacuagcuugggcuuguucucuuggagaaggagaagaggagccaagagagcaagcagaaauccacaaugcucuugggccugugucuggagcugguaaaacaguacuuccccucugccucagucagcucaggcugcugucacagaacaucauagacuggauagcauaaacaacacacacuuauaucucaccauucugguggcugggaaagucaagauaaaggugcuggcagauucaguugcuaugaggacccuuauccuggcuugcagaaggcugcuugcugucuucucauugaguccucacauggggguagauggggugugugugagagagagccagagagacagugagcacaugcucugguguuucuucuuuuccuuauaaggacacuaaucccaugaugggggcccuacccacauaaccucauuuaaacguaaucaucuuccaaaggcccccaucuccaaauacuaccacacugggaguuaggccuucaacauaggaauuuuggagggacacagacacuccccaacacccucuauuguacaaagcaagucacaaggccagcccagauucaaggagugaagaaguguacccuaccucuuggugagaagaaauauaaaauaauauugcauugugauauggguggcagcaagugagggugagugggaugaauguuugcagccauuuuugcaaacauuuuuucauaacauacaaaaauaaacaucuacuuuaagucauuucuaauaccauuaucaagagcuaauuauuguuaauauguuggucuaugcacaaauaggggcagauaugcacguacagaggcauaguuuugucuguacacauacagaggcagauugcuuuuaagaauauaauuuucauuuagaaucaaacuuauguucuauuaguguauuuucccagguauuaaauuuuccuugaaaacauguuuacccuaugaugcaaaggaaaucaacauaaauuacuauguuccaggcauugugcuaagcacuuucacucaguuaucuuaacuaaaaaacaaguuucuuguuaauuugcaggguuaauuugcaucaaaacaaggaauucauuuguugcuacaaagaaaaagcaaugaaaggacuuugugaaaagguucagagaaaaugauaaugguuaagacauaucagcaauacccauuuuucucuugaaaccugacuugugaacuauaacagaaaauacagaagauaaauccuuguaccuauugcccaccaauccagucuuuccauuuuauaggugaagucaugucauuauuuauguauuuguuugauuuggcuguauuucaggaucauguugaacaucaguucuuauuguauggguaacauaaauaagaagcagaaaauguagagggcaaaggccaaaguuugauccugggcuugggacugauuaguuguugacuaugaaaaaaaaaucacuuaauuuuuuugaguucaauuuuaucaucuguaauuacaaaagcuucaaucuucuuaaaauuggugugaagauugacuacagcauuuuauaucugcacugucugauguaguagccacuggcuauaaguggcuauugagcauuugaaauguggcuaguccaauugagaugugcuguaaguauaaaauacacaguagauuuugaacacuuagguggaaaaauauauaaaauaucuuauugauuacauguugaaauggcaauauauuguacccauugaguuaaauaaaguguuauuaaaauuaauucacuuguuuauuuuuuaaauucacuuguaaaaauuuauuuuggcugcuggaaauuaaaauauuacacauauggcucacauuauauuucugcuggacaauguuuugcuuaaaaaauguucucuguacaauauagaguacagcauaaauguuaguuauagccagaaaaaaaguauaggagguuuaguugaauauguaaggauucuaagugguagcaugaugcuuauuauuuuugcuacauuuauaauguaagcuuuuauuuaggcaucugaaguuuuucuuuuuauguguuauagagaaguagggauggaagugcuaauccaauuaugugaggaaaucauaauaacuucaguguauugagcuacagugaugcaggcauuguguuaaguacuguauuaggcaggauuccuuugauuacaagugacagagaugcaaucugaauuaacuaaauugaaaaagggggaucuuguaauuguaugaagcaugggagugcaucugggucuccugaauuucuagaauauaaacacuguuuuuccuauauaccuaucuuccucucucaaauuuacuucucccuccucagcagcauuguucucucagaucacuugucuccauaugucagaaagaauggcuccuucaaccucugugugucaucuuugcucuagggaaggauagacucagacuugcucuuucugguuuuaaauggaaaaguccugugaaaaagccaugguugaccuagcuugguuauagguaccuaucccugggcuauggcagcucuaacccaaccacagaagagaauuucccagaaaaagggaccauucuucuugguugauaaaagaauaaauguacacuauagcuacucuagcuaauuuaauauguacagccaaucaguaggguaguaccucaaugaacaaaugagaaacugagacucagaaaaguuauguauuucauucaaguucaaauauccaggcuggaagucugggucuguccaucuccaaagcccauguucuuaacuaccacacugagaaaguucuaguaaaugggguuugugucgacuuaaguuuuacugaauuauuuaauaggucuuugcuauuuuuuuccuccuaucauugcuucccauugaaaguuaagauagauugaggacaagggaacuggccccaugguaauacucaguaaauccuuauggaauugaaaaccaacaccacuaugcucuccaaucuugugaccaaggcuauaaaggcguuagaaaagcacugcuaucauuaucuuuguaccaugagcuuaagacauaguuaccacuacuuggacauuuccuuuuuguaauuugcagucuucugccuucuuuugaaaacuucuuauuuuucaccaacacaugguucccuauagucuauaccacaugggcauagagauuucagaggcaaagaugaaagagucauacucuguuauucauaaauaaaauauagccaaagggaauuuuaaaaaaugaugaucuguaagucuuucagaaaaauggucuggaguuugucagucuccuacucggaucaaaaauaaagucaaaguuuucaacuaaaauaauugcaauaggcuacaaaucuguuugucuacuuuaauacaguagaaauggaaaguagaaguaagugacaacuuuauuggcugaauucauauuaagcagugugauggaaugcugagaacucugacccggacuggucagaaaaccagucuccuauauguagcucugugaccuuaaucaguaauaaguacaaaggcuaacuaaccuucauugggugcuaaacagcguagaacaucuuuucauagguuguugacugacucugcccaguggcaguaguuauucauucauucgacacaucuuuuuuuuuuuuuuuuuuugagacggagucuagcucugucacucaggcuggagugcaguggcgcgaucuuagcucacugcaacauccaccuucuggguucaagcaauucucugccucagccuccugaguagcugggauuaaaggcgcacgccaccacgccuggcuaauuauuuguauuuuuauuagagacgggguuucaccauguuggccaggcuggucuugaacuccugaccucgugauccaccugccucggccuccaaaagugcugggauuacaggagugagccaccacgcccagccucauucagcacaucuuuaucaggcaucuacccugugucaggcauggaguuagguaccaaauaugguucugcuaucauggagcuuacagucuggugugggaagucauacauguaaacaggcaauuucaguguagcauguuguaagugcuauguuagaagaaguagacuguucuaugggaccucauaaaaugauaucaaacgugguuuugagaaauuggaugguuuccugggacaugcuguccauuuagggaucugaagggcaggcugggauuggccaggugggggaucacaacaaagcucuuugucuggacuuagaaagagguugggaagggggaaguggugaaggcugagggcugagucuugagggaaauuagcugguccuagaaugcagaguccauuaugcugacuaccuuugacugagggugauaggaaacccuugaauaguuuuaagcaacugagucacauaauuagaucugcauuuuagaaagcugagaugugaaucaauuuuuucauuuuucugucuugauuuucuuaucuuuaaauugaaagggauagucuacccuuuauaacucuguccagcuuuaguaguccauacauuucuccuauuuuggcaaaacuuaaugaaacugccuuugcaaaaauuauaacagugagaaaauuaugacagugacagaucugacuuaaugacuccauuuugcuauucuaaccuucaagcugcccuuguucauuguugggcgcaggcugaacuaaguuugggaggaacuuaguuuaaccuugaaacaaagaugauaacagcccuucuugccugaaaccagacugcccauguaggacuaauaaauuagcugcaagauuggaaauguagguuuaggaguccuguagccggaggcugcaaguucugaaccucccccauugcuccuugggguaacaucauuauugugaaaccuaagauuggucugagauguuuuucagaccuugcauucugaggcaccagcuggcgccacccagacugguaaucuggcacaaccaguucugcagugccucccaggaacagaagacagcaagaagaacccacuuuaacccccuaugauuccaucugugacccaaucaaucagcacuccccacucccuggcucccccuacgugccaaaucauccuuuaaaaaaaacccuagugucugaauuuuccagggagacugaaucgaguaauaaaacucugaucucccauucaguuggcucugugugaauuacacucuuucucuauuacaauuccccugucuugauaaauuggcucuuaucugggcagugggcaaggugaacuaguuggaugauuacguuacuuccaugcugauuuugagaucuguugggcagcaaggccuaagauuacaacuaguacuugaaaaugaggcaaguuuugugggucuagggugggugaaggugggaggugaggugaggacaagaagcugaaugaaugauguguuguuuuuacugggaaaaaaggaaaugggaagguaugcaguuuccuuugacagucuccugaagagaaacugguuaggaaauagcuuuggccucucagcaagcagguggaaugguacuuugccacaauucuaguacagaugaaaucugauaguuacuucccccaaauuaugaagucuggaauuugcuuaacgguaguaguuaggggucuauacauaugaaaaaagacugaccaugacuuuuuuuuuuuaaccguucaaaguguuuguuaauuauuuauuaagauaaacaauuucuuagcccacauauucauguuucacagauaguucaggaacacagguacagugacaaacuucuauguaauucaacccaaagaaauacuuuauguuccaaaaucacuuuguacucugagagauauuagccuuccucaucucaaauucuuuaauucaauuauaauuucuguagaaaucugcauaugccuucuuucuuggucaggccacagcaaacuuacagagagcugcaaccccaggguuauaaggaaugcuccaacaauaugaaaugacagaugcuuggccagaaggccacacaucccagguuacaccaaggcacugagagccaugguaguuauuguccuugacagggaugucagcaucaacacuaaugucuuucccggaugauggagaaauggaccaacuugauaaguauugaugcugagugauacauacaaagaaguccauuauaugauuuucccuacuuuugaauauguuugaaaauuucccuaauagaaaguaaaaagauagaauaauaaaauaaaaauacccccacuuauuaccuaaguuuucuuuuagcacaaauggaaaauaagucagacucucucauuuggccauauugaagcuaauagucucagaaccacugugucauaacacugacauuuugcuuaaagcucuguaucaccuuuaauggcuuaaaauauucuagacuguauugagaucaugcaaguagaucaaagaaagagaauuacacgcaaaggaagggauagcuguacuagggaguucacugguaacagagucagggguccacagcucugggcugggucuguccugaaaggcagucucuggauagcaggaugagauggagugaucacuggcuuuggagucagacacaauagacugagcuauguugaaggacaaugacaaauaacacaauagauagcauucauugaacccucacuauaugccaggccuuaugcuaagcucuuuauguacuuuauguuaugcaauuuuaauaacuacccuguuuuuauuaguauuuuauggaugagaaaacacagguuuagagguuaucaaauuuguccaugaccacaugaacuuguaauucccaguaaauauuuuuguaaauaaauaucugaaaguguccaggcacgguggcucaugccugcaaucccagcacuuugggaggccgagguaggcggaucaccugaggucaagaguuugagaccagccuggccaacaugcugaaaccccgucucuacuaaaaacacaaaagaauuagcugggcaugguggugugugcuuguaaucccagccacuugggaggcugaggcaggagaauugcuugaacccgggaggugagucaagauugcgccacugcacuccagccugggcaacaagagugugaaaacuccaucucaaaaaaaaaaaaaaaaaaaagaaaaaaagucugaaauccagugguuaauggugguagguuguaccccaguuaguuuggaugcacauaacagaaaaaagcaaaauaacaguggcaaaauaauaacuaaguaguuuguuuuucucucaccucuaaguaaucuagagguaaucagucuaggguugcuagggcucucuggagcucgggguucuucuauuuuacuguuucauugugaaugucuuccacccucaagguuaacucaugguccaaguaccugcuggagcuccauauuccaacuagaagaaagggagaaggauuggaaggacauaccaccuacccuccuuuuuaaggauccauaccagaaauugcacauauuauuuuugcuuauaauuacaauggcuacaacuuaguccuauguaugcaucuaguagauuacagaaaacuugcauguggcagguccaagacaugaaagagacugaaaaauauuuauacuauguggccacaugcccagcuaaagggcacagaagcauagaagauggagagcaacauugaggaucacuagcaaucacugcuuagcccacacucagcugcauuccagaguuuuaucucuuuggguaugguaauccuucucacgaaaccuuucacauucgaauggauaaauacaugaaaaacccaugcacuuaguuuaguguucagaaaaugcuaguuccuucccuuuaauuagauguugucaagugagcagcagugauuuggugcucuggagacucagcacccuaagaauuuguuccaccugugucugggguggugacugccuucugcaucaccaucuuagaggauuugccccaaguucuacauccucuauggcccagcacccuguuagguacaaugggguugcaaaaugaagcauccagauuuuaaggaucuugaacauaaaaucacacauaaugggcucagggccaaacaugggacuauccaggauuuaggaaaacuuucacuucaguguugguuugcagcugacuuugggaaacuauuuaccacauaaaaauuuccaguguuuucuucaagacugagagaagucgaucacagaaccagcccacuugagaagcugaaguuuuccuacuuguaaaaugacagaugaaaaggacugaugcuuccaugaguugcucuugaaaugguaauguagguguaucuguguguggaaaaacacacucaaagugccuuuucuuauuuucucacaacaaaaaucaacacaaauuaaaggcuucugugaucaaaugggcacuuccccccccacaaacaaacaaucaauucugcaguggacaccagcugcguguccuccaauucugaaacuaucuaccaggagauaagugucagauaccacugacacaguccccaaaacugcucccccaaccuaccaccuccacuuucagacaccaguugcaagucugggccucuaaaacuucugaucgaccagauucaaguuuggguucccaugauccccucuuuggguugauuaauuugcuggagcggcucacagaacucagggaaacacguuuauuggguuauaauaaaggauauuacaaagauacaaggaaagggaugccaagcugccaugcccucucugggugcaccauccuccaggaaccuccacuuagcuaucuggaagguccccaaacccuguccucuugggccuuguaugaagacuucauuggguaggcaugauugaagcauggacaacuguguuaaaaugugauucauggacaaaaaguauaugaucuaaacccaauaaggccuguuuagacucuguuugucuucucugugcagcauuucuucccccagggauggggcaggacacccucugggaugagggucuuaugacccacaaucagauaagaguccugccuuggacaggugaaaguagggagguagaacaucagagagagagagagagagagggagagaaagagaaagagguuuuguuuacuaugucgagggcuaugggaguuauacaggaacuguggauuuuauauauaauacguauuauauauauuauauauauaauauauaauauauauauauauauaaaaaauauauauaauacguauuauauauauuuauuauauauuauauuauacauuuauauauuauguuaauauauacauuaauauauuauaucaauauaauauacuauuauauugauauauuaauauauaauauuauauauauuauauauuauauaauauaauauauaauauauauaauauauauguuacaguauaacauugcugugguuugaauauccccuccacaacucauguugaaauuuaauugccauucugacaguaauaggugguaccauuaacaggugauuaggccauaagggguccacccucaugaauggauuaaugccauuacuaugggagugcacucuugauuaaagggaguuugccucccccuuaacccccuugcugucucuuccuuucuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccugucucuuccuuucuuauccucucuugccuuccugccuucuaucaugggaugaugcagcacgaaggcccucaccagauguaggcuccuugaucuuggacuuucuggccccagaaacuguaagaaauaaaucucugcucuuugugaauuacccagucuccuguauucuauuauagcagcacaaaaugaacuaaggcaaacguuguuauacuaugagcauguccuugaaaagucaaggauaaguuaaauguuagcaaauggaaauguguuuuuuaagugagcucauuaaagaaaccagagcgauuuuuucuguaaacuaaagauggcuuccaaaauaaaguuuuuugguauuuucauucaauuagcagauacuuacugaacaccuauuacuuggcaggcacugugcuagaccucauaaaacaugauggguguugucuucaccugccagaguugcucaaaauacgugaauaauaaauugacaaauauauucucagacuaauauacggucaaauaauaacauuuguuacaucgguuauaaaaguuuuuuaacauauuaacauuuaagaaaucuugggguaucuuaagauugauaguaugucauacuuucuuuaguagcauauuuuucuuauguugugacuuaaaauggaugguuucuuagauuugauaacaugcaguauuuagggcuuuaguguuuauuaugugcuuccaugcgccucauuugauucucucuucuuuuuuuuuuuugagacggagucucccucugucacccaggcuggagugcaguggcaugaucucggcucacugcaaccucugccucccagguucaagugauucucuugccucagccuccugaguagcuggagcuacaggcacguggcaccaugcccagcuaauuuuuuguuuguuuguuuguuuguuuuuuaguagagacgggguuucaccauguuggccaggcuggucucgaacucccgaccucaggugaucugccugccucagccucccaaagugcaauuuccauaaguugcccaaaccauuuuccacugaccacacuuaguaaggcaggucagaucuaaggaaugaccuaaauguccuucagcuuucacuuugaucaguggaauugccucuuuaggcugccucaguggccaaagcaugaucagaaagauggagguuugaauccuaacugauuguuguguaacccugggccaguuacuuaaccucuccaagucugccucaaaauaagaauaaaaucuuuagauuuaagguagguaaggcaccuggcaaaugauaaauaaucaauggcaguuauuuuguuacuauuagagcaucaaggaaacacagguuucaugauauuggguuaucuuaaagaaaaaaaaaaagcccuaccugggaaauuuguccuauuuucuggaagacccagaaccccaucaaacaccaagaacagauauccccacuccuaagaaacauuauaggaauaguucagauuuucuucuguuaaaugucauccaucagcucacccgauuuuuuccagcagaccuccucuucuaucuuguguguugcuuuauaugucgcucuugacagcugcuacuauuuaugcaugcauuucuauagcaaaaccuugauuaacugggacacagcaaacuguagcacuuaaaugacuaugguuuuccccuauggacaucauuuggaggagagagggaagugacaacuaaaguuuugagaacugaagagaaucauguaauuccacaucuucgauuuuacugcugagagaaggagaauggaucaaggccacccugcugauuaagagcagagucaggagaggauucucggucuauuuugcuuucuucuggacuguggccuaaagaugugucuuuuggcaucucucuuggggguauuucuccuuaagguuuugccacuacacugcaggucucaaacucaaaugccugcaagggcuaacugguaauaggaaugaguggaggaggcugaguauucuacauugggaaguaguagugaacuaugguccucagacuggagccuauauacccucuguaaaggcaucuaaacuaaaauguuuuucauuuuaagaaguacaggaccgacaaaacacaucugggagucagagauggcuugauguuccccaguugaagugccuugcacuauguauaucuauaggccuuauucaauaaggagauaaucuggauuauggcccucaggcacauugccaaaguaaguuucaauacugugcauugauuuauguuuguuaaaacagaaaauugaagagacgcauuuuagaaaccugaucauaauauauuuuguaacagagagaacagaguagaagcucuggcuucauuuacugucugcuuagccaaaacucuuugugguccaauuagccaaaugaauucagaugucacaguguauaggacauucauaauugggaacacuaggaccucuuaguaccagagauugucccauaacauagacauucaaaaacauuuauaaucaggacacacagugagaaauacauuuauaucauuacugagcagaaacauacacacacucauacauaucacacaaacccaaaacaauauuuuaagaaacaauaucuuacugcguuccaaacucugauguuuuccaaccuauuucauuuuuaugaaaauacuuuauaauuuacucaucggcuacagcauauaguuuaaaucacuggacuagguaaugccaugacauuuuuguuuauucauuaauucaguagauauuuacucaauaucuaaugagagcgaggugcucuuuggagugucaugggggacacaaacaugaacaaaacauggauuuuugcccucaaagaguccaaauccaauaggaaauacauacacgugaauauuuaaaaacucagggcaaaacaaucaguucacauuugacaaacugcuuuuauguuaucauagucauaaugauaacaaaucucuuagguaagcugggcagauuuaaacuuaauuuuacagaugggaaguugcauuuuugaaaaagugacauuuuaaaaagaaguggaaugauaguaauaauagauagcauauguuaagcacuuauuauauguuaggaacuaauuuacuucuuacuauaaccuuauuaugauggcauuacuauaauccucacuuuacagaggagaaaaaugaggcagagagguuaaguaacuugcccaaagucauagagccaggagucauuggaacuaagaaucaaucauaggcaacuucaauuuuuuuuuuuuuuuuuuugagacagagucucgcuuuguuggcucacugcaagcuccaccuccuggguucaagcgauucuccugccucagccuccugaguagcugggacuacaggugccugccaccacgccugguuauuuuuuuggauuuuuaguagauacaggguuucaccguguuagccaggauggucucaaucuccugaccucgugauccgcccaccucagccucccaaagugccaggaccacaggugugagccaccacaccuggcuggcaacuucaauuuuaaucaauguauuauauucucuggaaaugaaaaucacagaucaaaauccuacauaggucauggcauacauaccuugaucucuuagcccaccccaaaagugauguggcaucugcugugacaggauagcauuuggaaugagguguguaugaaggggaugggguggaauagagccugguuccucaguauuccucagugucacuaaucuucaucaaguuaauaaagcaccugaaggcagcaagagaaaagacaaagggaaugauugcuguccccagaagagggcaucuuauccuuugccguugucucauguaugauguaguauuuuugagauaaguuaugaaguagucuugaguuuggaaaaccaagaguuaggcuguaaauguucaccuuguguuugaccagugccaccucccuuaagcccaaauucucauucaaaguuacaaagacaauuuuccauuaggauaucccuggaaaaaauaauauuuagccuuuauugagcuuuucccauuugaaaaacuaagacugccaggcgcugagcuuaaagcugcacccaagacagaccaauaaugguaauagagaacaauuguuaaguacuacucucucucucaaucuguuucucucucucucucucucucucucucucucucucucucucucucucuauauauauauauauauauauauguuagguacuaaucuaauucuucuauauaaugaugguacucauauuaugcuuguuuuauagaguagaacagugagauauucauugauaaguauaugaauuugaucuuuagcacaguaaagaaaauuuuaauguugaaauuggugcauauccaaauuuaggcccaagcccuaguuuuuaggcuguuguaaauuaaccuaguuauuguauuuuccugccuuaauaugcuucuuauaucuucaauuuuauaggauuauuaauaguuauccugauugacuuuauuuauauuaaguauaaagauaaaauucuuauagcccauucagauuuuucuuuacacuugcaaacuccagagauagauauugaaaaauacaaaggcauaugucucaucuauaauuucuuucagcaauaugucugcaaguugagcaaaaauaacugaaagugcucuuuuugaaaauaauaauuuucacuuuucaaaaaugauccuguauuuauuuauuuauuuuuugagacagggucucagucugucacugaggcugguucuaaauucuauuaauccaaugauuauaguccagcauuugucagggcacaugaugaacacuagguauuuacugucccugugugucuguaaugaauuaaaagaaaaaguacagagaaagauuauuuaagauguuaugggaaaagauuuacuagacuucacagaauuauuacuuuagucaaguaacuaaaauaauucaaucugacagauuuggaaaauugaaaguauaaaaauuuguuuuaaaauuuuuauugcaguuuuuccugccaccauucagauuguuugaucuuguuauaaaugagcauuaacucugauuugcaauucaggucacaccauaccucaucaaagaaugcaguugggaaagcaacuggccaggaaguuuagguuuccccagaaggacuggaaggauuuagaaaacauuucuuuggacuucuucugguugaugcucuuccuacaagaaucuguguuugggugauccuuguacaggaaaaugucucuuaguccaauuuauuuuauguagaacuguguagagcuagagcuucccggaaacuuucugagacccaaaucaucuggacugaagucucuuagaugcuauuguuugauuuuguguccuuaggugauugauauaaggacagcaagagaaaaccauguaagaugagaagaaagcaaagcuggcuuuguguaugggcucaaguacauuuuacaugcacguacuuuuuuccuguuuuggugaggaaacucugucaaaugacucuugacgggcgccucacuuagucccuccaaguuuuaguagagaaaaugauaauuuuuaaccaagacuuacuugaucuugaccuaagaugaugagaaugagcaauccuucugaaaucuuauuauuuuaggugaaaauaaacauucgauaauuacauuuuaagacuuaccagaguuuauccagguuuuguucagauccagaacuuauacaaugucggagucuucuuuuaagaauacacgaugacagauacaaaauuagguacacagcuuaauuaacuucaugauaaauucucuucugauuaugaguuacugcuuucuuuggccagaauugugaaagaaaaauaaggcgugaggcuagaggauggggaaaaaaaauccuugucuaucuugcuucccaagcaggccuucaagcuagcuaacugaaacagucuuuucuccagguccuaagguaaaugguggcggaucugaaaaugcgucggacuuaaccuugcccuucuccccaguuuauucgcucaacaaagaguucuaaacagucacaucugcucucuaggcagaacggacgcugccuccuaguauuagaauacccaacucuuugauaucucccuuagggaucaucccuauucuggagaaugugcaaaauauugcucuuccuuuauauccuagcauagauauauucuggcacuuaacaugcauucuuuuucuguugaauugaguuacaagucaguucucuaggacgguuaccguccugguggcuuuggcggaaucuuccggugaaaauaggcuaaguugcaugaaaugggugugucuggauuuuaccacaagaccccugguccucaaagcuucgcaggccgagauaccucgccccuuucuucucugucacacgcgugcgaacacacccucccaacccacgucguaguaguccccucccccgaccaccccgccccguuucccuucaaccccccuccucacgaaccuccccucccuuccuaccucccuuuccuucccuccccgcgggccagcggcuuuggcgcugcccugcugcgcggcggggcgacgcggcgacaccuauaggauugcuuccgggcacuccucagccaggaggugcuggccuggggcccggagcucggcagggccgggcggcuccgcggcguuggcccagaggacgcgcgcccccgcccggccgcgucuccuucccucccucccuccucccggcgccccgagccgagcucagcccagggcggcggcuucgccucgcccggcgaagcuucucuccgguggccgcuccuucuuuucccuccucuuugcgucaugucgggcacuuaauuuuuuuuuuuuuuuaauuccuucuucagcccuuuccaccuuccaucucccuuuucgcuucccagguugauuauuuucucuuuucuccgggcuugcccaugagccuccucgggagcuaccggaaaaagaccagcaacgaugguuaugaaucuuugcagcugguggacaguaacggggacuuaagugcgggaagcggcgggguuggcggcaagcagagagugaacgccggggcagcggcgcggagucccgcccgacagccuccggaccgcgccagcaccauggacagcucagguagcgcugcccgaggggagugcagcgcugagccccgcgcggccuccggagccucccagucgcccggcccgaggcccccccguggucccccagccccgguuugcgagagagccgggcuggaggcgaaggcuucuaauaccaccugggugucgagucucuaauuucucucauccagggagcuacgaaacguuagaucaguccugaggcccagagacuguagcgagcuccuccuaaucucucuagacugcugaauacggcagcugggggcggggagggggagggaaggaggaggggagggguggagaagagaggggagcggguggggcgaagaacggcuugggaggagggcugggagaggcagcugcuuucacugcccagcuggaugagggggagaggugaaggagcaugugcguugauuguuuuugcagcaugcagacgguauuuauuccaauuguuauucuugcaaugcugaugcuauuugcaauucuguaaagcucugccacaucuuaacucagccgucugcuaggguuaauguuaccuuucuccugcaguuuuuaaccugggaucuagagcucuuuuacacagcuuuuacuguuugcacaaugaaauuuauuucauguguuggcuuugaucuuguuuguccuuuugcuugaguguacagauuucauaaaccuuuacauguagggacaaggaaauuccucuaaacuuuguaucggggcuugcaacugucuuuuauaaaagguuuggcaaguuagaguccucucuuggaacugcuguuggcauuugcgauuucaauagcaaaacagucauuuaauauauccauguuggacuaggaguauuauuauagcuauuugcuuacuucugcagggaaccagguucggagaauuguuuacagagauauuuauaauugaaguccucagugguugguucuacacugguaacuuuaauacuggacaacugaggauuccagaggaaagauucauauggggucguuugaacaguaaugaaaucaaacugaauuuaaaugcccugcuuugcaaacaaaugcuuguuuauuuuaauuguguaauggcuguccuugggcuauuauuuucuauuuuccuugucccaaagugggaugaaauauuguccacagaugcucaaauguccugggcugaaaacaaauucuacucauugaagcucuuauugaaguuaaccaagauauugaugggacauucucuuagaccauuuuaaauaaaacuaaaaugauccccaagggauugaugguuucaggacuguuuuuuuuuuuuuuuuuuuuuuuuuuugaggcggagucucacucuguugcccgggcuggagugcagggaugcgaacucggcggacugcaaacuccguuucccggguucaagcgauucuccugccucagccuccugaguagcugggauuacaggcaccugucaccaugcccggcuaauuuuuguacuuuuaguagagacgggguuuugccauguuggccgggcuggucuugaacuccugaccucaggugaucugccugccucggccucccaaagugcugggauuacaggcaugagccaccgcgcccaggcaggacuuuuuuauugauguuguaugugguuauucaauguauguuuuuucaaaucugugauauaucaaaguguaauccaucuuuugacuggauguaaucuccuuuaaaucuuaaaaagauucauguucucugaaugaugccaccauaauaauguuuacauguagugagcauguaaacaauugaaaugaaaacaaacauauuccaaaugagugugaaggagccucacuucaggaaaaugaaagaaauaugaaauacauauguuuuccuuuuucauagggauuauuauuuuaagaguugaaauugguuuuugaaauauguuacauuguagaauaaguucaacauacauuuucugagcccagcuaugugccaagcacugugagggaacacaguagugaaugagauccuucuggccucuaggggacucucagugggggcaguaacuauaacacagagcagccuaugguaaguccuggauuuuugaggauugucuuuuucacuaaaucagacuuuuuuaauagguggagagaagaauaauggauugcuuuaauaaucuguugugaugggaaaguguuucauuaagaauauuguuaucucuaaagugcuauugccaggaguugauucuuaaacuugaucaaagugguguugugugaagaggcugcagggauuccuuuucuccuccccuuauccaucauucacuccuauauuuuauuaggggaauauuguggcuuuguuguagaaguacaggguaucuuacaaugauuuugaugcauauuuucaacugagaaugauuuguuugguuugaaugaaggauuggacucugagaguaggauucuuuuacuaguacaacuauaugucuugccuaauuauaguucuuucuucuaagauccucaaaguguggccugugcaguguaaauauauccauuuguuuaguauaucuaauuaaguucauggaucauuucuaaaguggcaguaaucugcccauuuauucaacugauuguacugugacaugcuggauaggaucagugguuuaugggacuuuugcucugauagaaauauuaaugaguggaaaaaauauguugacaucucgcuacaugauuuaaagcuuagucuuaauaauaccuuaaacuuguaagacuguuuauaauagaacacuuggacaauucucuuauuucauuuccccagaauuuuauuaaauagguuggggaagcagcaugugucugugcuuggagacuugggaucaaaccucugcauuauuguuacucgcugaaaaaccuaguaaccuuuuucuuuucuuuucuagacagauagcucugucacccaggcuggagugcaguggugcgaucucagcucauugcaaccuccaccucccggguucagacaauucuuguguuucagccccucaaguagcugggauuacaggcgugcaccaccacacccggcuaauuuuuguauuuuuaguagagacgggcucuugccauguuggccaggcuggucucggacuccuggucucaagugaucugcccgccuugacaucccaaagugcugugauuacagggucuugcuccauugcccaggcuggagugcaguggugugaucauggcucacugcagucuggaccuccugggcucaaaugacccuccugccucagccucuugaguagcugggacuacagguaugaaccaccaugccuggcuaauuuuuuuuuuuuuuuucuuuguagagaugggguuuuuugccauguugcccaggcuggucucaaacuccugggcucaagcgaucugaccaccucggccucccucccaaagugcucggauuacagacaugaaccaccaugcuuggccuguucccauuuauaaaaguggaaucauaagagcuguucuuaccacagagcuuuaguugaggcugaaaacaauauaaaaauacauuugcaguuuuucuuuacuuuguaucuugcccuuucaauuuaucauaugaagaaacuuauucucagaggugguaggagaccuaucaaagguagaauagauaaugacagccagacuuaggucuucugacucaaagguuugaguuuuuccccauugaacuaaacuuuuggguagacacaauaucaacugauuguugaaauggaaacauuuuuaucuacuuugauuuccccccuguuuuuagauaaaagagggguacauguucagaggaauguaauggcuuucuaagucaacagccucucaagugguagauaccagagcagucuccuagccagaugugacuuccagagcucucugccuucccuggcucacuuucucuucauucaaauuauucucuagaaaagguugucauuuaaaggucauccugucauaucucaaaggcacugcacuaucccaaugccgaaaacccccuauuucucuugugugcaccccacuuuucagggaaaguagaaccacaaaaguagaacuuucaauauugagcugcuaaaguguuccaauauugggcuuaauuuaccaaguucauaaugacaaacugaaaaagaguaguccaauuaaaaucuggaaacagauauuaauacuuuuuaaagaauaaguauaaugauagguaaggauuucucuuuugauucucacuuuuuaggcuuuguucuauauauuuaaauauauagaaauucacauauauaaauaaacaaaauauuguauauauuaaaaaaaaagaauaaggauaaugaacaaugcuaaaauaccauguagugugagucugguuggaaacaaaaauuaccuuuaacaaauucuauuuuaguuaguguuuaaacacagcauccacauuuugaaccagguuucaacauuaugagauacguguuuggauaauuguauacuucauggaaguauaauaaacauauauguacuaauaauccuuucuuaagaauaucugcccauugaagggucuuguagguuggaggcaaaguuuauuuauauaacuuauuuuuuauuuuuuuuuuauuuuuugagacggagucucacucuguugcccaggcuggagugcaguggugugaucccggcucacugcaaccucuuccuccuaguucaagcaauuccccugccucagccuccugaguaacugggauuacaggcacccaccaccagccaggcuaauuuuuguacuuuuagaaaagacggaguuucgccauguuggccagguuggucuuggacuccugaccucaggugauccgccugccucagccucccaaagugcugggauuacaggcgugagccacugugcccagccaauuuauauaacuuauuuaaugugugguuauaguuuggauguuucuggauaaucguuuaaagaugcaccaguuacuggauuacagaauaagauacgucaauuuaaguuucaaauuucaaaugcuuggagacugccagauuucauagauuuggaaggggaaucccuggaaccaaaucucggaaaguuggccagguagccaaugguggacacuuucugugauggagcuuuagcuacuggggcagugucuuugaacuguucucaucagugcagaguucuuuuuauuugggcaaaaucagccuuucuguucucuagauacaaauuaugucuaauccuucuuucacaugguagcccuuagacaacagauuuuugagaacagguacuaauucucucuuagucuuaauuuuccucuuuucuaggccaaucaaaccuaaguuccacaugcuuuuuucucuauauaaaaugauuuccauauaauuauccuaagcuuugagaauaauguuuuuuuuuuuuauuauuuugcacaacagggguuuucaccaauuuuuauuauaaaagguuaaaaaagaauuaaagauuacagaaaggaauaaaaugagaaaaguuaaguauucucuccccucccugaucauuuagguccuugccucagagauaacuucuacuaaaaguuucuggaaggacuuucaacguacaacaugaguguguguaaauauauaugcuuuacacauauauguauauguauguguauaccauuagaauuauaauaaaauacaaauucaaaguuuaaccauguucauauauguacauuguucaauaaugcuuaaugacaaaaauagcuacaauuuaauuauuauaauucagggauuaugcuaaacacugcauauggugucacauuuaacccucauaagaauccuauaagguaaaugauaguaacggucaucuuauaguugaauaaacuaaggcacagagagguuaaguugcgugagguuacacaggcucuacuuauucuauauugaguaaaaugccauagagaaaugcccauacgauugcaaaugaagaauuuaguggugaauuuuuuuauuugcuucuuucucugaggcaaggaaaaauaggagugauugagagaaccaaaaugaguucaguuguuuuuuaaucccaugaaaguacaaauauguuuucuuuacuuaaauauaaagaauuuaaaaacacuggaaaugaaaacagcaaaaacagcauugaauaaagcugauuaagacuugauacggcacugagagaacaauacaauugaugaagcauuauauauuuuuggaaaaauauauugcaaaugaaaauggauccccacugcucuuaggauaaaauccaagguauucuuaacaggacaucagaagcccuuuguggcaccugugaaagcuggcccaacaaaacuuguugucgcuccacugguagauccccuccccagccugcaccuccaucuuuauguuuuugcauacacuguucucucaacucaggccaacuuaucccauagaccccuggacacccacuuuuccagguuaucuccuauucauucuucaggguuuagcucagauauuccuuaaucgcaggcugcaugcaauggucauucuccaugcuccucagcagccuuuacuuccguaucacagcucucaucacauugaguugugacaugcugccuggccugucucucccucuagucuguaaguaaaguucagagcaaggcugggucuuauuugccuuuguagucuugucauugcuuggcauuuauuaggagccugauaaauacuuguuggaugcacaaaagcaugaauggauuuugaauuuuuaaaagggcauuuauaaugaaauaugcccauccaaaucuaaaaauaagcauacagcuagguuuuaacagaaaugaggccagguuugagagaaauguaacuguuggucgaaagcuagaccaauucaguaaugagcauuuuuucauauguaaagacacuggaagugaaagaaagaugguuaauauauagccuagauccuuaacaguuuucuaauauagacaugucaagaaagaauuagcuuaccaaaagauugugcuuuuucgaccaacaaauacaaucuacuguaugauucaucauaaaggucacuuuuuuuuuuuuagccaaaaaaggaaacucaaaauguauacaauuuuuuuaaugaacugacaauagaugacuuucaucuauagaucuguguauuucuuaaucggugucauuaaguuuuaaucuuagccauuuucagguuuaauauuaaaaguucuuuguaucaucuuuggccgucugcaguuguauauaagcuuugugcuaacuuaacugcuuuuuuaaaucugugcucaccaucuugaacuccuuuuggaaaaaagcuauguuugagauggaugaagaaugcuggaguuuagauugugcauuuccuuguugcgaaagguguaacucugaaaaaacuaaauuacaguuauuguauauuaaacagcuauuccugaaauuuacuuggaagcuuuugaaagaguagcucaguaucugaggagaaguucuucacgguccaagaaauuaggaaguuccauaacaugugccaagggaucuggcaauuucuacuaccuuuaguugcuuuaucccacaugucacaggccauagucuagaugcaaaaaauaucuuuuuauuucaauaacacaucagaacauaguuuuaaaagugcuagagauagaaacuuuaaauuaaaauuaaaaugcguguaguauuaacagcgcaaaugucaccaccaaggaagcaaccagaugagccaaugccuccugugcaguguuaaguuugcaugugcagaaaauuacuguuguuguauugugguguaguacucuaccugguagcuggcaaguguguuuggcauacauuguaagccacuuccuaauuuuagaaguguuaugcugugaaaaaagugcaauuagaauuggagauauuugacaaaagucagggugaauaaauaguauaauaauaguuauauaaagugcaauaggggugcagaagaaggagccauaauuuuaaccaggaagacuaaagaaggccacaguggaaguugauauuugagccagaaaucuguaggaaaagaaagaaagaaaacccguuuugggcuuugggcuaaugcacaguggcaucauagugcaugguauguuuagagaauugcauuuaggcuugaagcuggagcccagaugggugggaggugcuauagcagauggugcugggaagauaagacccaggucagggugagucugcuugaggagguuggacuuuauucugcaggcagugggaggccagugaagauuuggagauggggugagguagggcugacuuaucuacuaggcacagugucuagaaaccacaauaauuuuaggguccacaaaaauguuuacauuuuaauugccuuuaaaaaucagaauaaaauaaauaaguauaacaauaaugaauucaucuuuauucaaaugcagucauuaaaauauauguuuuuuuuucuguuaauagaggaauagguccaugaagguaaaaaugccuacggccuacaaaagucauacugcagccccagggaaaagagggcaaaaugugaauccuggagauaauuuacagcugugugaaggaugaaucccaccggugguuccuaacugugaucuggcugcaucagauguaccugaguaaacacagauucccuacuaugcagccguaaaaaggaaugagaucaugaccuuugcagggacauggauggagcuggaagcuguuauccucagcaaacuaaugcaggaacagaaaaccaaacacugcauguucucacuuauaagcgggagcugaagaugagaacacauggacacauggcagggaacaacacacacuggagcuugucagggcauggguggggcgggggaaggagagcaucaggaagaauagcuaauggaugcugggcugaauaccuaggugauggguuggucugugcagcaaaccaucauggcacacguuuaucuauguaacaaacaugcugcacauguacaccagaacuuaaaauaaaaguugaaggaaaaaaaggaaaagaaaacacagauuccugggccccaagcauguuugauuuaggaggaaggggagggguguguuggaagacagagcaugccaguggaggaccaggagaacaaucaaauugcaguuuagcugaugaccugagaaacaacgaaggcccuagccagggcagugucagugagacugggaaaaagucagccuggggaagcauugcacaggugaaugacagacugacaaccaaccaaugguggggucugagauacaggagauaccuggauggcagcaggagagaagguaguauuucuagucucagccagaaguggaaaaugugaucaacuguuuuucucugcugcaaguucaccaugaacauacuuguggaagggcugagaauacuguuagcuuggcacaagcuuucaccaggcuuucagcuuuuugguaggcugcccauuaggcugugcagaugcccaggggagugcuguggaggggugugugguagaagcaggcccuguguuugccuggaggaagagugagauaauggguagaaaugcuagaacugaagcucuguggcucugggcugaguccaggccuaaggcccgaggccaguacggugucuguaucggguggccccuucucacugggagagcccuagacucugguuccuugcuuguugauggaggcacagcaagaauaaucaaacaccugagaaacuuggaagaugauuauugaaaccagaauuuuuuuucagaauucucuggaaaaaauaaaaaaaacaaaaaacaaaaaacaaaaaaaccaaaacaacccugaccccagaaauucucagggacuuucuuguaccagcauuuggccacuugagcauugcggcaaaaaucuuagcagauaauagucuucauuuuucccugauccuuauucuuauuuuaguuucuuccucuucugcagucuuucccucucuucucuucuuuuguccuucucuuucucuuucccacccaucuucaacuuccuuaucccucucucuucuccuuugccucuuguacucaucugcuccccucuucucuuuucuccuccccuucucucuagucagugagucagcaugccugggagauguggagccccaugccauaugcagaugacuguaguuuugggauauguguacgcaugugacuuaguucucagucugcugcauguggcucaaaaggugugaagacuggugucacuuuccaauuuaggcaauugcaucuggcuuaccuaaaauuucacuugcugcuucaaucagcaaaguguuucuuccauacugugacuuggugaugagagguuucaugagcugcaauaccagaggcaguugcauuucauucagaugaaggaaugaauuuuacuaauccacagcccgagaguauaagauaauagcucaccauuucuuccccuccaucucucuuacuuuaccucuguaggaaagcagaucuuucucuucuucuucccuguugcugaagccuagauauauugcucuauuuucaacccuuccaugucuaaauuaguugaggcuguugagcagugggaguacuagggaauuaugagucaggaacuccaaaucuaagcucugacuuugucauuuacaagcugugaccuugggcaagucauucaaaugagaaaaaucauacugacccugccuuuuucauaggcacaguggaaugugagaauguaaaugaaugcauuugcaguugauacucuucauucauucauugcauaaaugucuccuggcugccuacuaugugcugccacucuucuagccaugggggauacaguagacgauaagauagauaagaccuuggcacuuaugaguuugauuauagugcaugagcagugaacaaagauauaugguucuaugguaugcuaaauucuauggagggcuagagcaagcagagaauagcucaggaugguaguaggauggggagaccuaucuuccaggggcuggucaggaaaggcccuucugaggagauaauguuugagcugacaccugaagaaacagaaacaagcaggaaaaagaaagagcagaguguagggcauuucaaguucuagguacagcaaaugcaaagaccuggagaagggggauagcuuuguagaaagaaguguguaccugauauaacuggugcuuagugaacuaggagggcauggccacaaaugagguuugaguuguguuuuuaagagacuguuuggcugcuugcauagagagaguuugagguggcuuccuagguauuccacauuguaggcaggauuucuacaucauagacaaggucagcaauuauacuguucaacacuaaguaucagucuuuuaaaaauuuauuuauuuauuugagacagggucuugcucuguugcccaagcuggcuggaaugcaguggugcaaucauagcucacugcugccucgaauuccugggcucaagcaaggcuccugccucagcuuuccaaguagcuaggacuacaggcaugcaccccaccaugcagggcuaauuuuuaaauuuuuuguagaccagagucuugcuauguugcccaggacggucuugagaccucaaggaauccuccugccuuuggccucccaauauacagggauuacagaugugaaccaccacacccagccuaaauuuaauuuuuuaaagacgauuuuuuuuuaagagaaguuuuauguucacagcaaaauugagaggaagguacaaagauuucccauauauccccugccccuacacaggcaucgccucucccauuaucaacaucccccaccagcaacauacuuuguuaugcucuaucauaugcagaacuuacaaugauccagugaaguaggugguauuaacaaaauguuuuugagagaagguucaauuagguucaaugagcuuauacacagugaaacuagcagcagaacucaggucuucugccauauugggacaugagagagauuuucagaagaggaauugacaucuugggcacccuguagccaagauauaucagcuacuuuaggaagagacaagcuggagggauaggacaggaaaaguuggguuuuaauugccagggaaauugguuuagauugccuugaaaguauagcaggauuuuacuguaauuauuggucuuaaaauucagccauuaaaaucuccuaacaggagauaggagccuggcuuugucucugaaugugccaggagagaacugucuccauuaugccucucauuggcacacagaggcugggaaacuuucacacacugucucguuuugugagcauuugcaguuguaacggaagacagcucuauuuuauaucuugcuuuguuuucaagccauugcaugaaagccaggccucuuggcucuuaaaaauuaacccccccaaaccuauuuuaguuuauagcagugauacagguuaaugaaaagaauauuuaaaacaauucagagaguaguauaaaaaugaaaauaaaaauccauuuuuuucuaucuucucacacagacauggauucuugcauauucacauauacauacauccaaucauauauauaauguacacuugaauuccuggaauccaucuauacaugcuauuauauaaugugauguuuuauuuaacauugucauagauaacuuucuauauuaguaccuaaagauguaccuuauuuucucuaacgauuguuuuaaauuccacuguccaaauuccucuauugauaggggguaaauaucuuugagcauauauuuuuauauauuguauaugcaguauaccugugggaaaaauuccuagaaguggaauuacuaagagaaagaacauaugcaguucacauuaugauagauccugcauuguugcuaagaaccuugcacuaaauuaaguuucuaacaguauaugagacuaccuguuuucccacauucuugucaaagcugaguauugacaaacuucuuaaucuuugguagacucauacaugagaaaugaugauaaugguuuacuugaaacuggcauuaaagguugauauuucugugaauuauuuuuguuuucagaaauuaauuugaauagcuuuucauuagguaggcaauacauauucaaggcaaaacaauuuggaaaauccagaaaacacaaagaaaaaauaaaaauaacugauaaacuuguuuuucaugaauaaccauuguuaacauuuaggauauaccuuuuugucuaaugcaugaagugugaaugagaaaauuuuauuacagcaguggggaaagcauuggaguuggagccagugguuguucuagauucaaguuuuuaacauugcugacuagcuuugugaccuugggcaagucauuuaaauccucugagccucaguuuccuccuuuguaaaacagauaaugccuuuuaauaugauuuggcuuuguguccucacucaaaucucaucucgaauuguaauccccauuugucggaggaggggccuggugggagaugauugaaucaugggggcagcuuucucccuugcuguucucaugauagugagugagaacugaugguuuuaaaauguggacuuccuuucucacuuucucuuucuccugccaccauguaagacgugucuugcuuccccuuugccuucugccaugauuguaaguuucccgaggccuccuagucaugcuuccuguuaagccuguagaacugugagucaguuaaacuucuuuucuucauaaauuacccaggcucagguaguuccuuauagcgaugugaaacuagauuaauacaccuuccuuccuuuguuuucuuuucuuuuuucugaagcagguucuuacccugucacccaggcuggagugcagugacaugaucaaagcccccugcaaccuucaccuccuggggucaagcagucuucccaccucagccuccaaguagcugggauuacaagacugcgacaccaugcccagcuaauuuuuaaauuuuagagaugagguucuacuauguugcccagguuggucucaaccuccugggcucaaaugagccuccugccuuggccucccaaagugcugggauuacagacauuauuguucaggcacagugagccaccaugcccagccaauaaugccuuucuuaucagauuguuaggaagaacaaauggaauaaggaauagaaaacugcucacuguauuccuugcccuauaguggauaacuugauaaguguuggcugugcugaaguucaagugaaguaaggcaguguugagaauauuuuucuuauccugagguuucuucaagguggagaauuuucucucuucaguuuacaaggcacugagccuugucuuuguuauauccauuuugggauuguucauaaguuuuuucucuuucuuuauuuuguuuuuauuuuuuugagacagggucucacucugucacccaggcaggagugcaaauagcacgaucucaacucacugcagccucuacuucccaagcucaagcgauccuccugccuuacccucccucauagcugggacugcaggugcacgccacugugccuagcuaaguuuuuuuuguuuguuuuguuuuguuuuuuuuuuaagauggagucuugcccuguugcccaggcuggagugcaguggugugaucuccgcucacugcaaccuccaccucccggguucaagcaauucucugccucagccuccugaguagcugggauuauaggcacccaccaccaugguuggcuaauuuuuguauuuuuaguagagacgggguuucaccaucuuggccaggcaugucucaaacuccugaggucaagcaaugcucccaccucagccuccuaaagugcugggauuacaggcgugagccacugcacccagccucuuuuucuuguuuucccaguguuuguuuaaaagcuaguucauguaaggcagugguugucaaugaagggcuauuucaugcccuccuccugggacauuugguaaugucuggagacauuuuuaguugacacaauaguggggggaacuguuacuggucucuaguguguagaggccaggguguugccaaacaugcuacaguguacaaaacagcuccucacaacaaagaacuuuccugcccaaaaugucaauagugccgagguagggaaacccugauauagggaauauauugaaugugaauugaaguuaaugaaccuggugaaguaugcaucuauggacucaucaagcuaaugguacuuaguggucggcccuauaaauugaacuauacccuacaggaauuucuaccaggcugcaggagguucuuugcuuuucaggaagauggcguggaaagcaucuaaguuauaaaagggcuguuuggcuagggcuaucaccuggaggcagccgagguccuagaaguuugggucucaguuuucauggaauacaagguagacuuccuuuguuccuucaagcaucuauucauucagcaaacacuguuaagugaccagaaggccaaguacugugcugugucagauaaaaaaggaaaagaaacaaaagcuaagauauuuccucuuaaaggagcuuagaagacaguauauuauugugguuaagaacucagauguggaucucugcugcgugggcucaaagccuggcuuugccacuucuaguuuaugugauuuagccucuugcuuuaggauggaguugagaauaucuaggucauaugauugugugaugauuaaaauguugaugaacacaguguuuaggagagugucuagcucaaugaaauuugcauucuuguuuuuguuauuuguacuguacuacuccuacugcuaaggaaucuuggagccuuauggauuuucuaguuuaguaguuucaaguuugauuaguacuggauuccuuuucucaauauagccuuagccagacucugaguauauaaaauacagauaugcauagcuuaauauagccauacguucugagaaacgcaucuuugggcaauuuuguugugcaaacaucauagagugugcuuacacaaaccugcaugguauagccugcuaugcacuuaggcuguaggcuauagccuauugcucccaggcuacaagccuguauagcauguuacuguacugaauacuguaggcaauuauaacacaaugguaaguauauaucaaaacauaucuaaauauagaaaagguaaugcacugcacuaagauguuaugauggcugcaacaucacuaggugauaggaguuuuucagcuguuauuauccuaugggaugacugucauauauucaaugucauucaccuaaacaucauuaugugcacaugacuguauaugagaacagcagcucuuguuaaaguaagggugggagucuggacacugcuuucugggaccacuccccucucuccccacaacaguguugucugggagagaaccugggacuguguagaacccuguuugccacccagcaaucucauccaguccacucacuuugagugaggaaacugaggccuagagagaggaagugauuuaaaaggaggcuaaagcaagacaggaguagcucuaauguacaugugccaaacacagacagggugcucuaugagggaguucagagaagguagagaugggccccuucuugguuagguugaggucuugaaggauggguaggauuugaacauuccagauaaaguuggaaagaguauuuucacaggaagaaauagaaugauaaagggauggaggaaaaagcauuguagucuuuacccguuucuuagucagucuauuuaaaacauauuacuuaaaaaccaaaggaagguaguugucauaaagucacagaguaauuccuggggcccaggggcaguggagccagcccauaugcaccugguaccccagaagugagcaccuccuggaagcccccucuccagugccccauaguucuuguuucccuuccugugcauuugcucugcccuucacucucucugaagaccagcuuuauugucuucucuguguacauggcuuccucagagguccugaauuucuaugccacugcuuaaagcaaccaguucucaacgaucaucugucucugaaucccaaauucuaaauuccaggaggaaagaauccaauuacacauauagguauuauuugugugcgucucauccaaaauuuuagacagacuagggcaugugaggaaccugucuuauguugagauggauggcaaagcccuacucaaagaugaaaaaggaggaaaacuggcccucaaguugcucuuuuaccagcaguagaaagaagggucuauauaacuauaacaaaguaugagauagacaguacagguaaaaaguaagaggguugaugaaggcuucuugaauggggacauuagugcuggcuuugcaguguaggcaagauuucuugguggagagggagaugggggaggacauuccaaacuagaagcuuggaagaacuuugcauguuugaguaacagugagcaguugaguaccugcauaugccaguacuucauucauucguuuagacaggaaauauuuacugaggaccuaguaaggaggaggauauaauuauggauaaagaaacaaacuuaaaauaguuacacggcuuccccaaggucauagagaauaugaauaugaaccauaucuaucauguuucaaacucuuguuuucuccauuuauacuuuuucuacuugauucuacaaggucaaaagugacuuagagcaagguugguggcucaugcuuuuuuucuguuuuaaauagagaacuuuugaaauugugcauuguccuuacauccuaaagugagaauaggccauaauuuccauaacuauaaaaugauuuauguguggguguauguuuguuuuaggggaauuguuuggucaggugauuucuaccauccauucuaacucaacauuucaugucuggguaauauuggcaaccaguuugauuuaauuuauuacauaauuauuuauaauagaaaaacacuugaaacugccuaaaaugucccaaaauagaggauugguuuagaaaauuaugauaugcccauauaguauuaccaaauagaauauuaagauaugccuauguaguauuaccaaauagaaaacuaagauaugccuauauaguauuaccaacucaaaaaaguugcuuuuuuuuaaugguagagauggugucucaccauguugcccagucugguugugaacuccugggcacaagcaauucucccaccucagccucucaaaguguugggauuagaggcgugagccaccaugcccagcucaauaaauuuuuaauaugaugggaagauauucaaaauauaaaauuaguaguauaaacaagaaacagucuuuauacauugaauuaaacuacauaaacacauacacacauauauuuguauuuacauaggaaaauuauuguaaagauguguauuagucuaaaaaugaaggaacuaucaaaauauuacaaaacaauauuuggguaguagauaucaguaauuaacaaauuuuaaauguguuuugcuaaaaucucaaugaugaauuuauauuucauaacuacaguuuuauguaacuauguucuuuaucugcaucuacuuuuguaacugaaauuuuuauugaaauaauuauagauucacaugcaguugugagaaacaguacagagagauagcuguaaacuuugcccauuucucccagugguauauuuugcaaaacucuaguguaauaucacagccaggauguugacauugauucguuccaccucagauuccccuaguuucuuguacucauuugcauguguacucauguguguauguuaaguuccacacuauuuucucaacuauguggguuccugaaucacagucaagguaccaaacaguuccaacaccauaaggaacccccauguugccauccacaccugccacuauucuuuuaaaaaaguacuugaccccaaugggucgggcauuuauuuuauuuugcuuuugcaucugaggccauaaugguggaaccuuagaguugggaaggacuuagcagucuucuugguuccucaauauagaaguuuuagaggaggagugggaggcauuuuauaauucuccacccuccuccaaacacaucaucagcuugagcugucuucccaaccuuugccccguaacaccuuugccuugguaaugcaggucucaaguuagauaucauguccacuggaaacucuugucugaccuucuaagucugggucaggugcuucuuugugcccugauuauguucuguauuuuccucuuuguggcacuuuucucauuuuauaauugcucauagauaauaaauaaauagugaauggguagauggaggucuggaugagaguccuuucccagugucugaugauccugcaauggccgcuucuccuuccuuucccaccuugugaguggcuuuugauccugccugcacuucggccacagcacuuauguggcaagcccuuguuuauguugauugugcccaauuccagccuucuaccugcugaugguuccaccaggaugacuaacuucaucuucugagcuugucacauuuuucuuuuccuucauuuauaaagucaguaagaugauuacuuuaaguagcuaugagccuauauugugcuaugugcuugauauauauuauaauagcuucagcucuguucaaaagaggaaauggcuacagcugacccagagagcaucuggggauaaaauggggauaguaaaacauaacuugaaguauauuuuauuaaaauauguauaggaauauuuuuaauauuuuauucaauauaauaaauauaaauauuguauuuauacaguauucccacucaugauccugaacaacuuauuauuccugaauaaguuguucaggaucguguagccagauuaguggcagaaauagauucaaauccaaaacugucuguuacaaaguucaccuuuuuugcucugucugcaagaaggaacugcaucucuagggaucuguuuuaauuuccugauucuuccaagacuuagaacauccucuagggaccuguauccaagucuaguucuugacugaacccucuaguuagguagcucuggacuuuggaaggcagccauucuauugcuggacaagaaacauugcugggauguuuauugauguucaguggaaaucugcccuucacucucucaguucuguaucuagguggcuuguaguucuuucccuuggugcaacauacauucuuuugaauuuauaggucccucaugcuguaccuaaaagggauuuuucuggguuuaccucuuuauuuuacagaugaagaaacuugaguccaaagagagaagcccuguuuaacuuacugcccuugaguuacuugaaaccuaaucuugccuuucuggcuuaccuuucucuuucuagcucuuucagucuuuccucaugagauggguuuucuuuacuuuuuauuacccuagucauucuccuuauggacacucuccagcuggccugugugccuccuauuuuugaagcugaccucaauauuccaaauucggguugauugcauggaguucaacagaggauguuuaauucugcaaacaaugaugagaugccacuauguaccaggaacauguugcaauccucuaccauauucugccuuucuuuuucuuugugcacauugucuacaauauuuaugaggcuagagguuugguugcauaugucacaaaggccaucauaacaguggcuuaagcagaugaaagucuauuucuuuuuuuuuuguuuuguuuuguuuuuugagacggagucuuucucuguugcccaggcuggaguacaguggcccaauuucggcucaccgcaagcuccgccuccuggguucaagccauucuccugccucagccucccaaguagcugggacuacaggcgccgccaccaugcccagcuaauuuuguguauuuuuaguagagauaggguuucaccguguuagccaggauggucucaaucuccugaccucgugauccgccagucucggccucccaaaguguugggauuacaggcgugugccaccgcgcccagccuugaaggcuuauuucuugcucauauaaaagucggaucuggaauggauguuguauaaaguagcuagggugccaagcugcuucuaucaugcugcuuuuuuaaucuuuaggguauuacucucuucuucgucaucuaagauggccaacuaaacauuaguuuuccagccaaugugaaggcgagggaagggcuuacuuuuucucucugagaaacagcguguaaguugcagucuuaauuccacucucaucccauuggccagaacuuaaucacauggucguaccuggcugaaggaaagccugggaaauguagucuuuuauucugguaguccaugcgacgagcuaaaaauauuccuaagaagaacaaggaggggagaauggauuuugguuggcaaauagcagucucuaccauaccccuccuucuucagcuccagggaaacaaguccugguugguucuuuguagccauuggcuucccagguuuaugaaguuccauuucuaggaaaaguggcaaagcaggaucucccagaaauucucaggauucugugaaagacugaaaaucagaaucuuugguguggaggucacaaugauaaaaauaccugccauuuauuuggggcuuacuauuuguuugcuaggcauauguuaacaugcauucucuuauuuaauuuucagaugaauccuagggggcagguaugauaacuaauucuaaauuuacaaaccaaguuuuccaaagaggugaaacaacuucccaagguuguacagcgauuacagggugaagcugccaccuguuuaucuuagugcacuggagccugaggucauugcccacucaguuugaugccagacagaccagaguugcucauuaacacuucauaaagcccucucauguuccucauaauaaccagacauuucuaauuauaacuugagcagcaaauguuguuuaagauagguuaugagccccaaguugaagggauggcuuuuauaccauguuugcugaguaugagcucaggucagacaaaauauugggugaccaaauuggcaaagaccauugucccuguauuccauuuugcugucagcagugcucuugguuuauuuucuuuuccaugaggaaacugaggcacagagcuaucacaggacuuauuccaugugguaauguugggauuugcuccacauuguuaugauaccaagcuggaaaucuucauucuccugcugccacauguuccuuacucugggggggccuggacuucuauuuccucauguccuggagucucucagcauguccugggaccugggaccugguuccaggccugaguuugccagcuuugcugugucugguuagagaucacaggcuuuucuggacucuuuuuugcuuauagcuuugcuuuuuaaauuuuuuuucuccuauaaauauggcagauggauuacgaauacaaauguuaacguggggcacucaaugaagaaaggaugucucuaugguuaacucucuuuuccagcuccaaaucaggauauguagacuacaggaaggggcaauggaaaccuugauauuuaagaauaacaaacguuuggugaauugggugguggggcaccuuucuggaggaugaaaaggaaucaauuaugcaaagagccagguagagguuucuuagcaggaugauagcaaaagcaaaugccuuaagugcagaaaugaaaaagaggcaagaaauaaacuaauaucauguuugagucuuacauauuuuggaauuuauuuauuacggaaggagagacagaagcucauuaucagcaaugacuccccuccccugaaucaacggcaauuuuuggacaggccucaauaaugcuaggaguaagugcugucacgcuugucaaauauacuuugcuuagguauguuuggaaaaaugaucaguguccuuggugaaguguuauucucuuuugcuucauuaaacucaccuuaggaagugguuaaauugacaguguuuuuuuuguuuuguuuuguuuccagaauucucuugacaucucccagaggcuuugaacauaagauaccagugcuguuuuugauauuagcagugguuuauaaaaauauuuaagugacucuuuccucuuaacguacauucaaauacuuagaggguuagaaauuagaagauuauaucagaauuucaaaccugggauuuauagaaaauuggagggugcucaaagauguucuguuggcagaggaguugaguugcucugagaacaaugguggauucuuuuauuuacagugguuacagacucacagaugugcuuccacuggccacaauccauccaucacuagcagauuuguacauuguuccaguuugggcauuuggguucucaaucuaauguuaauucaccugcucauauuaagaauuuuaacauaccaagaaauguuuuuuuaaaagcaaacaaaaacaacacuaucccccaaauuaauagugggaauugaauaguacauuuuggccuuauuacucaucugggcucagcagagaucuuuggauaugcuuccaauaacaauaaaaauaacagcuuggugaaauaaauggacucguagguggagaaccgaaguacugagaggaguuuuaucuucugauugcauugcucuuuggcauugaccauggauaaaaaccaucacugcuuuauuuuuaguuuauaaaguacuucuauggauaacauuuuacuucagcuuuacaacugccuuguaaacuggguauaauugucuucauuucacagcugaggagacugaggcuuaaagggguuaagugaguugcccaaggucacagcauagcaagcaggugacagcaucgggauuccaacccguauguuauuauauaaauugucuuaaauccugaaaacaugauagcuuuaaaaccuuaaaaagcaucagugccaucuuuagaacaaugacuuaggauuuuuuuuuccuccauggauauugcuuuaaauguuugaggaaauaacugcaaauuuuguuucauccuaacccuaauaaugcucucuacaaugucccucagcucagaauuccuugugacuauuugaagcuucagucuuuaauauugccuuguguuugauuauaucaugucaaaggcagagccuggaaaaucauuauuaaggauuuguagguuguuugcaugaccuuuuaaaguaaaaaggauagauaugaauagaaauaaauaaaauuauuuugcaaaguaaccauaaggcuucagccaugucuguaucuaauuuauucacuauaaaaaguucuacugaagauacauuuugacuuagaucacauaauugagaaaaagauggcaaauuuaucguuagguuaauguaacuaucccuucuuuggagaggaugauaacaaaacugucaaaagaaaaagaugcccagaugagauuauacuugcaaaauuuuguaggcagauacacaaacugcaaguauaacauguaaccauguuugacaggagaaguaggagaacauggguuacaaaauccuuaagcuugacagccucuggcaagguggugaauaaugugaggucuuuuaaaauggcuuucuugagauaaagcacagaauguaaugcaugcaacuuucagaauuguugcuggagacagcaaaaauacucuugagacagugcaggcuacugaggaaaauacaugcggugauccagaagaaagugagagcacgggcuguugggagaacugcaaagaguuucccugggacuggggcaaagaugggugaaggaggaaugcaggaggugagaaugggaaggaaagcaguucccagguuauucaaggcuuuguaaaccauguaacccugugccucuaaaaauuucuaugaacgggagugauaagauaaaauuuguauuuuaacaacaugccucaucccucuggagaggauuggagggguccaaagcuguuaggaggcuagagauggaaauggccugaacugaguaagauacuaaguaaggaguaguggguguguagaaagguggguuggauuuggguuuugccuauaggaacagugggaggaaacaaggugacucucagauuucuuuguaucuacccauucuuacuccauaaccucccaugcuguaaaaugaugguggugguaacaaugacuauaaaauuugaaggccuguuauauuauaggugugaaacuucucaucaccuacaagauaaaauucaagucuuaaaggggcaugcaagcauuccauaaugugcuuguugccuauccuaccacccuuugguaaacacccugugcaguauugcugaccaauuuauaguucagaaucuaaggucagaauuaacaauauguauugagccagauacucugguacaaauaacagugaucaaaucaacuaugucugucuuuuuuuuuuuuuuucuuuaaacagagucucacucugucgccaggcuggagugcaguggcacgaucuuggcucacugcaaccuccaccucgcggguucaagauauucuccugccucagccuuccgaguagcugggacuacaggcgcacaccacccacgcccagcuaauuuuuuuuuuuuuguauuuuuaguaagacgggguuucaccacguuagccaugauggucuugaucuccugacuuugugauccgccugccuugaccucccaaagugcugcgauuacaggcaugagccaccaggcccagccuaugucuguccuuuuauggagcuucuuuuguaguagauagagacagaaaaaauaaaaacccucaagauaaaaagagccgugaagaaaaaagaguagacuaaggagaguucauauagggugaucaggaaagcaucucugaaaaagaaacauuuaaggagaaaccuauaggaagugaggagggaagccgcguggcucacugggggaauaguggaauuguaagugcaaaggcccugagggaaguacauguugaauagacgaguaguguggcugcagcaaagacgcagggagaaagguaggagauaaggcaagagggguacagaggccuguuccuauagagccuuguaggccauugcgcgagcuuugauuuuuauucuaagugagaugggaaaugauuggaaaauuuucagcagaagaguaacauuugccuuauuucuuaaaagaacaccuuuguuucucuuuaugaaccacaccuuagggaggcaaggguggaggcagagacagcagugaagaagauauugcaauaauucagaugagaagugauuggcuuagaccagguugguggcacuauaggcagugagaaaagguugauuauaccucuuuguaugugguaauauaaaaauauuauauacauuuguauuagucuguucucaugcuacuaauaaagacauauccaaggcuggguaauuuauuaaaggaaagagguuuaauugacucacaguucagcauggcuagggaggcugcaggaaacuuacaaucauggcagaaggggaagcaaacauauccuucuucaugcagcagcagcaaggagaagugccaagcaaaaggaggaaaaguccccuaugaaacuauuauaucuugugagaacucaccacuaucacgagaacaggagcauggggguaacugcccccaugauucaguuaccucccacugggucccucccacaacacauggggauuaucggaaccacaguucaagaugagauuuggguggggacacagccaaaccaugucaacauuguacaugauauauguaguaccuaaauauauauaguuuucuaaauucaaauauacaaaaaaguaaaaaggggaaacacagguagaaaccagaaacccauguccccauuacucagcuucgacaauuauccacuaaugagcaauuucauuuuuucuaaagcuguucuugccccucuggauuauugugaaguagaucccagccauaaugucauuaaauauuugaauaugccucuaacauguaagggccuagcugggcaugauagcaugaacuuguaguccuaguuacaggggagacugaggcuuggagugagaaccugcucaaucagucaaucagucaauaaagggcuccuuuuaaaaaacacugucacaacauucucaucucauccagaaucuuaauaguccuuacuauccucaaauauccagccuguucagauuuuccugauucuuuuaagugggaaucuuauuuuugccuuuuuauaguuuguuugaaccaggauccaaauaauguuuaugcauugaaguugcuugguuuuaaaguuucuucucuaugucucuuuuguuccuguguaauuuuuguuguuguuguuguuguugggaaaaaaaaccaggccauuuguacuguagauuuuccccaagucuagauuuugcugacugcaucccuguggugucacuuaaccuguuccuuuguccucuguguucccgguagauuaaaggcuugaucagacuuacauucagauuagcuuuuugcaagacuaucucguaggucguguuuuguauuuccaucggggauauacaaugugugguuguuucuguuuuuugucaucacugucuagugccauuguuuuauuaggggcugcaaauguaauucuuacuuuuuuuuuuuguuugcuggacuauuucuaugaggaaaaacucuuccucaucagauauuugguuauccuggaguaaaguucauauagcaaacaaaggaaaaaggcuugauucuuacccuuuauuuaccaguuuucaaaaauaaaaaguagguccccuauccuucucugagggugacuuaugaagcuucucucuuucucuuuuucucuucauuuuauuauuaugaacucauauuuuuaaacacacauucauguuucaguccacugcaguuauuacaguuggcccucuggggauuccacaucuguggauucaaccaacccugaaucaaaaauauuuggaaaaacaccaagacaacaacaacaaaaaaguacagaauaaaacaaugauuugucuagcauuuacauugcaauguaauagguauuauacauaaucuagagaugauuuaaaguauaugggaggauguguguagguuauaugcaaauacuacacgauuuuauauaaggacuugagcauccuuggauuuugguauccuugaagggcccuggauccaaucucucgaguauauagagggacaucaguauucuuacuaaugacuaaauggaccaucuuuggucaugggagccucugaagcuagcuccugaaugcuucuaacacacucaaguagucuuugaugcuuuccuugcuuucugguaucaccagauguuccaggcucaucuuguauguuuucugccccaaucuuagaaucagccacuuuuucaaagggcucuaguuccuuuuagagggaaauggugcauaaagaccucuggugugaggggugcucacugcuccugagcugguuuuugugucuaggccuucucaguggacagagcuaggagcaaauuuuuuaaaagguaaaauacauuauggauucacaauuauauuucuuucucccaugccaaaauucugguucucaguugcaccaguguaauuacuuauuugcuuugugccacaauacacagccacagaaucacaauaccaacacuaucaccaaaacagguuaagguaguuuuguuuuuuguuuuucuuuugguggugguggggguacugguuguauauauuuugcuuuaagacaguuacuuuguaucuuaaaguuacuugagguaguuucucucugugugguuauaucaucaauuucauacuaagcuggguugguuuggcucauuuugcuaucacuuuugagggguugcuuuaaaauuuauguuuguaauuauauagaauauuuacauaguuucaaauucaaaucuuuaaagcagguuguauucaaagaaacagcuucugucccugcccccucuacccuguucccucccucacagguaacucucuuucaaguuuuggguuuaucuuuucacuuuguaaauauguguguguaucuauccacucucucuuggauaagugggagcucuauacauaucuuaaauuucggauaaaauuuggagguaguacagacacuauuuucugaaagauuggaugugagguaugagaauagaguugaagcuaaugcccagguaugacaugauugacugauagaauugaaccaccuggccccgagugcccuucuuuccauguggccugguuagccucauucaucuuugcaaacuccagcuuucuuugcucucaggugcucuccucugugcuccauugaugcccucugcgucacauuauccuucccauauggucuuauauacuguuuucauuuguguuuggcugucaguagacugugagcagcuugaugucagacauuaugcuuucuuauucuguuuucccaccaccuaucacagaaccuuucacacaguagaagcucaauagauaccugaguaaauaaauaggccagguguaauguuggguucuuaagaaaaaaaaaaugagguggauguuguuguccuauuucacagaugaaggaacaggcacugaaagguuuaagcugcuuaucuaaagaaacagcuaauaaauugcuggaguacgaacccgaaucuugucugaugccaaggccacacagcuccaacucuguguucucauucagcaguggcaugugagacuguccacaauuagccuauuaauugugugaccucugcaagaaagugagccucuaugucuauuucuacaucuacgaaugcaagauaguaauggcguguacauuauagggcuguaaagcauuuagaauaaugccucauacauaguagggacucaaaucuuagcugauuuuagguacaauuguuauuuuuaguagcggaauauuagaauacuacuacuaccacuacauacaaagcccugugcuuggcacuguguauggagucuucuuugacucaccccaucuugccuucuaggaguuugcaggcaaugugcauaugcuuaaagauuucaagaagggcaacuggggaguggucagucaacaggcagucacuugagauuagugccaaaugcagggaaagaggaaagaaggcacuugcagguggccaacuuguuagauaauagucccucaccccugggcuucuggggcaaaaauaaaaaacagaagccaugguggagauuugaauguuucuguuccaccaaugucaccauuaguggcagccaaauacuucgacuccuuguccaguuuggugauacuccuaacaguccuugccuuguagcauuaauaaguugcacaaaucacaauuuaauacucacauuauauagacucuaugagucauggggucacccagaguucaugggaccuuggagagcagcaaauuccaccuccacauuuuauagaaagagacuuuguccagagaaggaaagccauauguuuaagggcacacugguauuuggaacuugaacucuguugguuaaccuuaugggucagaucaugcagauucccaaaugccuggacccuugccugggagggaguggacucucaauaugcaagagugcugagagacgagggaugauggcuccacuguugugcuggccacauuguauuuggugaguccaggcuccugcucuuaucagaacagcaaugguagcugcuggaggaagagcuggccucccucaggauguagccauuucugcugccugauucauauugggcaaggucuucuuugggcccuuccauagcuauagccaucuaugugcuauuggcgauugcacugagaccucuacucugucaaaaagagguaaggaagaaugugauagugaaagggcaugagauuuagagccacacagaucugguuuguguucugaccccaguguuucuuagaggugugacuuuuauccagucauuuaacuucacuggaaaccucaauuuccuccucaauaaaaugggcaugauaauauccaccacagcagguuguuguaaugauuaagugugauaaucuauaugaagcauuuggcagaaaaaaaguguccaaagaaugguagcuucucugccucucuccccgacucugccugaccuucauuuagggcugucuguccucugucacacaguguggcauagggcuguggcuguguuauuacacuuucuauuuaucagaagcuacugagggguguugaaagauguagacuuuaggcuccacucucagagauucugauuugaaagaaaucugaaaauuugcauuuuuuaaaacaggcaccccaggcuauucugaugcguagccugguaccuaggcugacauuuaaccuugggaaccucuugcaccacuguuugccagaccccuuagcuugggcggguuaugcaaccucucugagccucauuucugcaccuacuaacugggacugauagccuguuuagcaagguccuuuucagggugaaaugaaacagugugugugaagcaucuugcaugaaccuagcacacagcgggagccuggugaagaugugaagaccgauaccagacaccaaagggcugcauugccuucuuccaaucuauaagcuagccguggcccuaguuccuucuuuggaaaccaaacccuugcaauguaucuguccaccuauucuuaccauucuguggauuuugcagaggacacauuguucaugauggaaagccaccugcuugccugucaccugcauuuuuuggagacccuuuuuaugguuauuagugccugucuuugaaauuucagcaccugugagcucugauuguguuaccugggaucuaaaaaggcagcagaggagaacagaugcugcuaaugacuuaucagcucuuuuguccauagucuucucaaagaaaaaaggcugugacccuggguuugucagcacugauaugcuuucacaccacaaagggacuugacaaugggcagguuuccaagucuguagagugguucuuugggggaagauggaaagcauauuuacaguuugguucuucgggcucaugcucuuucuccaccuucugugcucugcugccacuaccccuggaaugcuggugcauguggcuuuugaacaugagagucaaagacagcagcuauugacccuaaaggcugugugugccuguggggugggugggacugggcagcaagaagaggcugaauuaggaaagagcaucuugagccacugucaucaucccuuugugggaccaaguccguaugagggaccgcgaucauagcuggauuguaguuuuccacuccugccuguucaagccuuagaaacuaguuuucauuaauuucauugcuaugcaaugaaugcauagcaguuuuccacuccuggguaucuguucuugcaaauauccuuagauuaaugcagagcagacaucaggccaaggucugccuuuuuuguucuccagcagugcuuuuggguuugacuguuuccuuuuauguuuuaagcuuuuaacaaauauaauaggaggcagcaaaauguugucaguggaacacaggcuuuggagugagacagaccuagggaagagccuggcuguaugaccuaaauuuuuguguuggguccugcugugggcugaauauuuguguccccuccuuucccagauucguaugcugaaaccuaauccuuaaugugguaauauuuggagguagggccuuugggaggugauuagguugugauggcagagccaucgugaacgagauuagugccuuuauaaaagagggccccagagaacuugcuugucucuuucaccaugggaggauacagggagaagauggccuucuacgaauaaagaagugggcccucacuagguaccaaaucugcaggcaccuugaucuuggacuuucucgucuccagaacugugaggaauacauuucuguucuuaauaagccacucaauuuauaguaccuuguuacagcagcccaaauggucuaagacaaguucucacuuugcuccucuguaaaaaggggauaaucaaacuuaccuggcaacauaauugugaagauuaaguaagauaauggacauaaagcuuguagucuaguucccagggaucaaagggugcuuaauaagugauggcuauugcuguuaucaucuugcugcacuucaaugcaauugaaauugguuuaaaagugaauagaaacgguugguuucuugauggauucaauucaguucaauuaaguguccuuuuuuagauggcuuacccugguaagugucaugcugaauacuugauacagauagaaauuaagcacucucuucucgcuaagcucuucuugugcauucucaauuuugcguugcagcuuucaacaaaagcauccccucacccuucccagugauucuaaauuucuuuaucuacucauuugaagguuaguuugacuuucaagccuuuugagaucugagcaucauucaccuuugcggucucaccucucaccccucucuaauauaccacccaguucugugaggaaacaccauaauaucuuggcucuaguauguaccauugccacugccugauacacauuccucuccauuucagagucuuccuccuuccuccuguguaguggagacgcaauacucaucugucaguguuggaugaggauuuaugcauauaauuuuuuuguccgaagagcagauggaaccacacagaccagacugcaggaaagagaagagauaaacaguagacuaccuuaccugugguuucacuuuccaagguuucaguuaucugcugccaacugcagucugaaaguguuaugaaaauuccagaaauaauccauuacguuuuaaauugugugccauucugaguagugugaugaaaucuugcaccgucuugcuugguccugccugggauaugcaucaucccuuuguccaguguuauguuacugcauauuagucacuuaguaguuguguaagugaugagauugacuaucuugguuauugcagugcuuguguucaagugacccuuauuuuacuucauaauggccccaaaucacaagaguagugaugccagcaacuuggauaugccagagaaaagcugcagggugcucccuuuaagugaaaaggcaaaaguuccugacuuaauaaaaaaaaaggaaaaaaaaauauuccgagguuguauagaucuaugguaagagugaaucuuuuaucugugaaauugugaagaaggaaaaagggaauucacgcuaguugugccauuacaucucagacggcaaauguuauggccacaguguguaagugcuguauuaagauggaaaaggcuucaguuugugaguggaagacaugaacagaaacguguuccaauugauggcaguuggguuugguauuaucugugguuucagacaucgacugcaggucuuggacuguauccucuauggaaaagaggggacuacuguacuagcaccugcauuggccagaugcuaaguagaaacagaagcugccuugaacuuagggaggcccuggguguacagugauuuuucuaugccauuuguggugccauuucugcagcccaccagggugcagccugcagaaggaaagucacacagcucuuuccucccuccagggguccuuacaauaaugaaugauggcaaagagucaaagauaggaugaugauaaugccuacuuuuuauugagcacuucuuguagauacaugcacauguguguauuucauucuuaacaaguauuauugcaaaacugagguucagagagguugcaucacacccuugagcaugaagaagacagggaggguggcuguaauaauagggacaguccuccaaagcaugacauccgacucuuuugaugguugggcagcuagugugccagggaaauaauuaucugucuccuuagcaacccccaauauuuggcuuaguugucauugaugcauuucaguuaucuucaugucguuaaagaaauaggucucaggaaauuuaauccagcuagcagugcuaugccuagaauucaauuaacuccaugauuugcaauuaaugagcccucaugccaagauugaggucauagcauuaaucuuacuuuuauuuuaggauuuccacugucaugauuuacagcgaaauccagccaaucuugucaggauuauuggagcauaauuaagccagaaaggcaggcagaacagcuaguuaacaugggauccagggagggaccacauaccuuugcuugguaagccuaccucaagcaggauggggcuacauaugaggauuuccaucuaaggacuguuucccagaugccugaucuguauacauuucaaauccccauccaaucuccaaagaaaauauuuccgagucccaguuggugagcccuugugaguuauguuguuguuaauucaaugcuaccacauccaccuccaccucaaguugccauuuacuaaguuguaaauguaacagacagugagugggcuuuuacagaugauggauuuaauaucugugaugauucuaugaggaagguaucauaggccuucucucuguauaagguuauacagcaaguaaguggccuuuccacugaacugauggaagguuguggcaguuccuagcugcagaccauuuuugugcuucucucccuuucguguguguguguguguguguguguguguguguguguguauuuugcccauuaggaucuccuccacuuucccauauagaaauaagaagguaggcaugcauaggcaaauauuguuuaugauugccuucuaggugacaaauacucauccaucauuaucucauuuaaucaucguauacaugggaggaggauauuaucuaccuccauuuuacaguugagaaaacugaggcuuagagagauuuacuaguuugccugcuguuacacagauagcaaggaaggagagucaguguugugaauccagguaugcuuguuugcaaauccuagguucuuuuaaucacaacacgcuaguacuaaauaaaugcuuuuucucuuuuccugguucuccaggagugguuauuauugagucgagaauuuuugggaaaaguaacacguggagagucaauuuuugaguggaaggagucugaagagaggguaggaaccaaccuccuacuacccaccagguaaggguguacuuuuggccuuugggauuuagcccaugucuucuguauguagagugcagauccagguuggcuaccaugucuggccaaccaagcacagaagccaaccccucccauugacuuuacuuuugcucaguguuugguuuuuccacaagggaggguaguggccagauguuuaugagaaggucuccauaagccaaguccacaccagaagcugaccccacagcuagcgguagcuuucuuugcccuagagaccagugaaacagaggaguagcagguucucuuuguacuuagguagcagauuuuccuccaaaugcuugcuguggguuuuuuggguuuucuccuaggauucaccuucagacuguaucugccucccuguguaguuagcauuuagaaguguccucacuggguuugcuuagccucauugaacauuuuuaugccuggcauggcuuacuagagacuaccuauuggaagugccuacuaauacaauuuucugauaauuuagaugcugaaggacuuccuugaaauuuucuucggcuggcuugggauggaauacuugcuuuugaaauaugcccuaaagagugugcuaucccuggggaaauccacuugucucaggcaauauuaaucugcucugcgaacagcuuguuggaaauuugcugauaauccauuuuuuuuuugucauuccauaucucagugugagagaguaagagaauuugguaaaaguucuuacuuuuuagcuugaccuucugaggucugaggagcacucaccuucccagucucaucuuccaucccucucuaacacacccucaaguucccugaggaaacaacauuauauccugguuccaguauguauuauaguuggugccuuaggaaaauuacuuucuuuuucagagaccccugccccacccuuccucaucugcuuaggggagacuguaauacucaucuuucagugcuggguaagccuagcauguucccuaguaugcuuauaaucagagcucaguuaugauccuuucacuuuuaugucuguccuugacaugauguucucuuaaccuuugcuugcucuccaacauuauuuuguacuaaauaauggacuaaaaugcccuucagcccauuuccauccaaacugcaauucaggcaucaccucugccauaagccauccucuuuccaacaaccuucaacaccacccccgcuccaccaccccugccugccacacacacacagacauacacaggcuggaaauaagcuccucagaaugcuuaucuacuuuauaugcaacuuuauaauacuucuuggugugucuaaacaguagaaaaucaacuaauaauuauaaugcagcacugugagagauaugagagaaaaaauacuaaugacucagaagacuacauuucauugcuaaguggaaauauggcagguccaaaucuauacacaguaucaucuuuauuucuauguauguggacacacaacacaaaauguguauauguacguauacacaaaaacagaacuaagaauguaaggauauauagucuccaaaauguuaacagugguacccuuguuuauuuucuucucuaucuuaauuucaucuucuuugguuucaguagaccucagggguagagaagugaguuaaucauacugcuuugcagucuuuauacggcacaaggccccgucugguuuuauuguagauuuucuuuuuuuuuuuuacuucaucagccucaauuccauccuccucacccagccauuugguuucuuucugaugcucuuuauguauguccuuaagugugcccaaauuuuccacauucuuuaugucuucuauauuauagauauauaugauauuauuguguaaugcaacguauuuuaauguauaaaauauaacaaaauauagguaauguuuauauuuauaucugaaugaaaccuuuuuucauaaauuagaaacuggaauucaugucucugcuuuuuaccucuuuuccccguugucuccccuccccucaacacugcaaucacacacacaugcaugugcacacacacacacgugcacacauacacacacacacaaaaaugaagauuuucuugaccagucguacuuccaguuccaaaaucucaggauuccuuguugcauauauugguugacucccucccuugagcucucugauauaugguuuuguaagaaguuuuuaacaugauuuuucucaaguaauugagcuccuaguuuuuagcauaguacagcagaguuugaacagagaaugaccaauggcaaugcagacagccuuauuggacuaaggauggcauuuucuggugauucguauguuuggcuuaucuuccccagucuaggcucuauucaagcauauggcaaaagggacacaccauuugcaguuagagcaauauuuguuuccuugcccugccagcuacuagcaagcuaagugacuugagccuuaauuucaucauuaugccuuaaagcacuucaaugaaucuuaauugacacccagaaauacgcauuuuuuaaccuuuugaaauuugucgauaauuauuuuaugccccagcauauguaaacacuugauaagaggguauauucuucaguuguugguugcaguauucuauaaaugucaauuagggcaauguaguauuguuguucaaauguuuucuucccauaccaauguuuugucuacuuguucuuaaaaagucugcauuugugauuguggguuugucccuuuaugucuacuuuucuguucauuuuugcuucauauacuuagaagcugugcauacauuuagaaugauauggaauaauugacccuuuauuauuaugaaacauuauuccuuaacucuguaauauugucuugaaauuaauuuguaucauguuaauauaggccuaccugcuuucuuuugcuuacuguaugauuaauauuuucucauccuuugcuauuaaccuaucuguaacuuuguaauuaaaguacaucucuuguagacagcauauaauuuguguuuuuuuuaugcagucugauaaucucugucuuuuagugauaguaucuggccuauuuagauuuauuauaauuauuaauauaauugggauuaagucuacucucguuauuuguuucuaacuauugcuucuguuuuuaguuucucuauucuuuucagcuuuguuaggauuaagcauauauuuuaauaugaaauuuuaauucuucuggcuuuuuggcuauauauaugugguacguauauuugugugugugcauguguguauauauauaaauauauauaaauauauauguaaauauauaaauauauauguaaauauauauaaguauaugugaauacauauaaauauauguaaaugcauauauaaaaauauauauguaaauacauauauaaaaauauauauguaaauauauauauaaauaaauauguaaauauauauauauaaauauauauguaaauauauauauuugguaugugguuucuccagagauugcaauauuuauucuucacuuaucacuguauacauaaaauaaaauaagagaauguuauagcaguaaaauuucacuuaccuuccacccaucuuuugugcuauuuugucauauauuuuucaucuguguaauaacaccacaauacaauguuguuauuuuugcuugcaacagugaucuuucagaugcauuaagagaagaaaaccauaaucuuuuauauucacccagacauuuaccauuucugguacacuucauccuuuccuacagaucugaguuuucaucugguaacauugcccuuaaggcugaagaacuccuuuuagcauuucuuauaaugcaggucaauuagcaacacauuuucuuguguuuuuaauauaaaauuuuguuuugaaaggauuuuuugcugucuauaaaguucuugguugaucauuuuuuucuaucagcacucuaaaaaaauucauuucauuauuuuuugaccuccauuguuucugaugaauguuagccauuauugacauuuuuguuccgcuauauguaauguaucuuuuucucuaucagcuacuaagauuuucuuuuucuuuuucucauuggcagucuuauucugaugugucuaaggugauucuuuguauauuuauccuguuuuggguuugcugaguuacuuggaucugcagcaauaguuuuuaaccagggacaauguugguucucuaggaaacguuuggcaauguuuggagguauuuuugguugucuuugcuuagaguucagauaggagaggauauuacuugaaauuaguuaauagaggcuagggaugcugccaaaaguucuacaauguccacgacaggcccccacaacaaagaauuauccaauuuacaauucaauagugcuaagugccgagguugagacauuugcauuuugaguugaauuuuuuuccaccaaauauuggaaauaaaauaguuuuucugcuccauuuucuuccugcgucccuucuuagacucugcuuacaugaugguaaacugcuugcaugauguugucucacaggucacugagacucuguuuuuaauuucugucgaccugccuucaaguucauaacauuuucuuuugcaguuucgaaucuccuguuaagaucauuuagcaaaauuuucauuucagauauuauacuuuuuaauucugcuauuuucuucuucuuuuuaaaaauauucuuugcugguagcucauuagacuaccucuuuguuuaagccuuugaacauauuaauaagcuuaaaguucuugucuacuaauucuaauaucugaagcauuucagguucuauuucuauuuacugcucuuuuauuguucaauuuuuacugcuccuuuauaucuguaguuuuauuguaugauaaacauugugaugauacuuuguuggaagucuggauuaccauuuucuuugaaaacauguuaaauuuuauucuggaagacaguuaaauuaccgacauauccuucuggucauuaggcuugauuuuauucuuuguuaaaaugggucuauugugguuuucaacuuaguccuaggaaugcagccuuuauuccaagguguaguccuuauuccuagugugauguggccuuucugauacagaaacacugaauauccagcuaaaugccugagaugcucagcaagagcuuuccauuuuggcuaugcuagagcuccaacauaugccagcauuuauaaccucugguauauagugcugguuuaguucucaacccugcaucaggcagucucugcugggccuugugaagucuuacucucuauauuuacagcccagaccucagcuaaggacucagggugaauuuccaugcagucuuuucccuccuaucccuccagcaccccuaaucccuauguccacacugugccucucccuauuuucuuuuauauugucccacauauuccugcuucuuaguaguuuuuguauuuugaucccugccuucacagcucaggggaccacuauucuacuugggcucuagaucauuuuaugguaauaggaaagugcuuccaggcaaaagcuggagcaauugugaggcucaucuugugugguuucuuucuuucaaagaucucaguccuucuuagacuguuguuuaaugccuaaaaaacagauguuuuauauaacuuaucuaguuuaucacaggagcucaaguccaauaccauuaucaugguuggaaguggaaaucaggaauaugcauuuuaaguaaagaccccagauaauucugaaacugaugguuguggguucauauuuuagaacugcugauguaaauuauuuaaaguagauauaaaguauucaaaguagccccagcuuucugaggaauugucagaggaucucuacucuccaggaggucuagguauuuuauauuuugcaaaggauaaaggacuuuuaucugaaauguuucuuggugugagaucccuuugagugugguguauguguaugcguauauuugcuacagugcugaguuguacucuguguuuucaccaucuuguguauagacaaugcacaauagaauaccacaccauagcagaaucauugaucaaauauacugcaagaaugaaucauccauacauguguguguacacacacaguuauauauauuuuuuuuuucuuaagauggaguuucgcucuuguugcccaggcuggagugcaguggcgcgaucucggcucaaugcaaccucugccuucagguucaagcaauucuccugcuucagccucccaaguagcugggauuacaggcguccaccaccaugcccggcuaauuuuuuguguuuuuaguagagacgggguuucaccauguuggccaggcuggucuugaacuccugacuucaggugauccacccgccucagcuucccaaagugcuaggauuacaggugugggccacugcacccggccuuauaaacauuuucaauauguaguuuuauauguaaauuucaugugucaauaaagcuauuuuuuucaaaaaguuaagucauggcaaugauuuggggaagucauuuuauuuuccuggugcauccauuugaggcauagggauacauugcuaauauucuauugaguauuaaaguguuaugagucuggguucuuuccucucauuguccaaggggggcuuccagcucucugacuguuauguuccugacugugccugaugaaaugaaaaaaacaugggucuugucuucacaccgacauuuggauauauccuaacuaaguaaucuggugaaugaacugaccucugacucucuuuugauuuaggcuagaaguccaaugcacuauccauugugccacagagccugccugcuugcacgaauugaccucuuugagacacaguucccuuaucugaaaaauaagagcaaaaauauauuucaguuuuaaugugugggauacuguauauuccuagcauggugccuaacauauaguaaggccacuuugguauauguguagcacauguguguguuguauguagcacauagcauauauacccuuaccuugaucuuguaaacgacaaacaauauucauccacaaccacugcuacuuuucuggagaacaguaauuugaucuuucucucagaaguuggcuugcaauggcagcuccagaauuucugccuuggagcuaagagaagacaaucuugguagaaggggaggagcuugagaaaacgcuucuuagagcugcauaugcauaacaagcacacugguuuucuaaaauucuaccuguauaugggggguuguuugggaagacugauagaguucucucaguugcccuuuggugccuauauugucuccccugucucucuuaaauggaacugaaaugucgaacagaaaauuuuugccuuauuuuuuucucuuugcaguuuucuuuaaguagaccaucaguccucugcuaucucuauucucuaucauagacaaggucagauaacagcaaggacauuuucucuguuccagggugguaauuaagagggaaaugucauaguccauuuuaugcaauuuaagcccugaucuuuugauuagagaagggaggaaaaaaacaauugauggccccucacuuucuggaguugagguuccauguggugcccagaacccuuucuguuucuucagguuucuauugaggauucugaucucauugaauagauuugauuauuauuauuucauaaugcagagccuuuuuauuugguccacauguugaagaguaaagauuccuuauuuagaccccuuuucccuggcacaucauaaguacuuacuuugucuguugaaucaaauuaagcaauauccauguaaaguuuuauaugagaguuuauugaguagaauuuggauuggcaccuguagccugauuucuuugauccuugaaggaacaaaauauguuacauccauuugacuggaauuccccuagcaccaacagccugguugugaacacugugcccuaucuuuauuauacgcagaguucauuuugguuucaauguagucauuacuuuguauuucucauuuuuuccacucuuaucaaucuuuuuucauguugucgauccuuuugggaaagaggagcuaguauugguuucuuaauuaguucuucuaucucuuugaagauaaacauuucccaucaaauauuagccuucuuuacaauaaagcgcauguuguauuucaagaaaucuccaucuuuuaggcaggcuuucucagugggugcaguguugcaaucagaaauucugaaaagcuugaggagacagugaaacagugaaagcaucuagucauauuugcuaccuacaguuaagcaaagaccagaucacugccaaaguugaucuguuuggucuuccuugccaucucugccaucuucucuuugauuauugcauuccauagcagcucaguuucacauacuuuuauugagugcuuacugugugccauauauugcacuuaggggacugugaagaggcaugaaacaugcuucuugcuguugaagacucaauagcaaguaauugaguugaggggagguagacucauucacaaguaauuauaaugcaagcugacugcucugaguccuaggauggaggaacagaaugaggugggagaauggaggcaugagagacaaaaaguaccucuugaaagaggcaggauggggaagugaauaagagcagaggcuuuggguccagccaaaccuagcuucauuucauucuguugugacuguuacuaaacuucaccaaaaccucaguuuccucagugggacucccaccugccacugugcuuagugcaagcaucccauuuaguuguuuauggaaacugcuuagcugagugucuagccuagaguacauguuuaguagauggccuuuguaugaggaugaugauaguguuaaagaauuuuaaaaguggaggggacuuaggaaaucacuuaauucauucuccuauguuuauauucuuggagacucugaguuugugauucucccauagcuugggaaauagcugagccaucauagucuaguauucuucccauuaacaaccugaaaagugaguguggacguacucaugugugcacguacagauuucauggugucuguaagugaugacaaaagcuuuaauaacuggcacacuagcauaauauagaaaucaauauauaucaauguaaaauauaacccccuuuuauucuguaaauaaauacacacaagcacauguauauuaucacuguuuauagcacaaauuaucacucuaauuuccaauuuuuuaauugauuuuuggacauucugaagaguauucuuguuacuagcuaaaugaucuccauuuccgggccaugguuugacauagggaaugccagccaaaccuuccagcaacuuccccauuaaauugauuauucugguugggcguaguggcugacacauguaaucccagcacuuugggaggucaaggcaggcagaucacuugagcucaggaguuugagaacauggcgaaaccccguugcugcagaaaauacaaaaauuagccaggcaugggugcaacccuguagucccagcuacucaggagguggaguugggaggaucgcuugagccugggaggcggagguugcagugagccaagauugggccacugcacugcacagccugggcaagagagccacacccugucucaaaaaaaaaaaaaaaaaaaaaagaaaaagauuauccuaagggcccuggcacuuuauugcaguacaaagagaguugggugugcuauugccuuguaagagcugugauggucuuggaugccuaugcuuccuauguggccugaaacgagaaagccugacucauuggcauuaccugcucuguggccucugccugccagugcuuagcuccccuggagccuuccauggaugcuacacaugccccugcuucugcucucuuggucuguugagcagcuguguccagggccacagcuguagcuuauaccacgugccaccuaguacauaaguauuguaauauaucaaaaaccaguacuacugaaucugagugaaccugaauauuaguccugcaaauagcucacaauaaguccuccuaccaggcaccaggucacgucaagaugagaagcagaaacuucagagugauaaagagguucacuucuguuaaacauuuguucuucugaacuaucaaaagugaagaguuuccaugggccauagcuuggauacaccaauaggagauucuuacccuagggaggcuugcuagacacaucuccagucuggcuuuguuaacccugaaauggaacagcauggcuuuuuuuuuuuuuuuuuuuuuuucuggccaaggcugcgugaguuugcuagaggcagcauuuuuuuguggcuuuaucuucuaugugccauucuauuaauauuucuauucuacagauaaggaaaucaagacuucucuagacuauauauccagcuaauagcagagguaggauccagaucaguucuggcugaacugaagcugacauaaagccuguauuuuaauacagguugccuucuguaaugccuaaccucuuguuuggcauagggguuauugauuuguuauuuugcuaaauguuaucuuuuuuucucugaaauuuuaauuucuaguuggauucccagccauuugugggaggcauuccuuggaaucauguacuaugagugcugaauuucuaagaauuaaaauaaaaauucugacaggcaugguggcucauaacuguaauuccagcacuuugggaggcuaaggccggccaaucaccugagguuaggaguucgagaccagccugggaaacauggugaaacccugucucuacaaaaaauuaacugggugugguggugcaugccuguaaucccagcuacucgggaggcugaggugggagacucacuugagcccaggagguggagguugcagugagccgagacugcaccacugcacugcagccuagauaacagaaugauacucugucucaaaaauaaauaaauaaauaaauaaaauaaaauaaaauaaaauaaauuuaaaaaaauaaaaauuucuggucauuuuagaagaucucauuacauaaaaaucacaaugucaugcguguuauuauuugauccuguugaugacaugaggcauguagaaaaguuuuuguucuuaauuaguuccaguuuauaggguggggaguugguggggggaaggaggccuagaggaguaaaaugacauacucaaggucacacagcuuuuaagcagaaaaaccaaguuucaagucugagaccucucuucucaaagucuguuacauuuccucaaagcuucccuggagugagaugaauggggaaugagacguaagcagccuuuggagccaaagcaguggcuuuuuccaugguauaucuacuuguuaugcccauacgauccauuucucuaacugcugggagccaagaucugaaaaaucuguuacaaagaaggaugaugaagcccuuugugauaaugacacgaguuccuuccuugcccuuugccaagcacugugaaggaauggcuuuucccuagaguggggcaucucuacagagucacuuuaguuucagggauuucuaucccacaguugucaauuuuauagaagccaggacaagacauuuuuaacauugugacucuuaaccacugagaaaaaugcccacuggugaaugggaacaugaauaugacaugauucuaaugccaaguucacuuuaucagucgucucuccaaaaggcugauccugaacacuaugggauacuaacucacuuuacuagaccuggaugaugaaaacauucuggaaagaggaaaagugauguucuguggaaguguuuuuguggagucccagaggauccacugaagaaggcugaugucccaagaacugcaguuggugccaaguguugguugaauucuugagagcaagaacugcaguuggugccaaguugcugcccaucuccucccuguccccagcauauuagaucaucuugaguauugaugcuggagcugagacaguuaccacugugaugaagcugggucugaagucuuagaauaagucaaauguagaaggauguuccuuccuggcaagccccuagccugcuuggagugaggggggcacacaggcucuuggagggcuguuggcagcauuugccugccucucccaggccagcugagaaacuuguguggcugugaacugugaugaaucacgcaagaggaaggaggucucuacagcuguugaggaaggacauaucaaacuugaauagcauagcacuuggcucuuuauuuuauguaacauauuuuuaauuguaaaacuaaugaauguggccgggcacgguggcucaugccuguaaucccagcacauugggaggccgaggcuggcggaucacuuuaggucaggacuucaagaccagccucaccaacauggcgaaaccccaucucuacuaaaaauacaaaaauuagcugggcaugguggcgggcaccuguaaucccagcuuaucgggaggccgacgcaggugaaucacuugaaccugggaggcagagguugcagugagcugagaucgcaccacuauacucuggccugggcgauagagcgagacucagucucaaaaaaaaaaaaaaaaaaaaaacaaaaccuaaugaauguaacuugcagaaaauuuagaaaauauaaucauaaaaacaaacaaaaaucacucaucauuuucccagauauaauuaaauauaauuacuauaacuguuuugaaaauguaguggauaaaagccuggacucuagaauagccugcauggguacaaauccuggcuuacuaacuguaggaccuggggugaaucacugauaugucuuugcuucaguuuccuuguguauaagaugaagauagcaaugguauugccuucauaggguauuugugaagauuaaauguguuacuacauauaaagaauuuagaucaguggccuaguaugugguaggcauucaguagguuucaguuguuauuauuuuauguuuauuauauccucugaauuguuucucuaaacugagauaguuuucuuuuacaaaaguaagauuacacaguggauuauguguuguagccugcuuauuuuacauuuagccuuugccaugcccuucuguacuuuucugcaaaaugauuuuaguagcuaaccauauggcguuauuagagauauuuaacaauucccuuacuauugaaaaaaauacaucauuuauagccucuugccaugguaaacacuaucuugaugaacgucucuuuuugguaaguuuuugcauaccauccuucuuuugaugacaguauuuuaugggggagcauuucuucuuagaggaccagauggaauuauccacagcccagggugccauaggcauguacugaauaagcauaugaggggaugaucacuaugcauuauggacacuccuucuccuuugauaccacuucucacaguguuuuguccacggcuaagaaaucaauaaaauguuuaugaaaagcagccacacuuuuuuauauuuucaguuacauuaaggcaguuaagacuagcccuagcauuuguguuuaucuucuuuauauaauuucuaaaugacuauugaaucaucucaaaucucuuuuggaaugaagcucgauacaaauaaaugaucaaacagccaacuagcaaucuagugggagacagaaauucucucccaggaaacacaaauuuuaugucacucuugacagcaaggacuggucagguuccuacaacuuggaaggaauaggauacugcgucuaguuucccaaacauuaggaaucccaaggaaaacuuauuucuuacacccuuaaagugacucagagguaaaagugcaauucucugauguuuguccuuggugggcuuagauuuucacaccacagacaucauugaaacaagaaucuacuuggagccuuagaggcaguccuggaccuuucucuuuggauggcacucacaugcucugucaacucugauguccucaccuucacucucuuacacccucaaaucccugaggacccuuaguaagcagaguguucuuuccacugggugccauuuuagccaaaguauuuagaaagguguuggagguagcaagcucugcauuccuaagaacacaagugguguuaaccaucugaugcaaggguuggaaaacuuuuucuguaaagggccagagaguaaaugcuuuagacuuugugggccguaagaucuguggcacuacuauuuuaacucugcauuguagcaugaaagcaaccauaggcaagauguaaacacauaaggguacuuuacuucuggacauugaaauuugacccucauaccaguuucauguuaugaaauaucauucuucuuucuacuuuuuucaaucauuuaaaaauguaaaagccauuguuauuucacagacuguacaaaaacaggccguggacuggaucuggcccaugggauccaguuuguuaccccuugaucuaccguggucauuguuugucuucugcauuucuuucucauugcaccauuuucuucuuuguugugccauauuuugaaaccucucugcccuuucucuuaacuagcugaggcuaaaauauuugcagaaucugcacuuuuggcacuuauguggcucaucagggaaagccagaauaucuaccuaaaagaaccaguagagcaacaucaaauaaugccccucuucuuuuuuguguggccuugccaguucaacguauaauuugaauauaugaagguuacagauggacucuggcaaguuguucugauuucugcagcauuccaaagcucuaaugagcagagcaugcagccugagggauggugagagucugauuuuuagauaaucaaggauauuuauaucuuuuaauaggcuggugccuuguaguucuauuccagcauaaaacugagaguugaagagacaucuaaucaauuugauguccucucuuuaacaguuauauaucaaagggguguucaggcugaacacaugaaaauguuacagggauggaaaugggagaauuauaaacauuuuaugcugcucuauccucacuauauuuaaaacaaaaacaugauacagauuuuuacauggugggguguguuuacagggaaauaaugugcucuauuucauaugaaacaggacacaagagagcauucucagauuuguaacacuagccguagucuguggaggugcccauuagaccuguuccuggccuuuuauucagggcugugaagcaguaggggcgacagaggcucggcugccugcguaaugagauugacuugguuugccuggcaugcagugauuuaugagggugcuuauuguagggauaucugccgcugagagcagccagaugaaaggugugugggugagagguggaggagagcagggaauaggagagaggcaguuguguauaggcagguaaggcucaucuugauuauaguuguuggaauccugagcugagugaagauguagaauagugugaaaugguagauuagcaaggcuuuggaauugcacagauauggguuugaauugcugacccuuccacucguuaacuggacucuuuggugaguuacuuuccuucuuugagcuuccauugcuucaucuguaaacuggggauaauaaccacuuccacucucccgcuauaugaaacuguacuaucauaaaggucugagcacaguuccuguugcauuggagagcucaguuagugguagagaugauuaauguuuguccauauguccauucauuguuuguuuaccaguauucaaugugcuuugcaauuucuaacagagccucauuuucuaauagaugucuaauggugacuuagacaucuguuagguaucaauagcucuuaagaucaggauggaagaacaugacagucaacauguauuuauagauauauguaugaacaucuaaguggcauguaggaguguacugguaccugaaauaugauugaaagaacagccaccuggccaguaagcacaguaaaagauacuucaccucacuaguaaucagggaaauuaccaaaauaggaccaaagugagauacuuauuuauacuugacaaagugguaaaaauguaaaagucugacaauacuaaguguuaaggagaauauagagugaaggaacacauauguacuaguuguaggaauuuaaacugcugugacugcuuuggagaaugguuugucaauaucuagauauaugaaguguacauaccuuauuuacuggcaaauucugcuuguagguauaaucuagagagagucuuauguauguuaucaaagucauguguuccucacuguguugcuuauuauaacaaauagccuacguguccaucagugggguaauugauacacacauuaauugagcuaaagcugcauuugguaccagcauaggugaauuuuaaacaaaaguaagugaaaaaaauaaaguugcaaaauuaugcaaauagaaaaccauuuauguacagcuugaaaucuuggaaaauaauauuaauacauuuuuuguggauacaaacauauggaauacaaguuugaagaaauuaauuggaaugacaaauauaaaauucaggcugauauuaggagaagaaagugggaugugauuggaaggguugccuggguucacuagcuuguaugcccuuagacaaguuucuuaacgucugugccucaguuuucugaucuauaacauaggaauaauaauauuaucuauuucauugggaugcuaugaggauuaaaugacugaauauagauaaaaugcuuagaaaaauaccuaccagauaguaaguguuauauauaaguuagcaauuauagugccuauuacgugaauauuuuuauuauucuuuauuuugaaaaucuuauauauugcaaguuuugaaaaagaauagaugccauucuugucuuuugucaucauauaguuggaaagugaacaaagauuaaaaauaccaucaauacaggaauuucaggauguggcauaauagaguuuagcuacguucucuugaccccuagauuuauuagguaccaugccaacagcuuuauaugcauuuauuuaaucuuucccuauggaguaggcacaauuuuuaucccuauuuuacagaugggaagaaagagauuuagaaagacugacuuccagggucacacagcuagggguagcaaagcugggcaggaacccaggugagaaugacucacgcucuugacugcuaggccuuaaagcccuaccuggccacuguucacauuaaccaccuccucuacacagauuccugcuuccuuccuguaucagccugcauagguuagguugugcuuugguuaugaacauucccaaaagaucagcggcuucuauuaacaaacagguguuucuuacuguauuagucuguuuucacgcugcuuuaaagaacuaccugagacucagcaauuuauaaagaaaagaaguuuaauugauucacaguuccacauggcuguagaggccucaggaaacuuacaaccaugacagagggugaaggggaagcaagucacaucuuacaugauggcaggacagagaaagagagcaaggacggaagugccacauuuuaaaaccuucagaucucucacugucaugagaacagcauggggaaaauccaccuccaugauccaaucacuucccaccagguuccuccccugacccguggagauuacaacuugagacgagauuugaguggggacauagaaccaaaccauauuacuuacucaugccaaauauucaucaaaggucaccugggucaucaaaggucauaugccacauagcuccuuucucugggacccagaagucauggacagagcagccacagucuccaaccuugcugauugcuauggcaaagggagagagaaauacagacagagagagagagagacagagaaagagagaaagagagagagaaaaacuauggagaauaucacauugacaguuaaauguacccuggaagugaugcacaacauacacugugauacacagcacuuccccucacacacauaggcuggagcagugguuuucaaccaggggugauuuugccuccacuaggggauauuugccaaucucuggagacauuuuuuauugucacaacucagagguggaguggggguuggggcaggugcuacuggcaucuagugaauagaggccaggaaugcuacucaacaccuugcagugcacagggacaacccccucaaaacacgcacaauaaagaaguauuuagccuaaaaugucaauagugcugagauugagaagcccuggacuggagcuaagcacaaggggccaaaaagcgcaauuuuaagaagcuauaaagggaagagaaccugaaauauuugacagauagcacuaauagcugccaugcauccuaaggccuaaaagcuguacuaaagccccuucagaagguguuuuucaugauagaagugaaccagugcuuuaagggauagccauggaauggggcuucuaguauagucagcuucaucagagggccgaggagugcccuggacucacugaaguugacuacugcucuuccucagcagucucucuggagcagcacuguccaaauguaguacaauaaaggccacauacguagcuuaaaaauuuucaguauccacaccaaacagguaaaaaggagcaggugaaauugauuuuacagcuauaauuucuuuaauucaauauauuuaaauuauuauuucaacauguaaucaguauaaaaauauugagauacuuuacauucuuuuuuuuuugcaccaagccuuuggaauguguuguguguuuuauauuuacugcacauuucaguugagacuagccauauuucaggcgcucaauuguuacacauggcuaguagcggcaauacuggagguuucuguuccugggacucagugagggacugaccugggucuccccugaggaccaguagcaaugcuauaacucagagucuauaaguucugagagugggacacaauuuccaggaauaucugucccagacucuuaaagacagucuguguauguuuuaagaaugaagagggauugguuuuccguggauucucugccaucaccauuuuuguuuguuuguuuuuuuuuuuuuuuggcaggugccucaucuccagacauggagcccagcuaugggggaggucucuuugacaugguaaaaggaggugcagggaggcucuuuaguaaccuaaaggacaacuugaaagacacccucaaagacacaucuucuagagugauacaaucugugaccagguacgcacauucuucccaguuaauuuaguggauccccaugcucucaaaggaucugguuaccugcugacugcuugucuggcucaaagagugucaauuuugggauauaauuuuaugggaucugaugaacugagaaaugucauugaagacauaaaguuaaguccuuuagaagcuauaagcacgggcugggaggacucaguucauugccacauuagaguauaaugguugcccucccugucuuuagaaucaaacaucuuggguucuaaugcaauaucugcccuuguuaacuaagagcccucaggcaaguuaauuaaccucucagagcuuuuuuuuuauacccugacaggauuugugucuuuggguuguuuagggauuaaaugagauuaaaauauacaugcaaucugaauaagcauuaccuacggauuguaaucaaaucagaacuuuguuuuuguuuccuacuagcccuuuaacauuuauucagugagagaaguuuccuacucuuccacuguaugaaaauucuuauaagcaggucauaggaguuauuuuuuauuguuuaguauuagaaaauucuagggucacuuugaguuacaauaugcaguucuuaaucagaaauucaaacgucaaguacauuauauuaaucaaaauuuuaaucuuuguucaaagauaaaacuauucuuaccucugauucucaaccagggccugguaggcagaaaaauggugucauuuauuuuuucucaaccacuucuuccccuaccccuuagccacuuacaauuauggaagauauuuccagguaggcaaagaagcuagaacaauugguguugauaaauaagcagaguuuucuauucugagauugauucagaucaugaaguggcaucuacaagggcauuagaaugcaccaguuggaguggcauauuuauaccccugaggucacgggcuuucuuuucucagugauccuuccuuguuggagagaagggcuggaggggagucgaaacaugcccccuggacagcggugucccaguucauaugcgcaagugauugagagagagaaaucuuggcauauuuggaucauuuuaaugagugcccauuuuugucuugcuuuuagcuacacaaagggagauuuagacuucacuuauguuaccuccagaauuauugguaaguuucucauguuuauuaacaguccuuuggcucaguuucccguugcugcccaucguuauagcagacguaaacauuuaaccuguuuucuuucugugugaucucucuccuagugauguccuuuccucuggacaauguugacauaggauucaggaaucagguugaugacauucgaagcuuuuuggauuccagacaucuugaccacuacacaguauacaaucugucaccuaagucuuaucgaacugccaaguuucacagccggguaaggauuuuuagcccugagaucauacuguugaagacgugauggugcuuuuccuccucagagauacccuuaaagcacgugcccuuaggcaucugaagcugaaaaacuauacacucuggacacuucuguucacaaaauauuuauuaggcugcuaugagauauccuaaagauuuuccuugggugaggauacuuacaggaaaguguaucugucaaugaaauaccaucgaaguuggggucucaagucuguuggugccugguuguuccauggcacaguguucaugaggcuuaaguuggagauugaacugcugcuagggcaguuggcugccuucaugcuguuacacuaauuaugccguugacccuucuuuauugcuacuugguaucaagauaaggcaguguggauagaccgguacugacaaguauuaaugggaacguguuuccauuaauauauuuuaagaaguuuuuugaacuagagagagaaauauuccuaguuucaccuuggcuuagguuugaaucugauaucgagccugauauuucuggccacugaauucugacuuacucacuaaaaaaaggcauuuuuuuccccucucaagaacaucucuaaauauuuuugacuuagccuucagauaugauugguucugcaacuucauuugggucuauuaauaaauagaauggacuuucuaugcauggauccuuuaaaagugaaacuugaugucaaauguguaaaaugauagcugguugacaaugcuguguaucuaggaucuuagcuuugaugcuggaacacacuucguuccaaauuccaguuaccauugauaaucucugggccucaguuuccagaucuguaacacacacaagaaaauugguguacaugcuuuauauggcuccuuccugcccuaauauucaauaagcuaugggagaguuuuaaggaccucuuuuucagcguauucugagaacagucucaaauuuuggugugcaucagaaucacuuggagggcuuguuaaacacagacuucugauucagaaggacaagggaggcauaagaaucugcauuucuaacagcuuccugggggcugcuccugauguugcugcggggaccacucuuugauaaagcacugauaacgccauucugaagugguuugaucuaaauugccauucuauaaugaagauuuuaaaugcaucucuuuaaaaucuucuguaauaaaauaaccuuccaacucuuauuccaucuauuagcuaauucagaacaagugaauuaacaucaaacaaaaauguggauagauauuuuguucuuaauguaaggcaaaucuuuugaauuauuuuucuugacuggaggcuaagucagugccauuauuuucauaauuuaaggacuguggaacauccuacacaauauuucauagaaauuuuauuugaccuugaaagaucugugauaaucuggagcauuuucccucugaaaguaaauaaagauaugauaucauuauagaagcauuuauacauauaaagaugucucuuuguauaauguuuauaaaaggcaaucucuauaaagauguuuuuaaugaaaggcaucuaucaguguaacuaaagauuuugugacuggacuuaaggguuuaccaaaggaaucagagauuacauauuaaacaccuacccugggcugcucuuacuugcccuagaagaggagggagcauuuuuuuuuuuuuuuuuuuggauaccuagaacaacaguuccugacauagauaaucaauguuuuuaaaaagcaugaaugugcugcacccauuaacucgucauuuagcauuagguauaucuccuaaugcuaucccuccccaaaaauaaaaaauaaaaauaaaaaagcaugaauguggaaagaauuguuaaacacuauagauauaaaauaaauauuugguuuuuguucucaagacaccuaagccuaguuggcgagagaacccaggacguucuaaagauaaguacaaauaauauuuauaauaccugccaagggagauuaguaaagggagacaccagugacagcuggaccuuagagcaggagaaaggcuuauauaggucagaggaguggagucauuucuugccuauacaaaucauaaaauaucuugugaggcucuugaugaucuagccucuaucugcuccucuaacuucaucuuuuaccauucuucauugcccaaaaaucauaugcuccaauagggauaggcaugugcucaugugcacacagacacacacaaucuucuugcaugagcuacuccuucucccuuaaaagcuacccaugucacacacccuucgucuccuuccuuccuuccuucuucccuucucuuuccuuucuccuuccguuuuccuucccuucuccuucccuucuccuuccuuccuuccuucuuuccucuucuuccuccucuucuucuucuucuucuucuccuccuucuccuucuucuccuucuccuccuccucauucuucuucucccuuccuccuuccuuccucucucccuuccucccuuccuccuccucuuccuccuccuucuucuuccucuucuucuucuucuucuucccccuccccuccccucccuucucuucccuccccuccccuucccuucccuucccuuccaaaagagccucacucaguugcccaggcuggaguacaguggcaugaucuuggcucacugcaaccuucgccuccuggguucugauucuuguaccucagucacccaaguagcugggauuacagaugugugccacuaugcccagcuaauuuuuguauauuuaguagagacgauuuugccaucuuggccaggcuggucuugaacuccuggccuuaagugauccaccugccucagccucccaaagugcugggauuauaggugugagccaccacccccagcccaucuucuucuuuauuugccuaauuuugcuaaggagaagauuuccacaugccacgaggcuuuuccaauucucucuccuaaaacacaggauugcacuacaucuuuagcucuuccagauaguccuagaauuuggcagaaugcaaguggauccucugaccugucuccuuuacccuuaguugcaucuuagggaggcagucccaaagccguaguauuuccaucuuaccuuuguuuuugauuugccuacaucucuuuucaaacuccuagaccuuucuuuccccagcacuaacacugugaauggauuugcaucucauuguugcaugacuuagaaaaguuuucuuuguuuuuaccuuucaguucaugaggacuagaaccauuucuuacuccuuccgguucuguggagugcuacgucugaaauuaaaccuuauuuuaauaaauguugaugguagagucuaccauaaauacuaaacauggaacugguuuuauuuguagauucauaaggguguauaaggucuuaggaauuuuuuauuuauaaacucgugggagucuggaucugcccacaucauauaccucugugccuugaaaccugaauucagucauuuuacaugaugauuaugugauuguuuguauauguucaaaccugcauuugaggauguagguagugauguuggcaaagacaggcuguuuccaggaagauuuuacuuugcugaggguugucauucuguauuucgauucacuuuuaugcuuagaagccacauugguugacaggaauuguaugaaaugaucaauacuguuuuccugauuuuucuauuauguauuugcauaugucacagaauguuaaaauaggacuuuguuuagucucaguuuagcagaggcuacaacucaaaacaaugcauagcacauagcccagcauucaaaagcgaaguacuggaauaccuauucaggacugcaaaggauguaugaaaccucagguguuuuuauuuuuuuuuaauguuuuuugacucuuuauagccaauauccaccuugaggaaauaagaguacugaugcugacaaugaaguccuggagaccaacaagaugcaucaguuaaaccagauguucauaaugacuccucuguguauguagaucuauugcuaggcuucagagagcuuaaccaucuguuucugcuccuuuaaaaaaauuauugugguaaaauauacauaacauaaacuuauuguaaccauuuguagcauaaaauuucaguggcauuaauuauauucccaauguugcauaaccaacaccgcuaucuauacuuaaaccuuucucaucauccccaacauaaacacuguucccauccacuccaugcauauguguguguaugcguguauacacugguuugguuucugcauagaagguuuauagcugugccccagaauaucaggaaccuuuacacauuucuuggcauuacuguuggcaauaaauggaaagcuggaugaauguacacuaagucuaaccugauuccagaguucuuaaguucugauuaaugcuauucuagggccacuuugucucuccuucuuccacuguuuacccaggaaggacaguauggugacagaguccuucuagcagcaaagaaaucugcagcccagcugguuguuuuaggcucuacccucuuaacuauuucuaaaugacauaaucuucuaggauuucuuucccuuugggaacaauuugauuuuuggaaaauguauuaucaacuugggugucuuaaaggacucaugauugaaggucaauguuuuuaccccuuuuucuuccugagcacaccaaagaggucgcuacagcucccaguuguuucugcauuggugggagguuggugggagauuggcuggagugggagaaguuuauagcucauauuucaucucucacucugcuaccaugccucagugucaggacaagaaauaacuggagugaaaaaaacaaucccuggccugggggccagaggaccagagacucccacauucuaguuaugaagccuuccaugaauugaaugucuuaacccugguaaaauacagccaucacuugaagcuguaaccacucuacaaaugcaagguggaguuauuguuaucagucaucagacaauguaguauaauggagagugcacaaauuuuauuuuuuuaaacugagaugaagccauauaguguauacaaacuuuagacuuuaaaaauuacccuagguucacaucucagcuguucuucuuccugggcaagucacuuuuaccucuccuuggacucguuuuucuccuguguaaaauggauaugccaauaagagagugccuaucucacaagcacucuuagaauuuuuuuuauagguuuguuguaaggaauaaauuugauagcagucucuugcuuagagucaucaugcaguaaguaguagcuaugauuaacauugguaauaauaaaaugcuacaauaagugauugacugaauuauccccauccuccaaaaauggugugugauucauaaaacacuagauguagcaauuaagucauacucucuguagaagcauucauuccuaugcuuagugaauggcugcuucugcccauccugucuugggcaagggaugauggagagaugaaaauugaauggcauccagcucuagcgaugauuuggcuucuuuuucccacugggugguaucauggcagugcuguaaucuguaugguguccucugaugcuaagcaagcccaggagauguucaagguguucaggaaaacuggcgacagcauugcgaagugucagcuacugcaugaagcugugaaccccagagagcuacaaaaauagcuugcagugauugaauuccuuuuuuauuuuguugguuuuguuuaugccuuaguguuuuccccuuuuagacagagcacaugcuuuuaaaaaauucuaauuguauguuuacuuaaugguguauaauuauauaucaaguaaauauauaauuauggaguacuuuaaauuaauauuauuuacuugauugaguuaaugauucuggagcuauuagccuauugugcuaagaauaauuuagccaacuuuuagcugagacucauuacagauauugacauuuggggugugugugugugugugugugugugugugugugugugugugucauagccaguuuuuaaaaccuucaaaaauauugcuggggaaauaaauuuucuauacuuucauucuguuacagucuaaaaaaaacccaauaaaauggguucaccuguucccuccucaagauaugguacauguggacaaaucuuauuauaaaaauagauugccaaaugggguucauuccuuuauucuuucacucauucauucacucagcaaauaccugcugagcaccuaccauaugagcaacacaugcacaguggacacugggguuacaaaaaugaguaaguuauggucucucuucucauggagcuuggugucuacaaggggagacagguauaagcaguuuauucaguacagcuugaccgcaagcuagcauuuacuguguuuauguugugcuacuuaauucugacaacaaucuuguaaugcucauuuauacuuuacacacuagauaauugaggccuggagagguuaguaaauugccuaagguuaaucaaguaguaaaugguaaauccagagugaaaauccagccuguggauuuaaccauguuguucuacugaaaaaagcuguaauagaugaaaauaaacuggggcaugaguauaaagaugacuaagcguuucugucugugaguauuagagaaacagucagagccaagagaacacuugaacauuuuuuucuuuuuuaaaaauuugaguuaaaauaugcauauauaauguaccauuuuuaccauuuuaaguguacaguuuaauuacauuuauauuauuuuuuccuccuucaaacccucucccacuccucuuccuggccucugguaacuacuaaucuacucuuuaucuucaugagauccacauuuuuaguuucugcauaugaguaaaaaacaugcaauauuuaucuuucuaugcuuggguuauuucaguuauaauggccuccaguuccauccauguugcugcaaaugacaggauuucauucuuuuuuaugugaauaauauuucauuguauauguauaccacauuuuauuuauucauucauccauugguaggcacuuagguugauuccauauuuuggcuauugugaauagugcugcaauaaacaugggagugcagcuuuauauucgauauauugauuuccuuucuuuuggauauauacccaguaguggaauugcugggucauauggaaccuucauacuguccucuauggugauuguacuaauuuaccuucccaccuacauuguauaagaguucccuuuucucacauuuucaccagcaucugguauuaccugccuuuuugauacaaacuauuuuaacugaagugagaugacacuauauugugauuuugauuugcauuucucugauuagugauguuggacauuuuuucauauaacuguaugccauuucuaugucuucuuuggaagaucuguuaauucucuucaacucuuuugcccaguuuuuaauuuguuuuuuuuuuuuauuguugaguuguuugagcuccuuauauauucugguuauuaauuucuugucaaaugaauaguucacaaguauuuccugccauucaguggguugucucuucacuucguugauuguuugcuuugcuuugcagaagcuguuuagcuucauauagucccaauuguguauuuuugcuuugguugugugugcuuuugaggucuuccacaagaaauuuuuguccagaucaauguccuggaacauuucucuaauguuuucuucuagucauuuuauauuuuuggguuuuggauucaaguuuuuaaucaauuuuauuugauuuuuauauauaguuagagauauaggucuauuuucauuuuucugcauauaguuacccacuuuucccagcaccaucuauggaaaagacuguccucucccacuguaaguucuuagaaucuuugucaaagaugaauuggugguaaaugcguggacuuauaucuggguucucuauuuuguuccauuaguccaugugccuguuuuuaugccaguaccaugcuguuuugguuacgguagcuuuguaaaaaacuuugaagucagaugaugugaugccucuaacuuuguucuuuuugcucaggguggcuuuggcuauuuggagucuuuugugguuccacauacauuuuagggguuuuuuuuuauuucugugaagaaugucauuggcauuuugauagagauugcauugaaucuguacauugcuuuggguaguauugccauuuuaacaauauuauuucuucuaauccaugagcauggaauaccuuuccuuuuuuuguguccucuucuauuucuuucaucagaguuuuacaguucuucuuguguagaucuuucacuucuuugguuagauugauucccagguauuuuauauuuuuuguagcuauuggaaauggcauugguuccuugauuucuuuuucagauuguuggcuguuaguaaauaugaaugcuguugauuuaugcauguugguuuuguauucugcaacuuuacugaauucguuugucaguucuaacaguuuuuuugguggaguguuuagguuuuucuagccauaagaucauguugaguucgaacaaggguaauuugacuucuuccuuuccaauuuagauguccuuuauuucuuuuuuugccuaauugcucuggccaggacuuccaguauuauguugaauaauaguggcgaaaguggguaucguuguuguguuccauucuuuagaggaaaggccuucaauuuuccuccauucaguacgauguuagccauggauuugucauagauggccauuauuauuuugagguauguuccuucuguaucuauuuucugaggauuuuuuuuuuuuugagacggaguuuugcugucacccaggcuggagugcagugaucuugacucacugcaaccuccgccuccuggauucaagcaguucuccugccucagccucccaaguagcugggauuacaggcaccuaccacuaugcccgguuaauuuuuguauuuuugguagagacgggguuucaccauguuggccauggcuggucucaaacucaugaccucaagucaucugccugucucagccucccaaagugcugggauuauaggcgugagcugccgagccuggccucaugaggauuuuuaucauaaagggauguugaauuuuaucacauacuuuuucagcaucuauugaaauaaucacguauuuuuuguucuugauucuauucaugugguauauaacauuuauugauuugcauauauugagccauccuuguaccaaugaaguaaaacuuuuuuuuuuuuuuuuggagacggagucucgcucugucacccaggcuggagugcaguugugcgaucucggcucacugcaagcuccgccucauggguucacgccauucuucugcgucagccucccgaguaacucggacuacaggcaccugccaccacgcccggcuaauuuuuuuguauuuuuaguagagacgggauuucacuguguuagccaggauggucucgauuuccugaccucgugauccgccugccucagccuccugaagugcugggauuacaggcgugagccaccaugccuggccaugaagugaaucuuuguugauaauggugaaugaucuauuuaauguguuguugcauuuguuuugcaaguauuugguugaggauuuuuguaucuguguucuucagugacacuggcuuguaguuuuccuucuuuguuguauccuucucuaguuuuaguaucagguaaugcuggcuuuguagaaugaguucgaaaguauuuccucuucuuccauuuuuaaaaaauaguuugaguaggauuaauauucauucuuuuuuaaauauuugguagaauacagcagugaauccgucaggaccugggccuuucuuugauaggagaauuuuuauacagccucaaucucauuacuuguuacugguuuguugagguuuucuauuucuucaugguucaaucuugguagguuguauguguccaggcauuuauccauuucuucuaaguuuucugauuuguuugguauauaauuguucauaguagccgucucuuaugagucuuuguauuucugaggucucaguuguuaggucuccuuuuucauuccuggcuuuauuuauuugggucuucucucucuuuuucuuagcuuaccuagagguuuauugauuuuguauauuguuucaaaaaaaacaaccuuuuauuuugucgaaauuuuuuucuuuuuaguuucaauuuucuuaauuuuugcucuggucuuuauuauuucuuuccuucuaguaauuuuggcuuuaguuuguucuugcuuuuccaguuccuugagguguauuguuagguuguuaauuugaagucuuucuacuuuuucgauauagguguuuauugcuauaaacuuuccucuuaguacuucuuuugcuguaucccauauguuuuuguauauuuccauuuuaauuuguuucaagaaauuuuuaaauuuccuuccuaauuucuucauugacucauugguuguuuaauuuccauguguuuauguauuuuccaaguuuccuuuuguuauuuaguuguaaaguuuuauuccauuguggucagagaagaugcuugguaugauuucuauuuuauuuauuuauuuauuuuauuuauuuauuuuuuugagacgaagucuugcacuguugccugggcuagagugcaauggugugaucucaguucacugcaaccuccaccucccagguucaagugauucuccugccucagccuccugaguagcugggauuacuggugccuggcaccaugcccagcuaauuuuuuguguuuuuaguagaguuucacuguguuggccaggcuggucuugaacuccugaccucgugaucugccugccuaggccucccaaaguguugggauuacaggcgugagccaccacaccuggccaauuucuguguuuuugaauuuguacagacucguuuuguggacuauggucuauucuagaaaauguuccaugugcuaaugaaaagaauauaaauucugcagcaguuggguaaaauauucaguaaaugucaauaaggccuauuagaucuugaaccuggguuuuaaaagaugaauuggaguuuaccaagagaagaaaauacauugcagacagaaaggagcuuguacaaauguacauuuuaugauuccucugacagcaaaauguaucuucccaguuauucuguauuuuuagucaguaagucauuuccguuccuugaaaacaaacacgucaauggggaauauauauguggguaaagacuagaccagaaacaguccugaaucauguuggguaaaaggggcaaggcaucauaaaguuuaaauugacagaggccaaugcuagaucacccuggacuguuugggagcuaugccaaacauuucaaauacuuuguuuaauaaaccauacuugucucuccuaaagguauaugaaaguggguaaccuggaaggucuccugacauuugccccacagucaucuuguagaaaaaaguuacaaauuaacaaaaaagaaugggcuuucuuggcagccccagacagagaaacucaauguguuugcuuuuagacgucagcucuaccaagagcacagauaauuuccuagucguauuuugauuauuuauuaucugauuaccagaaaagggcuaaucaaacaaauuccuccugccucccuuucccauggucaaauagaaggaauucgagacauuugggauugcagagcacauucugacaucaucuguaugaagccucuucuuucugcagaauuccguaucucaggaaauagcacuucuuguauccuucuauccagccauucaagcuggaaacuuggaguucaggcuugacucuuuccucucccuccccugacacacucuucaguacaccccuccacaugcacacacugccaccauguaucaccugucuuauguccaggugucccaccaccuaucuccugagucccucaaguguguuuguaccccacugcuacucagcuagccuuagccacuaucaucccuuauugacacuccucaccaaccuccugacuggucuuccuaccuuuaggcucuuguuauccauuucuguucuccauacuggagccugaaagaucuuuggaaauguagaucugagagucauucuccuccuuaacaagacuguauaaucuggcccuucagucuacacucucaccaugaaggacuucauuuuuuucaaacauggccaguccugacugcagggcuuugcacuggcaguuacccgauaaaaugauaauaauugccaacauuuauuaucacucugggugugucagauacugagcuaagcucuugaaguacauguucauguaguauccugugaguuauguaagagguacuguucaccacauuuuaugaagaaaggcuuaaagagguuaugaaguuuguccaacucuaagcuucuccuuguuguuucuuagcuagauuaguaaguauguaaucaacuggggaucaugccuuaacaguauuuugaggcaagugauaaugucagccagugugcuguuguaacaugauuuauauucagaagaucugggcugcagugcugacgcugagcagcagugugacucuggauaaccucugagagucaguuuucucaucugcaaaaugggguuuauauuaauaccugucuuagaugauuguugcauggaucagagccaagcaauauuccuauaacuuaguugaugauccauaaugugugaaaaaaauaugcauguuaaaugaaugaaaaugccaaggguuuccccuguaaguuguguccuuugauuaaaagagaaaaaaaauagauccaugcacaagccugccuuuggcucacucuauagcacuuuucauguuaucacgagagcugggauaaauuagagauggugcaggacuuauaacccuauaauuaaacauuuggggggaggucaaaacauuuuaugcuuaauagaaaugaaauucuauguaaccucacagaauagaaaaaaauccaaggauguauuugaaauggucuaguuuaauuuaaaaugugcuucaaaauguguuuucauaccuuuacugaaugagaauucuuuaauuuaaaaaauugcuguguuaaacacccucuucuucaugcauuuggacccuguucccacuauuccuaucuauauuaagagaggaugugguaucacuuccagaagauguugguuggugugauaaccugcuuaugaagaggaaguugcuggaggaauuaauuuccuuuugcugugcucccuuaggucucagaaugcaguuggcccauuaggcaggcucccagucugcacaaccuuuuugcugugugucggaauauguauaacuggcuacugcagaaucccaaaaaugucuguguuguccacugcuuggugaguaaccuuuuguuguugguggugaugguuugguuuggucaaauauggaugagccuguacacaaugguagacagguaacauuugaguucaauaggauuuacugagcccauauuuaggaauuggguaaugugagaguuguaaaaauaagaaagggauuuauuauucuugacuuaaagcuugacuacuagugggaaaggcagauguauacacaacucacauaguguggggacucuagaaugugcuaaguauuauaaaggagguagaaacaggaguagugugugcacagcuaaaaaugccauugacuuuugugugaauaaaguuaacauuaacauauuggcguauuuauuuuuucuuccuguuuguguuugaauaaaaauaaaagaaaaaagauaccuauguccuuguaagaagucacauagauugacuguauuuuagagcauucccagugagacuaaugguuuuucugaccauugacuuccuagaguuccuuucccuaacucuucucagaacucuugccuguccuuuacaacucaacuuucaguaaaauccuucugacucuugaguauuuucacaauacagacauucccauuauaucuaaaugucuucuguggcuuuuaauacucugugucauaguaagcucuucuccugcauauuuucccacuagacuauuauaaucuugcaggaaagaaccaugccuuuuuuuaaacuuuuguacugcaggcauaaaaggcuucaauaagugauugaauacacaaauggaaucugagcauuaaugcuggaaauuucaaagcuucuauaaauuuuaaagcuucuauaaacuuuaguguauauguuuuugcuauaguauuacuugaugauucccaacccccuguccuuucuugagagccaguuggcuaaaacaggaaagaaaguuaaagaacauuuuuucuuucuuuuuacuucacaucuccaaacucuuggcaauaaagggauaacacuugguguuuguaagaauuuaauguuaaagaccaaaggauuuuccuuuccaaggcacagcagaugguguaacagaacagauuacuuuuagggacuaagcaaccuuaaggaccuuggugauuuucucuuuacucaagaauuugcuguaaguucagagagccuacaucugacaacuugauggaggaaagauggcucaauggagaccagaaacucccaguuccagugauucuucauaaagaauaaaaacccaaugaagaagaaaaaagaagaggcaaacaaaagauuaugguucuacagggugcucaauaagcucacucaaaaaggacaugcauauguuggaaaugaauaccaugucuuugggaaauggaauugaagcugggggagggaguuuuuuuuuuuuuguuuuuuguuuuguuuuguuuuuuuuuuuuuuuugggaccgagucuugcucuguugccaggcuggagugcaguggcacaaucucggcucacugcaaccucugccucccagguucgagugauucuccugccucagccucccgaguagcugggacuacaggcacgcaccaccacacccagauaauuuuuguauuuuuaguagagacggguuuucaccauguuggccaggauggucucgaucucuugaccucaugaucugcccgccuuggccucccaaagugcugggauuacaggcgugaccccaccaggccucuuauuuuuaucuuaauauacuacugguuauuauauuaaaaauaauaagcauaguggggcgugguggcucaugccuauaauuccagcacuuugggagacugaggcagguggaucacuugaggucaggaguuugagaccagccuggccaacauggugaaaccccaucucuaccaaaaauguaaaaaguuagccagguguggugcugugcaccuguaauuccagcuacuggggaggcugaggcaggagaauugcuugaaccugggaggcggagguugcagugggcugagaucgugccagugcacuccagucugggcaacagaguaggauucccucucaaaaaaaaaaaaaaugauaauaacaauaggcuauacuagucuuuuaauaaaaaaccaaaguuuuuaaaagaccugcaucacagguaaaaagagaggcuacauauccaagagccauggaucugugaaaagagugucaggaaggcuaaauucugaaaauaaaucagauuaagaaaaauauccuuuuuuuaaaacuguguuuggaauaagaacaacaacaauuucuugaagcaugugguauaaucuuaacuccuuuauucuguuuucuuuaucagagggaacaaaugucaaacuaggaagaacguaacaaugauguuuaagacaaagcugguagguagcaagauaguacgagagccucacaauccuccaaauuaauucacucucaaggcuuaaauuaugugacacaauaccgaaagcacuuggagaagcaauuauggauuucauuuguaauaugaagaaacaggaaggagaggugccaggcaaaugaagagaggagauuuuuucccaaaguauggaaggagguugauccuggaaaguuguaggcuugugaaccuggugguaauucaaggcacaauucugagaaaguuuugcacagaagauuuuaaacucuuagcaaaaaaggaaucuccauugguuuguuaugagcacauaucaaaccaacagaacauuucacaugacuaauagacuaguugagauaguuuauuggaguccugcaagauauuucuuaguuuuuucuagucaagauugagaaauuuggcuagguuguuauauauuuaguugaguugaggcugaauaucugcuuccaaagguaggugauuaauggaucaccuuucuccugggagaaggcuuuauuuaguuauucauuuuaaucaacaacuuugaugaagauguggaaauucagcuuaucaauuuucuuagaauuauaagggucacauagugaauuuggauuuuaaaaguucuuguagguuggucacuuaacaaaaauuaauaauaugaaauuaaauacaagauaaauguaaaguccugaauucugguuuuaaaaaauuaaacauauuugcacauuaccuuaacaugucaucuggaaaaaaucuagggguuuuaguggauagagagaauaauaaaagcuuauguuguuacuuagccuacauuuauacuagcuugggcugggguuauguuaauaaaagcauaguguccagaauaaagaagaugauauuucuucucuaguuuggucagaauauaucucauaucuuucauuucacaucugggcagcauuuaagguugucauuuuaaaacuugaauuuguuuagaagaaaugugcuaaaugaugaugucucuuaaaauggaaaaucaagugaggaagaauagaagggauugaguuuguuuuaaaagggaaauagaagcauugauagaaagggaggguauuucagauaugugaaggacugccauaggaagaaaggaguagguuuauuuuuuguucucacaaaaggaugagggucauuuaguggaagcuauggaggaaugaaagucaacucaacauauucaguauaaggaagagcucuguaaacuggaaugggcuacuucaaguaugaguaaucucccugucacuuaaaguguucuagaagaagcuaggucacaucugucagggauguuacugaauuuugucuuaauuagcuugagcugcuguaacaaauauaccauagaccggguggcuuaaacaacaggaauguaguucuggaggcuggaaaguccaagaucaaggugacugcaguucuuuucuuucuuuuuuucuuuucgaagaguugggguuucaccauguugcccaggcuggucucgaccuccugagcuuaggcaaucugcucgccuuggccucucaaagugcugggauuacagacaugagccacugugcccaaccaaggugccugcacuuguaaugucuggugagggccugcuucugggguggcagauggcugucuucuuguuuuucacauuggccaagggcagagggaguugacagcaagcucuuuugucuguucuuauaagggcacaauucccauucaugagaucuccacucucccuaccucauuaccuccccaaagcuccaccuccuaauaccaucacauugggguuaggauuucagcauaugaauucuggggcauacaaacauucaguccacaacagauuuauuucuacauugaaugaaguugaaucuggugaagguucuuuauuuuauacgaaucuaggaacauacuuugcaugagauacauauaugccauaucccaacaagcagcauuuaccuaaccugugagcucguuacuuccaguccuaaaccaagagacuucaacuauuaauucaacaaguccaaaauuacuuugaagauuauauuauuuuucaccaaauauauacaaaucaaauugggcuucucagauuagaaucaauuuuauucuaaggauaagucuuuccuugcugccuuugauuuaaaaagcugaaacaaauuuugguuuucaagugaauaauuuuuaaaugaaaagcacccacaguuaagaggauuucuccucucucugucucuuaauugcaaauucugccauuuucaauggagaauggcugauuugaucauguucauaaugauuuuaugcauuuucuuugacaggauggacgggcggcaucaucaauucugguuggugcuauguucauuuucuguaaucucuacucuacuccuggcccagccauucgauugcuauaugcaaagcgaccaggaauuggacuuucaccaucccauaggagguaaaguaagcuagaugcaggcuaggcacagauguagucuaauugguaucauguacuguuuuaaaucugccuuacaaauccuuucauaaguuucuuuuacuuuaucucuguauuaguccauuuuaauauugcuaugaagaacuacuugagacuggguaauuuauaaagaaaaagaguuucaauggauucacaguuccacauggcuggggaagccucacaaucaugguggaaggggaaggaggagcaaaggcacaucuuacaugguggcggggaagagagcgugugcagggaaacugcccuuuaugaaaccaucagaucucaugagacuuauucacuaucaugagaacagcaugggaaaacccgcccccaugauucaauuaccucccaccggaucccucccacaacacguuggggauuaugggagcuacaauucaagaugagauuuggauggggacauagccaaaccacaucaaucugacauuauccugaacuaugcaaaaacugaauuggauuaggauauuagauugucauucaguuuguaagcccccauacgaaaauuuaugauguuaaaacuagaaggaaacuuuaaagaauacuuauauccaacuucccucauuuuacaggugaggaaacugggacucaagacagguugugauuugccucaggucuaaugcccaguggacagagccagaacagcauucuugaucccaagcucuaagaccagucccuuuuuguuuuauuauacaggucuuuauugaaaaacagcaguagcugguuauacuuaucacuggugauccuccugugggaaaccugauuuaacaaagggaaaugcaaaaauacauagagaauaaagcguuuuaaaauucacuuuuucauguaacucugauauagaaauaaaagauuacaaaagauaaucugaaaaauggaauaaaaaagaaaacuguuuuuagauaacauugauuuuucuuuuaucacaauuucuucauuuuuuuaaaaacuacaucuccuuaauuuuuuggauuaaaagugcuucugaugauaaaauucuaaaauuuauccaaagccaaauuuuagcugauaaauuggaucugcuagauaaaauaggaauagauguucaaauauugaaguacuauaaaauucccauaagcuuuuugauuuaauaaauaccccaguaucaguucauuggggaaguacagcaaucucaguagauaaaauguuuccuaaauuauugaucgcauuaucuuuugcuaguuaauauuuaagaaauugauagaauaaguuuuuauuauaacaguaauuugcaagaagaaucuucauagcaaauauugauugcuugcuucuccugaugugaugggccccaagagagugccaaccuucuguuucagauaccugggcuauaugugugaccuacuggcagacaagcccuaccgcccucacuucaagccucucacaauuaagucgaucacugucaguccaauacccuuuuucaacaaacagaggaauggaugucgcccuuacugugauguacucauuggagaaaccaaaauauauucgacuugcacagauuuugaacgaaugaaguaagucaugauacuuuacuucuuccuauguacuucucaauucucauguaaaugagcaggaaugaguugaaucauauucuuccugcaagacuauaucauugugaaauagcugauauauaaaaaauguucaacaucagugguaaucauagaaaaguacaaguaaaucaggggauguuauggcccuuuuucaaaugaaaccaugauauaggcuaagggacuagcauaagcuguauacaggauuaagaccaaggggaacaugggacaccuggucauugaagaaggagauggccuugaugggauuaggugaggguaauggaagaaucacugaugaaugagguuucuaagugagcaacuagguagacggugauguaauuaaagaaguuacagaauccauaauaaagagcaggugccaguggguggucauaggggauguggagagaagggagugggugguaacauaacaugaaauuaguuaggaauagauugaauuugaggacuggcauccaagacuuucacagagcaagacauuucuguuuguauccugaucuccaguggauuuuuuguucccuuuaucucugcuuuuaguauuaauuuaaaguuaagaaaaggcaaauacaugggggcuagaugcauuugaggaaaaugagaucugcaaagcaggcaugggcaauugcaguccagaugggaugcagagagggggccuggcauuagaccagcaccauccuacugcacaaccaguuggcacuggcugcacuccuguuuuugcucaagauaggaaauaguuucuggguccgggccugggcgaacaguccucugggccagagccauagagaacuauaccugugucugugugauuguaccagauuggacucucuuucaauguauauuuuggucuguguuuacagagaauaucguguccaagauggaaaaaucuucauucccuugaacaucacugugcaaggagacgugguuguuuccauguaucacuugaggucaaccauugggagccggcuacaggcuaagguaugguuuuuggaagaaucauggcauaaguucaucugagucuucaauaggaguauuucugaaucuuuucuccccaucacuuugggcuugagucacuuguaguuuuagaaugaaaaagagcguuuaaagauugcuuagcucaccuccuucaucuuacaggggaggaacugagacucaaagagguugugacuugcccaaaguccuuggcaugauguccgugccagaggaugacagcccuggaacucuuagcaaaccauacucuuuagaagccugugcuuuucuuauagugccccauuuggaucaguguaagggaagagauuucuacugaggauguggaauuaagggauuguauuuuuucaauuuuaaaaaauugagauaaaaccacauaacauaaaagucacccuuuuaaaguguacaaugcaguuguuuuuagucuauucaaaagguugugcaaacaucaccacuaauuccagaacauuuucaucacucacaaaagauacccuguaccuauagcagucacuuccuauucccucuccuccaucuccugguaaccacugaucuacauucugccucuauggauuugucuauuugggacauuuuauuuaauggaaucauacaauauguggccuuuugaggcuuccuucucucacuuagaauguuuuugaagcuuauuguguuauagcaugugucaguacuucauuaucuuauauggccaaauauuauuccauuguaaugucacaauguauuaaucuuaguugauaaucucaguuaauaaucaucaguuggugaacauuugggauauugccauuuuuugcuauuaggaauaauguggcaaguaauuguguuuugauucaucacauauuggcuaagugagugcuuugugccagccauugcugagguuuuuaggauugacaagaguaagacuaugucucugccuuuaagggacucaauuucacaagggaaauccaugcaaguacaaauaugcaugauaccauauuagagggaggaugagguguuauaaugggagcaguuuguuuuagccagcaguggccuagaaaggcuacagagagaauaugaacuuuuaagacaugcccuaaaggaugaguucauuggguuggaacagggcauccuggguagaaggaaugcaaugagucgaaguaugccugugugcaagaacauaguauuuagcggaugagaaaaugguuugccaaggcagaguucaaguagaggagaggcuggaaaugaagcugagccuauucuaacuggggaggucauuuaauauccauaguaaacacaaauucagauauugaaacaguugaaggugcaugucuccccaaaaucuaaucuuuugaucagauucccuuuucgcugauugauuguaaugugcuucucucauguauuuuuaggugaccaacacacagauauuccagcuucaguuucacacuggauucauaccacuggacacaacaguuuuaaaguucaccaaguaaguacugguugggccaaaagucuauuugaaucaaauuagcugugaagugcugaggcucaauggcaccaggcuguagcauacccuggaauccugugcugcugaacuacugagugucacucaguagcacagagaggcugugggcauucuaaagcuuucaguugaauaugauuuaucuucagaaguacaaagggaccaaagacuucaaacagaaaguucuaaaauucuaugugagggaauaaggguaaacaaagcgggacaaaguaucacugcuuuugauccuuugcaucuguguauccccuuguguuuuccaguggggauggcaguuuaaucagugguaugguaucagcaaugaugcaucagaauagaagccccgcuauagcacugaagcaggcuucuggaggaccuuucugcaccgacauuaaccuaucucauaguguggucuaggugaacgcaguuguggggguggcuagagccgggauggaguugcuggggccaggauaggaguagauguucaagggcucaggacaguggcugugggccuauugcacuauuuuaauaauggauuuugccgugccagucacaucagcccugcuuuccagaaugcuuuuacaugcaguagcauucaaauuuguugagcaggcauuauucuccucuuuucucuagauuaggaaacugaagcucagaaaaguaaaguaacuuaucugguuaugacugagucuuuuuuagaaaugagacuuagauuuaaccuaagagucaaccuaagaugacuucugugccaaacaucauaccaguuccauuguuuuucacugaauuuaucuuuuuuaaaucccuauuuaggccugaguuagaugcaugugauguaccagaaaaauauccucagcuauuucaggugacacuggauguagaacuacagccccaugacaaaguaauagacuuaacuccaccaugggaacauuacugcacaaaagaugucaaucccagcauccucuucucuucucaccaggaacaucaagauacgcuggccuuaggagguaugagucaccugaugguuuuguuuuucaggaugaagccucucuguuauuuauuuccugugucucauugaugcuacauggucuuuuugucuugcaggacaggcuccaauagauaucccuccagacaaccccaggcauuacggacaaagugguuucuuugccucucucuguuggcaagguauuuacaaguguuucuuuaagucacaugguuugaugauuauguauuucuucuguaaagauguuggcccuagaagcagacuacauuaaagcagcacuuagaggucauucaauccaggcacacggacucccaccuguaagcccagcacuuuggaaggccaggauaggaaggccaggaguucaagaccagcucaggcaauauagugagacccuaucucaacaaaaaauuuuaaaaaauuaggugggagugguggcaaaugccuguaguccuagcuaugucagaggcuaaggcaggaagacugcuugagcccaggaguucaagguugcagugagcuaugauugcgccacugcacugcauucugggugacagagcaaaacuccaucucuaaaaaauuuuuuaaaagacaucauucaaguuuacauccuuccaauucauucccuuuucaaaucaggcaacuucccuacuuucaacucaguagaugcucuuagacugaugcaaaaggccauuuuaaacugaauucucccuucucucugcuguguuuuuggucacgucauuccuggacugacaaauaagugugauuuguuuaugaucucccuuuagacugcugccucuguaaugagauuaacacaggauucuaucuuccgcugucaacuaaauauuauaaaaauaucaaaucagcauuccccccagggagccuuaaccacuagcagggcagaacugagcuuacccugcugcagagaaagcaaacacuuggccuguauaucucugcucuugcuuuaacagccauaccagaaauaagggcucgauuacuagguucuuuucucucaaaccuggagauauuuucagaauccuccucaauauaacacuuccagcugcugccagcaguagccugacguuggcauccuaaucaauacccauuggcuauccuugcuuuagagcuggcugaggcuaacugugagauucaguguagacguggguagucaguguuuggguaugaaaggcaugggaaacuggcuaugguaugguuuaucugaaauuauccugauugaccuuccucuguugugugaauguaagauaauauucccaucgccugcaggcuucaguuugaugaaaaaguuguucauaaaauuccguugaauugaaagacucacuuucagaauuuucuuucgagaaauggaacuagcaaauccucaaauuuggaaaacccagugguaucuggacaguagguagauuucuuauccccuguuggccuuucuuaccucuuauuuuccucacagcgagggcuuuuaauacaacuucacucuuuccucuccacugucauuuuagcaaauaauuuagagauaauuccuguagacucugaaauagguuuuaguauagaugcacagucucuugucugaaccucucagagccagguauguuuaggaaugcagaacuuuuuggauuuuagaaggaugauaugcuacauaaagugauguaacuugacaucccaagugauaucucagauaauaaccuauaaucaaacauauuaauauuucugcaguagaacauauaaacaauagcccuaagugagauaaaugaagacuauaaguaucuucauauucacgucugucaguuuuccaccaacugaauucaugccaaacuuaggaaaaucuuuuccuuuucauagcuuauuacauuuuauaauuuggaauaaaggauguggauccauacuugacuuggaaugugggucuaucuggcauuaaauaucaaauuuuugugggaagaucuaucucagggagggcuuagaaggucacuccuuccccagaggaggccucuuuccugcugcucauuuugugcugaaaguaccccuuucaagcugguauaaggaccuuucacagcagagcucuucuuuucacuuuuuaaaugugugguucacuucugcuccagacuguuagagaagggauuugcuuuuggcuacaggacacauggagaaguaaagacagugagaagugucagcaaaugacuagcagauaaugguuuguacuacccuccccggccaaagcaccuagcauagugccugaaaaaaaaaaucaacacuuagguacuacuuacuauugauuggagugauuuauaauaucaucucauguauuucucacaguagccugugaguuagguacuauuuauuuauuuagacacaguuucacucuguagcccaggcuggaguacaauggcaugaucuuggcucauugcaaccucuaccucccggguucaagcaauucucaugccucagccucccgaguagcugggauuacaggcacacgccaccaugugcagcuaauuuuuguauuauuaguagagaugggguuuucaccauguuggccaagcugguuucaaacuccuuaccucaagugauccuaucucagccuccuaaagugcugggauuacaggugugaaccaccacgcccggccguuagguacaauuuguuauccccacuuugcugaggaggaaaccaaggcacagagaaguaaaguaacuugcccagugucauagagccagugaguagugaagcugagauucaguccuaggcuggcuccagaguuccugcuccuuaccccuaugcucuacugccucucagaugcucaacaagugguaguugaauguaacgugaaauacaucaaguguuccacugauuagggucuaaaaacacuguuugcucagggcugaauccuucugucuuucuggaauuauauacauauauuauaacaaaaaccaacaaugcuguggucagcaacuaaucucuuaugguauacuggccuuccucagaucagaaaucggagaagucauucugugaggaggaccacgcugcccuagugaaucaggaaagugagcaaucagaugaugaacuucugacacuuuccaguccgcauggcaaugccaauggugacaagccucauggagucaagaagcccagcaaaaagcagcaggagccagcagccccuccacccccugaggauguggaccuuuugggccuggaagggucugcaaugaguaacagcuucucuccgccagcggcuccucccaccaauucugaacuacugagugaccuguuuggggguggaggugcagcuggucccacccaggcuggacagucaggaguggaagauguguuucauccuaguggaccugcgucuacccagucaacaccacgccgcucugccaccuccaccucugcgucuccaacccuaagagugggagaagguaauuuuuucuauguugcacugugccucucagauuugaauucuaaccuuugggccaaauagguggaauugaacuuuccuaauaagcuagacuuuucugauuucacuguaaguccuuuagaggaggucuguaucuuuauuuaaauugagagcguaagagaaaauagaaauauuguccauuuggguagcacacuaagguaguguaagaguggacguuugagcuucacacucuuacuucuaauuuucuuuguuuagcacuucaaccccugagcugcauuagucugcuuaaacauacugauugaugaauuauuauugauaaaaauagcuaauauuuaugagguauuuacuauuugccagacauggaauuuaauacuaaacauuauuuaauucuuacagaaacucaauaaauaagggcuauuuuuauccccauuuuauaguugaggaaauggaagcauagaauuaaaucaguagcauagguuuauaugacuaguaauugauaaggccaguguccaaaccuagguuauuugacucuagggcuuucccucuguuuuccuauaacggcuuccugaaguuauaguuuucugaauauaugugggcuauccagagaaguguuugguuauuugaaaauauguuuaagugacucaugccggaagcacagcuuccuagaacagagcaguugguacuagguaaggaguuugagccccuugaggcucuguuaguuucacugucucauugccagagacucaaaccuucuacuaugagucaucuaggauuuuuugacauuuauaagacaguguaguuggguaagcagagauccagcacagcuccugaagaacccacucaaauuagcugccccuugguccugucaccauuaaccaagaugacuucacauuaggaaggguaaagagaaaugucucaacucuucaggccuauaguauccuauaggaacauuuuuuuuccccaagcguauccuucccagaaggcucugggcuggucuugacuugugauaguucagcuggaggcauccuucaugagugugggucucagaauuacagaguauugguguugaggcucaagcuccaauguuagcuauugguggacccaggaugugaacucaggugcccugaauccuaugccaaugcuauuucaucuguacuucacuuccuuccauacaguuuuaacuugccaaagugaaaaaaagcucugucaggaaaacaguuuccaagauccaagauaucaguacucgauaauugcauuuuaagacugugcaccuggugugacucucaugauuucauucaucauaguuucaggcagcuaguggaauuccagugccagaaggggccuuagacaucaguuaauucucugccucauguuauagacaaugaaacugaggcuuagauguauugauugaccugucugaggauacccacuggauuaguggcauacccaggucuagaaugcaaguauucuauccccccaagaggaaguagaaagaacaccaagucuagaguuaaagaccuggauuugaaucccaggacuuaacugucuguguaacauuauugaaaaaucuucucaguuguaaaauggggauaauaguuacauauuagcauuguugcaaagacuaaauuuugagcucuugucuugugguguugggcaguuuuaguuauuggagaaugccccuaguuuaacauaaauugauauuuuaaauguacugaguaugguaagaagggauaaggcuagauaacaaauaaauccugcucuuaaaaccgaggugggauauauggcuuaauacguuuucagcuaagacuucauuggcauaaugcucuccuaacaacugcugggcagauuagccuuguguagcagcaaugguaucgacuguaguucauccaacagguaaguccagacuacuccuuuguccacaaagauaggaaauucuuggaguccacuguuagcccuacaggaagugacaauucugugacauuuagugaaugaacucaugggacaaauaaauauauuuucccauuguuuucuaggugccaccuuugacccauuuggagcaccuucuaaaccaucaggucaggauuugcuggguucuuuucugaacacauccagugcuuccagugaccccuuucuccagccaacaagaaguccuucgcccacaguacaugguaaggaaauauuuuauauuguguucaguggaacauaguuuucugcaagauaucaguaagugcucauauauaaaagcacccugugggugcuuuuuugauaaaagcuuccucacacaucucuguuuuugaaauuaacaacucaccuuaacauaucaaaaucucugggcugucuuacaggacagaaaccugcuuaacuuuguuuugcucugcuuuccuauuugacuaugguauccuuuuuugcauuagagcuacauggacagaaucauaaaugacccuugauuguaggacauaugauuauuuuauguaccaauaagaaagaaaaaaacacugccacuaugaaaugauuggaagauacuucuugguuagagaaaucuuugaaaugugggaaaauaugucuuaaauaaauaaaauauguuaguaguccacaaaauugguauuccaaagaacaaaguuugggauaugauagccacuaguuacguguggcuguugaugacucuacauguggcuagucugauuugagauacacuccaaguauaaaauacauaccagauuucaaaacuuaguacaaaaagggcaugugaaacaucucaucaauauuuuuauauugaucauuuauuaacauaauauauugaacauacuggguuaaauaaacuauauuauuaaaaauaauuucaauagugucuuuuuacuuuuuaaaaugugacugcuaggaaauauaaaauuacauauguggcccaaauuauauuucuauguuagagacuuagguuguauagaaagaguaauaauaaucacauccauuuauaaaagugugucacuuagguaacauugauuaaaaccggaggucugcagugagggauaaauaacuuugagccagagaguuguagcucauuccugaugucgaagucuauugaacauuauuggccacaaccuagaaggugacguauuguugaaggcauccugagcuugcuuggagaaugcaguccagucaucaguugacuuugggaaaccaugccaaugcaaaaggaagaugacuuuugcaacacuggugaaacugaaacuugacuaaaaaagauuccaggaacaacuuuugugguucauuuccaacuagucuuuaaucucaaacuauuugaagugcauccucaggacaauauacaagaaauuccccucuuaccucugagucaugcucacuugagagagucuccugauuggauguugacuaccuguaggagaaaagaugcaggaauguagaguagaguugguuuucucacucauuuaaaauguuaagucaugucauugcucugcucaaaaugccuccccauuuuacucagcaugaaaaccaaaguccuugaaauggccuguguagccucuguaugcucuagcaucucagugcccgugaccucauuucccauucuuucccacuuuacucucugcauuccagcuguacuggccucuuugcuguugcacuggcuguuuccucugccucauacucuuccccaggcaucugcauggcuaaguccuucaccuccuucaaguguuugcucaaaugucaccuucucaguggagucuacucugauuccuccguuucaaauugcaacucgucucccugcccuacucuacauuccccuuucuguugugcuuaguaacuuccaguauaugcaguaauuaacuuauguguuacauuuuuuugucaucucucucucucuauuagaacaugaauuccacaaaggcagggaauuuuguuuuguucauuaaugcauccauagugccuaaaagaauuaccggcacaugguagcugcuaucuaucuuuccaauauuaaauauaaaaugaauuaacucauuuuucccaucaaaguuucuuugaugcacagugauagugucauaaggcuauauguuuuccugauuuuaauacuuugaaauuauuguuuuaauaagaguacuacccuuugugucccauggacguggguguucauacuuggcagcuuggcaguuuuggauccaguuuucuguuucugaugagcugauuagaacaugguguuuauaacccaguuuaggccaguuaguacuccuuuguuuugugguuacauuucucauuuuggucuguauuguacuagcgaguggaaagaauuuucuccucuccuuguugggaaagcaaugaucauuucacuguuacugaaucaacuccccgucuucacauaggacagaauauaggugacacucagaugucugcuuugggaggucagacauccucaggguacuucccccggguuucugcaaggcgucgccaaucucucaugaaaauaaaaaaaauacugccuuugggcucaacaaauauuuauugaacaucuauucugaagagaauaaucacuugggacaugauguuggaagaacaaauaaauaaucauaauaaaaggcaaaauagagacuaaaauauuagguaauuaccuuuuugaaaaaauauauuccuguuucucuaacagaccuuaaguuucuugaggauagauaaugcaucuuucagucucuguccccugauguggugccuugcaugugguagguagucauaaggguuuguggguuugauuagcaacaggguugaaguucugauaccuacuucugcgucuuaauuggauguaagacuaggaucagagcuuaaaggaaaucagauagaacguacuagcaaaaccgucuaacuuccaccucaguggaauggguuacuguguaaaaauagaagggauaaauagaaaagaaagaauuauuauugcugauaauggcauauccuuuuuaacuuaaugaugggaagguacuagaugacuugguugguacuaaguaaacaaaacaaggaaauaaaagguuuggaaugcuaaucuugaugccuucugguggugauggggugugugugugcguguguguguguuuuaaaucccaguugcaaugucaguuuaguauuugcauuuuaauaauugauuugugugggcaaaaccuagaggugccucagaaagaaauucuucaucauggcauccuguuuccuauauagauuuuauagauguguaaaaaacuuacuacgcacauguauuccucuaguacaccugauuccuuuuagccaaauauuucuuuuaaauuauauguuuggaacuuugagggggggucagaaugauuuauuuugaagcuguaaugaguuuauuuugaguaccauagacacaucccugacaaccagcauagugaugauguauagccagugcccaguacauguucugcaugacucauuauucucaacucaugucacagcagaggagaaaacaaaaugucaguuuugaguggauuaugcuucuauacuuaaugcuuagcaaagguaaacugagcuuaagguguuuucccccuuuucuuauugcacacugacucuguguuaaauuuagaggugggacacacacacauaagauaguucuuuccugacuucgagggacugacaauugaauggagacagacacaugcucaaugauaacucaaagcguguggauauggagguaaaaccaaagugagacaaagaaggagcagagacaaauaauaugucguuucugucaagccucaugugaacaaccagaggugaaggcagaacauauugaauguugcagaguguggcaagaacucagaaggaggaguggauaucuugggaucuugcuggggccaugcaggcuucagggauggaauggcauuauccugugugaacucagaaaaguggguucugagcucucuuguucucauucuuuuucuuuuccccauuugcagcuucuaguacgccugcugugaacauucagccagauguuucuggagguugggacuggcaugcuaaaccagguaaaagcagguuauuuucuguacacauuuauauaauugcaaaagcauaauccuuacccaagaugaagugaguacucacagaguauuguggccuaccuguguaauuugugucacuuuuuccuaaagauucauauucuagaagagcuuuucccaaugcacuugaugacaugauagugcuacuuaucauacaccauuuaacuuuucuaaauuucauuugcugaaugucuuaucuugacaauagaaucagacggauauaaauauauaucaaacucuaucacuuagaaacucuuggguuuuuuuggcaagucugagccucaguuuucuuaucugaacaauggggauaauaauuuuggucccacauaguuguguaaguuuaaauaaaaaaaacuuauauaagaauuucuggcacaguguagaugcugacaaaugugaauauucuuccuucuuuacaaaguacuuacuucagggugggauuugucugucaucaacaaggucuccuccucaugaccacuauggcauuuauggagcugucuugugugacugcuccugacauugagcaaguuaagugcacgcgugcacauacaaacacauacacaaugggcuuaucacaacaacuuucugaagcaguugcuguuuccuuuuuuuauuguagcaaccccuuccccacaacguaacauuuacccugccaauaauuuccaaguauacaauacaguauuaucagcuacaugcacuuuguugugcaacagauccccagaacgaacccaccuccccacugaccuucucacauaacugaaacucuacacucacuaaauaacucccuaccucugccuccaccagccccuggccaccacccuucuacaugaguuugacuacuuuauauaccucccauaaguagaaucauacagcauuugacuuuuguggcuggcuuauuucacuuaguauaauauccucaagguucaucuguguuguaacaugugacaggauuuccuucuguuuuuaauuuaaaaauuuuuuuuggcuggggcgugguggcucacgcuuauaaucccagcacuuugggaggcugaugugggaggaucccuugaggccaggaguucaugaccaguccgggcaacauggcaaaaccccaucucuacaaaaauacaaaaguuagccagguaugguggugugugccuguagucccagcuacuugggaggcugagaugggagaauuacuuaggcccaggagguugaggcugcagugagccgagaucacaccacugcacuccagccucggugacagagugagaaaccugucucaaaaaaagauuuuucuuuaaauugacagauaaaauuguauguauuugucguguacaauaugauguuuugaaguacacauacacugugauaugguuaaauguagcuaauuaacaaaugcauuuccucacaugguuaucauuuuuguggugagaacauuuaacauccauucucuuuggauuuuucaagaauguaguagaucaucauuaacuagagucacuaugcuguacaauggaucucuugacuuauuccuccuuucuagcuguaauaauauauccuuuaaccaaugccuccucaucccugcccuaccuccaaccaccccagcaccugguaaccaccauucuacucuuuauuucuaugagaccaacuuuuuuagcuuccacaugugaaugagaacaugcaguauuugucuuucugugccuggcuuauuucacguaacauaaugcucucuagguuuauccaugucaucucaaaugauaggaauucuuccuuuuuauggcucaauaguauucuauuguguauauacaccauauuuuauuuauccauucauccauuaauggacacuuagguugauuccauaucuuggcuguugugaauagugcugcaauaagcaugggagugcagauaucucuuugacauacugacuugauuuccuuuggauauauacccaguagcaggauugauaaaucauauggcaguucuauuuuuaauauuuuaaggaaucuccaaauuguuucccauaauggcuguacuaauuuacauucccaccaacuguguccuuuuuucucuacauccuugccaacauguuuuuuguuuuuuuuaauagcaauucugacaggagugaggugauaugucauuuugguuuugauuugcauuucuaugaugauuaguguuguuaggauuuuuuuauacaucuguugguuuuauacgucuguugguuuucuucugguauucaucuguauguuuucuucugguaauuccauaguuuugggucuuacauuuaaaucuuuaauggauuuugagcugauuuuuuuauauggugagagauaagagucuuuuuacccuguugccuucuuauucuguugauuguuaccuucccugaacagcaguuuuuagcuugacaauugucccauuuguuuuucuuuuguugccugugauguugguuucauauuauuucucuuuuuuaaaacuaaugguaaaaugcugaagcucaaagauguuaagcaagauucccacggucacucaggaauuggcaaagccagaauccagauccagaccuaacuucgaaucuuauaggaaagagugaagucaggugacaugaggaccuggaaauaaaacaaacacuggaaauaauaguucacacuuguggccuggaaacagcauuugucuuuucuguggucuguccuuguucaaggccaccauucacccaggucagggaaacagggucuagcaacuucuuagacauuuucaaacccuguccuaauuugccuaggagacaaauaaacaguaacucuggaauucugaauuucacaauucagccucaaacaacuaacucauuuucaaugaccuuauuuccuuuucaggaggcuuuggaaugggaagcaagucagcugccaccagcccaaccggauccucgcaugguacucccacccaucaaagcaaaccccagacucuggauccuuuugccgaccuugggacacuagguacaaacucagaagaucaagauacaaauaacauuuauuuauagcuauaaagccucaaaucucagucuuugguguuacagcaagcugguauugucaccuggaaccucaaauaguguguauucuuaagcuauccucugaaaccugagauuggcuuuuuaaaaaaggaaagcgauaaucagaugugggguuagaaaucaucuuuauugauucauuucuccagugccuaauucuggauguguagcaugaauaaaguuagagcuuucaggggcucauggcaacagaguuuggcugcgcaaaaguaaugcguagggaaacaguaugagacagggcuggucagauggauuugugccacaugaugccaaccuugcagaacacuaacugugaugcggugauguuaccugugagaucuucacaccguuccccuucucuccauuaacuguggugcucuccggucaauuuguaaaauucuauacagaaaauagacucaaguaucguauuuccagaauauuuucaccauauguuaauagauguuacaggauaaguguucugagagcaggugagauugggaagcacugguuucaguggauuuugauuaccacuaagagggacacaguauccagaguucucaaacugauuucaccaaggagccuguuuucaaggagggguucacuggacuacuauguucugaaacauuuucuuccuccuuuuuccuuccuccucuagggcagugcagauuuguuaaauaagggugggguagcccugacacaaagguuuaucuuggcuauauugauagucugugaucucagaaagcccuacugaggcauuuagagccagauggagggaaugugagccuggcuaccguuguugucuguaacuagugucagcaucuuuaucuuccauucuguacuauuuagauguuuuucccuuuuaagaacucucaaaauuauuuuaugcagucauuuucuucuccaccuuucuuuguaucuuacugaaaauuucaaauuuuaaaguaauauuauaucagaugaaauuuuacuucaauaaaaucucauuuauuauuuauuuuuaaugcauuuaaugcauugauucauccaacaaguauuuaaggcacuuuugugccuucuaggugcuaggacuguuuuaguaaaaaaaauaaccaaacaaaacaaaacuccugccuuaauaaaacuuacauuauagaaggggaaucaaauaauaaauuaacaaauauauaaugucaaauaaugaaaacaauaaaaauaacaguuaauaguuauuggggccuuacuaugugccaggcacuacuuaaaguguuuuacauauaucauuucauuuaaucuuccucauaaucuuuugaaguagugacuguuauaauccucguuuuacagaugaggaaacagggacacaacagguuaaguaacaugcacaaaucacaagcuuucaacaccaagaagucuagcucuggagcuugcacucauaaaagguuuagagguugauguagcugagugugggaagggguaucaguucaguucauccagucaaugguuuucuacccuugagcauuaauucccucauuucacagguauuuuugaguacuuauuaugugguaggcauucaggauguaauaaagaaucaaagcugaugauauuccuguucuuugaaacuugcacuacagugggaggaagaaacuuuaaucaaauguaaaauauccgcuacuguaggggcuacacaagauggagcauuuuuuaaaaagcuccccagguaauucuaaugcacaaucaagguugagaacuacugcuuugcuuuuaaugaggacugcaguggucucuggauuuagcuaccacuuuguauuucuguaaguucucugcuucaauagcauuaacaauuagacuugcugagcauggggagaaaauauucuagaaggguagacaucagagaguccugcaauguugaugagccccaugagugcggggucagcgucugcuuuuucaccacuguaucugcagccuggcaucuagaggaugcucaguaguguuuccuaaauuaaugaauaacuggcagugugguaggcauauggcaagguuuucuuaguucuuuaggcuuuucuguauuuaccaaauuuuaaaauaaaaaaaacacauauguucagaacagaguaagcuuccuuaaauauaaaaugaaaccccaguguagaaugaauaccaaguuuuagguguauguucccgugcuauuggcaggagggcucugggacauaggaagaaggaauucaugcugcuaguuauggaaugaguggggcaaugccaagcuugaagacaagcccugucauuacauuuuccuaucaccaaguguuuauugagcccugaagauguaccaggcaugugcuuauuagcauaugagcuuacauuauuuuauaauauauaacgucucuuuguuugcuuaauuguguaauacuuuccuauaguuguugugucuuuacaguauaccugugauauagacauaguuuugauuaaacagaugaagaaacucaggcucaaaggagugaguuuuuuuuacccagcuuuagaagagcaaagauucucuauauccuguuuucagcuauauucuuagugcccagcauaguacaugacacuugguaaugcucaucaaauaguggugaauuaguguauauauguaugaaugaaugaagaacgaaugcaagaaugaaugacagagcugagacucaaacucagauugaugguaaguccagugaucaugaugcauuuccagcagggaaggaaaguggagccccaggaucagaauagggaaaguaucuauagaaagaagagauaguaagggaugaguuguagugaaaggcuuagcaauuaggagaggaauuaaggauuacugagugcaguaaaugaacaugacauuuggagguaggaugcacauagucuaaucccagcuccauuaauuggcugugugaucaugaguauaucaggaaaccucucugagccuuaauuuccuuauuuuuaaaguggagccagugauacuacuuacuuccuaagaguguuguguagaucugagcaguaauguacauaaacacauuuuguuaacucuaaagagcuauauaaauauuaguuauuuuauuauuguuacuuuagacuuauuacaugaaagggucuuuggacaucagcacauuucaguuuucucauuuuaccucuuuaaaugcaagccacagcugguuuucauauuuuggacauagcccagcuuguaugcaaugagugcuuaaaaguuuggagauuauggaaucaagauucuacuuaaauuccuggcacaaaauaacaucauuuucaaagcuugaauaagauccuuuguccuguuuaaaguuaucagaauguugacuguuuuugcucuccuucagugaaaugcaaguaguaugaaguuaaaaccuacuugugaaauuucaaaacaucuuuauuuacucuugggcacuaaccaugcuuuauaacaaaaaaugaugaauccuaauaauugaaguuuaaguagcaccuuaaugaguggacuguuuuauuccccauucuugucauuuggugguuuuuuuuaaauuuuauucuagugaagaaacagaaucugcucagaagauggaaggguggggaaggauggcacagugggaagagccaggguucuuuugaccuggaggcaaagauccagaaucaagucucggcucagcuacuugcugugugccucugagaaaaaucacuuaacugcucugaccugcaguuuguucaucugaaggaaaaaugaggccauuaaaacauaccuagaaauguuauuguggggaugaaggaaauaauauguaugccugcaauugcuuuaucuauauuaggaagauuacuuaugcugucagucaagggaaugacuauuaaagccacugcaaacagugucuuaagacacaagaguuagaggccacucaaaauaguuuuaccuucuuuaucucuuuuuuucuuuagguaguucuuccuuugccagcaaacccaccacaccaacuggauuggguggaggauucccgccucucagcucgccacagaaggcgucuccccagccuauggguggcggguggcagcagggaggugccuacaacuggcagcagccacagccuaagccucagcccagcaugccccacuccucuccccagaaccgacccaacuacaacgugagcuucucagccaugccugggggccagaacgaacgugggaaaggaucaaguaauuuggguaaggauaaugguaugggaccuagcuauggggcagccugucuauguugucauacugccugaaugugucucucugaaggugacaguauuuucuggguaguuucaauucaguaguuucugagggaaucuuauaguuguagagauaaaacaugauuccuacccccaacgcuguaccuggaggcuccuagguugacuaugcuccuaacuuuuauaccauuuugugaccgugggcucacuuggcuguuuaucuccagacuggaaccagauggagggcagggacugugucuuaguugccaugguaucauuagcaccuagcauagugcuuggcauaggguaggcacuaaaugaauguugaagggauaugaguggagagguagauggaucuuaaagcuguuauuccuuuggaagaggaaguggaagaaaaaguuggggaaucuuucaagcacauuggucauauuugcccuuuggucccaguugguggacugcaugugucuuggaaaacuuggucuuucuuaugcucugcuugguggauuccugagaucagcgggguaccuaugauggugccaacaccugaggcuggaggauacucuggauaggaucuugacaaugaaugaaaaguaauauuuuugcauaggaaggaugguuagauuugaguuuauuaaaagccuauuuugguacauuuuauauuucagcugauuuugucagacccuccaaugaaguacauaggaacauggugagggaagaggccuuucucucuauggaacauggaaaggcaauucuuaugcucuuccuaauagcuguagcuaacauuuauugaguccuuacuguauggcaggugcuauccuaagcauuuuucauguacaggcaucccccuuuauuugugguuuuauuugcaguuucaguuaccugaggucaacugcagucugaaaauauuaaauggaaaauuccaggaauaagcaauucauacauuucaaauugugcacuauuaugaguagcgugaugaaaccucgcacugucuuacuccauccugccuaggaugugaagcaucccucugucuagcacaucuauguuguauucucuacccacccauuacuuacuuaguagccaucucgguuaucagaucaaaaaaaagaguacuguauauauagggucugguacuaucugcaguuuuagguguccacugggggucuuggaacauaccgccugugaauaaguggagggacuccuguauuauuucuuauaaucuucaaaaccaaccgcauaucauaggaagcugugacacagaucgaugaaguaauuuccuaaguuuauacagcuuauaagcgacagagccaggauucgaacccuggcaaucuggcuccagaaccccugcccuucauugcuacccucuacuggcuagaacacaggugcucacaacaccagcauguuaggaauucaguugucggggauauguaacaucauguuuguucuugacuagcagggauauuuccuggacaauuccauagagucaugccaauuccccuccauuuuugaguagauagauguggggcgagugacuucaaucagcaaauacuuauggagcaucuucaguguagaaaacauugaggaugcagcagggaacaagaaacaaaaucccuaguuucagagcacuuacauuucagugugugcaaaaacagguauguguaugucuuacaguauagagauagcaaaugguuuucaacucaaaaacugauuuugguugauuugaaucgacuguauggacuguuauguuuugguucuauuuuguuuuaacaagcauuuagauagccaggcacuguucuaagcauuuuaaauguuaacuaauucauuuucaaaacaaguccauaaggugaguaauauuccuaacaccauccccauuuuauggaugaggaaguugaggaguagagauaauaaguaacuugccuagauuacaucacuaauaaguggcagagcuggaaugcaaacccagggaguugggguccaaagucuuuguuccuagccaccaugcucggcugccucuccaaacaaauugagaaagauuaagaggcuacaaccagacuuggagagaaagagcaaagugauugacuaaaauaucaacagaauaugggcagagaagugguagcaugcaugaauuucaaguaccaaaccgagaucccagugccaacacugauaugaguuaguuauaaucuggagggauaaugaguauccucaucuaaagagaagguacaguggaaauggaauuggauuuggcuucaugauccagccuccaguuuuaaccuugccacauauaugauucuggacagguucauuuucuucaucuguagaauggaugcaacagucucuuacccuacucacaggguaagcaagcaugaggguuaaggacugaaugcauauuaaaaacaccuugaagacuccagaugcugugagauaaugauacagcauuauguuuaagaaugaaaacuguaaugauuuucaaaaauuauauugcagaagggaaacaaaaagcagcugauuuugaagaccuacucucuggucaagguuucaaugcucacaaagacaaaaaggggccucggacaauagcugagaugagaaaggaggaaauggccaaggaaauggauccugagaaauuaaaggugagugaggccccugacgcagcuugauuauccuauaugacaaagucaugugauaaagucauguguauggagcuaucgccaugagaguaaccuauugucuuagcccauucaggcugcuauaacaaaauaccauaaacuagguggcuuauaaacaacaggauuuuuuuuuucucauaguuaaugaaggcugggaaguccaagaucaaggugccagccauuuuggugucuggugagggccaucuuccugguucauggaugguggucuuuucccuguguccucauaggcagaagaaagaggucuugcucaggccucuuucauaaggacacuaaucccauuuauaagaggucugucucaugaacuaaucaccucccaauaggaagcccuaaccuccuaauaccaucaccucuggaguuagaauuucaacauagcaauuuuggggggacacauacauucagaccauaucaccuauaaaaggcaugauaguagauuucugguggccacucuauuucauuuggucuuugcagcugugauuugaguacagcugugcccuuuaauagcaaaguagcucugaggagguugcacacacuguuuacuuucuuuaauaaaauaaauguuauuccaugauauggcaauauagauuucuuuuguuugccuguucaaaugagcaguggcacuuucuaagaggugauuuuguuauucagauggcauucacauucuaaagaugagucauuagaauuugcugguaagaagaaugcauuauuuauguuuucucuuucugcuuugagagcuuuuuuauuaaaccagauugacugaagcccccaggaucuuuucucuaccgauagagaaauauuuauguaccugagacuuaccaauuccugcaacauuagaccuggagcuuuggaaaguagaggagagaaaggcugagggaaguguggcuccugucuuccccauugucucccucuacuuuuaaccaaagcaguuccacuuuucucucuuucugauucuggagguuuagguaaaauuagauuugagguuuuuccucaaaucaaaucaacauacuuuuuuccucaaaucaacauacuguuuuagcauguuucagcauuuuguuuuuuuaaguuugcaauucagcgaaucuaaccccuuuguuucacagcugaaaaaaaaccacauaacuucauagaugaagauguuguauggacaggcggaugcggauuagcugggaaacagagggugguucuguugaugagugguaugaggucuggaagaguuuguaaagaucaagagaauuggaaugcucuucacagauggagagguugaguuccuaugugacaaaauacuaaauaugcugauacuacaacaaacugaaagaggaggauguaaucugucucuguauuaaagcaucugcaaaaccaguacuuaaacagcaagucaaucuuaacacauucugaaaacauauaccaccguucuguauaauuuccugacagauuuguugcagauguauauaauauacaucuaauauaacuuagauucuuugauacauuuuuuaguacaauguagggucuuucauuugcauguuuuucacuccacccaaugucacagaagcuuaauauuucuuccaaaaacuuugugcuucaucucaauaaccguuguucauuaggcaaauucggacaguuuccuauaaaagaaagcuguuuauuucauuuaaaccauguuugauuauuuaauugguacaggguauguaauuguuugggaggguagcugucauuaaugugacuaaaccauucauccagcaacacucacuuagcugaacuccuguuagguacucaaugcugauacaguuuuaugaucccucugacuuaaucaccucauuuguucaaacugugaauguucauaguucaaauaaauggcuaaaugggucaauucacguaacaagccuuuuugagcucuguucugcaccagguuacuuauuugguuccgagauacagugauauauaagaaauaauacuuuuccucaaacagcucugccuaauggcaggcaaagagaaacacacaauuacaauaaagugugguacauauuaugguagaaauauguuuaagguagaguggcccagagaaguuuggcccuuuuuuaagguuuacuuauuuagugcaguaucuacccucauggaguuuauauugaguauaacucuggggguggggaugggagagaaaggaauucaaacucgcaaagucuaacagugugaaauuucucagcacccuuuugaaagaugauagaguuaaccagggagacaagguaggagauugaggaggagaagcauuccagguagaggaaacagccuggaucauacagguugcccuaaguguuuugauguugcuggagcagaagggguuucuagaguccuaguggaaaccuucugaacuaguaaguaagcauuugaauuucuuaauccccuuuguguuuacagauucuggaauggauugaaggcaaagaaagaaauaucagagcccuucuuuccacgaugcauaccguacuaugggcuggggagaccaaguggaaaccaguuggcauggcagaccugguaacaccagagcaggugaagaagguguacaggaaggcuguccugguggugcacccagauaaaguggguauaaccugcccuguuguguaacuugucagguccuugcuucauuaucuuaugaguauguguuuuacuuuaaaugugcugguucauauggccuauuuuuaauaaaauuaagucaaugagcuaaaaucagauauuuaaacaaauaguuauacuuuaugaaaugagaaagacgauaucaaacuauauauuacaggggcuuauuuagagagaguaagauuuacccagugauuaauuuuuagggcucagaaguaaauugugucugaguacgguggcucaugccuguaaucccagcacuuuggggggggcaggguaggcgaaucgcucgagcccucaaguuugagaccagccugggcaacaugacaaaaccccgucccuacaaaaaaaauaaaaaaauuagcuggugugguggcauaagccuguagucuuagccacucgggagguugagguaggaggaucacuugagccugggugaucaaggcugcagugagcugagaucgcuccacuguacuccagccugggcaacagagugagacccugucuccaaaaaaagaaaagaaaaaguaaauuguguccuggcuuacaauaguaaggacaggcuaagagcuggacagaagaaaacuccuuuccuuuagagauacagcaguauaguuagcuaggaugguaaugaaaaagcuucagaauguaguugguaaaauuugugagaaucaauaaaauauucagaauggaauuaaauuugcccucucuugauuauuacuacauugauuaugucaguuuauguuuucauugaaguauauauacaucuaagggcucuaccuugucagaaacuucaaguaacucauggacaaaugaaaucaucauauaauacauagaaacauucagcaagaagugagucaucuugcugucacauagacuauaccagucauaugacaugaagcuaugaucgaagugccacuugggaacacaggcuugaauuugaugcauaugauuuucaucucuccacauuuuuuuguacuagucugaaaagaagaauuaaugagaagcaaugguagugcuugaauuuugaugaaucaaaagagaaggagaaacaagagcccagaaaaauccacaaacuguauuccccauuaugacucucaaagaacuuuuuagaaaugggaaaaugggaguuaaaaacagucaauagagaugggcugucaugaaccuuugucauuuggcagauacgucuggagaacagagauacgucuugugcugccugauaagcucucuguugucuacuucuugauggauuacuacuacccuugugcauuucuagggggaggucauuauggggagguuauaguaauuugggucagauauaguagauuaggcugaaaaggagaaauggccaaauagaaaaacauuuccauugcuuagagcccauauauuggcagugaaaaauuuaauauuaaugaaauuuuggucugugguaucuaauguguguuuuuguuuucucuacaggcuacugggcaacccuaugaacaauacgcaaagaugauuuucauggagcucaaugaugccuggucugaauuugaaaaccaaggccaaaagcccuuauauuaauuuaugagcuuuuccaucucugcugcagaccugugcuaaugcuuagugugugucacaauucugagguuuucgcagaugaaccaaaaacuccaguaacauguuuucaguacuaaaccguuaaguuacucaugaauuaauuucucauugauaaggaauguggauguuugguuucuccaaaguucccaccauaaaagauccaaagcaugagaggaacuucuagucagaugaccuugcagaaccaccgcauuccacccugcccuuuggggagccuacucagcauucuaccuggggaaauggaaaacagaggccaccacccaugaaggcauaacacccaucacauugucugagaauaggauuaaugagcaaaaguuaugauaauagaguuauaugaugguuuaaugguuucuagauuuuucuuggaaagauauaauuugagcaguggcuuuaugcagacuccaagaacaaaaccaccagguauuuuuuuuuaaguaaaaauuuacuaaggccuuuagcauaauacuguaaaugucuuuuggucaagagaacuaacaaauauaaaggaacuugaaauguggggagugauaauaguccagugauuaaacuacaguccagugauuaccaccaacuuucugacuaagcuaaaaaugaaugaaaaugguggcuaaagaaaauagggacucugaagaugucgaaaucuuuauuccugguuaggaaggugggccgcuacccuucuuucccuuuagaaaacugugauuaauuaaauaaaaagucuuacuacuauaacaacucuaaaccugguuuaaaugaaacaucuaauuuugcuguaaggcuuaaugcucuucuuuuguuuagccaagaaaacauucuuaguuggaaacaggugguaaaguaguuuggccuguucacaacuuaucaggaccaauaucuaguguggacucaguguucucuagguuugugagcaguugugguaagagaauggaaggcaacacugaauaggaguuaagggaauggcacgaucacagugagagagcugcacucaccugcagacccagucagauggcuugucaguaucugcucugaggaaccaggucccaccuccccacaaggcaaaucuagacccauuaaauuauuacagugggcuuuuuuguuuuaaaagugguuggggauccacaggaacgacauucauacagggacauuugugaaagcaaagcaagaaugaaugcuuucccgaucucagacuggcuggauucagaucaguguguuggcugguucucauuuuaagggguaagcaguuugcuauucugugacuuuaguagaucucuuuugugugcacauauacaaugugcauuauacauauauauuaaauauauccacaaagcagaugggcaaaaagauuuucaugcuaaucuucaaagguucaugcucaauauugugaaaagcuuuuaaaaguuguuuugaaaagacaaucauuuuuuguuuuuguuuuaacuuucuuguggcaagcuauaccggaaaagcggcaugucaaaaauacuuuagguucuacauagaucucuuucucucuuuuguuuuguuuguuuguuuguuaaaguucauuauuuauuuuaccuuuuacugacaaugugaaacucgaagaaaauguucucuuuuuaaauauacagucauaaacuguucaagguaaccauaacaaacuagguguuauuuauuaacguauuauaaaauaauguuugauccaguaugugcuugucuuauuuaaaauuggaaugugagacauguugcugugaccuguuuuucuuucucauucacauuuguagauauugugugaacuacaguauauaaugauaacaauuaaaaggauauucuguggaugucacguauuuugaaaugauagaacuacauuagcuuuguaucauguuuggauaauucaucaauguucacaguuuaaaacaucauuaaacauuauguaauuacaaugagaaagaaucuuacuuaaauuuggagauuuucccccacaucucuuuuccggauacauuauaauucuggaccccuauuuaucucaaaacucuuaauauaugcagaccaacaggucuuugcauuccuuuuaaauaacugguugugacaaagcuuguuguugaucagauucacuguuucaucauauuuauuguaauauauuuuuuguuuuguaaauauguuacaacaaaaugugauuggucuaaaauauuuguaauguauauuaaaagguucaaaaauauuuguauaaaucuaaguuauuuggguacuuguaggaauacaaugaggagcuugaaugccaccuucugacaugauuuacuuuuaaggaaaguuaugaggagagaauacaaaaagcaugcaccaaaauguaaucugacaggauuucuggauuuauacguaaucacuccugccccaacacacacacacacacacacacacacacacacacacaugcacgcacacaugauuuugauuaugcuacaugauauauguuucaaaaagaauuagcauagaaauccuggucuccuagccaaaaaaaucaaaggauuuucaaaaaaacgaaucuguauguugaggcaaaaggauugaaccuggaagucugggacuuuaucauagaaacaaagucucagauauuuuaguucuuuggaaacaaaugcuguaauucaaaagcauuugaccugucacuguacuaucuacauguggaagaauguucaaguugaauccuaaugccgugaaugaaacacagucuguguagggaaugagcaaaaaaguugaauuccaauugcuuuuuggccuuuuggcuaaaauaaauguagcaucuaauuuuaucaguuuaacaucugauaugucuucuauccauguacaauauuuuaaauggauuuuguggagcagggagauggaauaggaguuucccccacccauuccacacaucagccugguaaugcaguaacugcaggaauaguucaccuccgccucacuaaaacaacaacaacaacaacaaaagacaaaauuugaauuccagaaauaguuauugcagcaacaagucagucucccugcuggaaacaccuaucagggaagcuggcucaaguagcagauuuugauuauucuaaagauaaaucaugguuuuugggaauagugauacauguugguuugagauuaaaagacuggguuuaaauccuaguuuuuccauuuauagacuuuuuuuuuuuuuuaagagagucuugcucugucaccuaggcugaaaugcagugggucugucacagcucucugcaaccccuaacuccugagcucaagugauccucucuccucagcccucuugaguagcuaggacugcaggugagagccaccaugccugguuuuuuuuuuuuuuuucagacggggucuugcuguguugcccaggauggucuugaacuccuggccucaagugauccuccagccucagccucccaaagugcugggauuacaggcaugagccacugugccaagccuuacagacucuuauauuggacaaguuucuugaacugagucuuaauuuuaucaccuguaaaauagaauucuaacaacccugcaauggaggaauuaagaacuguguauauaaacucuuaacaagcggguacucacuaaauaguaauuauuguuauuguuacugauaguaaauaagacaaaguauaucacuguagguggguauuggagcuggaauuacauggaaaccucauauucuagggagugacacaaguaggaaaaggcaacccaaaguuacuuuuaccuugguccuuauuccuuaucuccuuggguuuacagagaucugucuacauaaaauggcaaagagguuugcauuguaguuucuguaaagggaauagcuauguaaaaagaaguagugauugagcauuaggaaggaaaaccaacauuuacggauuucaauuaguguugcaucauucuugcauuuaacuuaugcacugacuugcaagccuaccccaguguagauauaacauccuggcauuuaucuugugugcacugcccuagguguuaccauauauauauauauauguuuuauauauauuuuuuucucacuuaauucccccaaagauucugagacagguuuuuguaaaucuuaccucaggaagcuaaagcauggagaaauuuacccagagcuggagcuugaggcuauauauuuuuuuuuuucugaggauagggagagaugauacuguguaugguaaacuuauuaauauuuguuaauucagccaacauuuuguguauacuguaugcaagaugcuaauagauaugcuggagaaaauuaagacagugaauggauuugaugcccugugaag

SEQ ID NO: 14037 - RNA, 13188 nt, Homo sapiens
ggccggggcgggcucgggauccgcggggcgacucccggucuggcuugggcaggcugcccgggccguggcaggaagccggaagcagccgcggccccaguucgggagacauggcgggcguuaaagguacaucgcgguccccggcucgcuugucguguggugggguugccaccuccguuccggucaagccuggggcugcgccuuccgcgcgccguuggggaacggccucaccacccuucccgccucuccgguucgggaggcgaucgaccgcucccuucgucccuugggguguggguggagcggcguuucgggggagccuuggcccuuuuugcaaggccgcuggccuuccugcucuccaguggcggcaccagaccccuccccagccugagcccucggcgagagcggcgcccuccaccucuccugaguuuuuaaacaagguuuccacuucuugacgccacccuaacgccuuucuucugguuuucugccccuccgcaguuuccuauuugccacaaaggacccuuugucuccagcguucuuagcauugggaaacuuaauccucuuuuuccuaaugauuuuuccaacugggcagaguugaccgcgggcgggugucaauggaaagcacccagaaagacgguguuucucgcagucguggagaguagauuacguguaauuuuaauacugcuuucuucgguguuuucucuguuuauggacagagaagaaaccaguguguguguaguauguguuuuuugcauggggcaguugguaaaaacaccgcgucccuuaucuguauggcuucagagcaaugcgagacggaaaagguuuuuugcaaggcuuccuguauuuugguaggaaaacauuccauuucuaaucugucgaauagaguagcaugacuuguuuuuauauuggcuuuuauaucauccuugaaauuugcacccaaagauauccccaguuaacaucugcuauaaacauguagauaguauauauacgaguacgccucuguucacuaugaauuuauccgaguaugugagcuguuagcagcagacauuuuaucguuauuucuggcugacuuuuauacuuaauaucaguuuaguaaacaugguuuacuuggagagugucgacuguguuauauauccauuugaagccaaugccgaaaacagaugaaaaguagugucucaguacuacacaugaucagaaacuaccaaaucaugaucacguuuaugugugaauguguuagaaaauugugauguagugaaaaaaaaggaagucugaaauggaaacggacuaagggaaggaagcauuuuacagauuguucaacuuuuauugaggaacuacuguaugccagagacuuaggauacaaagauaaaugagaaguuauuggugggugacagagcuggaaauaauuauauuacuaugucaguguuuauguugggcucagaugcggugggagaacagaugguggguuggauuuuguccuccaaaaagauguguucaagcucuaauucccugguaccugugaaugugaucuuauuuggaaguaguaucuuugcagauauaaucaaauuaaaaugauaacugguuuaaggugggcccuaauccaaugacugguguccuuauaagaagaggggaauuuagacauagagacauacagggagaauaccaugggaagacggagacagaaauuggagugaugcagcuacaaagucaggagcaccaaagauuguuggcaaccaugcuggcaaccacugaguguuaggaagaggcaaggaagggugcuucccuacagccuucagagggagugugguggcgcugcugacaccuugauuucagaaguccagccuccagaacugucagaagauaaauuucuguuguucucagccauccaguuugugguacuuuguaacggcagcccuaggaagcugaugcaggugggauugauuccccugcuccagagaaaggacuguuuucacagaagaggcgaugcuugaacugaaucugaagggaucaauguggcuucccuuggcaaggcauggagugaagguggaguauaucccaaguggggaggacagcacgugacauggcgcagggcuuaugaaacaacaugccuucuucucuucagguacuuaagcuacauuaguaagaccagaacuuaguggugaggguugaagcuggcuggacaggcaguuaggagugagucaggcgauggugagccuccgugccagaacaacuuguaggcuguggaagcaaccgcaaagggauggcagcggugauauauauaguugaaagaucacugucugcuguguagaggauggauuggaagagucacagaggcaggaauaagagguuaagggccugcaccagggcuguagcagagaguuuaagaagucugggagauugagucaccuugaccuacugauucauuggaagguggaaugcaaucauggugucaguccucuaagauaggaccuuuaaaguguagggauagugguuugguuuuacacguguuacacauguugaauuugagguucuuguuggcggucaaggcagagaaguccagacuggagguggaaguacaggccuaguucuuuaggaccuacucugggcuggagcaucaguugcggccgggcccuugugguaguaggagcuuuggguugaacauaaguuuucagcaggagugcguggagugaaaagagagaugggguuggauuuuuggucaacuccaacuuuaagagauucagaggaugugauuccugaaaaaagaggaaaaaaaagaccaaaaagaaucaaacagaaagaugguugugaacguugagaaacugguaucagaacagaaggaagaggucugcaguaccuagcuuugacaggccucauggaggaggggguacugccgauggucaggcacagaggagaggagcaaagccugcugggaaaagaucaucugaaugaaauaguaugugguauuugcuuuccauccacacaugggcauuuuccauuaaagaguggaaauguaaaaagauauguuaaaauugacaguguuucuuugucccuuaacauguguauacuuucagauguuuuuuaaaaagcacuuuggcaccuuccuauuaaagagucucucuaaaucuucucucaaguaaaaggaagcaaucaaaaauguucauuggcuuaauuaauuaguuuaauacuaauuaugaguauuauggacuuuuuucagaagaaaauuuggauaagauagucuccuaugcuuuugauuucuaccuuuaucaaagaacauugcuaaaaugaguagauaccugagucagucagcauuuauuuggcuaccuccuuuugccaagcacuuuacauagauuaucucauuuaauucccauaagcucaauaagguggcaccauuauuuccauuuuacaggugagaaaucagguucagaggauuagcuucuacccaaagucauaagaccagaugguggcagaguuaagauuugacucauguuugugacucagagcucaagauuuuguaacaaccuugauacucuguuucucacucagcagcacaacaagggcaaauacguuccuacucccgcagagacuaguguccaauagauacagggaauacauauuuuauucagugcacacuaguugggaauuguuuccuacaaagacaugaaaacaaucuucaaauacuugcaguacugugguuuggggaggcaaaaugaucaaagguauauauuacagggaggcaguucuggauauaauuuaaagaaggagggcuuucaacauuuagaagcuguuggaauuaaaugacuugccuugggagguagugaguuuuccuucacuggaguuauguggaccaacuggcugcccucuggugacaaauacagagggaauucauccauuggauagggguuagguacuggaauuacuugagaccuuuguauacuuuaugauuucaagguggcagacaugggucauugucuuaaucaguuugggcuacuauaagaaauauauuuuagacuggguggcuuaaacaacaaacauuuaguuuccacaguucugaagacugggaaguccaaaauuguggugcagucagaucuggugucuggugagagccagcuuccugguuugcaggccugcuuucugcucucacauuggagaacagagggagagaaacacagagagagugugugcucuacuuucucucuucuuauaagggcacucaucccaucguggagaccccacccucaugaccucaucugaaccuaauuaucucccaaagguccaccuccugauagcaucucacggugagagggauggagccgggaagguuucaacaugugaauuugaaagggacacacauaaugcagucuguaacgggucaaauguaaccucaauaaaaugaguaaauugcuacauuugcuugaauuugggaccuuuuuuucuuucuuuuuuauuuuaguaaauguuuuuauugauaaaugauucacauaccauaaaauuaacauucuuaaaguguaagauuucaugguuuuuaguauauucagaagguuaugcagccaucacuacuaucuaauuccagaaaauuuacucauccgccaaagaaacucuggaccuauuagaagucacuccccauuuccccaaacccucuagugccugacaaccucuacugugggaacuuuaacuuuuggcuuuauuuuucacagcucucguggcauuauccuucaguggggcuauuggacugacuuuucuuaugcugggaugugccuuagaggauuauggguaaguuaucauuucaaaaagaacuauuccucuuucugugucuuugucacuauuaguauggguguuagagaguucggucaauuuagcaccaaguucuaaccagugaguuaguggagcccaguuuaugaacacagucccuuugugggucagguguacuuuugcagagggcucuguuaaaaauugauguauucauuccauaagcauuuguuuaacaccuacucuggacuagcuggggacacacaaaugaagagagaguccuguccucaaagaggagguaaaguucuaguugugagugagagacaggcaaacggucuagucaguaaucuggcagcugcaguggagaugccagcacaguacgcuggagcucggauaaagugcaccugaguuucagugggacagucagggaaggcugcauggcagagguuguaucugagccaagacuagguggaugaauaagaguuuuucagggugaugagucaggggaggacauuccaggcagagggaacauucuacacauuuuuucauucaaccauuguugguugaaugcuucccaugugccagcuacuguuaugggaacuagggauuaagacauaagaaaacaaagguccugcucucucagaguuuguguuucagugggggagacggacaguaaacaacaaaaguaugcauacugucagagguagaaaugguacaaaagaugaagagcacagaagcugggaagacaguggucagggagggccucucagaggagguaaaaagugagaagaaaugucaagaaaaucagcaagcaggccauacagaucucuagggaaaaagcacuuuaggcaccaggaaagcugaaugcuaaggcccggagacaugaaaguguauauagccuuuucaggaaaccacacaugguacauuaugguacagcauaaauuguaguggaguggcaaaagaaggguuagucaagaguguaaaagucagcacuuagggcucuauaugccugccguguagaggagguuccauuuuauacaucagacaauagaaccugggaaaauaucuugagaauggguuuggaggaggggguuauguuaaaaugucauucuugccauaacgugagacuagauaggaaagagcugagacugcagucagggagaauaguaggggacuacuaucauaaaucaagcaaaauugagggcuggggcaguaggaauggaaagaaaaggagagugaguuaggaaaccaaaccaaccaacagguuuuguucaucgaugucaggauucaacaaggagggagaguucuuagaugucucccaggugauuggcuugaacaacuagauagaagaugaugugauuaggccaggcaccauggcucacgccuguaaucccagcacuuugggaggcugaggcgggcagaucacgaggucaagagaucgagaccauccuaggcaacauggugaaaccccaucucuacuaaaaauacaaaaaauuagcugggcgugguggcacacgccuguauucccagcuacuuaggaggcugaggcaggagaauugcuugaacacaggagguggagguuguagugagccaagaucgugccacugcacucuagccuggcgacagagcaagacuuugucuccaaaaaaaaaaaaaagaugaugaugaugugguuaagaccuauugaagugaguuauuaugacagugaugaauucaaauccaucaccgcaguccuggccaacuauuacagaaauuguuuaaacccaagagggauccagauauaagcggucacuuauauuuguuuagagccuucacagcaauuacuuuauucuagcuuuuggaauguaauacgguauuauuauccucauuucucgcugggaaaccaaagcccaggguaguuaaagacuuacccagauugaacagcaguaagugacagagcccggccgugguggcucaugccuauaaucccagcacuuugggaggcaacgguaggaggauugcuugaagccaggaguuugagaccagucugggcaacaaagugagaccccauucuacaaaaaacuaaaauaagccaggcauggugccuguagcaggguugggaggcugaggugggaagauugguugagcccagggguuggaggcugcagugagcugugaucacaccacugcaguccagccugggcgacagagugagacuuugucucuuaaauaaaaaaguagaaaaaaaauuaaaauggcagacauggaaauggagcucauguucugacgcccuugaccaaacguuuuuccacuauuccacaaccaacuguaaaucuaggaguuuuaauucucugugauacacugucuuuguaagguaagaaaaugacucauuacugcuacuacaaauaaguuuguuuucuaucuuuauuuuaauuuuuuguuuuuuagagaugccacaacacccagcugauuuuuuuuagaaguuuuuguagagaccgagucucucuguguugcucaggcuggucuugaacuccuggccucaagucauccuccugccuuggccucccaaagcuguaucuugauagugaaccaggauuaucaucuauauuggaagucagcaaacugccacauauaaccugcuaccuguuuuuguaauaaagguuuuauugaaauacagccaugcucauuuguuuaugaauuaucuuuggcugcuuuugcauugcucugccaauuaucuuuggcagaguugaguaguugagauagucuuuauggcuugcagauccucguuauuuacucuuuggcccuuuauagaaaaaguuggcccaccccuggccuauguauuuauugaauuguauauauuuaauauuuacauuuuauauauaaacaagguuucuuguacauuaauauuucucuuaguuggauaucgguggcuuacuaugaaugaaaacauagagucagauuguuuuucacaaaacugucacuguauuccaggaaaaauuaagaguucuuggcuguggauauguaaggugacauaucuauuccaaaccccuuccccucucugugucuccuuucucacuguugaaagaagggcuuugaaguagagaaugucuaagggcuacuucccacaauauuguuuggugauucuugaaacauacuaucaucccucuaguuuaaaaucagggguccaaauccacuguuuccauccugaguccucuugaaggacacauucccuucuugccuuuugguugccuagaucuguggcuggaaugggaggcuuucauuaguguggcuucaucccaacuccugcuuguaggugcugucugggcguaucugugugauuacaguauuguggugauaugaauuauuguaguguauauauaaaaaugagcagagacuuuuuuuuucuuaagaaaugaagcauaagaaaugucugauggagaaaaaaagauuauuuuugaaguacugauagagaaaauacuguuggaaaccagauggcaauuuuuuuuuuauaauugcaaaauguugaaauuugggaggaaaacaguuuuguuuuguuuuugcauuacacuauuaauugugagcucuuauaaugaagaucaaaguacaucuaagcuuuucacuagugagcauauuuauuuucaugccuuccguacuuaaaauuuauuuauuauuuuauucauuuaacaaguauaaauggaguacaucauucuaggcccuggagauaaauggcguuugaucaagacuaaucuaucagaugggaauaaguguugugcagaaaguucaaagagggugguauguucgagggugaccugggguacauuagaauagaugaccagggaaaguucugcuuuuagaaaggaaucugucaguuuagaucacaugguaugaaggagucagccaaugagaagaucauggggaaggacauugcaagcagggggcacagcuagcgcaaaggccccaggauaacagcuaugagcucaagaguguucaagggacagaaaaaaggcugguguggcuacagauuaagcaaaugaagggaaaagaguacaaaaugaauggaagaaguagauaauaccagaccauaaaggcuuuguaggcuagggcaaggaauuuaggguuuauucuaagcucuuaaaagguuucaagcaugcgugcacucaaaagaucuuuaccgaacuagcuuuugcaagacacucuacuauguucuauagggaaggcagaaaugaccaaguuaaaauucugucuuuaaagaaauuguggcucagugguacagaaaacaguaaaguuucuaggguauauauuauauaguggcuucuuaacacaauauaagcuaccuacauaguaauuuuaaaauuaucacuacuuaucuaucccugguagaaaucaucuuauguucuaauauucacaauuaauuaauuuuuugaccuaaacauuuaaaauagcaaugauuuugaaauaguaguaugucuuucauuuaaaauguaacuguuacuuuucuuuuuggauuuugccuggguccaacugacagcguuuacuggcccuuauucguccugauuuuccacgccaucucccccaucccccauuucauugccaaaagagucaccuaugacucagaugcaaccaguagugccugucgggaacuggcauauuucuucacuacuggaauuguuguuucugccuuuggauuuccuguuauucuugcucguguggcugugguaaguuuuauuuucuauuguuuugcccaaccguugcugaguuuacuucagaggccugugucugggaccuccauuucaugcucauuacuuaggcuuuauacucaaggccguguguuuuuaguuucucuguuccucuacuuuagaccugccuaacaguaguucggccaugccuucagagugcuuucuuuauuucucuuacaacuuuuagccagacgauaugauuucuuacuuuuucuacuuuaagcuauucucuggaauuguucuuaaauuccugccucuuaaaucuuacaguaauccacagauacuaugcuagcaguacuuuucuaguugcaagaugaagauauuucaaauucuucuccugcaaaugggaucauggacucaacucucaacucaguauaauagguauauguugagggacaacuguguagcuuccagaaaaugcagugaauaaguugacaucuucacuuccaagacaaaaacuuucuuuuugucuucagaguacacauuguagguauaauuuauucaauuauuugcuauucacugucuuuccuacuauuugauuuuauucccuccaauuacguucuauuuuaauuuuaugaaacucuuauuugaggcauugaauaucagauaagcgcaagucuuguucauucaauaaauaucuuugcaacaacugcuacuuguaaaacaccagaaauaagaaauagguacugucucugcuccugaggaacacagaaacuagcuugcuggguaaguauacuauaaguguacuaagugagacgguugaagcaugaucagaaugccauaggggcaccaagaagagagaaauuccgacuggcauuugauaugggccucuaaggauaaauagcauuuguauugagguaggauggcuguuguauggaaugacauucaaguguaagaaugcaguauauagaauaaagaagaauccagugugguagagcuaaaagaaaguuguugagguuaaggcuggaaggguugugaaaccugauuagcaauggucuugaaccccaugccaguuugaucuuugucuagauaauggggaaagauugaagguuuuugaauacaacaagauugucaugacuuuauuuuucuugugcuuuagaccagcccuucuuaagcgcugcaguaaauauuuauauuuuuuccuuucaauacugccaucauauuuugugaagaaacuuucauugauguuucucuugcuuaaaguaaaacaaaaaaugcccacuagaggguacucucacccccaaaugugcuucuguaaaaccaucuacaaaccaucuacuaagcuggaaagcaguuuucaguuguaugaagacuauuauuuaaagucuuuucuugccuagaaaagaaacacacaaauuuauaacucuacaauuuuuauuuuccaugaaagaaguugaugugugcagaacuuucaguacccaauauuguaauugcacuauuuauaaucuuaccacuugaguuuuacuuaaggcaaucauugucaauuaaaaacaaguagagaaauaugucuaauugggaacauguuaaggaugauaccagacuuaauuaacaagcaucacagaaguaauuagacucauuacugaacaguucauugucuccuguuacauuauuaagccuuuuagcagcuuuguguaacauuucauuggauguuucuaaugcagaaaauaauagggauugcaaagaguacaauaugaaggaaguaaggauuuaauccuucuuuucuugucuuucagaucaaauggggagccugcggccuuguguuggcaggcaaugcagucauuuuccuuacaauucaaggguuuuuccuuauauuuggaagaggagaugauuuuagcugggagcagugguagcacuuuauucugauuacagugcauugaauuucuuagaacucauacuaucuguauacaugugcacaugcggcauuuuacuaugaaauuuaauaugcuggguuuuuuaauaccuuuauauaucauguucacuuuaagaaagacuucauaaguaggagaugaguuuuauucucagcaaauagaccugucaaauuuagauuauguuacucaaauuauguuacuuguuuggcuguucauguagucacggugcucucagaaaauauauuaacgcagucuuguaggcagcugccaccuuaugcagugcaucgaaaccuuuugcuuggggaugugcuuggagaggcagauaacgcugaagcaggccucucaugacccaggaaggccgggguggaucccucuuuguguuguaguccaugcuauuaaaaguguggcccacagaccaagagccucaacauuuccuagagccuuauuagaaaugcagaaucugaagccccacucuggacccaggacauuuugaugagauccaaaggaguuguaugcacaugaaaguuugagaagcaucaucauagagaaguaaacaucacacccaacuuccuuaucuuuccaguggcuaaaccacuuaaccucucuggguguuaccugcucauuuguuuaaaaaaaaaaaaaaagucucaccugcuuucaugcugaggacaaguucagauguucaagccuauaauauuuaggcaguuccucaaauuuaugaaaaguguucucagaauugggagacagucaaaggguacaaagccucaguuaggaggaauaagugugauuuuuuuuuaaagaucacuugcacagcaugcuaaauauaggaauaauugaauguauauuucaauauugcuaagagaguaaauuucuaauguucucauaaaaaaguuaaauauuugagaucauauguuaauuaguguaaucauuccaccuuauauucaaaaaucauaaaaccguauuguacccuauaaaaauauacaauaauuugucaauauauaaucaaaauaaaaaacaaaacauacucucucccccaaaaaaacaucucaguggggaacagauguaucuuuucaucugaaagacaaugcugggggaagagcuccacugagaugcgggcagggaggcugggcucgagccagccccugcguuagcaggagggggagaacagauagguaacucuuuuacauuuccuuuaugaucuggcacuucuccccagcuccuucccucugccccccaccccuacuccucaacaguucugguuugcccugacuucucuacggcucuggcuucuucccgaagagauauaggagccauguaagcacgcagugggugaacugcuuaauuucacuacguguugauguacuugucuuccguccuguaggucuuuucuauauaacuuuaugccacccuuaaaugaaucauuggguauaccugucauguuggauccuguaaucacaguuuucccugcucaccuuuuugucuaagaucuauugagaaagggaaauaugggaaggagaaccauuugaucagaauacaaccaauagucuuuaagcauuguuaaaguaugaaacugaaauacauucaaaacacuuaauccuugaggcuugugaucugaguaauuagcagguaugaugcugggacuggaaaauagaaaguaauaacuaaaggguuaaugugcaacguuauuuuuuggccuuguucaugauuuuauguuuucaguguccuguguacauauagaauuguuaaaguugucauuuccaauauuuauauuagaaaaauuauuuagauacuuuauaauuuuaaccggcauuuuuaauaaugacacuugcauuuauuguauuguaauaaauuucacuuuuaacuuuaaa

SEQ ID NO: 14038 - RNA, 6010 nt, Homo sapiens
uugguuucuuguuuuuuauuauuggcgucagcuaggacuauacguggccuuaaacgucaugcacugauggacagaagagaaaaaaggaugaaaaaaaagacaaaggaggggaaagaggagcagcagugaaaauuuguaauaaaaacucuucuuaauuuauagguaaguuuuggcauuuuuaaauccaacgcccccucccacccccuaaaguuccaaccaaagugagagggucacagggugacccggccagguguucugcacucccucacaggcugcugucagaggcagcuuguggguuuaauucuuuuguauguguuuuacauuuuucacuuucuuuaaauaauugcuucuugacucuuagacguuccgguucacgggggugacauaauugcggggaaacaugccggucugcccguggcaagcuccuuuccaccaguuggggucugaguuauccaugacauggauaaaaucuccccggcggaagcccagcucuccauccuccuggggaucaaagucaaagagggccuggacguaugucggcugcugcaaaacaggagcaggaaaaacccacauugcauuccuggucugugacuggccaccuccgaggccagauggguuccagggggaaacgaaugcgugccaaauucuccauguuucuuaaacucaccucccaucucccaaccccccguuuauucuuaccuauucuaaguuuacaggccaagcggguuuagugugauauuucccagugcucagaaaauauuagaguaugucucccagaggaggguggccaacugugccguauuaucaaguagagggcaggcagugcuuggaggagaaaguucuucagaaacagccaucuguguuuaggccgugggcccagaaucgcaaaucccuucuacgacacccuuaagguauuaaagccuaaaguucuggagcucgaauaacauaaggggcucuaaccguaacuuacgaccagggcucgagggacaggaacgggugccgaccccauucccucacaagcauaguuuuccucauaauuugcuuccagggacaggaucuuuggguggguguguuaaagaccaucucccuagagaggcuggcaagcuggcuacacacugccucuggaaaagcaaaaaccuuguauuugaaacaacaaaucuuuuuuuuuuuuuuuuuuuuuuuuugaaaugaagucucccucugucgcccagguuggagugcaguggugcaaucucagcucacuacaaucuccaccuccuggguucaagcaauuuuuccaucucagcuucccgaguagcugggacugcaggugugcgccaccacauccagcuaauuuuuguauuuuuaguagcgacaggguuucaccauguuggccaggcuagucucaaacaccugaccucaagagaucugccugccucggccucccaaagugcugggauuauaggugugagcuacuaugcugggccagaaaaaagaacucuuuagugugaauggaggguaacauuuucaguaaggagcacagaagccccagcggcaaucccugaagggcgcccgcauguugaggggcgccuccccuuuccuacaggaaugcacacugaggagcuauucuuaacuaaaaaugaucccaucucacccugaugaggcuuaccuguggcaccuguucuaugucccgcaggaauaucugcugguuucuggagacagauguagaucugugauaauccaccagcucauucaaagaauugaacuucaccacccagaggaaguacuucccggcuccaucucggagcaccuugaagugcugcacaucguuuccaaaccugggagggacagaaagcacaugugaccggcuaaaggcucuaacuuggcaaaucgaggguauuuccauauaggagcuaucucgagagaaccacugucccagcagcacuccucagggacugcagagcaacaaguuuccucacugggugucccugggacggaccucucccuaugaaugaugggcaccaggacaacauccagaaaccagagagggacaggccaucagucauucucauucugaagauguuuguaagauaaagaguccaggccgggugcgguggcucacaccuguaaucccaacacuuuggaggccguggugggcagaucaccugaggucgggaguucgagaccagccuggccaacauggagaaaucccaucucuacuaaaaauacaaaaguagcugggcaugauggugcaugccuguaaucccagcuacucgggaggcugaggcaggagaaucacuugaaccugggaggccgagguuguggugagcugagaucgcgccauugcacuccaaccuggguaacaagagugaaacucugucucaaaaaaaaaaaaaaaaagaguccaugugcccugaacccuaccaaauaaaaacagccguacuuaagacaaaggagugugacuuaacauccuuugaauaaaaaaauaauuaaaaucuuauaugcaggaagaaggugaggagggcuggaaauacuuucaacaauucucucguaacugggaauaguucaaaguaauguuuuccauucaggaauuuuagcuccacucauggggaaaaggucucugaacaaaaggacguacugggacaauaaaagaggcccagacuucaaaacccaaaagcuucuccaucacuagaucacacccuuuuauacuggcaagcaaaaccggcaacagcguggcuggcugguacuagcucacagggucugucacaggauauuuggcuaaaacaccagccuagcgagggcgcuucugccuguccuguucaccuggccgggcacucucggcauucucggccggaugcgguggcucaugccuguaaucccagcacuuugggaggccgaggugggcggaucauaaggucaggauaucgagaccaccauggcuaacacagugaaaccccgucucuacuaaaaauacaaaaaauuagccaggugugguggcagaugccuguagucacagcuacucgggaggcugaggcaggagaauggugugaacccgggaggaggagcuugcagugagccgagauugggccacuguacuccagccugugcgacagagugacacuccaucucauuaaaaaaaaaaaaaaaaaaaaaggcauucucugagagugcuuguucaaugaaugaaugagucccuccucuccuucagucuuucagcugauggaaaccaaaggcuucagaaaaucaauccggcagguggcagcacugagccucaaggaagccacucagcacaagaugccucgcauuuggaaaaaauacugcuuuacauguuaagacaaaauguggaaggugagaaagcuucauuagcaaggguauauuccacggcacuucuggccccacagaggcccacuuccacccaugcaaugcaggugguuucuaagagcccagggccccaauaaugagcaguguuucaaaucacaggcucaaaacauccuaaaacuaagaaacaucugacaacuguugauucuugaaccuuuuuugcagagguguguguguuguuaaagagagucaugacaccugcuuugcuucuaaaacaauaaaugcauuaaauccuuaaaagauucuacuugagaaaauggaaguuugagaguuucugcugagcaaacaggcagcguccagccgagcacguggcugcccccgugguuuuggccaccacccagugauuuacugcuuguuccccucaucuuauaagguuucaguuacacuugggucaguauaaaacuaaagaaagacaggugucacacauguuuuucuuuucuuuuuuuuuuuuuuuuaaagauggauggagucuugcucuuucacccaggcuggaaugcaauggcucagucucggcucacugcaaccucugccuccuagguucaagugauucuccugcuucagccuccggaguagcugggaauacaggcaugugccaccacgccuggcuaauuuuuguauuuuuuuaguagggacaguguuucaccauauuggucaggcuggucucaaacuccugaccucaugaucggcccgccucagccuccuaaagggcugggauuacaggcaugagccaccaugccgggccacaacuauaaauuuaaaaucuacguuucaaaaaaaaaaucuacauuuuaaucacacauuaagugguucuaaaaccaaauaagauauucaguuuguuuguuuguuuugggagacacagucuuacucugucacucaggcuggaguguaguggcacgaucuuggcucaucugccucucggguucaagugauucuucucucucagccuccugaguagcugggauuacaggcacacgccaccacgccgaggccauuuuuguauuuuuuuuuuuuuuuuuuuuuuuaguagagacaggguuuuaccauguucgccaggcuggucucgaacuucugaccucaggugaucugccugccucggccucccaaagugcugggauuacaggugugagccaccgcacccaguuuuuuuuuuuuuuuuuuuuuuuuuuuuggagacagaguuuugcucuucgcccaggcuaaagugcaauggcgccaucucgccucacuacaaccuccgccuccuggauucaaaugauucucuggccucagccucccaaguagcugggacuacaggugugugccacuaugccuggguuauuuucuauuuuuagcagaaacaggguuucaccauguuggccaggcuggucaguucauuuuugaaauggaaaagucucacgcuuuacaucaguuauaaaugggaaaugguggcuggaagcaguggcuccagccuguaaucccagcacuuugggaggucgagguggguggaucaccugaggucaggaguucaagaccagccuggccaauauggcaaaaccccaucucuacuaaaaauacaaaaauaagccgggcguggugucaggcaccuguaaucccagguacucggaggguggggcagggagaacugcuugaaccugggagguggagguugcagugagcugaggcaugccauuggacuccagccugggggacagagcgagacucugucucaaaaauaaguaaauaaaauaaaaggaaaaugguuuucuaucccccauucaaaaacaaaacaaucuuaauguaaucuaaacuaaguagugaucugaguguugaaucuaauuacuucuuuauauauaacugaugaagugaucugccggacuccuggggaggguccuaugauaauacauuaacuagaaaauaacugaaaguaaaaaacauggaaauaacaauuuaauucaaaaucccgacuucacagcugaggugugaauuguuuagaaucuucaagugcugguuucuauucuccacacucuccauggcggcagaacuuccugucuucuccauucccugcuuacccgcucccuuucacaccugaacuuuccaccggggaaaugcaagccccacauccccugcagcagccuucuuaagugacugugagggccuaggauggggcugguugauuuaagucaguggaccugagcaaggcaagccaaggcagccgacaggcgcuccacuaucccauuagagagagcugcgggaaucccuuggagggcagaagcucaggagugcugggcacuagggaaaacuggcaggcuccagcuggcugcagggagcugcugcucaccuccugaaggcuguguccacaugggaaucuacauccagugcuucuagaacucauuuugagaggagccagaaauuaggauuuuaaugugaaaugaagaaacuguuuaggcuaagccuccaccauuuuguguguagccaggcaccugaccaacggcuucacaauuuggaucagucagagacaggauuccaggcaacugcagcaggaaauacuuacuugacagagagggagaaguccccaggagcgcucucacucucucggauaagaaaggccccaucgugccgcuguuugcuaagcauuucuucugccuuggcucuggggauuuugccaaaaaaccac

SEQ ID NO: 14039 - RNA, 75412 nt, Homo sapiens
cgcgccugcgcauaggucgggucugcggugucaccgcuuucgcuucugcuugagucaguccucacggugacgcuuuuccccagcuuuuccgaguaggaucgugcccaggggaggaggcagagugcggcaguggggagggggcggagcgcagagcgccugcgggggcgcccgggcaaggaguggggauccuuggggauggggguacgggaggaggcgugggugggcgauaaggcugcguggaggggaggggcggggggcgccggggcgggagacggaggggaucuguccugggggagcccgguucuccccuagccuugcccggggcacgccggugaccccgugugucugccccguggcaguacuuucgugggccgccugcccucccccucagcccgcccuuauccgcggcuccgcuuucagagcaggguuucucacccgcggggcuucgggcuccucacccggcaccucugccagaggggaccgccucccggcgcgucgggcauucgucucuuucaccccuucccucuucaggagaaacugaacacguuuuccagccuaaacucggcagggcaaaccagaacauuccccgucuaagcaguuccggggaguuuuaacaauuuccucguaaacucgucuacagaacucacuguauacuguuuaaaugucgccuguguguggagcaacaguuuuauugugccgugcaauccucaacaagaaauuguaguccagggagaugaaaaucccuuauuuggcauucaggcguugaucaaggucgugcaacccucgcuaaaaggauuuagguucaucuccgucauucucagccggggugaagggguguagucugacauuuggaagcuuaagaaccaagucugcugccguccaauucuuuuuuaaagccuuccaucauguguguacuuugcuugaaugauuauuuuaaaguacauguccuauuuuugccaaucugacagcuguuuccauagaaacuagagaagaaauagucauuuucagcaagaguuguuaaaacugucuuccaggcuucagcugugagugccagugagugcugcacuugcucauucggagaugguacuuaaagaauuaaggaucugaaauguucguagaggcuaacaauccaaauuguuuaauuuucucacaucauuaauuuuguuauccuagaagucugccagcuauguuuguugaccugccacagcucuuugaagagaauaugucagcccugauuuuuuuuuuucuuaugugcucuguagucuagugauuggcuccuugaaaaugcaugaauagauuucuucccucauucuuuacccuuucuucaggauaaaccggguauuacaaaauaucaggcacuguuucuauucaaaacgacacuugguugucagugauagaaaugauaaugguuuuaauuauauaugcguaguguuggggcuuuugcuuauaccuucugugucaauaggauucuuuuaaaauuuuuacacaagucaugagaaaugagaaggaguuugcuugucaugugcagagcuaagcagugugaauagaugugcauagacauagagaugagagcuuucuuuuucugugggguguaaguaaaucagggaguuuggaauuuaggaaugggugaaggaggguuggggaaggugccuggagaaguaguaggagggccugguucgccauaugaaggaguuuguggaagccauggaaaaccaacgaaaguccaggcgugguggcucaugacuguaaucccaacacuucgcagugcaguaugaucaguugagcccaggaguuaaaaaccagccugggcaacauagugacacaccgugucuacagaaaaaaauuaaaaaauuagcugggcuggccaggugcgguggcucaggccuauaaucccaacacuuugggagaccgaggugagcagaucacuugaggccaggaguucgagacuagccugggcaauuugccgaaaccccgucucuacuaaaaauacaaaaauuagccagaugugguaaugcaugcuuguaaucccagcuacugaggagacugaggcacgagaauugcuugaacccaagaggcgagguugcagugagccgagguggcaccacugcacuccagccuggacaacgacaaagugagacccugucucgaaaagaaaagaaaaacaaugggaauuacagaaauaguugccugaguggagguuuaaaaaaguaauaauacaucccguagaaauuugaacugcacagaaauauauaaggugaaaauacuaauaaucccucuuaaccaccauccugccauucaaaauaauugugaauaguuugguguaucuuuuuucagauuuauuuuuguauauacuagcauauuuucucauuacuauuuuugcaaauuggggaggguuuuuuaaaaucuguuuuguucucugcaguaucucuagcauccauuauggugccuagcauuuagugggcacucauuaaacauuuucagaaugaaugaauaauaauacaguucagaggucaaaaauacaaaaucugaauguuugguuaaggucguuaaaauuuuuuaaguucauugccaacauuuaaaaauugauaaauuucaccuaaaaucugaaauucuggcuuuacuuaaaaguuuugaaucauuuggccacagcaaguucaaauuccaucauaacuguuugcaccuccuuuagauggucaugaaucugcauucacaucaguaucacuuugcugauauucacuugccuggacccuacaaaccuguacugugcgauacaguagacacuagccacauauggccauuuaacugaguuaaaaauuucauuccucagaugcaccagucacauuucaaaugcucaguagccacauguaggggcuaccuuauuggacagugcagacaugaacauuuuuaucauuguagaaaggucuguuguauggugcuucuuuagacguuugaguuugccaccucuguuauacagaaguuuuuagguagcauuuauuauuauuuuuaaauuuguauaucccuuugccagagauugcuaucuuuuaaaucuuuuaaagauuuacagaucaucaugucauuuuuuaaaugauuaccugguauuuaccaggguaggacuguauguuaauugucgggguaggauucuguugccaggguuugcauuuuagaaauaaugcuuuagcucuaguuuggggucaaacuguagugggagggguuaguggugaaauaaggcagggagauuagguggguagugaucaacaccauaagaccacagagcccaggaaaggcuagaaugagauaagaaggagguagaauugacaugacugauuuaaugugggcugagauauuuuggaugcuaaaguugcuguagagauaauccaguauuucuggaacugauuaaauguugaaaauugguaaauuuggcuuugcaaaguguaggaggaacccucagcuaguuccaguaaacaacauguauaauauuaaaaugcugucaauuuacaaaaacaaauguauaacuguuuuauaccauguaaacgucuuagagaucauuuauuugcagaauacagaaacucauugaagaaagcgcauuauuuuggggauaaaguaaaagcucaugaagcucaauuaaguguaggaaguacaaugguuucaugggaaucagggaggucuuauucucucauauucacucuggcuuuguggucucucacuuaucuucugucuacacuuaauaguccauugucuuuucuguggauccacuuuuuuuuuuuuaaaaaagcuuuuuguuuguaguucuugcuuucauauugcuuuguuuagccauagcacccgcuguagacccaacuuacacaugcccuuauauuccugugcggaauacuguuuuauguaaaaucuuuucaguaucaaauaccuacuccuagcucuguagcuaaugguagggguugcuagggaugaauguggccgucuaagccuguccccuaaaaugaggcuguaagaugcacauuuggaaaaggacuugugcuugggcaagugucugaagcuuaucuacuacaguaaaucaucagauuugaggucaaggaaagaaagugggcuuggguuguuuuugcaguuugacuucuagaagaagacuuuacauuuaaaccuuaaaacacuuucccauuuaaaacaguucuuuccauuuuuuuuugucuuucugcaucugccuaaauggcaugaaaaauaauugcugccuuccugaacucuucagcuacucauggaugucuuuuuaagaaugcauacaguauguaguauuuaauaacugaauuuuauuauccccuaauagucuuacuuagguucaguuuugucuccccaacuagauuauaaccuccaugagagcaggacuauauucugugcugcauaacucucauggccccuagccaaugaaaaccuuacuagcuacuccaguaugaauugugaaaugacuucuaggcuuaaauuauuuaacaauuuuucagcuugguucaaaaaaguaaaaacaaaguaucuuguuaauaaugucaaacuauuauauaucagccuggacuuuacuaauuuaaaauugguuguauuucaaaaaggguuaacucaaaguuaauguuuuacuuagcaugcccuuuauuaacauuauacauuaacagugcaagggcaggauguaugaauuacauaaaaaauaaauuugaguaauuuucaaaugguuugauauauagauaauacuauuaaaacugguaguccuggagcaucuuucuagauaauaucguauuagcuuagguugaaguuuacauauuuuuuuccccaacuuuuauaugaagauuuugaaacaugcagaaaaauuuaaggaacacauauguaacuaucacugagauacaaugauugcugauauuuuguuuauugacuuuauguccuuuguguguguaccuuugcuguacaauuugaaagugaguuuuauuuaucaugaacagauccuucagcaaguaucucaggaauaaaauagucagauaaccacaauauuaucaccuaagaaaauaauaauuaccuaaaacaacuugaaauucaauucauauuuagauucccucaaucuggguuuuuuuguuuuuuguuuuugguuuuuuuuuuuuuuuuuuuuuuuuuuugacagguucucauucuguugcccacgccggaguguaguggcacaauuuuggcucacugcagucucuugccucccagguucaagugauucuccugccucagccucccaaguagcuggguuuacaggcaagcaccacucuuuguaaucccuuccccugcugcuuuuuuccuacaacuccucaagcagucacucaucucucugucacuauggauuaguuugcauuuuuugcaguuuauauuauagagauguaaucagaguauguacuuucuuguguuuuuccuguuuuuuuuuuuuuuuuuuuuuuuuuuuuuuuuuuuuuuuugagacagagucucacucuguugcccaggcuggaaugcaguggcgucaucucggcucacugcaaccuccgccucccggguucaagcgauucuccugccucagccuccugaguagcugggauuacaggcaagugccaccacaccugccuaauuuuuguauuuuuaguagagacgggguuucacgccucgaaugccugaccucaaaugauccaccugccucggccucccaaagugcugggauuacaggcgugagccaccaugcccagcuuuuuuuguguuuuucaaugaauuuauacaguucaccuaagaugucaaguuuaagauuuuaucuuucauugauuuuaagaaguuaugugccuuguaguuuuuuuccuuuguguuucuuuuguguaggauuuguuaaacuuuuugaauuugugguuuuauaauuuucaucaaguuuggaaaacuuuuggccauuauuucaaguguuuuuuuuuucugucuacaccuccuccccgcuuuuuggggacuucaguuagaugaauauuaggccacuugaaguuauugcauaccucauugaugcccugugccuuuuuuuauuauuguauuuuuucucuguauuucauuuuagaugguuucuauugauacgucuucaaagucacaaaucuuuauuucuacaauguuaaucugcuguuagucucaucuaguauguuuuucaucuuaguucuuacaguuuucuugucuaaaaguuuaggucuuuuaaagaaauauauuacauaucucuacauaacaugcucauauuuuccuuuagcuucuuaaacaugugcaguauaguuacaauaacuaauauccuuaucuacuaaugcuguuauuuguuuauuuaggaguuaguuuccacugauugauauuucuucuaauuguggaucacauaucuugcugcuugcaugcuuggugauuuuuaauuauaaauugcaccuuguuaaguguuaaauaguuuuguguccuaauaccuguuuagauuuuuuuuuuuuccugggaugcaguuguugcuuggaagcauuuaaucuuuuuggggguugcuuuuaauauuuguuagguggggccagagcagcuuucggucucagacuaaucuuucucuaauguugaggcaaaacccuucugaguacucuacccacgaaugauaagguuuuccacuuugaaugguggggaggggauaggcaguauaccaugcccugugugagcccuguauauuauucccugcaaucuuuucagguggcccuuucccagcuccagggaauuuucuuacacauaugcccagacaggacucagcugaauaugggagggggauucucugcagaacucuagaguuauuucucugugcagcucuugucuucucuuguccucuguccugugagcucuagcaaccuugguuuacuugaccucccagcuuuaucucuucgauuuaggggaaccacugggcuccaccuagguuuacccugucugcauuguggccuggaagcacucuccaggcaauaagcuaggacaguuguagggcucuguuucccaucuguuagggaucacuguucuucauugcguaauguccagugcauuuuauaaguuagauuuuacuauucuguaucacaugcuuccuuccaguuauugcaaacugauaaaguuuuacuguuguuuuuaucuaauccacuuuauugcucaaaucauuugccauuaaaauacaaauggcucuucccuaacuaaaaauuaaaaaugaaaugaaaaaaauucaagcuucuaaaguaaacguugcauaguaaauaucgugguauauauacucugguuuaucuugcugaaaggcguugcucuaggggugaugaguugaaacccaagguaauuuagccugagauguguuagaagaacaacugacacgccuauuuaauaaguguuauagucccaguuugguaaguaaauauuuuccacagauauuuauaguuuuuuuuuuguuucagguagucaagugaaaaaaugagcuucaucuguggauugcagucugcugcuagaaaccauguuuucuuccgauuuaauucacugucuaacuggagaaaauguaacacauuagcauccaccucacggggcugucaucaaguacaaguuaaccauauaguaaauaaguaucagggacugggaguaaaucagugugacagguggaguuuucugccuggaaacuuucauuuuuauaguacuuuuaacaacaaaagaacaggaggccucucaaguaccaaaaguaaggaaauuuggaggauuaccagcaaauguacuguauggaaugaugcuuuuucaagacagcugcuaauaaaagaaguuacagcagucccuagucugucaguauugcauccucuaagcccugcuuccauaagagcuauuaggaauuuccauacuucuccacgguuucaagcugcuccgguuccucucuuguugaugauucuuaaaccaguacagaaguuauuugcaaucauuguaggcagguaaaaugcuuuuuuagaauaaaaacuuuuauauuaacuuuuugcauuaauauuuugugcuaacguauuaacuuuuagaaauuaauuuuuuuauuuauaaaacuguacuuuuaaagaaaccuugccagauccccugucuccccccauuuagcucaaagugaaguuucuaaacaguagguccugcccaauuuuguucuguaugauuuaauaaucuugaaacaauuuccugcauacuaauuuaugguauagaaauaucucuuuaaaaaguuauucuuacauuuuguauaggcauuaaaaaaaucuuauauuuaugacuacaaaaucuuaggauauauggaucagaagugcugguuaucacuuauguauaagaagaguacuuacaaacauuucuuuuuaauuuguggaauuuaaggcagcaaaucauaaaauugaggaacuuugcuuauauaagggugggcucacuccuaguuaacucuuaagucauuaaugcuucuuuucuuucuauucuguucccaacaaaucuuuguuuuuuuccuuggugauccuuuauaauaauauuuucacagcuuguagugcuuuaacccuuuuucucuuguuuguuuuaugaagauggaagaaagcuaaucacuguuucuucauaaagcuuucuuguguuugaugacugugaagucccuucuagccuucuuacuaccacaugaaccaaaccaguuugcuuuugaucaaaaaccaagaacuucuauuuguaacuuauuguguuuuucaugauuugguguuggcacccaaaagcgauacagcuguauugacuauugguugaaguaauacgcucaucccagguucuucggaugcucuuucugauuucugcuauguccucauccuuuuaaauuauuuauuuguaacuuucuuguuuuuguuacuauuguugaucaccuaaaauuuuucauuuagaauaugucuuucauacauuuuaaauaaaggauaaugucauguaaaguuuuaaauaggaaauaaguauacucgauaguuugauuuaugucccuuuaaauggacacacuuuguguaaaggcauuggggugugucacuucacaaagagaacuuuaagaauuuguaaaauaaauuuuugucaagagaaugauguauauaugguaaauuuuuguugugauuuuacagaucaacucauaaggaaaauuuuugucccaguauugaaaacauugcuuguugucaaaauguuucugaacacugcuaaguggcagagaguauuguugccugguagaaauuggaccuucucagauguuaucuauaaaaucucccacuuucuuaugaauaccuaggaucuuguuaucucuccuuuuucacguuguaaagaggauaguggaguuucugcuacugagcacuauuuauuuccaaaaugaaugcugaggcaguuucccuuguaccuuguggaaucacuggcaaauuguguuggaggucugaggagcagugggaaaaguagugguuccagguauagauuuauuguacuguaaccucuuacauaauuauuuaggcauuuaucccuauuaaguggcuaaguggucagacucuggaaugucauugccuucauugcuugguuuuccuuuuauuaccucaguggccauggacaaguuaccuaacaauuuuaucuucuguaacaggguuauuaugaagauuaaaugagaugguauauauauauauacagagagagagagagagagagagaauuuugcauguacuagauaguaauaaauauuaaccagugguaguuauaguaaacuagcaucucauuuaguguuuauccuuaaaauagcugaagaagaaaauuucgaugaguauuagaauuuuuuaacuguaacuuuacaucauugauuauuuuuucaucauuuagcuaagaauuuuauuaauuggaaaagcgauguauucagcgaaauacaucauacaaauucagguauuugaggacguaaaauucuaguguaugcauuugagcuuuagugauaugugcuggaaugauuuucagaacuuugaauuuuucuuuuugcuuuaggggcauaaggaaaugguggcaggcacuuccuccuaacaagaaggaaguaguuaaagaaaauauaaggaagaauaaauggaagcuauuccuugguuugaguaguuuuggauugcucuuugugguguuuuauuuuacucaccuggaaguaaguccaaucacaggaaggagcaagcuacuauuauuggggaaagaacaguucagacuuuuaucggaacuggaauaugaagcaguaaguaguaagaguuguuuuuaauuagacugcuuaauauaacacucaaaguaggaaaguaucuuaaaugugaaagauauguuguuuuuuaauuuuagucuuugauaugaaauuagcauuuuuuuuucccgaaggccucagaccuuucacacuuaguauuccuacugccuacauugcuuuuccuagcauucacccagcuaacuccugcucagcacauuucaccuuaaaugucacuuuucucaggaaaaccuuccuugauuauccagacuggguuaggcagggugacuggaucaggcccuaggagguauccuucauaccgacugaauuaugaaccagcucauuuguaguugcgcccauugcuuggcuuuacugggguuaggucuccuaggcuuuuuuucucugcauacuguacuuuuccuucaaagcacucaugagaguaacauaauuauuugcauaauuauuuuuuugauugucuuucuuguuagacuaagcuucaugggggcagggaucuuaccuguuuuguuuaugguuuuaaauacuaacacaguauguaagaguagagcuuaguauauauuuauugaauaaauagauuuauagucagaauucuuauaccuugaaaaucaaguaauauaagauuuuuuucccaaacaucaguuuuagcaauuuauuauauuuuuugaauccaaauuuaaguuauaauuuagaagucuuaccucuuuggaaaguauaguaacucagguaguuaaacauuuuguacccuagugaguuucuuagggacagaggucauuuucucuccaguucauagcacauacacauguuaugugcccuguggcucaauuaauauuuuucgaauucauguccaguagccucacuugacagcuuuggcauggcugaaucuuuuuuuuuuuuuuuuuuuugagacagagacuugcucugucacccaggcuguacugcaguggugccaucuuggcucacugcaaccuccaccuuacagguucaaauuauucuccugccucagccucccgaguagcugggacuacaggcgugcgccaccacgccuggccaauuuuuguauuuuuaguagagaugggguuucauccguguuggccaggauggucuugaucuccugaccucgugaucugcccaccuccuaaagugcugggauuacaggcaugagccaccaugcccagccgcuuguugauucuuaagugaaaaaaagcauacacuuuaugaaaguuaaaguaauauuucagaacauuuuuaauuuucucaguacacuugaaagagcucucaugaauauaacuucagaaaaaguaucuucugugguggcuagucuuaaucagcaucuuuuagagacagugauaaugcucauuaguucugagaauucaguaauuuccuuucaaucugugaguaaaacaccuuaaaauuaaugaaaugucuauuuugguaguuuaacuuucuuauuagguauaggguguuuuucuguucaaugcauugugaauuuaauuuucuuuuguauuuuacuuagaugaaaucuuaaguucuccaggcucuccuuuucuuuucuuuuugagaugggaucucccucugucacccagguugguguuggagugcaguggcgagaucucagcucacugcaaccuccaccuccuagacucaagcgauccucccacuucagccucccauguagcugggaacacaggugcaugccaccacgccuggcuaauuuuuuguguuuucgguagagacgggguuucaccauguugcccaggcuggucuugaacuucugagcugaggugauccuccugccuuggccuccccuaguucugggauuacaggcgugagccaucuugcccuggccuaggcaguguuuucuaaaauguuuaggaaaguagaaauaauacuuaaguauucguuuguaguuuaaucgaaaagaaugaaauuuugaugucaaucuauucauaaaaaaacuuaguauuagaauuuauuccuuuguaagaaaccacauugucuuugcaugaauaauucagauuugagaaauuucagugcuuaauauaugcagauuuuuauauaauuaaaacuuaaaauguucaauaauaaguagccauauaacuuuccaugaagcagaguaagcauuuuguagugcucuuuuaaaauaagaaguaauuuuuaaucuuucaguggauggaagaauuuaaaaaugauaugcuaacugagaaagaugcccgauaccuggcuguuaaagaagugcuuugucaucuaauugaaugcaauaaagauguuccagggaucucucagaucaauuggguuauucaugugguugauuccccaauuauuaaugccuucgugcuuccaguaaguaaauguucucaaacgcauuguaauuguuaaauuuauuguccuuauuuuuuaugauguucuaauugcuuacauuauuuucuuuguggugcagaauggacaaauguuuguuuucacuggauuuuuaaauaguguaaccgauauucaucaacuuucuuuccuucugggccaugaaauagcacaugcaguacuugggcaugcuguaaguaccuaaaaugaauguucagguuuggaaaaacugcuuugaaguuaacaaguuaaaucuuuuaaagaacugauuuuuuucagguuuuuuaaaaaugauagacuuuuaguuuuggguaauugccuuaaucugcuaccugaaaaaaacgugauuggcuaauuuugagaauuuuuauggucuuuaguauuugauacugaauaauauuuuucuuaaauacuauuuuuaucaccugucucuuuugcuaaaacguaauuauucucaaccccuaauuauuucaaauuaaauuuuaaacuuucuauaauuauuaauauacuuguaaucuagucagaaaauuaauuguagggaagugauauuacuauuuaaguggguaaaucaucuuucuuuuuuauucauucucagaggauagcuuggagcaucuuugaaaaugucuagaaugaugugucauguguaauuaauacagaguaauaacaauaccuugccauuuuacaguuuacugagcuuuuuaguauauguggcuucccauucauaauuuuaauacccaaugagguauguauuuauuauuacuauuuuauauaagagaaaacuaauguuuagaaaaacaguaacaugacuaaccugacaaaguaaccgaacugggacuuuaacgugggucuucuguauguuaguccaguguuucuuccuuucacuacaguuaccugguuuuuagcagcgcuuuucuuauagaucauagaauucaaguugauguaugcuccugugaauacaugucuguucaucuugauauaaguccaggaaaaauaacacaucuguuucacacauuuuuuaaauuguuauucauuuaaaaauauaaauggcucuuuugucuacauuagagaaaguauuuuuuaaauuguaaacgcaaagguacauagugaagugacugaaaugcuaaaucagaaauacaaguaacauuaacuucaaauggaaaugauaaugauucuaauccuucuaagaguaaucucaaauucuaccuguuccuuagacuauuaauaagaugagaugggcuaaauuguuuuucugaaacacugaaaguaauuaucuccuugauuucuuuugaguuacaggaagauuuuaaaaacauuuuucuugacugggugcaguggcuuauaccuguaaucccagcacuuugagaggcugaggcaggaguauugcuugagcccaggaguuugagacuggccucggcaacauagacucagucuguacagaaaaauuuuaaaaauuagcugagcaugguggcucacaccuguaguuccagcuguucuggagccugaggcaggaggauugcuugagccugggagaucaaggcuacagugagccaugaucgcaccacugcacucuagccugggugacagagugagacacugucucaaacaaaaaaguaagaaaaaaaaucuuuuuuucuuaaacaaauauacacaagaauacgucuaagcaguguuauuauaugcacucuaauaucuuucaaguaauggcuucacaacugcaaaaucaguuuuggccauuuuagcauuugaaagguguuacuauucaguacauuuguuuuuuaggcaucuaguucagugccuuauauucaguguauugucaucucuaucagugcaagaacaguaguagaugagguguaaaaagcaaacagcagccuuaaaaauagaacauaguuauuaauauguuuuugcagagaucuuaaacauugucagcacaauauuuucucuuuugggagucucaguuuugauuuuaucuaggcguuuauguuuucuuuauucuacaaauacagguuuuuguguguguauuuccaguuuucuaagacuguauaauagcaauuauauucuuuaauaacaagggcuuucucuucuauaacaacuuccuuauuuugaguuucacuuuuucauguuaaaauaauuucauaauugggcugggcacaguggcucaccccuguaaucccagcacuuugggaggcugagguggguggaucaugaggucaggaguucaagaccagccuggccaacauggugaaacuccaucucugcuaaaaauacaaaaaauagcugagcauggugguggguaccuguaaucacagguacucgggaggcugaggcaggagaaacauuugaaccuggaggcggagguugcagugagucgagaccucgccacugcacuccagcuugggcaacagggcaagacucugucucaaaaaaaaaaagauaaauccauaauuguuuuucaaaacacacauuuguguuuugaggcaaaguaaugaggcaaauauaaggagguaaaguauguuuugugaggguacaauauuuguuaagggacaauauucuaagucaguuuuuaguuuucagucauuuuucauacauucaaguaaugacugcuauuuuaucaguuucagcauuacaacauuaacauuuacuaaucaccuuuaauggcaaaccaugaacaaucuaguucauuaaacuuagauauuacuacucaaaacaacuauuuuaugaaaaaucuuuuuugguaacugauauaaguaaauacaaaaauucauagaaccugauucuuucaugauaaauacuagacuuacaaauuuacaaacuuguauaaaugaauaauauuucauauauuaggucuugaagaucagaauacuuuuauuuaaaauaaacuuccagucuuuuucugaauuuuuucuuguuuuaagugcuucauauguuagguaguguuuagucuuuauccaaaaauauuaguaaaauaaaacauuuacuugauuuuuuaaaaugaugcaacuauauuaaaaacuaaaacugaccggguuugauuucugguccuuuuaguaauagcugugcaaaucugggcaacucuuaaccucucucuaucucaguuucauuaucuauaaauguagggauaauuguagcuauuucacaagauuauuaugccuguuaauauaagaaauuguagguuuauauccucugacuaauaguaaguggcuuaguagauacuaguuaaaugaaugaauagguauauaaguagauaaaccaaggaagggaaaaacagacccggaaagaauaagcaaaagaagaaaaagagaacucucagucuuagguggagaaggucagguaauuguaacacaugaugaacuagaaaauguaagcauauacugucucaauguauaaaauguaguuuuuauuauuuugauuauucuuaggcagaaaaggcuggcaugguucauuuguuggauuuccuagguaugauuuuccucacaaugauuugggccauuuguccucgagauagcuuggcacuuuugugccaguggauacagucuaaauugcaggagguaagucugagacaauaacuugaauugaucauagccucuggugaagauauuuuaauacuacuguaaagcagcaaauccagagauguuuuuacauuuuacuaugaaauauggguacgaauuuuuagugucuuauguuuucucguuuuuaggggauauucuuauauaugaauauuuaaauuaaggaauacuacaucucucaaaugauggguauggagaguuagaagggcuuggcaacuuuuggcuaauaaaauuuuugaaaauauauuuauugguuuuacagagagaaaacccagccacugacccuuccuuucguaguaacugaaugacucccaaauucagcugucccuugguauacaggacuucuuguggauaccaaaaucugaguaugcucaaguccuugauaaaaaauggcaugguauuggccgggcgccguggcucaugccuguaaucucagcacuuugggaggccaagguggguggaucacgaagucaggagauugagaccauccuggcuaacguggugaaacccugucucuacuaaaaauacaaaaaaauuagccuggcguuguggcgggcgccuguagucucagcuacuugggaggcugaggcaggagaauggcgugaacccaggaggcagagcuugcugugagccgagauugcgccacugcacuccagccugggcgacagagugagacuacaucucaaaaaaaaauaaaaauaaaaauaaaagcaugguguuugcauguaacuaugcacauccucucauauacuuuaaaucaucucuagauuacuuguaauucaauguaaaugcuauguaaauaguuauuuuacuauauauauuuuuaaguuguaguuuuuuaaauuguuuuuucguagauauuuucuauccaaauugguugaaucuaccaggugcauaauccacagauauagagagccaacuguauuuggguuuuaaugcggcacuguuaaaaccucugaacuuuaaugggcacagaauuggcuaaagcuacuuugccauccuuccuugcuuuucacucuguuaaaauaucauugcuuugaaaaugcugaaaggaaagucuuacuagguguuuguuaacuuuuguuuuuagugcuuauguauaauaaucaucucaaaaauguauugagugccucauuuuguccaaaacacuguaauacugaaaguaggucuugcaaucuuuauaacuacuuuguuaaccauaauuuuuuuguuuuacaucuuucuuugaauauuuccucuugucccaggagguuugguuauuuaggaacaaucuguuauuuguuuauuuaaugauuuguggaguucccaucagagugccaucugggugcuguuuaaaucuaaugugcaaaauucuaugagacaaauuguuuuugagauuggauaacuaagucuauuauucaguauuaacaugucauuuggcuucauuuauauugaaguaaagguucuuaaagagaaaauaaaagauugguuauuccuuagguuguaggaucucauauuuugaauuuuguuucugucacugacccgccaggaaauuaaaagaauuaaugugguuauuuuccugaucuaucuauagauugcuuuuuuuuauaauggaaucagcacaguuggucauaagaaagauaacauuuaucuauuucuuucuugaaauacuugauaaauucugccacuucacuguaauucgucaaugaaaauaaaguaggaaugauucuauuugaauuauuuuuuccuaaaucaaggccccucaauaauuuuggugacgaggagauguuucucucuagaaaguugcucacugugauuggagagcagagaggaauguugauagugaagucauuagggugugggaauugcugagguucaucuguugugaggaccgaaugacacauuuaaagcaggauuucucaaucucagcacuacucacacuuuggacuggauaauucuuuguugugggggaguuguccugugcacuguaggauguuuaguagcauuucugacccccauucccuagaugucaguagcucucccuccucucaguuaugacaguaauaaauauuuccaaacauuuguaaaugucccuggaggacaaaaucacacuagguuuagaaucauuaauuuaaagcacuuagcacaguaccuggcacaaaucagggcucaauaaauaugagcuguuauuuuuguucauuuaauccccucugcagcucugugagcuuggaacuguuacuagcuucauuuuacauaugauacuacuggguuuagcaggguuaaacaauuagcucaggguuaacaauaaguuaacaguauuuggacuugaacuuaaguuucucucuuuuuaaagccacaguuuuaaauccuuauguuaucaauagacuugacgggggcacaugcagccugcucauggggagugaaggcauuauaugauauacaucauugaccuaaaacagacugauugaaaaggaaggaagucauuuguaauggucacauacuguauaucagauuuauuauauuauuucaggccaucacagacauguggcuaccuuugaaagauugcuuccccaauuaauagcucuuuucucaaaaguccugccuauugauucaucuccuacaaaguuuuaguacuuacugaaaauuagaauuuaacuggaaagcauucacauaaauacaaguaauuaggaaaauuaaaguuacuguaucuauguguguuuuuuauugaagucagaagaaaauuucauuuucccaacuaaucaauacuuagaaaagaaaaaggaaauuaagauaauuuaucaaagaaagagcauucugcuauaugguuaauuuuuuuacugaaauaaauugucuaguagugucauuggauauuauaugccuacguuuucuugauuuucuuuuaaaacucaaggucaaaauauuccuugaccauauuaaaaagccuucaucaauaagcuuucuuagugaauccuguacucaguagguggagacuauaauuggaaaaauagaaguaaauuccuuauacuacagacugucaagaaauuuauaggcaugacuuauauccuuaucauuuuuuaaaguauuucuaaucagggaaauaaaggcuguguuuauauuuuauaucauggaguuauuuuaauguuaguagacaguauaggaauuuuauccuagauacuccaugaaacuguuuuuuaaaaaucucucuguguuacuccuuuuuucgugaaauaaauugucuuaauggagcuuuucugucauuucuucuuaguauauguuuaauagaccauacagcagaaaauuggaggccgaagcugacaaaauuggacuacugcuugcugcaaagguaaaguguuuaguaguugagaauacauaaugcccuucccaggcugaaagauaaacguguguuauuuuaaugaggcuuggcauaagcagagaaugagaguuggacuguauuagcccuuuauguaauuucuguuaaucuagaaauuugaagauuauggaccuugaaagaauguauaacugaagagucucaauucccuucuauauuugaagcuguauuaugccuuagacagaauccauaagauuauaguaauuaucagguucuauuaaaagaaagucaguucuugauuggaaauaauuuuuugcguguauaaauuuuuugaucauagacaugaaacauacaaauugaaauuuuaaaacauuugguuauguaaugugucauccccucuggccuuuuaacauuugucccucuggaaagcuaaugcuaucucuuuauuuuacuccaguacuccaauauuuuaccccuugcuucucugaucuaaggaggcuuuuugaguaaacagguugauagguaguuguuuucccccacuugaagauagguugauccuguuguagcuaugaucuuggcuaagcaaacugauuuucuaccauuuaaauaaacaguagacgaacagacauuuagguuauuuuuguuguagcagauggcuuuuuuuuuuuuuuuuugcuagccauagagagcagcucugggccuuuacuuuuauuuaaguugacuuuguuccugucuacuuaacagggcaccuggcagcuauuuuuaaucaccugugauaacugaguguuauuaguagcauuuaagauuagaaguaaaacugcauuuuaaaaaaaugagugaaagcaaugccacuucacauauuaaauucaaguuuuaauugauccuuuguuauguuucugguaguuauuaaaacuauuaaucauuuuauuugaaccucucauaaguuuuauggauuuaauuucauaaaucaagguauuacuccuucacaaaagcaaaaucaguucuuugaauguuaaauaaaugugauuaagugaauuaucagacugcgugcacuaagaaguucccacauaagggggccacagauuggcuguauuaagaauuuccuaauuuucauguacuccagucugucagauuuucccuauauguuaaguguguucuguguucugguuaggaaaucuuuguuuaucucaguaaguuauuccugcuuuauuucuaauaaacuuuacuauuuuuaaaauauauaauaugaggaagagggcaacaucuuuuuuuuccccuauggauagcuaauagacucagcacuguuuauggaaaaaagucaccuuuuuuucaccagacuucagugucucuuugucauaaaggugggaguauaucuggggucucuuucuagacacacuauucuguuccauuggcuuguuuauguuucagccaguaccauauuaucacuauaacuuuguaguaaguguugauaccugaagcuucuguccuccaguguuguucugcagaauugauuugacucuucuuggaucuuugcauuucuauauacauuuuagaaauagcuuauuaaauuauacauacauagaaaaacacaugggguuuugauuggaauugcauugcauuuauacaugaauuuggggacacuugacuagugucuguaguauugauucuucccauccauaaauaugauauauuuuccaguuuguuuagauguuuaauuuuucucgauguuuugaaauuuuuuuguauguaggaauuacacaucuuuuguuagauuuauugcuaaguguuugaugucaugauaaauagugucauuuuuaaaguaaauugcuuguauauaaaaauacaauugauuuuauaauugaccuuguacccagcaaccuuuauuucuuccuuuccaaucuguauacaguugacucuugaacagcauguuuuugagcuguguagauccacuuauacauaggauuuuuuucaauaaauauauuggaagguuuuuuggaaaugugcaacaauuugaaaaaacucacaggugaaccauguagcuuagaaauauugaaaaaauuaagaaaaggauaugucaugaaugcauaaaauacauguagauauuagucuuuuauaauuuuuuaccauaaaacacaaaucgguuaugaaaauuuaucaaaacgugugccuacacagaccauacauggugccauuugcaguugagagaaauguaaacaaacagaaagaugcaguauuaaaucauaacugcauagaauuaacugugguaccuaugguacuacucuuauaguuuuguauucacuuccuguugcuaaugcagugaucucaaauauugugaauaucuacuuaaaacaccagaagacacuaaucaucuccaugugagcagcuuucucuccaguaaauugaguaucuuaguaaauggucucuugcaguucuugcauauuuuucauuguguuuagugcaauacuguaaacaccuugaguaauaccaugagacccauaugaguugcugcuagugauacuggaaauguucccaggaaguaaacucaugauauuacaagaaaaaguugaguugcuugauauauacuguagauugaggucugcagcugugguugccugccauuucaacauaaacgaauccagaauaaggaccguugaaaaaaggaaaagaaaauuugugaagucauagcugcaacucuaccagcaagcaugaaaaccuugcacuuuuugcaaaagacuuuuaucuuguauagaagaugcaccuuuuaugugggugcaggauugccauaagaaaggccuaucuauagacucuaauaugauucaagaaaaagcaaagucauuauauuacaacuuaaaaggaagaugaaagaucuaaagcuggagaauuuaaugccagcgaaggaugguuugauaguuuuagagauuuggcuuaaaaaugucaagauaacaggagaagcagcuucugcugaccaagaggcagcagaugcauucccagaugcuuuaagaaaaucguuaaggagaaagaauagcugccggaacagguuuuuaaugcagaugaaagugugcuauucuggaaaaaagauaaugccauaaaggacauuuauuaaugagcaucaagauuuaaggcagaagggauaugcuaacucuacuguuuugcggaaauggaguuggauuuguaaguacuuuccuuaucuauaaagcugguaaccccugagccucuaaggaaaaagauaauaccagcugccagucuuuugguuguaaagcaaaaaggccugcuacacaaugagaacgcuuuuucuggauugguuccauccaugcuuuguuccuaaaguuaagaauuaucuugccaguaaaggcugccaguucuuuuuuucuuuuuuugagauggagucucgcucugucacccaggcuggagugcaguggugugaucucggcucacugcaagcucugccucccagcuucacaccauucuccugccucagccucccgaguagcuggaauuacaggcacccaccaccaugcccggcuaauuuuuuguguuuuuaguagagaugggguuucaccguguuagccaggauggucucgaucuccugaccucgugauccgcccuccuuggccucccaaagugcugggauuacaggugugagccacugcgcccggccaggacugccaguucuuuuuacauucucaauuccucuggucaccuggaaccccaugaguucaacacugaaggcguccaaauggucuacuugcccccaaacacaacauuccuaguugagucucagaucagagggccauaaggaccuuuaaggcucaguacaacaggguacuuuagggaaagguuguuacugcuauugaagagaaccccgauagaacauuaugaaagucuguaagguuuacaccacugaagauuccaucauuguuauagaaaaagccaugaaagccaccaagccugaaauaauaaauuguugaugaagcaaacuauccagauguugugcgugaccacacagagccagucaaggaaaugaugaaaagauuauggauauggcaaaaaagguggggagugaaggguuucaauauacagaucuuagagaaauucaagagcuaauagaaacaccuuaucaggggaauuaaccguggaugacuugauggagaugagugcuuccaaaauggugccagguagaaaagacauaguagugccagaaaacaaauugacauuagacaaucuagcagaaggauucugauuauucaagacuacuuuugacuuauuuuacaacagaaauuacaaaguaucuccauuaaguuacacugauuaugccugccuuuccugucucccguucuaccucugccaccccuggaacugcaagaccaacucuccucuuccuucucagucuacucagugugaagauaaggauggagacauuuaugaugauccacuuccacuuaaugaauaguaaauauauuuucucuuccuuaugguuuucuuaauaacauuuuccuuucucuagcuuauuuuauuguaagaauacaguauauaauacauauaacauacaaaacauguuaauuuacuguguuacuggcaaggucaacaguaggcuauuaguaguuagguuuugggggagucaaauguuacauguggauuuuugacugcacagaggggucagugcccuuaaccuccauguuguucaagggucaacuguacuuuuuaauuuuugcuuuauugcaauagccaaaaacuuuaguacaaaguuggugaugggcaacuuuguaucucccugaucuuaggggcaagaaagcauucaguauuucaccauuaugauguuuguuguaagcuuuuuauagauacuuuuuuaucaaaugaaagaguuucucuuccauuucuaauauccuaagauuuaaaaaaauuauguauauauauuaaauuuuaucaaaugcauuuucugcacuuuuucuucaacuuuaaaguuccaggguacaugugcagaugugcagguuuguuacauuaauaaauaugugucacagugguuugcugcacagaucaacucaucaccuagguauuaagcccagcauccauuagcuauucuuccugauguucuccuucccccugcauuuucugccuguauugagaugauuauaugauuuuucuccuuuaaucuguuauugggcaaauuacauuaauuuuuuuuaaaguuaaguugcauuuuuggggaaauauaccuaauuuugucaauuaucccuuaauauauugcuagaauugguuuaaugcuuaguuuagaauguuuauccuauguucaaaggagauagucgccuagaauuuucuuuucuuguaauguccugucagguuuuggaaucaaaguuaugcuggccucauaaaauugaucagggaaguguucuucauuuucucuucuccagaagaguuuuuguaagauuagcuauauuuauuuuuuaaacguuuggagaauuccuggguaaagccauaugggccugaagauuucuucaugaguuugucuuuaauuauggauucagucucuuuaauagauauagaacuauucagauuuuucuauuucuuguuucaguuuuuguaguuuuucuaggaauuuuuguuuaauuuucaaaaucauuggcaugaaguuguuuuaauauacucuuauuauauuuuaaugucugaaggauaccuguuauuuuacauguaucuuuuaaauguccccuuuguuaauauuggugcucuuugucuugucuuuuuuuugcuagauuuuaucacuuucaucaaucuuuucaaaaccaucuuuuggguuugcuuauugucucuauuauauaauuguuuucuguuaugucaguuaccauuuuuuuucauuauuuuauucugcauucauuuuuuggguuucauaugugguucuuucccuaacuuaagaugaauacuacuaucauuuauuuuaaacucuuuuuuuuuucuaguacauacauuuaaggccguacauuuuccucugagagcaucuuuacuugucauguugcaaggguugauauguuauuuuuucuucaguuuaaaauguauucuuguuuucgcugugguuucuucuuugacccauggguuauuuagaaguauauugcuuaguuuuugaacauuugaugauuuuaaaguuaccuuuuguuuucgauuucuagcuuaguuacacucugauuggauaauauacugaaugacuggaauccuuugaaaaggguugggucuugcuuuguggcucaggaugugaucaauuuugucaaaaugacgugcacuugaaaguggauccugccauugcgggugguguucuguggaugucaguuuugccaagugugucaauuuuguuguuucagaucuucuauauucuugcugauuuuuuuuccuuuuuuuuguaguuaucaagagagguuugguaauauuucauuaugguuguagauuuuucuuuuuuccuuuuagggcuauuaauuuuugccguguacaucuuaaaaguaucuuuaauauacauacuuguuagauuguuagauuuuccuaguggauugguccuuuucuugcaauaaaaucacugucucuaguaauacuucuugccuaauguccacuuuuuccuuuuaguauuguuauuucagcuuucuuucaguuagugcuugcaugguaaaucuuuaauauucugauuuucaaaccuccuguguucuuguguguguagcccuuguaaacagaacauugcuguuguuuuuaucuuugcccuuuuuuggggaaaaguuagucuauuuguuuaauuugcauuucuuauuuguaauuauuuauauaauguggaacauuuuuaugugucuauuggcacuucauuuauauuccuuugugaauuaucuucucagauauuuuucccauuuucaaauugggcaaggaaguuuguguucuuauucuugaguuguaggaguuuuucacauaagugcuaggugcaaguucuuugucagauaugugucuugcaaguguuuucuuucauucuguggcuugcucuuuuauuuuuuauuuuuuucaacguuuagguuccaggguacacgugcaggucuguuacguggguaaauugcacguugcuaagauuugguguacaaaugauccucuccccgagguagugagcaugguacccaaaaggugguuuuucaacccuugcuccccuccuucccccuucccucugguaguugccagugucuguuguucccaucuuuguguccauguguagucaauguuuagcucccccuuaugagugagaacaugcaauaggcuaaucacuuaaccucugacuguccauguaucagaauguguuuuccacuaccuaucuugaaguucauuaaucuuauuuuuagcuguauuuguucuacauuaaauucguauuugaguuuuaaauuucaguuacuuugucuuuucauuccagaauaucccuuugaugcucuuuuauaaauuucacuucucuggugaaauucuccauuuugucauauguuucuuuguuuauauuuucuugaauauguuaaucauauauuuuuuuaaaaauucauguuucuuaacucuaaucucuguauuauagcuggguccguuucuguugucuguuuuuggcuuuggucuuguuuguuggcaucguugcuuauuuuugauugaaugcuggauguuucauauaaacaguucuguuggcucugaaugauauauuuuuuuuuuccaucagagguauucucugugcuaaguggucacuuagagcauagcagaucucuucacucauucagagccugaggugaguuugcauaggcugggaugaugagcucuacuguaagauuguaggacagcgaucuagcucuuucuuuggggaagcuucccauagaauauauauuggccuuuccucuguggucauucacgugucugcagaugaauccuguaaaaacuggcuguuggauguaccccauuuacccugaugugauuacuauacauuucaugccucuaucaaaauaucucauguaaccccuaaauauauaaccuaccaagugcccacaaaaauaaaaaacaaguaaacugguuugucaguguuugaggauuggcaguggaaaagggaguaggguuuucccauucauuguggagacuuuuaaaaauucucuguuaugacccuuauaccucaaccuuucuuucuuggaagucaaauacuaaaccuuucuggggucucugcagugugggguaaucaaucaauugccaaagaagcgagcaauaaguguagagauaaugcaugaacucuggaaccauacugccaaguuugagaaucugcuuucccagagagaguacuagcugugugauuaugaucaaguuauuuauccuuuuugugccucaacuuuucucaucuguaggauaggaacaguauuggaccuaucucauacacuuaauauaauuaaaauucuuagagcucgugucuuuuaaucauuuaucuuaaaaggacugucugcuaucuccucuucuuuauuucacagauacauuaucucaaacccaguauguucaauauuaaauucuuaauuucucccuacauguguuuuucuucuggucucccuuuucccaaugaauauacuacccucuauucaguugcuuuuggaaaaaaaacccuggaguccuccaggguuuauagauaaagauauucguucuuuaucauuuacucuuaauuuuuucaccaaguccuggcaguucuaucuauaaaauauaucucaguauguucccaucuccaguacuagcaucuuuuaccuaaacuucuguagcaggcucaugauagcuuucauugacuccaguccuacuccccuccauuccauucuccacccugccacaaguaagaaacagauccaguaagcuaugaugauauucucuuuucuuuuuucuuuucuuuucuucccuucucuucucuucccuucccuucucuucucuucucuucucuucucuucucuucucuucucuucucuucucuucucuucucuucucuucucuucuccucuccucucuccucuccccucuccccucuccccucuccccucuccccucuccccucuccccucuccccucuccccucuccucuuuucuuucugacagaauuucacuuuuguugcccaggcuggagugcaauggcgcgaucucagcucacagcaaccaccaccuccuguguucaagcgauucuccugccucagccuccugaguagcugggauuacaggcaugugccaccaugccuagcuaauuuuguauuuuuaguugagacgggguuucuccauguugggcaggcuggucucgaacucccaaccucaggugacccacccacuuuggccuccuaaagugcugggauuacaggugugagccacugugcccggccugauacucacuuucuuaagauaaggcuuuaagaagacauugaccagaauuuuccuccagacuuuucccuuucucaccugaccaauccccuacuuuggauugacauuuaacauuaauacaaucagaagacaguuugaucuuacagaccuaggugcuagcucuucucugauccauuaugaugauuuucauuuauuaauugaauguaauuaacuuccagauuauagggauacauaauaucuucaugacauuagaauucaagagacagaaauuuaauaaauaauuuuaacaaaguuugaaguauuaugaauuggagauacaggaaacauucauuccaugggagaauguagcagagauguaacuugagggaucucucaaguuacaucaaauuacauaggaaaacuuagucuugggauuagacugagaaagaaauagauaaaauggagaucugaaagauaaauaguaauuauccugaugaagauguugauagguguaguguuuggcaugguguguucaaaggcaagagaaacaauggcuuauuccaggaauugaaaauuuguugugguuaaaaugucaacagaauucaagagcaccaauggcaacagauaaaacugaaggauaggcagaaacuucuuuauuagcaauuuuaaggauuuuacaccuugucuagcauaggggucaggacuuuggguucaguaguccagauguguguuugagcucuugucuccuccacaugacuguagcaaaucacuuaaccucuucaaaucuguuuuguagucugacuagugagaaucaugauaguacuuccaucaaagaguuauuuuggguauccuggacuugauucuuauuuguggcuuguauccuuuuuuuggaccuugaugcaucagacucccuugacuucuugccauuguagcauucaaaucaugucaacauaauccuccuuuuccuaauucucuccuuccuaggcaaccuucugauuacagccuggcuuccucuguagcaugccuaaaagggagagaaaguccugacccaaggacauagaugcaugugcucuugcugguuugggcagcuguaguuaucucuguaaauuaagaaguuggcauucugauuuuaugucaaucuugugagcuugguuacugggaacuauuucugagagaugguucuauuggucauaugcagucccauuggauuuaugagguuucaacgugcaaaauucacaaaaacgauguuacucaugaagccucuuucaaaguaggcagcccacuuucccuaggguucucugcugcuccucugcuacuggcuaugagugauuuuauugugcaaauuuauguuuuuauaggaguucuuuuaauuuuucauuuggaaggcauuugucguuauauaaauuaucagaaugauuaauauagaauuaauaaucacugguaagaccaacauguaaauuaagcauagaauaacaagcuguucagucuucagcugacaaaagagguccuguuaaguauuugaucuuuugggguaugaauauucauuugucacuguaaagagcuuuugacacuuugcagucauuauagaaaugacuuuuuaaaaauuucacaagcaacuaaacuaucaguuuuaauuuuuucguaacaguuucuuaaguuuggaaaagaaaacugauauucuuuuagugguucugaacugggcuagccuucuaggaugacaugguguaugauuguuuuugauugucauaguuauuggggaaguggggggaauuauugauguuuaaugugagggaaaaggggauaauaaauauccuauaguggccuggaaagcacucacugggaguaauccccaaagccuguuaaguggcccuuuugggaaacguggccugcuaguuuccucaaguaaccugagauaacugugccaauagcaccaucuagugagggcauuagguaauaagcaaaaucuauuuuucaucacagaaaugagaaaauuucaaauucuaaacuuuauuuaaaauaguaccuuguagaaucauagacuuuuagagcaggaaagaaaauuggagcuaauuuaaucuaccuucucauuuuacagauaagaaaaccagagucuaaagauguaaagugauuuaucuaauaaccuauaccuaguuaguaggaagacccuuaguucuuauuuuucagguuaguauucugagcuuucaucacagcaaaguaucuuugcguuuuauuuggguuacuguuuuagguucuuugcuuaaugauucuuuuaagaaagaaaagaaucaguaaguaaggagaccaucuuauuuaauagguauguuguaaaguaacuuucauaaugcauacauuauuuggaacuuaauuuuaucacccagaaaaaugagacaggcuuguguguauucaucugauuuuucauugcuaugauuucagcuguugagucuuaugauaaaacuuuaccuaagauagagggaaaaaaguaacaugaaaauuuauuaaaacuuaauuuauuauauugauuggugaaaugaccugcuggcaaucaaaagaugcagaaaauugagcaaaaaauuaagauuaaaugaccaacauaugucuuucauuuuuauguuggagcacaugaaguauuuuugauaaguuuucucuuggugugagggauuggcaaaugcugagaauggcuuagcugaaauuaucucaagauuauguugcauuuaguuggaaaagagcaauuuuaaauuauuuccuggaaaaauguuguuuagagaauaaguggguuacaaaauaaaaugagcuuuaagaagugaugccaucagcaauauuggaaaaugaugaaccuguggagguaugugagacugaaaugaacuaguuucugguagaugaugacaaugaugauuguaguguauaauaaucaauaacauuuuuaaugugcugggcacuguccugaguguauuacauguauuuauucuuuugaucuucauaacaacccugugagguauagguaaaccugagggauggaggaguuaaguaacuuggcaaagcucucauagacaguaagguuucccucucccaaaguggagguacauucauuucugaaagggaacuuuccaucuuauauuugccugcuggaaacaauuuugguuuucugcaguauugcuucuaaaauaaugaucauuuuuauaucuguuuuggucccuuuacaucuuauaacagccucaguguauuuuucuagcuguaggagcccagcucccccugccacaauccuuuguaguauugucucagaugauuauuuuaccuaucacaugucuauguggaauacaggagaggaugcuacaaugacugggacaaguguaggguguuaaugguuuccuaaaaaaagauucagauucauucagugucaggauuuaccuuuggaagggggugauggcuaacaggagcuuuguuggagugucuagugaauacagacagcaaaauucagagauacuuuucaucuuugcauuucuaaugaaaacguuggcuacagguaacgguacaguuaggcuuuuacuuggucuagaucuauuuauacauauuucucuaguauuguuuuggcauugggaaauggugaaauuauaagaacaauuuuuauacugcuguauucuuuaugaauaucauaucccacugaauuuauaauuuaauaguagcaaauucuuucucaauauguuccuuaaugcauauucauauacauuuauauucucuggauuguacuagaaccuucuuguaaauucaugacaucaucacuuaggaccaaacauagcauuuugcaauuaccauaggccuccaguugcucaccaggggaaaggaagguagaaauaguguccacuauguucugaguccuggaauggcugcuuugcaagaauuaucacauuuuaacuugacaauucacugcuuuaauuuaguuuuacagaugcaucugagacuccuagagacuaaauuauugacccaggggcaaaaacucugucaccagacuacuuguguucaaauuauggcucugucacuuacuagcuguuugagcuuugucaaguuauguagucaccauggaucuugguuucuucaucuaaucuguaaagugagggucauaacaguacuuaccacaugaaguuguuaugaggauuaaaugaguuaauauaauguguuaauauuuguaauacacuuaaaacaaugccuggcauguggugucauauaagugacuguuaauaaauaaaauaaucaguauuuugaacccagauauuucugauucuaaaaccuguagucucuccauuaucuuaguuuacagucucaaaaaauauucuaggaccaaaguauuucacugacacauauuuucuuauguuucucuggccagcgguagccauuauuaguucuguuuuuaagaaggaaagguuaccuagagucuaauucuuucuucguguacuuacaguugcuuaauaaguuauuuaguucaguucaauaauuuuauugaagcaaugaguuagacugaauuaguugcuguauuaguccauuuucacagugcuguaaagaaauacccaagacuggguaauuuauaaaggaaagagguuuaauugacucacaguucuccauggcuggggaggccucaggaaacuuauaaucaugguggaaggggaagcagguaugucuuacauagcagaagagaggaagaguguguaagagcagggaaaacugccuuuuaaaaccaucagaucccaugagaacucacucaguaucacgagaacagcaugggggaacugcugucaugauccagucaccuccuaccaagucccucccucgacacauggggauuacaguuuggaugacaguuguugacgagauuuggguggggacacagccaaaccauaucaguugcuuaauaaguucuuaguuuucuauaauacuuuucuugaagcaaaagaauuagacuugugauaaacugaguauuuauuuuaaaaaugccuuuauuuuggucuaucguuacuuuuuuucucuuuuuuaguaaguacauuuaacaugagaucuacccucuuaaauuuauaauuuuacaacacauacuuaacuauaggcacaugcuguauaucagaucucuagaucuuauucauuuugcagaacugagacuuuauauccauugaauagcaacuccucauuuccuccuacuuccacucccugacaaacacuauucuauucucuacuucuacaagcuugcuacuuuagauacauaccacauguaaguggaaucgucucguauuuguccauuugugacuggcuuauuucacuuagcuuaauguccucaagguuuauccguauuguugcauaugacaggauuuccuuuuuuaaggccaaauaauauuuugauguauguuuauaccacauuuucuuaaucuguucauucgcugaugaacauucagguuguuuccacaucuuggcuauugugaauaaugcugcaaugaauguggagugcaaaucccuuugagauccugauuucaacucuuggauaaauauccagaaguaggauuucugaaucauaaugauaguacuuuuuaaaaauuuuuugaguaaucuucauauuguuuuucauaaaguccacaccauuuuauguucucacugacaguguacaagaguuccaguuucuucacauccuugccaacacuuagaugucucuuuuuuucaaugauagauaaccuaacagguguaagguaauauuucauugugauuccaguuugcauugcccugaugauuagugauauugaacauuuuuucuaauacuuguuaccuacuuuugaaugucuuuuuugaagaaaugucuauugagauccuuugccuauuuuuuaaauuggguuuuuugcuauugaguuguagaaauucuuuauauauuuuagaaauuaacuguuuaucaguuauuugguauacaaaugguuuuucccauucuguagauugccuuucacucuguuuccuuagcugugcagagcuuuuugguaguuccaccugucuauuuuugccuuuuguuucccgugcuuuuggugucauauucacaaaaucauugccaagaccaaagucaugaaacuuuucccuuauauuuucuucuaggaguuuuauaguuuuaggucuuacguuuaaaucuuuaauccauuuuuaguugguuuuuguguguagcguaagauaaggguccaguuucauucuuuugcaugugaauauucaguuuuucuagcaccauuuguugaagagacugcucuuuccucauugugggguuuguguguguguguguguucguuuuugagacagggucuugcucuguuacccaggcuagagugcagugaugugaucacagcuuacucuagccucgacuucccaggcucaggugauccucccaccucagccucuuggugcacagguguguaccaucacaccugccuaauuuuuuguagagaugguuucaccauguugcccagguuggucuuggacuccuggucucaagcaauccaugugccucagccucccaaacugcugggaucacagauaugaaccaccauaccuggccucccauuguauauuuuugguacccucaucaaagaucuguauuugugugggcuuaauuuugggcucucucuucuguuccauucauuuaacgguuaucuuucugcuaauacuauacuguuuuaauuacuguagcuuuguaauauauuuugaaaucaggaagcaugaugccucuagucuuacucuuuuucaagauugcuuuggcgauuugggguuaguugugguuccaugugaauuuuaggaucguuuuuucuguuucuauaagaaaagugccaaugggauuuucauagagaucucauugaaucuguagaucaccuugggugguauggauauuuuaacgauauuaagucuuacaauccaugaacaugggaugucuuuccauuuauuugaguugucuuuaauuucuuucaucaguuuuuuuuuagauacuuuuuaguguagaaggcuuucaccuccuuaguuugguuuaauaaguauuuuauucuuuuuaauuuuccuguaaguggaauuguuucuuaauuuccuguuuggauaguuuguuguuaguguguagaacauaacugacuuuuguaugcugauuuuuguauacuaacuuuacugaauuuauuuauuaguucuagcaggguuuuuuuuuguguguguggagucuuuaguuuucuacuuauaagaucauaucaucugcaaaucauuuuacuucuuucuuucugauuuaaaugccuuuuauuucuuucucuugccucauugcccuggcuaggacucccagugcuguauugaagagaaguggcaagauuggucauucuugccuuguuccuagacuuagaggaaaaaauuuuuguuuuucaccaugaagugugaugcuaguugugggcuuuucauauauagcuauaauuaugucgagauaauuuuuuucuauuucuaguguuugagaguuuuuauuaugaaaggauguuuaauuuugucaagugcuuuuucugcaucuauugagaugaucauguguuuuuuuauucuguuaaugugguauaucacauuaauugauuuuuguguguugaaccauucuugauuaccaggaagaaauccuccuuggucaugaggugugauccuuuuaauaugaucuugaauuuggcuugcuaguauuuuguuaagaauuuuuguauuuauguucaucagggauauuggcccguaauuuuuuuuuguagugucuuuggcauagguaucaggguaauggcuggccucauaaaaugaguuuggaaguguuuucuccuccucaauuuuuuggaagacuuugagagucauugacauuaauucuuuaaauguuuuugguggcauucaccagugaggucaucugguucugggcuuuucuuuguugggagguuuuuuauaauugacucaaucucauuaguuauagauuuguucauauuuccuauuucuuuuucagucuuaguggguuguauauuucuuggaguuuauccauuucuucuagguuauccaguuugugggcauauaauuguucagaguagucucuuaugauccuuuguaugguaucaguuacaaugguaugcuguaauguguccucuuuuguuucugauuuuguucacuuaagucuuuuuuuuucuuacucuaacgacuugucaguuuuguaaaucuuuccccaaaaagcucuuaguuuuaauuuuuuucuauuuuuuuauucucuguuuucuuuauuuaugcucuaaucuuuauuauuucccuccuucuguaaacuuugggcuuaguccuuuuuuuuuuuucuuuuuugguagaucuuacagguauaaaguuaguuuauuugcuugcuuucuucuuuuuuuuuuuaauguagguguuuaucauuauaaaccauccucuuagaacugccuuugcuguaucccaucaguuuuguuauauuguguuuucauuuucauuugucucaaaaucauuuucuuuuugguuuuuuuuuccuugacccauaggcuguucaggaguauguuguuuaggagugugcuucagaauuucuguuuaguacuuuuuuacauuuucugugucuuuguugaaauucucacuuuguucguacauuguucugaccucuuugagugucuuuaugaugguuauuuugaauucucuuguuagauaaguaauauauuucucuuucauuagggucaguuucugaagauuuaucuucauccuuugguacauauuucucuguuuauuuuuuucacucuuauuguugauaucuacacauuaggaaaaaacagcaaccucuuagccuuuacagacugucuuuguacaggagaagaucuucaccagucagcacagcagagauucccagaaccucucaaaccuucaugcuaguccaaagugcugucuuuguucuuaguggugccuaggugucuaggguccugucugguccaucugguccauaugcuggguccuaucagugcuacaagacagaugagacagaagccagucccuuggacagcccucagaaauguuagaauguuggacacgugaucuaccucuuucccgagcccugccccaggagaagcugggcucuggaguuucucuccaacucauuucaugcugagcuucagggaguggucauggcaacugcuugugugcuuguucaaacuucugucacauuaucacuggccccuagauaucuagggcguuuuagauuccaucagugcuacaaggcuggcaagacagaagccaguuccuagggcagcucuuagaaaaguuggaauguuagauacacaagccaaguuuuuccuuccccaaggagugguggggagcugcagguguucuuaugaucauauggugcuguauuggggguacauaauugcucucgcagauuauggcaagagggugucuccagucuucuaccagguuugauguuguucauuucguacuugugcaggugcagaagcauugcaccuaguuucaggauuucucacaaagggaauucguauauuaucguugaaucaguguguucauguggggaaggaggguuuagggcguccuauucuuccaucuugcugaugucaaccuguuacuuauuuuuccuaaauuggaaaaauguaaauaaaauacucauuuuggaaacaaaauuaucugacuuuaguggcucuuugaacuggguuugagaaguacagacaaacucaacacucuuaucuuaacauuaaaguagauaucucaaguccccuuuuaauacuuuuagcuuggaauacuuucuagucuguagggauaauuaauuucuuuuucuauuucugcauaucaaauauugcuuuaaagauucccuucagcuguguuacuuagagauugaauagggaaauauuuugucuuuugauuaacaguuuuaggcuaaaaaaauuagauaaguaugccuuugguuuguguagcagacaaacuucauguuagauaauucgugaauuuguaguccauucaaauguuuaucuuccaguuuucagagggguuuuuuguuuguguuagaauucuuucaagucauuuuauauuuuuaugaauuauuugagaagaauacuuguuaaucucagccuguauuuuuauugugaaugugauuaccuauuauugaggggcauaguccucuggguguuucuaauucagcaucaaauaauuauuucuuuauagauacauauguuacauacauauuuuacacauaagcacacacacaucuugcauauauagauauguauuuauauguguauaaacaugaauaauauuuauguuuguuauauacauuuaucuuguauauuccuguuuauauacauauaaacauguauauccauaucugugcaguaguguauaaaguaccuugaauucuuuucaacuuagaauacucagaggucuuaaggaauuauauuucuuuaaauauugaauaagauuuacuugaauuuaaaauuuuuuauuuugcuaacauuuggaaaugcuuuaaugguauuuguuaagaaaugauguagcaugguuguugacuagcaugcaguguucuauuaauauauuugccuuuugggguuucacaauuacacuauuauaaaucuuuuugagaguacauuuuagucaguauaguauauauauuuuuucuuaguuuuaaucaaaaauaaaaucauugggaaauauaaccacuuguuuuccaguuacuuauuauagaaagaauaaguuaagaaaugugaauaaauugaacaaauuaauaaaauauuuguuaauaauccaccuuauggaggauuuaaaaauaauuuuaauuauaaaauaauguauuuuaauauaguucagaaauaaaaguguugcucccucuccacuaucagauaccucagguacauucuuaggguaguuaacagcuucuuaaauagcuucucagauauguucugugcauauacaaguauauacguaugaguauguauaugaguguaugauggaauuguacauacacaagaucuacauauauucuuuuaaaaaguacuaauguacuuuuauauuguacuuuuauaagguauuguguuuuauaagguauaugaauuaaauauauuguccauauacauugagaaaauuggguaaauugaugugcauaauaaacaugucaucucuuuauguuuauuugaaguuuuuuucugauuguucuaguggcauagaaguaaaguuucuuuaauacaguuuaauaacauuauauuuuaaaacuuuaugaaaacagaauuuuuaauuuguguaaaagauuuuacccuuaauacauguucuuaauauccaucauacugaaaauagugggcuaucuuugguuagcaggguuauugugaauguuguauaugggaagggcaggcauucuguuauuucaguacugugauaccauguuguuugaggugggucuuuuucuaagcaaugggcauguucuacuuuuauuaaagugaugauagaaaaugacuuuaaagcauguagugacauaaaguuguuaggagauauaacuaaugcuaaaugacgaguuaauggguacagcacaccaacauggcacauguauacguauguaacaaaccugcacguugugcacauguacccuaaaacuuaaaguauaauuauaauagaauuaaaaaaaaauaaaguaguaguuuuuaaaaaauccucaaaacugagcucauugugugguuuuacuaauuuugguuuuaggcuugugcagacauaagagccaguucaguguuuuggcagcaaauggaguucguugauagccugcauggccaacccaagaugccagaaugguuaucuacacacccuucucauggcaaucgaguugaguacuuggauagacuuauaccucaggugagcugacaccguagaaggcgggacauuauuuuuacuguaucauuuauuuuuaaugcugucacuucuuuugcuuaguaaaagagaguucuagccuauuaacuauuuugauuacuauaauuauggauuaucaguugucacagaauuugacugaaaagcaaaauucugcuuguccacaagucuuggagaauaaauuacuauguacaguugacuuuucuuaauagugaagguuuaacuccuuuaguaugagacuuuaauuuuaacugacuugaugaaaguuuaaaacucaaggcauauuaaguuuuuuaaacauguugaugauaauuuaaucuuuccuuggugauuuaagcuuuuuguuaaaaauaccaguuaaugaguuguacagaaguuuugggucaaguggauauuaauuguaguagugguacuggaauuuguuuuuuuaggaaaaaaaaucuucauguuuguuucugguuauuuauuucuuuaugaagauaagagugaagcauuugcucucuggcuuuucuuucuguagaauucauaagugggucaagcugaggcggcuuucugccaaguaguuuucaguauccucugaaaaucuuuugauuuguugacaucauucagaauguuuuuaugguuuccauaucaggacaaaauggauguuaggcaucucugagccacguuacacgcucucuucuaucucacuuguauuaaauuugguggcuuguuaugaaagcggaacauuuuuuagcaauuuaagaauugguacugggccaugugcuaaggcauagcacaacagauccagguguauuauagaaguaucuuucucaugccuguuaucccagcauuuugggaggcugagguggguggaucaccugaggucaggaguucgagaccagccuggccaacggggugaaacccugucucuacugaaaauacaaaauuaggcgggcgugguggcaugcgccuguaaucccagcuacucgggagauugaggcaggggaaucgcuugaacccuggaggcagaaguuguagugagccgagaucgugccacugcacucuagucagcgacagggugagacucugucucaaaaaaaaaaaagaaguaucuuucaguaugacuucaaauucagcccaacaaauacggaguaccucuuaaaagaaagaaaugaugcuagaugugggggauacaaagaggaauaagauaugguucuugauauuuacaggaugcuaagauaaauaaaaaaugauuauuaguacaaggauaugauuuaucauaagaaaaauaaaaacgguaugcaguuugaaggaagaugaaucugcuucuaguuugggauaagaaacucuagugcaagauuuauucauucauuagguagaucgauauuuauugauacuuauugauuaaucuacuauucuguguucuauugcuggggaaugagcaaggaacaaaacagucuguuuucuuggaguuaacauucuaguuagguaaugcaaauaagaaacaaacauauaguaugccaagcaauaauaaguaccuugggaaaaaauaaagcagauuaaagguauuagagaggggugggcagcagagaagggguacuagucuauguucgguugucaaggaaggccucacuaaucagaauccggaaggaagcacgggagcaaguccuuuagcuguguggagggagagagagccuuuuaggcugaggaagcagcugaugcagagaaccuaaagucagcguauguuugauguguucaaggaauagcaaggaagacauuggggcugaauggaguaagggaagggaagaacaguucaagaugaggugaaaggggaccagaccacgcaggaucuucuaagccauuguaaggacuugacuuucacuucaagugauaggagaagcuaguugaggauauugagcagaggagugacuugauuugacucauguuuuauugugaucacuggcauuauuguguggaguagacuaguggggcaacgguggagucagggagacuuuuuaggagacucucauaauccugguaggagaugaugguggcuuggaccaagauaucugguagcagaaaauggggaaagaaucagucagauucuggauauauuuugaaaggagugaugacaggauuuguugguaauuuaggcauacuucgugccuuuugugagcauugaggacagccaagcauggcuucuuaacaccuauuuuaguuuguucagguugcaauaauaaaaauaccauagacuggguggcuuauaaacaacagaaacuuacuucucacaguuuggaaggcugugaaaucuuagauccaauuuccaacagauuuggugucuggugagggcccacuucccagcucauaaacagccaucuucuccuuguaaccucacaugguagaaggggcaagggagcucucaaaagccucuuuuauaaaagggugcuaacccauucaugagggcuccacccuuaugacaaucgccucccaaaggcgcuuaccuccugauaccaucacauugggaguuggaauuucaacauauaaauuuugacaggacacagacauucacucuauaucagcagcuaucuuaacuagauuucauuuguauucuuaauuugaaaaaaaaauuugagaaagaaauagcagugaaauuuaccugauauaauauguaguaauuauuccucuuaaaaggguaguauaggcaugggacauuauguauuucuucaguaacugacuuguacugaggaucacugacuauaagaggguccuuugugcuauccaaggccccugggacuuuaucgcacccugggaggccugggccugucucuaaagcaaugauaacaauaugauuuucucuugaauuuuuuuucuuuuuauuuucgcucaaugaaauucuaaaaauaugugguuuguuuaauuggauaauaaauucuguuagccaacuuuucaugugaagacuccuaaauucugaguugucauuucaucaucaaauuacugagcaucuucggagagguaaaaacugugcuuuagagaugucuuuaaaauaauaaugaauugauuagugaguaggaagaaaaauggcuagagaaacaaauuuuauuugggagcaaaugaugaagacaaagacgugagacauuuuucuucuaaaaauaaacuauccuaguucagaaacuuaauuugaaaaccucauauaauuucuuauauuccccaccccaagugauuaaauucaauuugaaaguaauaaaacucuauugcaauauugggaauaacucagugguugaagugaaacugauaguacaaggguauauuguuaauuagaauauacagucauaacucaaagauuggaauucccuauuauuguagucuaauuucugacauauaaugaaagaaggcaguuucucaggcaguauauagaauuaugugagucuguauacuacuacuacauuuugaaauuauauuuuauguagcaugcucuagugaguauguuauguucuaccuaagguuccuguccuuugacaucucuagcaguauggugaaguuauguuccccucaaaggcaguugagaauacagcacuagagagcacagacaaauccaggccagagaugaagauuucagaguuucagagucaucuaaaaagaagugauaguugaagcaaugagaauggaugaguucacguaggaagugauuagagaaaaagaucaaaguaacaguauugcauauuuuccacauuuaaugggugggaggaagacagagccuguguuggaucagauucauaggaaaucaagaaagcaaauaggaaaccaagaaagcaggauucugugggucugugauuagaacacaaauuuugaucauuuugauuuuuaaacuuuagcuuauugaagauuguauauuuuuauuucuuauuggaucccuugcauaucaucacaaaaauguauuguuucuuacuguagcuuaucaacuuuuaaaauguuuuaaauuuacacuuuaugcauucaacaaguauuuaucagucaucuguuauaugccagguuguaggugaugugaaauaaauagacaaaaaucccuguccucaugaagcuuauucugcaguaaagggagacagauaauaaauuuggugcugggggcgggaguggggggcagugaggagggagaggcagcucucuuaugucucuuuuuauaaagcuacuaauccuauucgaucagggccccacccuucagaccucauuaaaccuuaguuaccuccuuuuaggccuuauuuccaaauacaguuacacuggagguugggacuucaaaauaugaauuuuagaggaacacaugaguccuuagcacacaguuaugugugagcagagaugggaggggugcaggaauagcaguguaaaaugggguccuucagcagucaaagaagguuucauugagaagcugacacuugaacacagauuugaaauaagugaaggaaccaggcuuguggcugucuuggggaagaguacaaggcuguggggcaggagcaacaagaagaaaaccaguguggguggaauggggugagcaagggaagggggagggcgugggccuuaucgccccuguaaggacuuuggcuuuuguucacagagaugggacaauaguggagggauuugagcagaggacuggaggagugacaaggucacuuauguuugaaaaugaugugaucuacagcuccugcaaaacaguaccauaauauaauuuuggaucauuuuagcauaauauauuguucagaaaauagaugaguuccuuucuugcuuuaagucaagauaacccaucacauuagaaaaaaaagcaaaccuuugcuuuuuuaaaugugaauuucaagauaaaacauguauaaauugccuaaauauaaucuugugauccauuagcauuuaaaaaggauaaauacagguuuguagcaauauuacuuguaguuaauaagcugauauguuauaauucuauuuacuugaaauaaucaguuaaacacauauuccacauauuuugguuaucauaacaacuugggugaaaaaaugaagagcagauguuguaucaauuuguugauguuuaauaguaugacaguuuuaaaauuauaguuacacuguucagacuuuauguauauuauaauuugucguugaaagagacaccuuauuuaacuuuuuucuaugaagauuguuauaaaauaugaauagaugugaauaagagaaaucugcuucaaagauuuauuuuaaaacugaaaacauuuagacugaauuucuuauucuccacuucacuuaccaacccuguuucucuccaccauccccucuuuguugggugaaggguauggagaaugauagaauguauaggaaaaauauuuaauuugaacuuacucauuguuuaugguuauguuuauagucauaauuugaauaggauauauuuuuaaauguuuuuagagcuuucaauacuggcuuuauucagaaacuuaaaaaaaucuuuaucaaauucacuucauucaauuuuuagauaucagaaucacuugguggcugcauucauauuaaucucauuuuauuuugaauccuuuauacuuucaggaagcuagggguuugaacucguguaaaucauucuuacacguuuauaauuggacaaaguaaaugaauaaaucauuaauauuauacaucucaugagcagaaaacaugaguguuuaacauugaagugaaaugucguuguuggccaguguacacaaacauacacuguucaccuuacagaauuucauuuugucugacauagagaguguugaggaaaaggcaaauaucauagcagcugcuguaauugaauuggcuucugaaucauauaaagccaggaagccugacaguaacauugucuaaacccuuaaaaaaaauauuauggugcaugugauguguaucuacuugaggcugaaaugaaugggcuauuagaaaaaauugcuuuugaggggaaaggggaaaguaaugauauuuuagaaaaacaugcuaaaaauagaggugauuuuuuucccucuugaaaugucuugcuuucuguuuucaaaggaagcuuuuaauccagucgugaagacucucuggcauuaauuuuuguccauuuuuuucuucuuuuuuuaaacuuacuuuuacuuuuugugaauaaguaguugauguuuuacuugauauguaauaccugucagaauacugauguguauuagcaguuguuucauaaauacuuuaguuguuacugggaauaaauauagccaguuuuuuuuucaauacaaguguuuauuuuuuauuuacuuuaacuaauuuuuaaaauuuuuuauauauuuauggaguccagcaugauguuucaauaucuguauacauuguguaaugguuaaaucaaaccaacuaagauauuaaucaccucacauacuuacuuuuuguggcaagaauguuuaaaaucuauucucuuagcaauuuucaaauauacaguacauuuuuauuaacuguaguaacaaugcuguguaguagaucuccagaagcuacuuuuccugacugaaaguuuauacuuuuuaauaucuaucuaucuaucuauuuaucuaucuaucuaucuaucuaucuaucuauagucuggcuuuguucccuaggcuggagugcagugguggaaucauaguucacugcagcuuugaaguccugggcuaaagcaauuuucccacuucagccuccagaguagcuaggacuauaggaauguaccacaaugccuggccuuuuuuuuuuuuuuuuuuuuuuuguagagauguggucuugcuguguugcccuggcuggcaaaacuucauacuuuuugaccaacaccuccugauuccuacuccccgauccccagccugugguaaucauuauucuacucacaauuucucugaguuggacuuuuuuagauuccauauauaagugagacuguauaguauuuuucuuucuguaccuggcuuauuucacuuagcauaauguccuccagauuuauccauacuguuacaaaugguaggauuuuaucauguucauauuuuaggaaugguugauuauaaaauguuuuuauagguuuguuugaaaaccuuuucuaauuauuuuaucauuccagaggauaauuguccuaugucaagguggccuuaauuuuuaauuuuuuguauuuacuuuaaauuauuuacgucaguuauuuauacuuauuuacuuuagaacacuucaaaaacuagucagaauccaauuuccauugcaguguuugugaaaggaaaugaaaugaauuaaagaauaauuuuuuuaaaagaugaaaucaugaaucauucaaauauaaaaugaacacaucucugagauuuuauuuaacucauuaaugagggaaacuguaauauguuacaacuaguucaaaagagaauucaagaaacauaguuauauaggcaagaaggaaugcugaaaugucuuagagauuuccuuuauagaguuuuuguucuguuaauaaguagccauauaggcauuauccuuguuguauuucuuuucugucuuuuaaaguaguuacccacuauucucucuaauuucuguuaaaucuauugcauagugagucuuuggauuagggccauugacaccuaacuccuuaggccuucuuaaaaguauaugcuugcuuuuagaaauuaagggagagaguuggaaauagaggugguaguaaagggacuaguuucauuuuccaggagaaauauuuaaaauuuaaaccucucaugagccauuuagaacuaaaaacaguuguaaaaucaagggugaaguuauaggaaugcaaaaaugguagaggagaauggaagacaauggaaaaaguuguuuuuuuuuuuuaacuuuuaguuuuaccauuauuauaaauguuuaaaauacaugucaagauagagaauaauuugaauagcuuaaugagccccuauuuuucacccacugauauugaacaguauaauccuuuuauacacuugcuucaucugucccaucucuguuuuucucagaaguauuuugauauaaagcccagauaucagggccuuauaggggaggagaaaauaauuuucucucuaugcuucauaguucuuaguugagaugaaccccuguauuaaaagacagauuaacaagagggaaauggaagcuuuuuaacauguauacuuccuguauaccugggagauacccauggaaugaauaauucuccaagagguggcuuugaguucagguguaaauaccaucuucaacugaaacuaagacagaaaggugcagggaaagccgccacguuguagagagguggucaggaaaagcagugagcaaggguaagguuuguuauguagauuguaccuucuuuguugauaagaguuuccagugauuuagagucauccuucucuuucugguacagagagggagacauacuugcaaauuagagauuuccuucguagauacauauuucucugagaaaacgguaacuucuucuuccuguuuucagaacuuccccuaugucugcuauugcccaaaauaauuaguagaaaauaacucuuaugcuaaagaggcauauuugggguggcauagucuggucuccuggagucuuauuuuggaaugauauguccugaacuccaucaacuuuaguaugcauuucagaaaguaguaucauuuucuuccauaaucauaacauuaucaugccuaaggaaacucauaguaauuccuuaaaauuaaauauucugucuacaucagauuucuguaucucagcaguguuacaguuggccuguuuaaauuaggauacuucaugauccacacauugcauuugguccuuacgucccuaaaguccuuuugacuuuaggacaguaccccccucccuuuuguuuuguuuguuuuaaaacuugucauugaauuggugaguacauauaaucccacauuguagauucuggauuaacuugauugcuucuucgugguauuucuaacuuguuucuauauauaccuguaaauagagauuaaauuuugggaaggauauuuuauaggugaugcaacuaagcuucauagugcuuugcauuggaagucucuuaauaccuggcugccccacaucuggugaugcugaaggccaucaguggguuggauggugauggccugguucuuuguuugcaaaggugguuuucuuccuuguggccagcaagugauuguggggugauaauuuagcaccacccugcaaauaaucaguuuucaaacaaccugagaaaugugucuucacgagaaaucuauguagaaucuauuuagaacucagaccagccaaauuaacccuaauggaauaaaagauguugcagacacuuuuaucuuauucaggaauagacuuaagagguagguaagagagacuuuuaaaaaaucagaacgguaaguguacaagaguuggaaaaacagaguugaaaggaaaaaugaggauaaucuuauuuaaaagauuauugaaugucuaagugccuuuaauaacuccacaaggacccucauguaaacaaaauucagcaauagcaacaaaacaaagccucugaaaugcucauuguuccccagugagauaagcuuuaaagagcagaaauacgaaaaacaaaaccaaaucucaagucaaacuuaaaaauguuacuuuaugggagaggacaggcaaggcggcaagaacauagaagcagugccaccugaagcuggcaugauaagguugauuuaacugcacugaaagugacagaaucugaaagaacgacuuuacaaauguaagauaaauccauuucagaaaauuguuaaacuugugaauucaacagagaagcuguaaaacuuucgguggaggcuguaaagagcagaauugauaccucagagcaaagacucauugaugcggaagauagaggaacauagcacaaccaaauuaaaaugcccaaagccaaaaaaaaaaagucuaaaaaaaugaaagaauauugaaaaggcaccaggaaauccaagcugcauauaacaaugggaaagauacauuuguacaugucuucauuucuuugauugugguuucuauaucauauuuuuuuauuuaguuaacauuucucaagauggguuuuuaggagauucccagaguaucauccaugggaagcccugaaaugacaagcuuagauauuuaaacuuaugaaguguuuaaucuucauugcaaagacaggcuuuuacaagcuaccuagguaaaaaggcauacaagaguaagaaugacucuggaccuuucuuuucauaagcauaaggaagauauuucuuuccuccuaaguucuuauacuucuugcuguuggaggaaguguaagaguuuuggaggaaagaaacaaaacaaaaaacaguggaacuaauacacuuugguaugauaucuacaaaaacuaacuuuuuuuuuuuuuaugguggaagauccuuagcaaaugaaacacauaggacaauaugucagugaaguucuugguugcaacagugcucuuuccagaaucuacugacaaucaggaauuagauaaaauauacaguuuuguuuguuuaaauauaauuguaacuagcuugcacccugccauuguuagaaaaccacagaucaaguaaggaacuaccaaaaaauucagcugaauaauaugaaaaauaaaauuuaaguggcaugagaaacuaaauccuaaaaaaaggaauguauuauuauuauuauuauacuuuaaguuuuaggguacaugugcacaacaugcagguguguuacauauauauacaugugccauguuggugugcugcacccauuaacucgucauuuaacauuagguauaucuccuaaugcuaucccucccuccuccucccaccccacaacagaccccugugugugauguuccccuuccuguguccauguguucucauuguucuguucccaccuaugagugagaaccugcaguguuuaguuuuuuguccuugcaauaguuugcugagaaugaugguuuccagcuuuauccaugucccuacaaaggacaugaacucauccuuuuuuauggcugcauaguauuccaugcuguauaugugccacauuuucuuaauccagucuaucauuguuggacguuuggguugguuccaagucuuugcuauugugaauagugcugcaauaaacauacgugugcaugugucuuuauagcagcaugauuuauaauccuuuagguauauacccaguaaugcgauggcugggucaaaugguauuucuaguucuagaucccugaggaaucgccacacugacuuccacaauguuugaacuaguuuacagucccaccaacaguguaaagguguuccuauuucuccacauccucuccagcaccuguaguuuccugacuuuuuaaugaucgccauucuaacuggugugagaugguaucucauugugguuuugauuugcauuucucugauggccagugaugaugagcauuuuuucaugugucuuuuggcugcauaaaugucuucuuuugagaagugucuguucauauccuucacccacuuuuugaugggguuguuuguuuuuuucuuguaaauuuguuugaguucauuguagauucuggauauuagcccuuugucaguugaguagauugcaaaaauuuucucccauucuguagguugccuguucacucugaugguaguuucuuuugcugugcagaagcucuuuaguuuaauuagaucccauuuaucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuaguauaagguguaaggaagggauccaguuucagcuuucuccauauggcuagccaguuuucccagcaccauuuauuaaagagggaauccuuuccccauuucuuauuuuugucagguuugucaaagaucagauaguuguagacauguggcauuauuucugagggcucuguucuguuccaauggucuauaucucuguuuugguaccaguaccaugcuguuuugguuacuguagccuuguaguauaguuugaagucagguagcaugaugccuccagcuuuguucuuuuugcuuaggauugacuuggcaaugagggcucuuuuuugguaccauaugaacuuuaaaguaguuuuuuccaauucugugaagaaagucauugguagcuugauggggauggcauugaaucuauaaauuaccuugggcaguauggccauuuucaccauauugauucuuccuacccaugagcauggaauguucuuccauuuguuuguauccucuuuuauuuccuugagcagugguuuguaguucuccuugaagagguccuucacaucccuuguaaguuggauuccuagcuauuuuauucucuuugaagcaauugugaaugggaguucacucaugauuuggcucucuguuugucuguuauugguguauaagaaugcuugugauuuuugcacauugauuuuguauccugagacuuugcugaaguugcuuaucagcuuaaggagauuuugggcugagacgaugggguuuucuagauauacaaucaugucaucugcaaacagggacaauuugacuugcucuuuuccuaauugaauacccuuuauuucuuucucuugccugauugcccuggccagaacuuccaacacuauguugaauaggaguggugagagagggcaucccugucuugugccaguuuucaaagggaaugcuuccaauuuuugcccauucaguaugauauuggcugugaguuugucauaaauagcucuuacuauuuugagauacgucccaucaauaccuaauuuauugagaguuuuuagcaugaagggcuguugaauuuugucaaaggccuuuucugcaucuauugagauaaucaugugguuuuucucguugguucuguuuauaugcuggauuacguuuauugauuugcguauguugaaccagccuugcaucccagggaugaagcccacuugaucaugguggauaagcuuuucgaugugcugcuggauuugguuugccaguauuuuauugaggauuuuugcauugauguucaucagggauauuggucuaaaauucucuuuuuuuguugugucucugccaggcuuugguaucaggaugaugcuggccucauaaaaugaguuagggaggauucucucuuuuucuguugauuggaauaguuucagaaggaaugguaccagcuccuucuuguaccucugguagaauucggcugugaauccaucugguccuggacuuuuuuugguugguaagcuauuaauuauugccccaauuucagauccuguuauuggucucuucagagauucaacuucuuccugguuuagucuugggagacuguauguguccaggaauuuauccauuucuuccagauuuucuaguuuauuuguguagagguguuuauaguauucucugaugguaguuuguauuucugugggaucgguggugauauccccuuuaucauuuuuuauugugucuauuugauucuucucucuuuuccuguuuauuagucuugcuaguggucuaucaauuuuguugaucuuuucaaaaaaccaacuccuggauucauugauuuuuugaaggguuuuuugugucucuauuuccuucaguucugcucugaucuuaguuauuuucuugccuucugcuagcuuuugaauguguuugcucuugcuucucuaguucuuuuaauugugauguuagggugucaauuuuagaucuuuccugcuuucuuuugugagcauuuagugcuauaaauuucccucuacacacugcuuugaaugugucucagagauucugguauguugugucuuuguucucguugguuucaaagaacaucuuuauuucugccuucauuucguuauguacccaguagucauucaggagcauguuguucaguugccaugugguugagugguuuugaguggguuucuuaauccugaguucuaguuugauugcacuguggucugagagacaguuuguuauacuuucuguucuuuuaauuugcugaggagugcuuuacuuccaacuauguggucaauuuuggaauaggugugguguggugcugaaaagaauguauauucuguugauuugggguggagaguucuguagaugucuauuagguccacuuggugcagagcugaguucaauuccuggauauccuuguuaacuuuuugucucauugaucugucuaauguuaacagugggguguuaaagucucccauuauuauugugugggagucuaagucacuuuguaggucucuaaggacuugcuuuaugaaucugggugcuccuguauugggugcauauauauuuaggauaguuagcucuucuuguugaauggaucccuuuaccauuauguaguggccuucuuugucucuuuugaucuuuguugguuuaaagucuguuuuaucagagacuaggauugcaaccccugccuuuuuuuguuuuccauuugcuugguagaucuuccuccauccuuuuauuuugaaccuaugugugucucugcacgugagauggguuuccugaauacagcacacugaugggucuugacucuuuauccaauuugccagucugugucuuuugauuggaacauuuagcccauuuacauuuaagguuaauauuguuaugugugaauuugauccugucauuaugauguuagcugguuauuuugcucgugaguugaugcaguuucuuccuagccuugauggucuuuacaauuuggcauguuuuugcugcggcugguaccgguuguuccuuuccauguuuagugcuuccuucaggagcucuuguagggcaggccugguggugacaaaaucucugagcauuugcuugucuguaaaguauuuuauuucuccuucacuuaugaagcuuaguuuggcuggauaugaaauucuggguugaaaauucuuuucuuuaaguauguugaagggccgggugcagugguucacgccuguaaucucagcacuuugggaggcugugguggguggaucacgaggucaggagauugagaccauccuggcuaacauggugaaaccccgucucuacuaaaaauacaaaaaaauuuagccgggcuugguagcgggugccuguagucccagcuacucggaaggcugaggcaggagaauggugugaacccaggaggcagagcuugcugugagccgagaucgcgccacugcacuccagccugggcgagagcgagaguccgucucaaaaaaaaaaaaaaaaaaaaaaaaaaaaaagaauguugacuauuggcccccacucucuucuggcuuguagaguuucugcugagagauccgcuguuagucugaugggcuucccuuuguggguaacccgaccuuucucucuagcugcccuuaacauuuuuuccuucauuucaacuuuggugaaucugacaauuaugugucuuggaguugcucuucucgaggaguaucuuuguggcauucucuguauuuccugaauuugaauguuggccugccuugcuagauuggggaaguucucuuggauaauauccugcagaguguuuuccaacuugguuccauucucccugucacuuucagguacaccaaucagauguagauuuggucuuuucacauagucccauauuucuuggaggcuuuguucauuucuuuuuauucuuuuuucucuaaccuucucuucuugcuucauuucauuaauuucaucuuccaucacugauaccuuuucuuccaguugaucgaaucggcuacugaggcuugugcauucgucacguaguucuugugccaugguuuucagcuccaucagguccuuuaaggacuucucugcauugguuauucuaguuagucauucgucuaaucuuuuuucaagauuuuuaacuucuuugccauggguucgaacuuccuccuuuagcucagaguaguuugaucgucugaagcauucuucucucaacucgucaaagucauucugcguccagcuuuguucuguugcuggugacgagcuguguuccuuuggaggaggagaggcacucugauuuuuagaauuuucaguuuuucugcucuguuuuuuccccaucuuuaugguuuuaucuaccuuuggucuuugaugauggugacguacagaugggguuuugguguggauguccuuucuguuuguuaguuuuccuucuaacagucaggacccucagcugcaggucuguuggaguuugcuggaggaccacuccagacccuguuugccuggauaucagcagcggaggcugcagaacagcggauauuggugaacagccaauguugcugccucaucauuccucuggaaguuuugucucagaggaguacccggcccugugaggugucagucugccccuacuggggggugccucccaguuaggcuacucaggggucagggacccacuugaggaggcagucugucuguucucagaucucaagcugcaugcugggagaaccacuacucucuucuaagcugucagacagggacauuuaagucugcagagguuucugcugccuuuuguuuggcuaugcccugcccccagagguggagucuacacaggcaggcaggccuccuugagcugcagugggcuccacccaguucgagcuucccagcugcuuuguuuaccuacucaagccucggcaauggcaggcaccccucccccagccucgcugccaccuugcaguuugaucucagacugcugugcuaguaaugagcgaggcucugugggcguaggacccuuugagccaggcgugggauauaaucuccuggugugccguuugcuaagaccgucggaaaauugcaguauuagggugggagugacccaauuuuccaggugccgucuguuaccccuuuccuuggcuaggaaagggaauucccugacccguugcacuucccgggugacacgaugccuugcccuacuucggcucacgcucggugcgcugcaccgacuguccugcacccacuggccaacaauccccagugagaugcacccaguaccucaguuggaaauggagaaaucguucgucuucugcgucgcugacgcugggagcuguagacuggagcuguuccuauuuggccaucuuggcuccagcaggaauauauuuucaaguacacaucuuucaugaaaauauugaucauaaaacuuggacaaaaauaucuguacauaauauaaaaauguuauguucucacugauaagugggagcuaagcuaugaggaugcaaaggcauaagacguauacaguggacuuugggggcucaggggaaacagugagaagugggugaggguaaaagacuacacacuggggcugggcgugguggcucacgccuguaaucccagcacuuuuggaggccgaggcaggagauaccugaggucgggaguucaagaccagccugaccaacauggagaaacccugucucuacuaaaaauacaaaaauuagcgagacaugguggcucaugccuguaaucccagcuacucaggaggcugacacaggagaauugcuugaaccugggaggcagagguugcagugaucugagaucgcgccauugcacuccagugugagcuacaagagugaaacucugucucaaaaaaaaagacuacacauuggguacaguguacacugcuugagugauggguguaccagaaucucagaagucaccauuuaagaacuuuuucacguaacugaacacugccuguuccccaaaaaccuauugaaauaauaaauaaauaaauaaaacaaaguuaugguuccaaucaucagaacauaguauaguaaaauuaauauaacaaaaauuaaaagauggauaaccacaugaaaauuaaaauuccgcacauguaaagcaaaagagaaaucuauaaacaauaagaggauggcuuguaaucaaugaacuuuauaaugauguaguuauauuuucaugaguuuuuacuaaaucuguauuuaaagaaaacuuuaucaguuuaaaugucuauauuagaaaaagagaaaagaaauauagaacuauaaaugucucaaauagggaaaauauaauuaauaaaauuaagcagaaauaagcaaaaugacaguaguugauucuuugggaaauuuagucaaagucauaaucauuagauuaguuagacaaaguaaaauguaaauaggaucaggagaagagguacgguaacaugcaagaaaacugaaauauuugggagaauguuauuuuuaguuagauaauguuaauuaauagcucaggucaaaaucagaaguaauuaaaguauauguguguugaggggggaggggaauugcuagaguggaugcagcuaggaguagaaauuauagcuagaaugaagcuucucaaauuacuaauuuacaaauuacaaauuacuaaauuacuuuagaaagaaguaagguauaaauaaaucaaauuuaaaaaacuauuagaacccauagagucauaauaaauuagcaaagaaaaggacgccuagcccugaugggauuuaauuuggagaauuuuuucagaaguucagagaacaauugccuaguuacuaauuaguucuaccuucaaaauguagaaagguauguuauuaaguuucugauucauuuuacaagcauaaaugauuuuguuuugacaauuugauaaaaacaauaacuuuaaaagaauuuauggacuggggucauuaauugacaauacgauauuauauuacaguaauuauuuacugugagcaaguuaauuauccucaaaugcaugagcagcaucauaaaagaaaagcuauuaaaacagaagaggaaauuuaggacucaucuucaguuccucuuuccuucacuucuguguccuauucaugaaaaaaucuugacugcuuuaacaaguacauuaagaaucugugggcuucucaacuucgccacugcuccuuuccuaguaaaagucaccaucaucuccucccaaguuaccgcagucauuuccuguugucacuuuucaccucacgaugucacguuucaccucaacuccuaacaaccuauuuucaauauguagccagagugaucauuguaauguccuuuccuugguuaaaacccucuaguggcuucucaucuaacuuagaauaaaaauccagacucuuccuaugucuuccaggcacguaauuuggccacugccuagcucuccaacuucaccacaugccccuuuccuuaggcuuuccuugguuuaggaaacauacaagaccaggguaugucccccauuaagcuaguguccuccuuacagcucuucuacuugcugauuucucugucugaaacauucuucccucaguucuuuaggcaaaugucacuguccuggggaggcuuucuuugaucccauaaucuuaaaucgcuucccuuccauguacucauuguccguccaacacaccucacucuuuaguuucuucauguacuuaacuaaaauuaccuuauuuguuuauuggcuuuuacccuaguguguaaggccuuuguacacugcuguauccauaguaccuaugagaaguugagaugauuagugaauauuaguuaaaugauugcaugauguguaauaauaggcaggauaagcaauauaauagugggugaaaaauagaaaaauuggcaguagaauugaacaguccuuccacucccuuauagaaauuuagcauguaggacauuaauaguugguaacgggagaaagauggucgcaggaaauaguaauauaaagauaacaguggucuuaggagucuucgguuuuaauucugacucagccauguaacuuggagaaaguuaccuaauccaaccuuuaguuuucuucauaugugaaaucaggauagcaauaucuccuagauguuggauguacauacuugugcauuucuguagguaagguccugcugucuucuuugccuugucccccucucuuuggcauagacauuuuaaugauaaguauuuuaugucaggcccaagauuucaaaagugguucaaauuccaaugucaauuuagauguguaaaauaccucacgcagugaaaggcacauagaaagugaacaguagauguuaguuucuuucacucauaguuguagucuuuaggcuggcuaauucuauauuuaacuucaaaucuuccucaggauucucagaaccauauauucuugcuauuaaaauacauuccugcuuuuucuuaaaccauaaacuccuaagaguauuuucucuaugacauuuaucauaaugauuuauucauagcugguguucuauaaauguuuguuuaaaauuuagcaugcguuuguuaagugccuguuaugugcagugcguggaguuaaacacagaaaacaaaguaaaggaaguggaaagacauauucuagcuauaugguaggaaaauuuugcucacuuuugaagagaugaagauauauuuaauaagauagauuagaauuuauaaaaauaaaaagacauuggcgcccugaaauauauaaaaugaauauggaaaggaaaggaaaaaagaaaaaauaaguuaccaagacauccaauagaaucuuacuaugcaaaguagaugaagauuugauagaaauauguauggucauaacaggauucugcuugauagauauuuggggaggagaaacaguucacacaugaagaaguagugauagaaaaccuguaugaagaacauauaguguuucuagcaauuaaagaaaccuagcucagacaucuccaaaguacauuuauucaguaaaaaauuuacucaagaaauaucaugugauacaaaaaagcaugagcacaaaaagcauguagagcaaaagcgguagaaacaaaacagguucuaaacccagcuuuuuuacuuccaggccagcuuuuuuuuuuuuuuuuuuuuuuuuuuuuaguaguagacucuuuuauuuuuagacucuaaagcuucaacuuuuaauugaguagaagguauagagauuucccuuauacaucuguccccgcauacucacagccucccauaccaucaaaaucccaugccagagugauaauauuaguuacaauugaugaaccuauguugacccaucauuaucacccaaaguccauuaggguuuacucuuggugcuguacauucagugcauuuugacaaauguauaaugacauguauccaccauuauagcaucaugcagaguaguuucacugccauaaaaauacacucugugccuacucauuccucccucccccuagccccuggcaaccacugaucuuuuuacugucuccauaguugugccuuuuccagaauaucauauaguuggaaucauguagccuuuucagauuggcuuuuuucucuuagcaauauacguuuaagguuccucauaucuuuucauggcuugauagcuaauuucuucuuagaucugaauaauauucuuuugucuggauaucccacaguuuauccauucaccuaucgaaggaaaucuugguuauuuccaaguuuuagcaaauaaagcuguuaaaaacauuuaccaagccagcuuuuuguuccuugcccggcauuuaacuucucugagacucaguuuccucaucuguaaaauugagcugauauuuucuaaggauucugagguuugaaauuauguaauuaucuauauaaaagucaugaaauguuaugugaauaacugugaauaacucaaguaugccuguauuacuggugacauuaaagguugauaaagccuuucugguagaaagcaguuugguccuauauaacaaaaaguauaaucuaccugugcuuacucuuugaucagaucauucuauuuuggguguuagacuucacauaucuccaaauggaggugagaaaagauuuuuuuaaagaaaaguuuuuauagcaggguaauuuauaaaagccaaauagacacaacugugggaacaauucuaaugcccaguaacggagaaauacaaaguaaauuacaugagggcagggaccaugacuauucugaccaauguguaccuagcaccuuacucacugugguguucuaaauauuuguuguauuaaaaagacugaauaagcgaauuuaaggauaagagaagaguuuuuacugaauacacaaagaucuuaggggauggcauccuauuccucucuuuguugcuuugcaucucucauugccacacucagcugugccaguuguuaccugcuggacuccauacucucccccuuuacugaugccagugcagugcuuaaacauaggcacuacacugauauagcagccaugacagguaaacuucucacuugggaaagaaaauuaacaucauuguaaaggaacuaaugcaagagugaccguacgucccaauuuugcagagacagucauggcucaugccugaugucucagugcaaaucuugcuagcaucucauuucauucucaaagguaucccaguuuggacaguaggucaccguuuagcugaggaucugacuuucuguuuacuuaagugcuguaagugcuauaguugggaaacauuuucuuguugugucaauucaguuuacuuaaacauuuacuuaacacucacuagauauaaggaaaucuuaaaucugcugugaaauacaaagaaaaauaagacaagaccacugccacugaagaauuucacguuaaguaauguuuuuucaacucuccagcuuaccuugguaacucagagccuaaucagagcuagaagugcuccuagacccaagcuucugcccugaccccauucacuuagagaacgucuaucuggcucgcaucugacuacaagucccucucuccugugggacucaaugaaauguuagcauacaagaaccugugccccuaccauaccccacucaggguaucuggaauaauggaauuccuugcccagauauguuugagccugcuuucagggcccaucuggaccucuuccuugaacacauucacacaaggcccuuuacagugccagauaagcuagggcugggagagggggcagauggcaggcuaguggcaagagcuacacaguaagcucccugcaaucuuacauguucugaaauucaagaauucuaguuuuguaccuggacuuccagguaauuucgaauguguauucuucaaaguaggagaauagaacagauuuuaaguaguaguguauuagcuugacuuacugcuuuuagguguuuagagacaugguaucugggccuccauuuucauucuuuccauggaccccacaaauauuagaggcaggcuguuuagaguaaaacuuaaaauccuuagcaugaccugugagguccuacauaaucugcuccugcccuccacccugcuccacucggcuguaccugcuucuucacuguuccaaaacaccccaggcacgcucccaucucccuuguacucgcagcucccucuuggaaugauuuuucccuagguugccacauggucucuuuccucauguccuucaggucugucccccucuugacccccaaagucauuauccuaucagugaggccuugccuggauagucuuucuaagauuuuaccagucccucaaacacugucuccuuuacugccuuauuuacuucccuuaagacacaucaguaucagaaagccagaagucguaaaaaacugaauuagcuuuuuccccuaaaugucuuucuuuuaaaacuccuaaauauuaagaccauuuauccuuaaaaauuauuuuggcucuuauaucuuaaaauuauccauauacccacuuugaagaguuaaauaguucuaaggcuaguuacuuaaaucagcagccagucccucaacccugccaucaguuucagggguaacuauuuccaauucuauuggacgauucuuuuaguauuucccauugugucuaaauaacaugcuuauguugcuacauucuaacuucaauuuugggccuuaauuauuuuccaccuuacaggaugagacguaagcccucucuuuccagugucacacccugugcaugugcacacacaugcagcucuccccuucucaguaugaugaaauuguacuuuuugguuucaucaagauuugguauuuuaaacuguaagcacuagucauagcugagccccauaguacacugugauuacuuuuccuuccuuugcaauguuuuauuucuccuggaguuaaaaauugucaugauuuugauuuguuuacuuuucuaaguauauuaguccauucucaugcugcuaaugaaacauaccugagacuagguaauuuaugaaggaaagagguuuaauugacuuacaguuccauauggcugaggauggccucacaaucaugguggaaggcgaaugaggagaaaagucaugucuuacauggcggcagucaagagagcauaugcagggggaacugcccuuuauaaaaccaucagaucucgugagacuuaaucacuaucaugagaacagcacgggaaacacccaccuccaugauucaguuaccucccaugacaugugggaauuaugggaacugcaauucaagaugagauuuggguggagacauaugcaaaccauaucacuagguuauuaucaucaauuuuacccaagacuguaucaguuauguauaucuuuuuucaguauauucagucaucuauguucugcaguuuuucuugaaaaaaaucucucauagagccuuuuuaaaucugaaugauucuccggucugcuagaguuuaacugaaaccauagauguaucucuaagauuuguuuacccucaaaacagcauuagggcaguuguuacagauuauuaauacuauuguuguuguuuuuaaaauaauacuauuugaccaaaucaugaaaacaacuguucacuguagauuuuucagugguucucuuuuauguguuauaaucaagauaccuuuuauuaaaaaaauaacaauacauucuuuguuuuacauggagcauauuagggauuacugaaacaaucugaauacauugauguauauauauaguauuuuuuuauuuuauuauuucuuuauaggcucucaaaauuagagagauguguaauuguccaccacugucuaauccagacccucgauuacuauucaaacucagcacgaagcauuuucuugaagaaucagagaaagaagaccuaaauaucacgaagaaacagaaaauggauacucuuccuauucaaaaacaggagcaaauaccauuaacauacauaguugagaaaagaacgggcaguugaauuaaaauuuaugagacacaagauauaugaagaauguugcaguccuuaucauuuuauguuacuuuuuaaaaaaugauguuugaagugaaaaaaaaaaggauauucagggucaaaucauguacauuacagauauuaucuaaauucuucuagaauuuauuuuucaugaaauauugauguauuuuaaucuauguuaaaauaucuucaaugaggaaaaugucacagaauaaauuuauauuacacauuuuacucugucuucuacuugcuuuugauuuagaaggcagaccccuaguggaugagaaaugagcccauacgguaguuuuuauaguagagaauguuucaacugagccuaaacuggauuucuaagucugggucguuaugaugaagggggaaacagucugaagguaucuguuugcaggaaauaguuugcauuggggugggauuauguggaaaagggggccucaggauagagaauuuccuugucuucaccuguggaugacuggagaaaaugcuacuggcagaagccauuuucauagggaggcaaaagaaguacaguuugugguucagaugacaaagcaagaaacagaauugggggagagggcauuuccacagagauacagcguguuccuggugcacugaaaucuuaacagaaguuuaugucauuugguugcuccaugagauuaccauuugggaaucucggguucccagagaagaaaaagaggcaaaggcaaggcacugucccucaaaagaggcugaggcaaggcacuguccccaaguugaccuuccugagcagcagauaucaacaagacgacuggaggaaaacgacaagagaagcagcacaagacauacccccaguggugcccagaaauugcugcauuauauaaauguggaaauacgaguuauuuaauauuuguauucccaaacuagugaagucuagugaugcuuagguuauauuucuaagaagggcauuuuucuugaaauacauuauauuaaauaaauauuuucuuagagaauuaaagaggaaagggacuacuuuguauugugaaucuacuaugaacugggcccuauauuuaucuuuauuccauaacccuacuagguuuuauuauucucacuuuacaaugacaaauaggcuucgagaaguuacauaauauauccaauaucucucaccuagauagaacaaagcugagucuaucugacuacaaaucuguccauuuuuuuacaacucucagauaucuaagacuaagcuaucaagacaaggaacaaaguauucucaguuguucauuagcuuccccacauauggcuucaauauaaguaaaaaucucaucauuaugaaaucagggaccacuuguguuuucuguagguugauuuuauagguucuucucucagacccuucuaucaaaauugacaugaaaagcauagaugaggcaguguaggagaguagaaccucucccccugccugugaaagccugugaaaucucauuugggauguguccugacauuauuaaaucuucuuggacaaaauaucuaguuguuaagaagauaaguucagaggcuguuuauguuucucagggauuauuauacauuacuuguaaggaauuuccugaucugcacacgagacaacauuggucaugaagagguucauauuaacuauucuccauauaaucauuuuuuacacuccuugugauuggaguauuguaaaaggcacuccauaacauauaaagacacuuggagaaugucaccuaaagguaaacaguaaaacacagcauuagauuuuccugcagauuuccuaggaaaauaauguagcaacggccuacuuuuucuuccauucccauugucacuucuaauuguguuguucauacuugcuagaaacauauauaaguugacaccaugucagaaagagcagagauaauaucuuuauaguauaugaaaaagauuuuuuuuaaccaguggaauuaaauguaaaagaaauguuacaguucagcucaaugcuuuagaagaaauuaaauagcaguugaaauacaagauguauauauauacuuuaaauuuuauauggaaauaagcuguauguucuacacuuaguugcagaacuacuuuguuccugucaauacuuuucaugugccuauaggauuuagaugauaggcugguuaacuuaguuguuaggagcaugaugcuaauaaauccaaggcacaaacucaacccgaucuuuucuauaauucagauagggugagacuauccucuaaaacuaaaggacaguguguauauuuacugcuauauacuuauaaugcuuugcacauuauaggcauucaauuaacauugacacuguacaauaauuaucuguucaaaggauugaaaaaaaggagaaacaaucauacucuguaaaaucugcuucuguaguuguggaacccuggacaagucaugcaaacucucuaacccucauuucuuaauuguaaaauggggacaaaaaaaauccuccuagguugaccaaugaccaagugaaaugauauacuuaaagcauuuaacacaaagucuagagcugcaaauguaauaaaaauuguuaccauauacugaaugcauacuuuguacuauuaguccauuuucacacugcuauaaagacauacccgagacuagguaauuuauaaagaaaagggauuuaauugacucacaguucuacauggcuggggaggcuucaggaaucucacaaucauggcggaaggguaagaggcaugucucacgugguggcaggcaagagagagugaguaagagcagggaaaacugccccauaaaaccaucagauauggugagaagucacucacuaucaggagaacagcauggaggaaacugcccccaugauucaaucacuuaccuuucuugucacauggggauuacaauuugaaaugagauuuggguggggacacagagucaaaccauaucauuuauguguggugcuaagcauuuuucaagcacuguugaaccccacagugacccuauuuaugguaggcauucuauucuacuaugcccuauuauagaucacggaacugaaguuuagagggguaauggaaguuacucaaggguacaugguguauuucuuaagguuuuuuuacuuguaagaacagaggaaccaacacaaacccaaccaagaaaauucguugccucaaacugacagaaaagcccagcagugugcugcuucaggcacaguuuaauccaggggaucaugauauuaucagagcaagggcucuuuuuucuuugcagucuuucucaccuguucccuggugauauccagaugguugccaguagcucccaggguugcaugcuuucacauccagcuggaugugugacugacucacaccacaacuauugaaacaaagccuuuaacacucuaacugcacccuugaagcaaucaccauggcaggggauggcauuaucuugauuggcuuggaccuaucaggauccaacauucaagcugaugauggguaugagucaacaccacccaaacagaauggcuacugcguguuaggagagaugcaaccacggggcuuacgaaguaaguggcagaacuagaauuaaaaccuaauguuuauccuuucagcaggcaaauaaacaagaugauuccuugacaauuuuaucugaaaugacauuuaaucugauaaaaaaguagcuuaaauuuuauauugauaugauagcaaauuuucauuagcauauuugcuuuagcguuuacaagguuuuuuuguuuuguuuugucuuguuuuguacugaauuauauccucaaaaccagccuaugagauuggaaggacaaauggcaucauuuacucguaggggagaaaacuaaagcuuggagaauuaggcaagugguccaaguaugcauucaaguaaauggcugaacugggauuggaacuaaagaauucacugauuuguaauccaguguucuuuuggcaauacugcagucuuuggaaagggagcuguuaccuccacuuaccuggagaccgaagcucaaaaauauuagucaauguguguccagcaguacucaacucucaaugacagaacugguucaaacccucccaucuucugacuccaaaguccguccucuuccuccauguacugccacuuacgugaacaaaucucauauaggaagugaggaugaaaaauguccauuucccuucacccuucacuugugaacagcagggccaacaccuuuucccugauuuaaaagcacccauuuuaauagucuaugacagaugguaaaaauauccauuuuaagcguauguauacaugugagggaugaaauuucuguuaaucaccucauaacauguuuuugugagagccuagagaauucuuuaaucuguagugagaugagauaaaucucccacuucauuacugggaagaaaacucugucaguguucuacccaucuacacuuugcccccuaacuuccaucagaaaaguuaggccaguggcucgcucccagccucugaaucacccagaccuccuuuuacauuaacuggcucugcgugcaagggguuuuacaccacuaaguucugucuugaaggguuggugugucuagacucaugcccagguguucucaccacacuagcuguuuaggagacugcagagcauggggcauaagucacagugcagcucuguuuccaggucuuaggaugucucugauaucaucaaagaccaagcagggccuuugaucaucacgugaucucugguguuaucaaaguuccagccaaaagaaaaaaaaaauuauuuuaauuaguuugaguaccuaauuaugugagagaaaauauaaaauuuuuaguuaagcucuuugaaauauuaaacauagcugacagguuccuaauaccaucuucauagaccacaagaggcccgggaccuuguccugggcagcauuggucuaaaaucagauuuguuuuuuucuuccuucagaauauuaaaguuaacuuguuaauuuugaccaauauauuaaaguauaaucauauuuucauagguuagaaaugguggauguucuacuuaaggauucuguuauucuauacuuaagguuguauuuuuuuaaguaacuauugcuuuugcacagaaauauugaguuuaguuuuuuccaaauuauuccuuucugauguuaugguagccuugaaaguauuaagggcaacaucacuagucucauuuauuuauuugggaaaauaggauaguaauauuugcccugcccaauucccagaauuauuauggguuuaaauauaguaacguguauaugcuuuacugaacaucccaagugcugcauugugcugauucuuguuaauauauucuaacaugucuucaucugggcugugagauuauuaguuaagagaggucacuuccaaaaguuuggcucugaucugcuacagcucagaagugaugaugaugucuuccuaccugagugugagaagaaaggaaacuuuuauuuguggcacguuuuguuuuagucugauucguguguguguguguguguguguguguguuuaauuaaccuaauucagccaggcacaguggcucauuccuguaaucccaacacuuugggaggcugaggcagguagaucacuugaggucaggaguuucagaccagccuggccaacauggugaaaccuugucucuacuaaaaauacaaaaauuagccagaugugguugugguggcaggugccuguaauuccaguuacucgggaggcugagacaggaguaucgcuugagcccaggaggcagagguuacagugagccgagaucgugccacugcacuccagccugagugacagagcaagacucaguuucaauacuacuacuacuaauaauuaaucuaauucuauuaauccauuacggcucuugucuggagagugcuccugauuuccaucaauuucuacauucuaauguuuaaaucuggagaaauaaggccagucuuuuccuggaaucaccaauccauucgccagaugaugggcugggaaaaugggaauuaguauuuguugagcccuauuaaggcaagauucuacaaccuuccucuccuuuuaaucuucacagcaaccccgugaggcauguuuuauucuccuaauuuacagauaagaaaaugaggguucacaggacuguguaacuuuaccgaggucacacaguaauccaggaguuuagcuaggucugugagacucaaaggcuuucacugucuuuaauaugcuucccuucacacacaagaagugagaacaauuggcagggcaacgagggaaacaauuauuugggaucuuugcuuuguuugaaugccuagagcauuucuccugcuccauagucccugaaacuuuccaugaucucaucgcucaacaccagcucccuuugcaaugagccaaucagcuaacuaaaagguauucaugaaaaaggcccagcagccucaggaacauacaguugacccuuggcaacacaggaguuaggguacuuuuuggacccuaacagguacccaaagucacaugggccaccagcuuugaccugagcuuaucacaaugaaccaacuccuucucucaggggaacaauuagguuggugcaaaaguaguugcuuuuuuuuuuucauuacuuuuaaauggcaaauuuuaaaaggcaauuacuuuugcacaaaccuauaguuuaggaaaccacugaggauucaaggucagaagaucugaguucacauccugccuuccuuaccagcugugagauccagcaaguaacuaagccucucgaaagcucaguuuauccucaccuguauguuguggccauguaaagagcucuauuacugcaccuaucccauugugcugcaagcuggcuauuggccugaaagcuccuugagggcaggagcucuggcauccucaucuuuuucauccacacuccacaggaaugcuugaugcuuuauuggugauuccuaggcucuggauugggaaugacccuaauagccaccaugaaguagaaguuugacucggaaaucaaaguccaggcauaaagugauauuuacgugcaugugacagcuuguccgggaagagaaguuuauugaacagccagaacagauugcagaguuaacgcucaacagcuucauccagaacacagaaaucugucggaguugaaaugugaaggaaacgcaggcuaggaagacacaccagucuugggaagugugcuuggcggugcucagacuuucucugcagagcguucuugggucagacuguucuggagauggggucauuagggcuugguaagaucaagucccuaacaauaagagcaguaacaagagcaauaauaauggcuagcauucauuauugagaccucuuacaaaccaggcucugaaauacaugcaguagcuugcuugacucccucaacaauucuaugaggcagauaaaauugucccauguuauuuauuuauuuauuuauuuauuuauuuauuuauuuauuuauuuuuuugagacggagucuugcucugucgcccaggcuggagugcaguggcacaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucgugauccacccgccucggccucccaaagugcugggauuacaggcgugagccaccgcgcccggcccccauguuauuuaugaaugaggaaauugagcccagagagucugagugacuugacucagaccucccagguaagacuuaccuuggccuugcaagcucuugggucucagaugaaaugcuauuuggaagcauuaagcauugggagguuggcucuggcugguuggaugguuuguaaagcaugacaauacaguguggugcggggaaaugucguuuaaauuacuuuguuuuccugggaccacuuccucucuuaacaaaucuucuauaacaccugcccauagaacacccugagaaggcaguggguuuauuccuuuaggggccuggcacauggugaguggccacugcuggcugcuccucuuucccucucgcuuugugguguaugcuccaccuacuuccacacgugauuuauaaaggaaaauuuuggagccaaagccugagagcaggaucucuucuuuccaggacuccauuuauuuaagagauucuuuuguaaggcagagaacuucaagagacaaguguaagaagggguuuucaucggucuuuuguuuucuacucaagauagcuuuaaguaauaaccagccauuacccaccuuggauuuucuguccucuacuggugaggucucuuucuuugaacuauuucaaaugucccagcagagcuggggaggcccccuccccacagccccacugacuuaagaagaacagauagagcacccauggucaagcucaggggccacaauuugucacugacucacuugaagggaaccgcuucucccucuuuuacccacgauguugaaaagagguugauucaggcuguuucuaagcaagacuuaugaaaagugcuaaugacaaaaauaaaacaaaauaaaaacuauaaaguuauaucaggaccaaauauaccaaggacaaggggaggccacaucucagauaaaaugaaauagugaagacagaugaggaagaacuauuuuacuccuauucaggacugaggcuaacagucacaccuccauaggguacauucccuagaguaacaugugaguagcacuccaugggauuagacaauaagauagcccuaccuagggugucuuuuucuuccaaggagcaugacuaucaagguagggcauaauugaaggugaacagaaguccuaagugggaaaagagaugaucagagggacccugguuacuuuuuaugaaaguuuaucauuauaguaggcaauaguaauaguuaacauuuaugaagcagaagguguugggaacucuacuaaacacuuugcauauauuauccaauuuugcacucacuauaaugcuguuguugcccagcuguauuagucuguucuugaauugcuaaaauaaauaccugagacuaauuucuaaagaaaacagauuuaauuggcuuaugguucugcaggcuguacaggaagcaugguggcaucagcuucugggaaggccucagggaacuuaaaaucauggcagaagugcaaaggggagcaaagcaccucagauggcaggagcaggagggguggggaggugcuacacacuuuuaaaacaaccagaucuugugauaacucacucacuaucacgagaacagcacagaggggauagugcuaaaccacucaucagaaccugccccaugauccaaucaccucucacugggccccaccuccaaaaaggggauuggggauuacauacaauucgacaugagauuuggauggggacacagauccaaaccauaucaccagccaauagccacuuuuccucuucuuuuucugcaaaccuucauuuuguuuagguggcaguauucccugcccgagacaucaugaaugucuaagucaauuauguaaugcuguucaccuaagccagggccaggucuaggaacagguguguaacuagaucugaugaaaaagaaagagaacaaagucaaguacuuuccaag

SEQ ID NO: 14040 - RNA, 1752 nt, Homo sapiens
aaugcuucgguuacccacagucuuucgccagaugagaccaguguccaggguacuggcuccucaucucacucgagcuuaugccaaagauguaaaauuuggugcagaugcccgagccuuaaugcuucaagguguagguagaccuuuuagccgaugcuguggccguuacaauggagccaaagggaagaacagugauuauugagcagagcuggggaagucccaacguaacaaaagauggugugacuguugcaaagucaauugacuugaaggauaaauauaaaaacauuggagcuaaacuuguucaagauguugccaauaacacaaaugaagaaucuggggauggcacuaccacugcuacuguacuggcaggcucuauagccaaggaaggcuuccagaagauuagcaaaggugcuaauccaguggaaaucaggagaggugugauguuagcuguugaugcuguaauugcugaacuuaaaaagcagucuaaaccugugaccaccccugaagaaauugcacagguugcuaugauuucugcaaauggagacaaagaaauuggcaauaucaucucugaugcaaugaaaaagguuggaagaaagggugucaucacaguaaaggauggaaaaacacugaaugaugaauuagaaauuauugaaggcaugaaguuugauugaggguauauuucuccauacuuuauuaauacaucaaaaggucagaaaugugaauuccaggaugccuauguucuguugagugaaaagaaaauuucuaguguccaguccauuguaccugcucuugaaauugccaaugcucaccauaagccuuuggugauaaucgcugaagauguugauggagaagcucuaaguacacucaucuugaauaggcuaaagguuggucuucagguuguggcagucaaggcuccaggguuuggugacaauagaaagaaccaacuuaaagauauggcuauugcuacugguggugcaguguuuggagaagagggguugacccugaaucuugaagauguucagccucaugacuuaggaaaaguuggagaggucauugugaccaaagacgaugccaugcucuuaaaaggaaaaggugacaaggcucaacuugaaaaacguauucaagaaaucauugggcaguuagaugucacaacuagugaauaugaaaaggaaaaacugaaugaauggcuggcaaaacuuucagauggaguaguugugcugaaguuuggugggacaagugauguugaagugaaugaaaagaaagacagaguuacagaugcccuuaaugcuacaagagcugcuguugaaggaggcauuguuuugggaggggguuuugcccuccuucgaugcauuccagccuuggacucauugacuccagcuaaugaagaucaaaaaauugguauggaaauuauuaaaagaacacucaaaauuccagcaaugaccacugcuacgaaugcagguguugaaggaucuuugauaguugagaaaauuaugcaaaauuccucagaaguugguuaugaugcuaugguuggagauuuuaugaauaugguagaaaaaggaauuauugacccaacaaagcuugugagaacugcuuuauuggaugcugcugguguggccucucuguuaacuacagcagaaguuguagucacagaaauuccuaaagaagagaaggacccuggaaugggugcaauggguggaaugggaggugguaugggagguggcauguucuaacuccuagacuagugcuuuaccuuua

SEQ ID NO: 14041 - RNA, 25573 nt, Homo sapiens
gagaggcgggagaggaggagccccuagggcgccggccugccuuccagcccaguuaggauuugggaguuuuuucuucccucugcgcguaaucugacgcuguuuggggagggcgaggccgaaaccugauccuccaguccggggguuccguuaauguuuaaucagauaggaucguccgauggggcucugguggcgugaucugcgcgccccaggcgucaagcacccacacccuagaagguuuccgcagcgacgucgaggcgcucaugguugcaggcgggcgccgccguucaguucagggucugagccuggaggagugagccaggcagugagacuggcucgggcgggccgggacgcgucguugcagcagcggcucccagcucccagccaggauuccgcgcgccccuucacgcgcccugcuccugaacuucagcuccugcacaguccuccccaccgcaaggcucaaggcgccgccggcguggaccgcgcacggccucuaggucuccucgccaggacagcaaccucuccccuggcccucaugggcaccgucagcuccaggcgguccugguggccgcugccacugcugcugcugcugcugcugcuccugggucccgcgggcgcccgugcgcaggaggacgaggacggcgacuacgaggagcuggugcuagccuugcguuccgaggaggacggccuggccgaagcacccgagcacggaaccacagccaccuuccaccgcugcgccaaggugcggguguagggaugggaggccggggcgaacccgcagccgggacggugcggugcuguuuccucucgggccucaguuuccccccauguaagagaggaaguggagugcaggucgccgagggcucuucgcuuggcacgaucuuggggacugcaggcaaggcggcgggggaggacggguaguggggagcacgguggagagcggggacggccggcucuuuggggacuugcuggggcgugcggcugcgcuauucagugggaagguucgcgggguugggagacccggaggccgaggaagggcgagcagagcacugccaggauauccugcccagauuucccaguuucugccucgccgcggcacaggugggugaaggagugaaugccuggaacguacugggaacugcaccaggcacagagaaagcgggcuugccauuauaguggguuccgauuugguuuggaaaacaugggcagcggaggguggagggccuggagagaaggcccuacccgagacaggggcggggugggaaggacggcagaugcugggagcacgaggcaauuucuuuaugacacagaacucaugcucuaguauuccaucuguuucagccgaagaaaagaaccagcugaaggggcaggggagaaggggcggagguauucucgaggcccauuggcguccuuuaggacucaggcagggaagggcccuuggugcucuggagccggagguggugcgccugguacugggaccccggagcugagcccggcgccucagcccaccuggcugucugccgaccgugugcggggcgaguuugcucaacaacucugccagcuucuggcccucaggcugugggaagcuucuucccggggcgagaccacuagcuuuuucuaaguauuaccagcccaggacuuggcugagguucugugucccccagcuuggagucagaugugggguugaaucuuggcuuccucucacuagcuguggugcuugacaagucacuuauccuugagccuccauugccuaaucuuuaaaagggaggugacaaucgucccuacggcucaguggcagcagauggggagaugaagggaaaguucuguugaccaugagugaacuuacaaugcaagccccggggggaucacuugcaguuuugucccugucugcagugugaccuguuggugacauugucuuugcuccaaaccacagcuccuggggcagaggggaaaauucugccacucacagcugccugcccacgcuucugucugagugugcuggguggcaggauggcaaguccuuacucagcucaguauagcccucuuccuuguucccugagccuuugacuuucucgagggauguugugggguuguggccaggauaagaaagggcauuucaaguuaccacugcuccaaaacaacuguucuggaaauagugaguaccccauccugagaggugaguaagcagaggcuguaugaccaccugaaccaagcccuugaggauguuucuucucugguggaaguuuggaacaggagccuccucaaguucauuuauucauucauucaaugguuauuuugugggaaucgaauuuagaaugaaaauauuuuuuggcaagcagaaaauaauuuuuagaccaauccuuuucuuuuagucaugagaaacugaggcccagagagaggaggucaccccaggugcauuagaacuggguuuccagaacugacacuccacugcacagaguacucucccaauucauucaauuuuuauuuagcggaaggcauuuucagaugggucuuugaagcauuaguaggaguucagcgaugauggugucaugagaauuuuauucuaggauuaggagguaccaugaacaaagauacagagcugggaaaaccagagguggaagauaaggagcacauguccacaguucuuuuucuuuuuuuuuugagauggaguuucgcucuuguugcccaggcuggagugcaauggugcagucucagcucacugcaacaucugucucccggguucaagugguucuccugccucagccucccaagaagcugggauuacagguaccugccaccacgcccggcuaauuuuuguauuuuuaguagagaagggguuucaccacguuggccaggcuagucgcaaacuccugaccuccucaguggauccgaggaggugauccucccgccucagccucccaaagugcucgaauuacaggugugagccaccacgccuggccuccacaguucuuuauccaccgucugaaauguaaaauguuacgaaaaccaaaaguuuuuuuugugauuuauuugaugguagcaccugacgugaacugacaugagauuauuuuuaauuuaguugugugaauaugcauauucauauauuuugcugcauagauuacaguaugcagcuccagauucuuccaagcagacucugauugcccauuacugccuuucuaaaauccaaacaaguucugagguucaaaaccguuuuggcccuaaggcuuuggguaaaggggguggacucuguucuacucugacuggaguccaagaugcauauauacagagauaugggugauggggcugcaagguagguugagguaggggccaaggaggagcauggaguuuggacuugauucaugaggcuguggggagccagugaagguucuuaagcagguaugucugccugagagcaguuggagcagacaagagcuaaaaaccaaacaaaucaccauagauaguggcugcuauaauuuguuuguccccuccaaaucucauguggaaauuugguccucaguguuggaaguggggccuaaugggagguguuugggucaugggggaggaaccccugugaaaggcuuggugccguccuugugauaaugaguaaguucucccgcuaugauuucccuugaaggcugauuauuaaaaagagcuuggcaccucccucucuucucucuugcuucuucucuugccaugugauugaucucugcacauguaggcuccccuucaccuucugccaucagugaaagcagcuuaaggcccucaccagaagcagaugcuggugccaugcuuccuggagagcuugcagaaucaugagcugaauaaaucccuuuuccuuguaaauuacucaccuucagguauuccuuuauauagcaacacaaaaggacuaagacaguggccuugacuuuucucucucuuuaagaaguguugccuuugcucacuuagucaucccuucugccugcauuuguagagcaucuggaugggagauuuauauaaccgucacucuugacuuucccagcaggccuaugucauagguacuguggucucuacaauacagcagagguaucugaggcuccgagagguugagugacuugcucauggcugcacaaccaguaaauauuggagcuggaauucagguccacgguuuccuggcuccaaagcccaugauuuuuucccucaauuuauucugacuggggcaugggggaggggguggccuuugggcagggccaccaggagcgaccaggcccguagagagcugggugcagguacagaggaaaaccuguugucgaguguggcccguaguucccauuuuugccugaauggcacauuugaaaguguuauauaaccaugugaauaauaauaguuggccuauaugaguucuuuaauuugcuuuuugguccgcauuugguaacuucuuuaucaucuacuauacucuguugugucucuuuuguuguaauuuguaaguaggggugagauaaaguacaccuaggguuugcuggguuucuuccaugucaucauguuccuccuugcauggggccaggauccguggagguugccuggcaccuacgugguggugcugaaggaggagacccaccucucgcagucagagcgcacugcccgccgccugcaggcccaggcugcccgccggggauaccucaccaagauccugcaugucuuccauggccuucuuccuggcuuccuggugaagaugaguggcgaccugcuggagcuggugagccacccuuuuugggaauggcacuuccugauagggcugggccacugcauauacacuggggacugugcuuaguaggcccauugcugaaaaucagaaggggacagcaaguauguauugagcacuuaucggguaccaagcacaguaacuacuggcuuucuguauagaauucccuuuaagccuggccaugccccagugguacgucuaucuucauuugaaagacgaggagacugaaguucagaggggaccacacagacagcuagggguagagccuggaucaaacccauuggucugccugccagccauucuugugccaaugcaucugcugccuacggaaaccuguagggacaaggcccugggauguucaguggagccugagucauuuuauaaaaaagcaugacucuaggguccaaaauuccuuugaagcuguugcuauccagagugaagucccuucuuuaggacaggguggcccuccucccuccuggaugucacaucuucgguggaggggcagaaaggggacuggguauucuccucacccuggcccuagugcuucaaaucuuaaaaaaacguuuuuauuugugcuucugcaccaccuucuagcccaccucguuuccuggccucuaacuugaugagagcgugugucauuuucacacugauucuccacauggcaggcggugcuucuuagccuccugcagacagugaggccccacggucuuguccaaggucacacagcguguaaugggcagggucagagucuggagucuggaccugggucuccuagcugcacugcacugcugccccauggguuaaucagcucagcauaccguggcugaacagcuaccucauaccaaggccuguggcgccaugacagggauugacagggucccugccuuggaaacccguagucuaaguagaggagacugacaagucaaugccuuccaucagucugcucaacacacguuuaccaagugccuacugugugcugcagaggcgaagaugacacagcucaggccuuucccuugagcuuacaguucaggaggagagacugaccagugacugccaguacaguugacuaugggacaaugugcucagccuuggggagagacgaagaagguacccguauagcaccagaugacaggcacgagccccacaggccagggcagcugcucagaggagaguaggccaagcagaaggcaaacagaaggcugcaggcauuugccaucgagagcuggacuucaaacugggcaucauaccagccuggguucgaguccugcccagccccuuauuggcugucuaacccugagcaaaucccuucaccucucugagccucauuccucuaucuguaaaccaguuauaauaauuggaacauucauuuaaggacuaaaugaggucgugaagcauucagcagaugcuagguacggaaacucgcugaagugggggcagguuaagaagccucuggggauacgaaggcauccagggacuaguuguggcaggaggcuguuaccacuuaggucugaaggguaaggagagggaauagcuuucccucugcccaguuggagccgguggcauggaggagaggcugccuguggggaaucacccgaggguucaccgcugccaugcgcagggagucaggagguagggagggaguggggcagaugcacaccauuuuuuuuuuuuuuugagacucuguugcccagacuggagugcaguggugccauaucugcaccucugccucccggguucaagcucacugcaaccucugccucccggguucaagcgauucuccugccucagccucccgaguagcugggacuacaggugugugccaccaugccuggcuaauuuuuguauuuuuaauagagaugggguuucaccauguuggccaggcuggucucgaacucucgaccucaggugaucccccaccucggccucccaaagugcugggauuacaggcgugagucaccgcucccagcugcugaugcacucuuguccuucuaacuccugcuagugccucccauuggcugagcccaacuggaagcuuugcaagggagcuggugcugcaguuugcacugagcaggcuggagaaggcuggagaauagacuaggggacaaaccgaauugccagugcuguuaugucaugauuuaggcauggaguccagggccugagcuucacuccauguccauccugcccagagccuuggcacagccuggcucccagacaagaugucaaguucagaauccuuccuaaaaggaauccucuaugccagaccguguugcagggauaugggagugcugggcucccagccugaucaaggagcgagaaaacucaggcuccuagucuguccuccggggcacuagcagggacaaggugggaggcugcugggcugggauguggggacagguuugaucagguaaggccaggcuguggcuguguuugcugcuguccaaauggcuuaagcagagucccccggccucucuggcuucugcaggccuugaaguugccccaugucgacuacaucgaggaggacuccucugucuuugcccagagcaucccguggaaccuggagcggauuaccccuccacgguaccgggcggaugaauaccagccccccgguaagacccccaucugugcccugccccaccccaucugagcugaauccauuugcucugcccuggccuggccucccugcuggugguuuccacuucucggggggcuuugggacucagcaccuccacugaccccuuuuuuucugucccauccccauccccugcagcccccacugccugccuuccuguugccccacaaaugcaaaagucuugccuuaaaugauccucuuuuccuucuuuucucuuguuuuccuuuucucaccauuuggaauggcccagcaggcugcacuuaccuuggaaggaggguucaucugauggugacucuaccuagggcccccaggccucuauaacucccagugcccugcagacuggaccagauccuuuaaugggauagacacaacccugucugggaugccucugccuaccuuccuguuuugcugcuccaccugccuccagcuccguuuggcuuccuggggcucccugccugggccacuuugugucuucccucuaggccuuucuuuccacuguucccucugccugguguggccuggcuauggaagggagggaggaggagcggccauggaaaacggucugcauucuagcagggacuugcagguggcaauucagucggggaagacucuagaugcaccuggccugaggagagaaugaaggguucuaguuggacuguguuaaguuugaggugcccauggugugaggucuggagcucagcgcagagaugaugcaaugugguggguccaugcaacauggugccaggacgcagagcuuggggugaacucagcuuucaccccuuaccgguucucgugggaucuugggaagccacuuucuucuaugagcuuugucguucuugucuguaaaaugggcacauaacccugucccuguccuucucacagguugcugugagacuccaaugaguugaaggaugugcagaugcuuuuggaagugaaaaguuggggggcuacugugugacuuugcauacacccaaacugugugaccuugcauaugucugaguugcugccauugcaacagaucagagcuggugggcuggguguggagaaaggguuugugugggggacauccucuggcaaggguggcagcagcagaagugaggggccuggucggucaugugugcugacccggccugggcagccuguggccagggagaggacagcuccucuguaggaagagccuguuccuuuccaaccaggugagaccucuucaguggagcccuggagcccccuguacuccacaucagugccucagggaccucccggagcaggcuaauaucagagaccaagagggacacuggcagaggaucacagagaccccaguccaggcagggacugagaagaucuugcccccuaaguuaguuuccuagcacugcugugacaaauuaccacccccucgguuggaacaaguugauucucugcaguccuggaggccagaagccugaaucagugucggcaggaccacuuucucccggggggcuccagggagaagcuucucuugccucuuccgugucccaacagcggcagcacaccaaucccagccucugucuucacacagccuucucugugucucucuccucuucauugucucauaaggacacuugucauuggauuuagggcccacuggauccuccaggaugaucucauguggggaaccuuaaccacaucugcaaggacccuuuuuccaaauaaggucacagccacagguuguggggguuaggaugugaguguaucucuuuggcagccacuguucccuccucucccuugggccagaagcagacguggggcccuuucuuccccauaggaugcccauggauugccccccuucccgcuucccccgagugucugugggagguggcaggaauggcaggcagggguguggaaccccuucuggagucauaucaagggcuuggcuggaggaaguccuccuggagcuguugggcuggcauggggcaggcuggcugggcccagcagcagcuucuucauucauggggaggccacaagcaugggcccuagagcuggcugccgcccucaaacccagacccugcacucuuaacugugugaccuugcauacgucacucacccucucugaucuucagguuccucugcaaaagggagguaaugauaacccucacucuggggggcuguuuggaggguuaaaucaguuauugcuguagcaugcauuucucugucagguauugagugaggugcugugauuuuagcccugcauuuuucuuuucuuaccauucaauaauaacguuuugagcacccacugugcgccaggcaccauauuaggugcuggggauacaaaugugaaugaaaugaauguggucucuucccccaacaguguauccagaagauuaauccauuccuuaaacaaaugcuacuugacacagauuaguucuggauaggcugagagcucugaaggagugcaggcagcugcgagccuguguauccagcagaaggaucaggaaaggauuccuggaggaagcgcuguucuagccaagaccuacgggggcauuauuaaccaggcaaaggggacgguguccaagcaguggaaugaacguggauugaagcugugaggcaggagggaguguggccugugcagaagggaccgaggcuggugagaccaggagggccuggguggccuccaggucagaugugaaaggaagaacuuggccacagucugagcuucucaggcguauggcagggcugccuggugagagggaaugagcucccugcucuggagguaugcaagcaggacugggcucucaccugccagaggccacagagcuuuccagaggcuggaagaggccacuccaaggccucuuugccccugagagugguggcucuucuugaggccaccuugccacgcugucacagggaacuagcagccccugccucacccggggguuuggaagauagagggaggccuaggaagggcccugugucucauccgagcugggccccuuuccagccucucacuggaaggaagcccaaggauguuccugugggggcuuuuaccaggcccaccugcccucugcuggccaugcuugcagccuccugacccugucccagcaggacagugggcuggugugagcgggcaggaaccgccugcacuuagaagguguggggcugccuccccgagcuuccaucugccgcuggggccacaccccaggcccagggaugggaccccacaguggucacaucaucuugcagcagaacccagguacagcuccuggagcagaugguggucccaagcacgggugggaccagaaaggacucucaccugggcuaacucagcugcagccucaguucccuccucacacacgacgaggaacauggacuggaagccugcccagcaggccuucugcucgaugugcguuguguggcuuacguccagggagggaagcagccucugugcugucuucuagauaagccuguauuccccgggcugucugccaauguauccaguugucccgucagccuggaagcucugagggaaaaccuugggcugcuuccugagcaccuguauccccugcagccagcccggggccucugcuaggagcagacugagcauggcuuaugggccuggcaccaucuggccucugcccaccuugcuggccuugucuugugucugccccuucgacauuccauagcccagcucaauaucuagugguuccucuaggguggcgagcacuguuuggucuccagaugucuucaggucggagcucacagcgcucucagccaccccuucccaguguagcaccgggcacaugguagaugccuauugaugagugaaagcuccuaacacacucagagagcaaggacuccgccucaucccacagccugggaggagaggcagacugccaaggaccugcucagcaugcuacagaagaaaccaaagugcccacgggacugaucaguggagcuuccugccgagacuggaggccuuagggcaggguagacagugugugugcaggcuggggacucacaguucggacugugcccagaccuacuagcauagugggugggugggaggaugcgggacugggggccgaccuugccugaaauucaugugggaucucagagcagccacugaauugcucuguagggggcuaaauaguggcccccacagauacacacacccagacagagccugugagccagaccuuauuuggagaaaaggucuuuguagauguaauuaagcaucucaagauggcaucaucuggauuaugcggugggcuguaaguccugugaugugucuuuaugagagaaaggcagagggagauuugacacacacaggaggggccacguggagacagagguggagauuggagaaauguggccacaagccagggaacaccagcagccaccagaagccggaagacgugaggcaggguucuucccagagccuucgcugcugagucugggaauuugugaccgaagccauaagaaguggguacacgcccugagccucccacacuugcucaccuguccugagaugagaaucucuacucugcagcauauuuggaggaucacugcgggggccacagaggugcuguucagauggcacuucagaagacucaggagacccuggggcaggagcaguuugacugacagcccagagggcugcccucugauuccaccugaggcccugcuuuuccuggcugcagggguuccagggccaggccauuuccgcuggcgcaggacucugcuagcagcaaccugccugaagucuuccuuuggccuggcugagaguuucugagaccugcgcuggagcggaggugcuuccuuccuugcuuccuuucuuccucucucccuucuccauccagcaggcuggaccugccuggcaucugugagcucucccuacuuucuccuauacccuaaccuuuguccugcaugggcgacucccccagugagucucuugcagcuuuuaccccagugccugcuucuuggagaauccaaacugauccaguuagggaugauaaaguguaggguaggcgcucggugacuguuuucucugagguugugacucgugugaggcagaagcaguccccgugagcccuccugguaucuuguggaguggagaacgcuuggaccuggagccaggaggcccagacauacauccuguccgagcugcagcuuccugucucuaaaaugagccggccagcgcagguggccagacaucacuguuauucuccuuugagucuuuaaaucuuguugucuuucuugcagacucggugagcugugaaaggcuauaauaggggcuuuauuuuacacuuugauacuauuuuuugaacauucauauuauuguuagauauugauauucauaugaaggagcaggaugacuuggguccuucuuggcaguagcauugccagcugauggccuuggacaguuaccugcccucucuaggccucccuuuccuugucuaugaaauacauuauagaauaggauguagugugugaggauuuuuuggagguuaaacgagugaauauauuuaaggcgcuuucaccagugccugggaugugcucuguaguuucuguguguuaacuauaagguugacuuuaugcucauucccuccucucccacaaaugucgccuuggaaagacggaggcagccugguggagguguaucuccuagacaccagcauacagagugaccaccgggaaaucgagggcagggucauggucaccgacuucgagaaugugcccgaggaggacgggacccgcuuccacagacagguaagcacggccgucugaugggagggcugccucugcccauauccccauccuggagguggguggggacugccaccccagagcguugcagcuguacuccuggguugcaccccccccagcugucacuguccccucccugccaucaguugugggaagggcguucauccauccagccaccugcugauuuguuauaggguggagggggggucuuucucaugugguccuuguguucgucgagcaggccagcaagugugacagucauggcacccaccuggcagggguggucagcggccgggaugccggcguggccaagggugccagcaugcgcagccugcgcgugcucaacugccaagggaagggcacgguuagcggcacccucauagguaagugauggccccagacgcuggucucucuccaucuggaccuggccugggagguggcuugggcugggcccagggagagcuaaugucuccuaaccaagaaugcuguggcagccucugccgcagagccagagaaccagagugccaaggcuggcaggguucccaguggccacgagugcagaugaagaaacccaggccccaagagggucaugcagguagcccagggaguucagccuugacccugggucaaugaccuuuccacaguuccacacugcuccccuuuuaaaauccggugaugucuuuaugucuuuuguuauguuaucuucaauguggagggacucgaggugaucuaagcaaacuuuuucuaucuucugcuugcauaccucugagaccaggggacucacucacuugcaugacugggcccugcaggucacacuggccaggcagaugugguggaggaacuggcagaggacuuuuucuagacugugacuacauuuaguccacccagcggccccccuaugaaguccaguugagaacuaggacucugggggccgguggacagagaagagggaggguucucucccuuacugacuuccuucuguggccagacauugagcaaggccucuguacagcauguccuggggcuggccuugccguagcugcuaaauaguugacgaaaccaguccagagaggggaggugacugccagggucgcacagcucaagcuggggaacucgcugggaaaacugucagcucugggcagcagcuugacuuccacuguaagccccagcccccagggucaaacacuggcucuggugcuggcagaggcagcccacuagccuguuucaaaggcugagaaggcccaggagucugcccugugcuccaccaguucugcccugagacuuuccuacagaguacagguuuugauguucaguuuuaaaggcaagaaucaauaaccuucugccccaucaggugaccccuugugccugucccaccccuuuauugacugaccucggcucagucaggucaguuccugaaggucaguguguggaggggaggcuguucuuucccagaaaggccuuccccaggccuggugcucuggccucuggaggacuuccuggagaagucccuucuuuggggucccagucaguguaugggaagcccuuauugcaugaccuggcacggggcaggggcucaacagucacuauugccuuccuugccacugccauuuccuccucuguaagcaggugauuguguguccagucugagcacagagauaagcacacagcaggugcuuaauaacuagcagcuguaggcugggcgcgguggcucaugccuguaaucccagcacuuugggaggccgaggugggcagaucaccugaggucaggaguucgagaccagccuguucaacauggugaaaccccgucucuacuaaaaauacaaaaauuagccaggcaugguggugggugucuguaucccagcuacuugggaggcuaaggcaggagaaucgcuugaacccaggagguggagguugcagugagcugagaucgugccacugcaauccagccugagugauagagcgagauuccaucucaaaaauaaauaaguaaauaacuagcagcuguaaauguggcuguuguucuucaccuccacacucagugccacuccacucccucccuccguggugugaggggccucacuagcugucuccuaggaggagcauggcugugagauuccagcuccauccuuggccacggcuccuggagacaucuuagaggccaggauccagaaggcucccacaccucauuugacaggggagaagcugucaguuccagguccccuugcacaucagggccagagcugcguuaggccuccagucuccaggccacugggccagagcucacaggcuggcagaggguuagaacuguuacugguggcugggugcaguggcucacgccuguaaucuuagcacuuugggagggcaaggcgggaggaucaugaggucaggacaucgagaccauccuugcuaacacggugaagccccgucucuacuaaaacuacaaaaaauuagccgggcgugguggcaggcgccuguagucccagcuacucaggaggcugaggcaggagaauggcgugaacccgggaggcggagcuugcagugagccgagauugcgccacugcacuccagccugggcaauagagcgagacuccgucuggaaagaaaaaaaaaaaaaagagcuguuacuguugacaguagcaugagguagaccauggccugcaccaaaaugggggaguggagugccacugaggccagaaggaaccacacccucaaggguggggaguuaugguaugggggguccuaggcauggagucuuuuaauucuuuagacaauccugggagcaacugucccuguuucacagagggcggggccacacagcuggugagugggcagccaagacucuguucaaguuuguguggguccaacacuugcggccacgguggaggggcaucugagccaggccucagagaguggcgggggaaguuggguggggaagugugcccuucucauuccucugaggcucauccucuuggugccucucuuucauggaaagggauaauaagguuauugugaggauccccugaguucguauauucagacgcuuagacagagccaggcacagagaagggcccgggguuggcuaguuugauugcugguguaauugcuaauaucuuccaguuuguauuggucaagguucugcagagaagcagaaccaguaggauguauauauuaagaguuucaagcucaugugaccgugcgggcuggcaagucugaaauccgcagggcaggccaggcaggcuggcaauuccugcagaauuugauguugcaauacugaguccuaaggcaguccuggggcagaauuccuucuucccugggaggccucagucuguucucuuaaggccuucaacugauuaaaugaggccugcccaaguuauagagaguaaccugccuuacuccgucuucugauuuaaauguuagucacaucuaaaaaauauuuucgcagcagcauuuccacuggcuuuugaccaaacaucaggccacaaaguugauccccaaaauuaaccaucacucugugccuguaagggaggggcugggaaaggggagcaggucuccccaaggggugaccuuggcuuuguuccucccaggccuggaguuuauucggaaaagccagcugguccagccuguggggccacugguggugcugcugccccuggcggguggguacagccgcguccucaacgccgccugccagcgccuggcgagggcuggggucgugcuggucaccgcugccggcaacuuccgggacgaugccugccucuacuccccagccucagcucccgagguaggugcuggggcugcugccccaaggcgcggguagggggcggagggcggagggcggagggagggcgggcgggcaggcgggcuucuuguggcacgugggcuucuuguggcacguuccuggaggccgaacccuucuggcuuuggaaggagucgucagagacccccgccaugcgggaggcuggggaggaaggggcucgaaaccuccaucaucgcagagucugaauagcaguggccccgccaugcgcccacguagcggcgccuacguagccacgcccccacaccccguccuggccacucucccuccugaaggucuucugguacccgcccccuccccaucuccauccccaggcccugcguccucugcccaauacucuuugggccucccuguuguccagcucucuccgcggcuccaugacugacaacuugagcaaggcuaaugugaaugggagcgguugagggcucagaccucucacccgaggaacauccacagagugugccgcaugcccggugcaguguggcugcggggacacagacacggagccucggcccugaggagcuggggggcagugaccgucccuccucugacccaccacuccuccagugucaggacacugcggguaucuaggggaaggaaucuuguuccacuucaagucuggaacuucaagucugugugugugcgugcgcgcgcgcgcguuggggguggggguugcagagcagaugcguaccugacagcgguaaccuagguccccccuggccuaucaaggcuucccuggcggccgaauuuaaaggcaucaagcaaacaaagcccaacacaucucugccuuguccucucaguuuccccccguggcacuuagaaccacuugauacaccgaauaguuuccuaucucccccacuaggauguaaacuccacaggggcauugggaaugcugccuggcuaugguagggacagaggggagcaccagggcggggcaggggugccagaguucugccugggcagucagauuuuccuuaggaggggacauuugagugggacccaaacagguguauagcaguuguccagcccagcuggcaaggccugagucugccucugcaaccccucucuugggcuccuuucucugccacccaccuccucaccuuuccaggucaucacaguuggggccaccaaugcccaagaccagccggugacccuggggacuuuggggaccaacuuuggccgcuguguggaccucuuugccccaggggaggacaucauuggugccuccagcgacugcagcaccugcuuugugucacagagugggacaucacaggcugcugcccacguggcugguaagucaccaccccacugccucggccaccgugaugcuaacagccccuuuggcagucagggucugugccgggaccuccagugccaggcucugugcagggggaccagagaugaaguaggccugauggugccuucaaggacacucagucugaugagggaggcgagugcacagaggaaacacgaggucagggcuguauuagagggagcccagaggaggcaccugcccagcccgagggucagagaaggcaucuuggaggagggacauuugaucgggagcuugauggaugaauaggaguucaccuggccgauaagacagcaacuaccaaggcuuagaggugugagaggaggcugucuuaccucacugaguaaggacugcaggcggcuuaccuucgagaagagagcuuagugucugugugcacguguguuuguguguaugugugugcgugugugcacuggcaggaguccccugcuggggcaggagggccgggccaucaccaucuuucaccauucaccccugcaccaggcauugcagccaugaugcugucugccgagccggagcucacccuggccgaguugaggcagagacugauccacuucucugccaaagaugucaucaaugaggccugguucccugaggaccagcggguacugacccccaaccugguggccgcccugccccccagcacccauggggcagguaagcaggauggcagggugggcaaguccaggcuggggcuugggaggucugugugaccuugacagucucucccuucucccuugucuguguaaggaggaugacgccaccuuaaauaggauuaaaugagaauggggcucugaaagggcugugcaauauuuucauaacguguuuuuauagagacaguugaguauguucuuuaagcccuccucucuccuaccaugaacuaaagauuucuguggagguccccucacucccagcacccccuccucaucccaggcccuuuuugcagguuggcagcuguuuugcaggacuguauggucagcacacucggggccuacacggauggccacagccgucgcccgcugcgccccagaugaggagcugcugagcugcuccaguuucuccaggagugggaagcggcggggcgagcgcauggaggugacuguaccccuccuucgugugugugugugugugugugugugugugugugugugugugugugugugugucagugcugggcccucagggacccccagcaagccccuccauccuccagacuccagcucuucuguaagcuuacagggcuggccagaccaggaguggggcacuccucacuucacgcggcugggggcugcuggagagagccacagcgggaaggguuuccuagaggcugcaggacagugcuggauggauuuucaaugcucaccugggugugagcgugcggcagggccgcgugagggucagcgaucugcuacucuggacucagccaucucuaggccccucucacucaggugcuccaugguucugggagcugagaaaucucaaaccagcaaaaaaguggaauugauguugaugcuacaggauagugcacagaugccaucugguugcagcauuuugguggaagggcagugcccagcuaggagagugaggaggggcaggcauuucuggcuugaggagauggggucuuaaugcucgugugagaggcagaguggguggaguggagcuggcuggauccuugcuuuggccuccuggauuucucucuaucuccauuuugaaaccacucuguguuuggaagaacuuuugaguauucagagcugcccacuggcagaacagucuuccuugggcaggagugagcuccuuguccccagaaggcugggucuggcuggccccuggcagggacacugaugagggugcuugaguugauccugucuagucccuuucuguguuuucaaagcccauucuaaagcagauucccauuuccgucuuugacucuaaggcccaagggggcaagcuggucugccgggcccacaacgcuuuugggggugagggugucuacgccauugccaggugcugccugcuaccccaggccaacugcagcguccacacagcuccaccagcugaggccagcauggggacccguguccacugccaccaacagggccacguccucacagguaggaggcugggcuugcccuggggugaggaggggucucuuucuccuuaugcacccacugcccgcgaggcuugguccucacaagugugauccaugagacucaagccugacuugcaguuccauacucugguucugccacuuccaugcccuuugagccugggcaggugaccuuacuucuccucaucucagcuuccuccuccauaagagggaaaaagguauuaccugccucauuguguugcaaggagaugggcagcaucuagggcacuggccuggaguaucgcaggugcuuugccuaagguggugcaguccaggagaggcagcuccagagagaggcccccggcuggggcugaaaggagggcagaccucgguuugaauuucacccugccgcucuauagcugugugacuugggcaaauuacuuaacaucucuguaugaggaaaugaugagugcuaagcacuuagcuuagugccgggacaauauaaauucuagcuaucguuacuauuguuuucaucacccguugcuuuaaaauccagccucugguauaggcaacuauugacgggcuacccugugucgaaaacaugcccaggcagguagcaggaagucacagauggggaccucuuggggcaucaagggauggugcccugaggcugagcuguucugguuggguggagcaugagaggucugggaagacagugggacuccagccuggaauaagaggcucagaguugauucucgucugagcacguccaggggaaccacugaggguuugggaacaggagagugagggugagaaccugguucugggcacagcaggcuggcauguaggauggauguucaggaaagaugagcauagucagguggcuggugcccuuguccaggggagaggcuccgucagguucagggguccuggcuuggagggaaguccgccaugcucuaaucacgcuccccuuuggaagugcucagccgaugagcucacaggcacaugucaguuugaagucauggaaucugacuccaugaagcgcaccucaaagagcaccauuuugcagcuaagggaacugcaggcuggacaugcugaguggcugccccgagcccuugcagcuaggacauagagaaugcuaguaaccacaacccuaccauguucagagcacaugccaggcuccaugcuggggcuucgcacgugucaucuucacagugucccugugaguaggugugguuucucuuuccaucuuacaaaugaguaaacagagccucaguguagcuaaguaaccacuauuuuagguuucuuagccaaugggugugucugacuccuaagcccauggagggcauucugaggugguucagacagaccccggcuuacccuugaacuucugccugcuggcugcauagggaggggcuggggggaguuugagcaucucaggccauagagccccugccucacugucuccaucucuggguggaaagaugguguuuucccugagaaacuaaggcucagagagguugaauggcucucccaaggucacacagcuggucagcugcagaguugagaacacaggaguccuggugcucaggccagcaucucuuuuuuucuuugaguuguuucuagguuuccuagcucuugccucagaccuuaaagagagagggucugauggggaugggcacuggagacggagcaucccagcauuucacaucugagcuggcuuuccucugccccaggcugcagcucccacugggagguggaggaccuuggcacccacaagccgccugugcugaggccacgaggucagcccaaccagugcgugggccacagggaggccagcauccacgcuuccugcugccaugccccaggucuggaaugcaaagucaaggagcauggaaucccggccccucaggagcaggugaagaggcccgugaggccggguggguggggugcugcgugucucuccugcacagcuuuucugugucaguuugugccaccaccauaccgccaugcaucaggguggcgguuugccagguagaugcugugggcagcuuccgccauuguguggacagcauguauaugugucucuguguggcugggucuguuuuugcuuuuguccagaucaguaagguuugcuaccuggguaccccacuccacuuggaguagaaugugcauaaauauggcauaaagaaaugcaauaugcaugcauuuauugauugaucuauuuuuuucugagauggggucuugcuguguugcccaggcuggucucaaauuccugggcucaagcaauccucuggucucagccuccccaaguguugggauuauaggcaugagccgcugcaccuggccucucugaucuauuuaacaaaccugcugggagggucucagggucaggagcagcacugggcucugaggacacagagcucacucagccgugacccagagggggugccugagcugcaugcugaagguuguuagcaugaccagcaaggcaagaaaaggcccugccgagauuagcaaggcaugugccaagcccuggaaugugacagccgggccuucuagaaaccugaguguauaacucuccuuaaaagccaguaggagcuccucaaaaggcagcccuaaggaguccacucuuaaaugaacucagagucaguuuuaaaaugcaagucuguguugauucuggucuggauggugcauuccucgagagcaaaagacagucuuggucuuggauccacuugcccuggguacacugagggcugcuagguuccaggugcucuuccuggcacuggggagggauacaggcccaagagacaugcuguucucccuccuggagcaucuauuuuaguggaggaagacagaaaacaaaccauuaauauagaguacugaaaagaugcgauggagaaaacuauagcaaggaagggaauggggugggagagaggucaggagaggucucgcugacaagguggacgaaacaggccaugaggcagagaacauguuccaggcaaagcaaaggcccccagguggggaugugcagggaguaccaggaaaccagagaggugggaauaguuaugagauggggggugccucagaggggacagggccaagucaggugagaccugagggucacagucagcagugagcuggggccaugcaggggucuggccucagaggaguguggucuggccuggaucugaaccucucacuguggccuagcugcugagcugagaagagaugacaaggaccuugggcagaagcagggagacuggagggaggcgguggaggguccaggcguuggggcggggcucaggcuggagucugaagggagccugcaggccugguggguggaugugggugggagagggggaggauggcaccaaggcucgggccccuggacagauggaguugccauuaagugggauggggcaggcuauggggccaucaguuucagagggaugaguuuggcacuggcaugguaggcaucugucuaucuccacggcccucaaaccaggcaugaagcaggagcucacguguuuggucagccauggugcagaaccgccugggugggaggugcggggugggagauacacgguugugucccaaaugggcucugagccagcgagggccgucugcacuuuggccucacagaaggaugucggagggagaaaugaagugugggugggggucccgggccacgcuagacaugugcuuucuuuuccucgggcucuggcaggugaccguggccugcgaggagggcuggacccugacuggcugcagugcccucccugggaccucccacguccugggggccuacgccguagacaacacguguguagucaggagccgggacgucagcacuacaggcagcaccagcgaaggggccgugacagccguugccaucugcugccggagccggcaccuggcgcaggccucccaggagcuccagugacagccccaucccaggaugggugucuggggagggucaagggcuggggcugagcuuuaaaaugguuccgacuugucccucucucagcccuccauggccuggcacgaggggauggggaugcuuccgccuuuccggggcugcuggccuggcccuugaguggggcagccuccuugccuggaacucacucacucugggugccuccuccccagguggaggugccaggaagcucccucccucacuguggggcauuucaccauucaaacaggucgagcugugcucgggugcugccagcugcucccaaugugccgauguccgugggcagaaugacuuuuauugagcucuuguuccgugccaggcauucaauccucaggucuccaccaaggaggcaggauucuucccauggauaggggagggggcgguaggggcugcagggacaaacaucguuggggggugagugugaaaggugcugauggcccucaucuccagcuaacuguggagaagccccugggggcucccugauuaauggaggcuuagcuuucuggauggcaucuagccagaggcuggagacaggugcgccccugguggucacaggcugugccuugguuuccugagccaccuuuacucugcucuaugccaggcugugcuagcaacacccaaagguggccugcggggagccaucaccuaggacugacucggcagugugcaguggugcaugcacugucucagccaacccgcuccacuacccggcaggguacacauucgcaccccuacuucacagaggaagaaaccuggaaccagagggggcgugccugccaagcucacacagcaggaacugagccagaaacgcagauugggcuggcucugaagccaagccucuucuuacuucacccggcugggcuccucauuuuuacggguaacagugaggcugggaaggggaacacagaccaggaagcucggugagugauggcagaacgaugccugcaggcauggaacuuuuuccguuaucacccaggccugauucacuggccuggcggagaugcuucuaaggcauggucgggggagagggccaacaacugucccuccuugagcaccagccccacccaagcaagcagacauuuaucuuuugggucuguccucucuguugccuuuuuacagccaacuuuucuagaccuguuuugcuuuuguaacuugaagauauuuauucuggguuuuguagcauuuuuauuaauauggugacuuuuuaaaauaaaaacaaacaaacguuguccuaacucuugcauagacuugacugccuagg

SEQ ID NO: 14042 - RNA, 37617 nt, Homo sapiens
ccagcuuccaggccacuuuuauuuaaacagaagcagcggccccacagccauggggacaugucuuccagacaguagacacagugccuguggcuguaagagccugacagggaagauucaugccuuucuccuuggcccccaugaccaaagaagaaaauaaaaaucacacaccauacacugccacacccaucuccaccccucccuuucaguaauauccaaguauucauccuucuggccaaagaaacuggcuacaauucugauucuaaagaaaaccuucaugcagccaagaaacucagggcucuggaggggagagccuuacucugauacuuuccacaugcacugcccacuggcaucaaguuuaacuccauccaaaaccaucacauggauggccagggacaggacuggcuacaaaaaaaagccaugaacucagcucaccaugcuaagaagacugccucuuuccaggcaagauuuuacuggagcaacauaaccggagggugugauuccaaaauaccuuccuuuccaagccccggguuguggauaaggucuggauuuugguuauaugacuaagggcgacagaggcugcuggcaucucuggccaccgucccaguggcuuaggguuggaggcuucacuggcaaaacaauggcacuguuuaacuagcucguguuaaccauucaucuacagcaaguagaaucaucaguuuugcacugagcaaggaagcacaugggucuccuaugagagcuaaugccagaauucacaugcuuuguaaaauauaggaugagguuuauuucuuucuucugcccccuccagaggccaaauggguagggugguuccuuugccuucugagugccuggaugcccccagcccucacaagacccugcuaagacacuggcagugugccaagccuugggugggaugggugaacacccuucaaugacucugagaggauucuggcaccuggaaugacaagacagaugcuucccugcaagccagguaugagccuuucuggaaaugagaugggagcugaccuugggguugaaggaaggaucuugaaugacagauaauccccaaguguccacuggaucauuuuuccucugacuuuccacacaaaugaggcuuuccguggguuuugcaaccacagugucuaagacaaucagaaggguuccagggaggucuugucuguagcgaugugacagaugaggaaacugcagcucagaggacaaugacuugcccacguugcacagcucgcugacaguagagaggggcugaaaccuaggucuccugacucacacgccacaaccaugacuggcucagcucccuuaauuccagcuucccuuacaugacgcaauuccuucucagauucggguuuucagcugaggcugggcaguucuuaagauagaguugcauaaacaaccaagcuuugcguuauaacaagccagggaaggaccuagggagguucccuucccucuggaacggaaauggaacuuucucugagcuuaggauuuguaaggcacugaaauuaacuacagcugggguggggagugguggaagaaagaaaaagagggaugagugguuggagaaaucaagucgaugcucuuuucuuccagccccacggugagaauccuacagaaacaugaggguggacuccacuuucccaccugaugcuguccacuccccagccccugcugcagagcagcgcggacccacucccaccaagacaaaguggguuuugggaaagaugaggccugcaggguuggugagccaagaagaaugagcccagguccccuggauccaauucagagcggagaccacucucuccaccuaggugucccaggcugaggcugggacaagauucaacccuggaaugccuucuccaggaacacagggcacuccgaguggacucagugguggcuggggugggccugcaggcccaggcaugaaggaggaaggggcaggacggcaccaaggauggcagggagaacuuuggccucggaccuggcuuuggcacagcgcaucuggggccuccccacuccguggcugcccuccugagaucccaggguggggaagagcuguccuucuccugugaggaccucgucuggcugauggaggcgauggcagggcaacuccagcguauccccuucaucauuccagccauggcugugcacaggugaccuaauguggagccuuuucaggcuccacugcagaugugacgcugaacgggaagcaacaagagcuaccacuuacccagcaccuucaaugugaccagugcucaacucagaugacaacaaccugcaaguagguauuacuaucccuuucaacuaaugaagagacccgggcucagagggguuaagggacucacccagagucacacagcuaaugaguucuaaacggggaacuggacucaggcuugucugacuccaaaucccacauucuuuccauuccacugggcugcccccuggaagccaggaggaaggugguguugggcugucagggugggaguucuggagggguuucucuuugaaaguguggaucuaggaaagcagccaagcuugagugaagggaagaugccugaccacucacacgugucugucucuccaggcgggcuccagcucagugccuggcggccuugcagaucuugucguacaccucggggaaggcguccuggcaacccagcuucucucgcagcuugugguacaaggagccaucaaacaucucccagaacuccucccgguucauguagcagucggcauacagcaucuggaagcugcagaggcagagaagugggugaggacgccaggaggcacacggaacgcgaggcgugagagaaacccaacugcucauucugcagcccagaaaaggcuuuuggaggauuucucuuguuuaaccccguuaaccuggugaagaagauggugcagguauucuuaucccccuuuugcagguagggaauuggggcuuggggguuagguagcuuagcaguggagguagagucaggaguagagcucagacugcugggcuucugccccucugcuuggccagaggcacagcugccuucccuaauggagcagugggguuguuuuccuuuaaucuguuauugacuuucaauaaacuagacauaauuuaaaguacacaauuggauaagcuugacacaugcaugcaaccaaggacuccaaucacugcaguccagaucguggcuauaaccaucagccccaaacuuuccccaugccccuuaguuauccguugcccucugccauccccaggcaacuacugaugcgcuaucaguauggauucauguguguuuuugggaauuuuauaugaaaggaaucauauggcauuguuuuuuccuggcuuuguccauguuccacucaauaguuuauccaggcuguuuucugagcaauccucuguccugggccucuccgugguuuucauagacaggaaucccucucuccuuagcuuuggccuuuccaucuggagcaguugccccuggacccagcuaagcccacacccaucaucuguuccguggggaggaguggggugacucccagguuucuggcuggggcugcugggggggugugacauguucacuggaggagggggugcagggagaagagggcaaguaguccugcaagcccacccccugcccaucuuucacagcuuaccuccugacccagaggcugccacagcugcaggggcccuaaggaaccaguugauaggcuuggggcuccugguucuccauagagcuggccucauuccccuggagcaguacccuggggcugucagcuagaggcaacauacuauacucugggccacucacccaugcacgcugcggacaaacuucuccagcugccucaugcaggaccuggcuucaaaguguuucacacgcggcuccccauaugcuccaaugucgauguagagcucugccucauuuccuuuggggugcacuaggccuggcuggcugggcaggaugaacggacacagccagaugggguagaccuggguagaccagggagguggguauuggugcuuuuucuccaacaggugacaggcucauggcuggcccgcucauacccacccaaaugaaggcuuugcagcauucucaagacccccucaggugcucucagcuucacugccccgccccccagcccuggcugagaacacccugacuccaccaccuuggaggacacaaucggagcaggucaugggagugcucgaugccagacccuaugacuccucucccaggggggccaucacugaguggguugaggccucagcagacauagggacaaggaccucaucuuaaaguugggaaaacacccagagggcagugugcccaaggucggucacacgguucaggggaggagaccauggauuccaagggaaugcaccuggugcgcccucccugcccugccccacucacguggaugucguuuuggaaggugugcagggccugcugcaggcacuucaugggcaccagcauguccugcaccacguggugcugcucguacagcuugcgcagggucucacccugggucagcuucaggagggagaucuugggaggcaccauccagccaaagagguagcggaagaugggguuguugccaaaggggauaauguccuggaaaacaaagauuaggguuggagagaaaaaaaccaacaaggguugaaugucuccaagugcaaggggccaggggccaggucccauucugugcuugacagaagcacgccugaguccaauuccccucuuuggagggggugugaugggaccuaggacuuuaccaguccaaucuagguuugcuucucagcucuggcauucgccaguagugaugaccccgggcuaguuacuuaacuucuuugagcucaguuuccuuaucuguaaaaugggccuugugaggauaaugagauauuaauaccaaguggaaggcacucaaccccaugccuggagugcaauaaugagcuagcuaucauuccugaucuagcuguugagaucuggcuggaauagagcuggcauuccauaaauguuugagaaacgaaugcuguugaaugagcauagugauucuuagagaauuuaagcagucucccuaggggcacacagccagagacagcgcucauggggugggugcagucuggcucagguucgacaaggagcccacugguuugcagcaucccuugcucacagccugaccacccgccuggcucccccaauucggucucccuggaaacccuccugcgcagaagcuguucucuuccacgccucagacugccacgaggcgggagcuuccucacucagcacugcugccuccugacgauggcccccucuucccuccagcucugcccaccuccaacagagaagacuuuggccccugggucacaauccuccucccugcuugaguccuaccauguuccugaggguccccaguguccacugaugcccgauucucacagcucugggagcccuugaagccaaggcugcuccuccauucauuaaacaguucuggccaggcacgguggcucaugccuguaaucccagcacuuugggaggccgaggcagauggaucaugaggucaggagaucgagacuauccuggcuaacacggugaaaccccguuucuacuaaaaauacaaaaaauuagccgggcaugguggcgggcgccuguagucccagcuacucaggaggcugaggcaggagaauggcgugaacccaggaggcggagcuugcagugagccgagauugugccacugcacuccagugugggcgacagagugagacuccgucuccaaaaaaaaaaaaaaaacaguuccaaggggccuccgaggucaggaaccagguucuaugcugggugcuggggaaccaagauaacugagacauggucucuguccuuaagacacccacaaccgcagguguggaagacacaggccacuggaugagugugggaagaguggggacaaacagaggcuggggcagcucaugaaaggguccacaucagacuagggggcacggugacuccccaaagcagccauguguguaagcacugaaggcugagugacccuuucccucacuccucuggagcugccggaccacucccaugaagucagggaccugccuguuuucuucuguuagauccugcgccuuugccaaugucuggcaugcaacaggaucucaauaaauagccuggcuuuuauuguuuccuugguuaccuuuggaagaccuacacaugcccacagcagaaauccccauaguacaaaaguuaagccucccugcgcauuccugacccuguuucccucccagcaaugaccugaccuggcuccccacccacccucaacucuccucccccucccuaauggcaagcauugguaagaaugauuugccuacccuuugggggacaucugauacggagaagcagaggagcuuugaaaaaacagaaagcaaaaaaaccucauaaaugguggcaucuuagcaccacuggcucaucacuguauccuguaucaauacagagggcacuacugccuucgguugugggugucuaaugugugcugcagggguccacaaauucggcccacccucugguuguguguuccuuuacaaauuguccauggcugccuccaggcuacaaggcagaggagcaguuacuagagaggccuuaugguccgaaaaaccuagacuguauacuaucuggcccauuguauaaaaugcuuauuggaucgggugcgguggcucaugccuguaaucccagcgcuuugggaggcugagcgggcagaucacuugaggucaguaguucaagacuagccuggccaacauggcaaaacccugucucuacuaaaaacaccaaaaaaaauuagccgggcgugguggcgggugcguguaaucccagcuacucaggaggcggaggcaaggagaaucguuugaagcggagaggcggagguugcagugagccaagauugcaccauugcacuccagccuggaugacucagggagacuccgucucaaaaaaaaaaacaaagguuauugaccccugcucgauuacagcagaugugucauaauuuauuuaaucacuucuauacuggcagacauuuagauuauuuccagauuauuccaacuaauauacuucguauauguuaucuuugcccauuuauauaugugucagaaagauaaauuccuagaaguggaagauuuuggcuuaaacagugugugcaauuuucauggauaccauuucagagcuuguaccauuuuauacucucccagacaauguagaacacuguuucccuucucccuugccagcacaaugugacaucaaacuucuagaucacugucauucauucugauaggugaaaaaugagacuccuggaguucuguuuugccugucucuaauucugaguuagacuguaucacacugugauguuuaaaagccauuuguguuuuuuuccuaaaaauagucaacugguauccaaauauaucagcugaaaccauuccuuuuccagucuuagccucagaaaguucaaguuuuaaacaugugcccugcccuucuccuuucccgcuucuguccacccauuacuuauccuauguggcuuagugaccugggaugucaggguccuaagcugcccccuugcugaggccagucauugcagagaaucucacugcagcccuuguucucuggccauccuugcucacuggcuguagggccccauggcaaaucuaaggggcccagccugagccaggaaccccagccccagcaggaaguccuggggcaauggccuucuaugaacacaaggacccuaucuuauccuuucuuacugguguuaacucccuguguuagccaaccgcuuauacuaaaaugaugacauaaaaaggaaugacaagacagagcugcccagcuuggcuccuuuucuuucaguccuuccuuaccguaagucaaagguaguguugguagaaugugcauguaacaaagagaaguaaaaagaguuuaugcagcauucuuaaugaaaccaagaaauacauauacaugaggaguuaaauguaacauuuaaacagugaacaguaaaauucauacuaauaauuuaaauuuuucuucacuuagaauggcauuaaguugcaaauauuuaugacaagagacagaccauggagaaagaaaaaagcuuuauauuuaguaccuuuaauggcacuucuggccugcuuuuugcaccuggcccuacaaauuaugcagcuaacccugaccccgcguguugcugauugaccaagcugggggaagggaagugacuggaccagccaggccuggcacaggugugaccagaauggacuaaucacccagaaugcagcuuguuaaggggcuuagcacgcaggccuggucacacuugguucauuccagggccuuacucaucagggaggaaccugggggaaaggccgccaaugggaggagaagaguuaucccagcagagggggggaaaaggcaugcauuugaaauuguuuauuccuccccucuagaaaugucuugucuucugcauuucuacuguagaggaugcugcgcgcagaugcccgcuccagggaggcacccguucccccagcugcacagggugcugacugcugacacucagggagaacugcccuuggcagaagggagcugccucauccaaggucagucugcacaaugacugguugauggggcagcauuugguauaaaguccuagcccacuggccuaaaggugacacaacucuggagggccaucuuaccccagggcugccuguggguuagcugaggucuuccuugugacugcaccacagcuugacuucucccucuucccagucccacuucccuacuaccacacaaugacagaucagcacaaugacagaucccuagaggucugaacguucacuuccugcaugcaaauguaggcugaacacaccuauucuuccagauucuucuuuuaccugaaggcagugugggccaguguuuacuuaacagaacaaauauguaagacaaaccucauuuugaauccuagcucuguguagcaguuuuauuuuuauuuuuauuuauuuauuuauuugagauggaguuucacucuuauugcccaggcuggagagcaauggcgcgaucucagcucaccacaaccuccgcuucuggguucaagugauucuccugccacagccuccugaguagcugagauuacaggcaugcaccaccacaucuggcuaauuuuguauuuuuaguagagaugggguuucuccauguuggucaggcuggucucaaacuccugaccucaggugauccgcccaccuccgccucccaaagugcuggauugcagguguaagccacugcgcccggccuucuguagcgguuuuaacauaugccccuagauucuuugcuaguccuuucucaagaaguggagcucagugccccuccccugaguaugggcuggauuagugacucugaucuaauaaggagaauaugguggaagugagaggugugaccuacgacugggucauaaaaggcacugcagacucuuccuuggucucucucuuggaucacuugcucugggggaagccagcugcuuugucaugaggucacuggaggaacccauguggcaaggagguaaggucucuggucaacauccaugugagcuggaagcagaucuuccagccccagucaagccuccagaugacuacugccauagcccacagcaugagagucccugagccaggaccacccagaucagccacucccaaauccuugaccuucagaaacuaugauauaauaaauguuugcugcuuuaaucucuaacuuuugguuuuguucauuaugcagcaauagaucacuaauacacucauucucugaguuguguuauuuacuuugucuccaacaguuccuuuuuuuuuucuuauuuuugagacagagucucgcuguugcccaggcuggaguacacuggcgugaucuuggcucacugcaaccuccacuuccuggguucuccugccucagccucccuuguagcugggauuacaggcaugccccaacccaccugguucauuuuuguauuuuuaguagagacaggguuuugccauguugaccaagcugguaguuacuuuggauaaccuaauccucaguauucucaucuauggaauggaaauaacacuaauaucuacucucagaggguuguugggaagaugaagauaaugcguggaaaguguucagcauuaacguccacccacauugggaguggcuaauguuaaccacugcuguuaucuuucugauccucuuucacuaguuccucuccuuucucuuaacaaaaccacacuccacaaccuuaacacugcucuuggcagggaucaagaaggacucauaguggcuucugcuuuuggcaaaauugcccaccaccugcugugggccuugacauugcccaagauuaagacuaaugggugugggggagaccccauagccccuccaggccaugaugagacccucaccccuacacuccuccaccccuaccaccgcccaaucacauucugcuuaagauacuugcccaaugucagaacugaccaaucacccucuccuagaagcccaccagguauaauuccgucaugccuuacauucuaauguccuuagucaccauggccugccagaugccuuguuacugugaucuuagccuacuacagcaaugcagcaucucuuaaucugacuucacuugccacugccccaccgccuuuccucucaagcccugcucucauggucugaccuuaacaaaacccucuccauucucagucucuucucugaacauuccucuccccuccuuguuaacuagaacccugaagcccucuuuaagugguaucauuuucuccccuacaacccuccugccacugggauacacggaggugagguagggucccccuggccccucauuacugcuuccagaucucuguuccucccccaugcccagaaaccaaccucagaaacuuggaaacaugugcccaauaccuccucugauaaccauggcuccccucacuagaguguggaucacugaauuccccgaaucccaucauccuugguuccuuucaccgguuccuggaaaaacgucacuuucuucaacauuaacuuuuggugaggccaggcgcaguggcucacgccuguaaucccagcacuuugggaggccggggcgggcggaucacgaggucaggagaucgagaccauccuggcuaacauggugaaaccccgucucugcuaaaaauacaaaaaaaaauuagccaggugcaguggcaggcgccuguagucccagcuacucggggggcugaggcaggagaauggcaugaacccgggaggcggcacuugcagugagccgagauccagccacugcaccccagccugggcgacagagcgagacuucaucucaaaaaagaaaaaaaaaaaaaaaaacuuuugguaauuuaaaacccacagagaagguccugaccacgccuggccucucugcccuuggccuucuuucuuuacauuccagugaucuuaucuuccacauguccuuggccacuggcucucacaacauacccuggaggaggggacagaaauuacuacccguggggauccagugugggagcggaagugagcauguggccuagugacuguuuuuguaaauuugguuuuacuggggccagucaucccuauucauuuauguaccaucccuggcuguuuccauguggcagaucugaggagcugugauagauucuguagcuuggaaugccuaaaauauuuguuguuuggccuuuuaggaaaguuugcugaccccuaggcucugucacccugcccuacauucacagucuccauagcuuccauugcaaguguuugcucucagccaucaccgccucucuuccuagcuuacgcccucuaguccccugacuucaaugcuccacuccacccagggcauccuguccaccauaucagucccuugucagucccugggggccucucacauccggccuccccuccauagcuggcuuagauuucaucauaacacacccuuggguccucacucuugccuacacaucacacucccugcaaaaccucagccaugguuaaauauaacucucugccuacucuguaccccagcaacacagauuccugggugaaaacccacaaacacagggcuggucucacuguaaauucaugagugugaaucccugguaggcccagugcugccuggcaaugccacaguguuuccccaguuaacucauuucccacucuccgagggacagcuucacaucucuucucuccucaaaccaucaaaauccucuccccuuucaucucagcugaaauccuuauuucacugagaaaacagaagcaaucagaagagaacucccacacccucccaccacccuaugguccucccauuaguagcaacuguagccauuaguacugcuucccuccugacaacuggaugaacuuuccaugugcccaucaaaaggcagccucuccaccugagcucaggagccacuccacuccccuacucaagacuucacccuaucaauauacccucucuucugcauugucauuuuccccuccacuggaucacugucaugacugccaucucucccaucuuaaagcaaucacacagacaaaguaccuucaccuggccccacacccgccuccagccaucacccuguuucucugccucucuugauagugagccucagguuuguuuucacuguguccaccgccuugucuccaguucucucucaaacccacuggucaaggauucaccccuauugcuuaaagucaaugaugacauuccuauggccaaauccagaggucgagucugucuucaucuccuucagcagcauguggcacaguugcuggucuuccuccugaaacagucuucccuuagcuuccgggaugccacauccuccugguuuuguuccccugcccugguugacagcacuuucuccugcccuuggcuaguuccuccuccccuaaccugcaaggugucccagggucuucucuaucugcccucacucaucucccuccauggcuuuagaaaacauuucucuguggcugagaaauguguauauagggcuccaaccuccacugaacuccugaagucccgacacacgucacuggcuccugcugucaucccaccuggacaucugaauggcuucugauuccccuuuccaguccccucccccauguuucaaauggcagucaaccaggccgggugcggugguucacgccuguaauaccagcacuuugggaggccgaggcggguggaucacgaggucaggagaucgagaccauccuggcuaacauggugaaaccccgucucuacuaaaaauacaaaaaauuagcugggcguaguggugggcgccuauagucccagcuacuugggaggcugaggcaagagaauggcaugaacccgggaagcggagcaugcagugggcgaaauugcgccacugcacuccagccugggugacagagcaagacucugccucaaaaaaaaaaaaaaaaaaaaaaaaaaggcagucaaccuuggcccugaaccuuugaaucacauccacggccaaucugucuggaaauccugcugguugguucagccugcacugcaucucccagauuugacacuucuccucugcugcugcccagacaacaguaucuucuuucuucuacucuuccacucuuguccacucccguccccauccacucuauccagcugucacaguuauucuuuuaaaacaaaaaucaggccaugccacuuuccuguucaaagcccucauuggcuuccuauuauacuuagaauaaaauauaaaguccuuccuaaccuacaaggagccauaugaucuagccucuggugccuguuugaccucauuccucaccauagcucagcgugggcaugcuggcuccgaaggcuucuugcuguuuuucaaacacaugcagccuugcugggacaccuggauagcuauaagcaaaagaauggagccuggacuccuaccccacucaacaaccuaaagauuagagcugcaacuauaaaggucuuugaagaaaacaaaggggcuuggacuugacaauaaauucuuauauauggcacuaaaagcacaaacaaaagggaaaauagauaaauuggaauucaucuaaauuaaaaacuucugugcaucaaaggacguuaccaagacaaugaaaagaaaccuacagaauuggagaaaauguuugcagaucauauaucugaugagggucuaguauccagaauacacaaagaacucuuacaucucaacaacaaagacaaaugaccaaauuuuaaaagguggcaaaggauucaaauagacuuuucaccaaagaagauauacaaaacgguuaacaugcauauaaaaagaugcucagcaucauuaauuucaaggaaaaugcaagucaauaccauaaacccaccagaauggcuauaauaauaauacuaauaauuuaaaaaccagaaaauaacaaguguuggugagaauguugaaaaaauagagcgcucauacauugcuggugggaaugaaaaauggcacagccucaguggaaaagaguuugguuguugcucagaaaguuagacacagaauuagcauaugacccagcaauuccacuccuaguucuauaucccaaagaacugaaaacaaguauucaaacaaauacaugcacaugaagguuuguagcagcacuguucacaguagccaaaagguugaaacaacccacauguccaucaacagaugagugacaaaacaaaauguggucucucauauaaugaacuacuaucccgccauaaaaagaaaugaaauauugauacaugaaaacauuaugcuauguaaaagaagccagucacaaaaggcacauacugaaugauuccauauaugugaaauauccagaauaaguaaaucugcagagacagaagaugaauuggugguugccacaggcuggggaaaggggagagaauagggaguggcugcuuaauggguauaggguuuccuuuucagagaugaaaauguuuggaacuacacagagguagugguugcacaacacugugaauguacuaaacuacccugaacuguccauuuuauaauguuuaauuuccuguuagcccagcucaagcccugggcucuggcugucccucugccugugaacagaguuccagaguccuccccagaguuguuccuggucugccuucccuauguucaggucccugcucacaaagucaucuccugagggguucuuccugaccuucccccacuuaaagugucacugcuccucauccacccacccaucuacacaugcaacagcaaauucucacucaccuuucacagccaggcuuggcuguuaccucgagcccuaggcagaacuagccacuuccuacuaauguuccugcggcccuuuacagugcagggaucugucugcucaccguggcuagaggcuaacccuuccucaagggcggaacaggucuguguuccccaaaguaccggcccaggggcuuacuccccagcaccaagcagaugcuugcuaagagccugcugcuugaacugaagguaguugguuccuucagaaggaaacgacuguguugcugcuuaagaaggcauugcaguuccuuaggacaaagccacucuuuacccugaagggagagaguauggcuacaguguuaacuguccgggcucccugcccagcuggccuggaggagccagggcuacagaaaccuaagccucaccuggagcucccagaagaugcugcgcguguggcggugguaguagugucucaagggaauguacuccaggcccucucgguuugucuucagauaguucuccacaugcuuaaagaaccacggcuuguaguaauugccaaugcuauucagcugaaaugacagagggcauugugaucagccugcagacaagcgcccagcaccaucgggguguaacagcgacacccggcuucuguucagcacuccuggccuuuucaaagcucuuucaugucuauuacugccuuugagacucuugaaagcuggugagguuaggcacagcggguauccucuagcagagagagcaggagcucaaagagguuaaguggugugugcccagggccaaacagugaguccccgacagucuagagaacucagcgaccccgccuagccuggugcaaguguuuaacagaguuaaacauuuaacugcccugaugcagugccccaugcaggggaauucccucccucccucccuucccaccuuccccaaggccagggaagcacgaacucugggaaugggucagccccucagugcaacccagggcucauggcaccaacuggucauggcacuuucccugcugucccuggaccaagcuccacaguccuccggguacagcacuccccaggcagccaccaucgucuggaggaugcucacaugaauaaggcucauaccucccuggcccugggggcucccacacccaaaucuucuauugagcugaugucuccugcagcccuaaauggucaugacucaaugugcugugugccuugggauggcugagcuucuccuggccucagcuuccucauccauaaaugaauucuggcagaugcucucggggagaggcaggggggauccuggaaaagcacaagcuuuagggugggcagcuggggacacacccaggcaggucaucucugagccuguuucuucacauguaacaugacaauaaaaauacauacuuugugggaguuauuugucuauuagaaauuacauacauaugcccacuguuuuuaaaaaauaggaccaucuuuuuuuuuuuuuugagacagagucucgcucugucgcccaggcuggaguucaguggcacgaucuuggcucacugcaagcuccaccucccugguucacgccauucuccugccucagccuccugaaaaaugggaccaucuuacacguacuguuugccaauuugcuuuuuccauuuacaacacacuuagcagagccuaggcagguuacuuagcauuucuggaagacuaaaagagaugauguagaaagugccaagcacggugccugguccacagguggcugaaguaucaguccccacccauucccuuguugaccugcucuacccuacagccaggcaacccuuugccguggaucucuggccuccagcacuugcagcuuaucugugugccacccgcuugugcaggcccacccugcugguaaggccacccugcuggugaggccacucugcagggaggaaacuggggcuaaagagccucuuugcccaaauuaguuuugguguggaugguauggggcagcgcaaaaaacacucacgcuggccucugccugcuaaugugaacaggggaacccagcaggaaacagagcaaccugaucuaaccccaggugaggugugucacauaccuggcaguggcagcagcugcauaaugaaagugagacuuagggccaccuggauacaggcgcuccuggugcucacugaugcaucaggagccaugcagagaagcccaggacaugggaaagaacccagauagucugucuuuuccaggcacacaccagcugaggaggccagguggcugcaugagcuccaguccaccccagcccuugacugcaagccacuuccuaucucugggccuccucugugaaauggggguaggcugcuucucacaggauugcagcaauguuuacacggggcagugccugcagagggcccaucacagggccuggcacacagggacaaauuccugaaugcuuagaaacagaaauguuuggaagcaaugcuucuaaaaugaaaugcccagaugucuaauggcauccaccacucugccccagcccuguucccucagguaucagggucuugcucacuggggcacuuggcaaauaucccucugcugcugauucugggagggccuuuggguaaggcucucugugccucacagucuucuccuugggaaauaagggaaucagaucaggucuccaaauauuucaaaagcugggcaaaccccucugccaaaucauaaucuuagggagcaucuaauacaucaaauggauggcagcagagccacuuuggguacaguggggguggugacuccccuuggucccaucccuccucagcuuuccuaccccugagagccucaagggaacaccucagagcagcuggaaagcucuggucuagauguccuugcuaggugacuuggugcuaggugacacacacugucugagcuuuggccucaggcagauccaggggcccaggagggccagagcacuucagcucaauguccgguauugccaccgcuguuccaggaccuccagcacuuaccgcagugucccacagggagcaauguuugcauagugcuaaagucugcaggcugauaugucagggaaccgacacugaaccaggagucagaagcuggaauuuaaaucuguucugugcuagcugugugucuucagagaagucucuuucccuuucugggccucauuuccuuauuuguagagaggauuguaccggaugauuuuauagcccuucacaacuuuaaaauguuuuaaguauguauauagguauagauuaagagucuuaagggaugccuauccuuugaucugcgauuuuauguuaagauauuacuccaauuggccgggcgcaguggcucacgcccguaaucccaacacuuugggaggccgagguggguggaucacgaggucaggagaucgagacaauccuggcuaacacagugaaaccccaucucuacuaaaaauacaaaaaauuagccgggcgugguggugggcgccuguagucccagcuacuugggaggcugaggcaggagaauggcgugaaccugggagguggagcuugcagugagccgagaucccgccacugcacuccagccugggugacagagcgagacucugucucaaaaaaaaacaaaagauauuacucaaauuacagacaaaagauguucauugcuccauuaauuaaaguaauaaaaaaauuggaagcaacuuaaauuuccaacuaugggcagcaauagggcauucauuuccucagugcaaggugcaaugcaagguuggccauucuaauugggauucuuuaauucuaauaagaauggacauuaacagugaugguuaugaaggcaauguaauaguucuaauaaaagauggauauuaacaaugacgguuaugaaggcaauguaacaacagggggaaaugcuuaucacaauaaacaagaaaaaggcugggugcagugggucacgccuguaaucccagcauuuugggaggccgaggcaggcgaucaccugagcucagaaguucaagaccaaccugggcaacauggcgaaaccccgucucuacuaaaaauaccaaaaucagccaggugcaguggcaugcgccuguauucccagcuacucgggaggcugagacaggagaauugcuugagccugggagguggagguugcagugagccaagaucgcaccauugcacuccagucugggugacagagugagaccuugucucaaaacaaaaaacaauaaacaagaaaagacaaaugugaaccaagugaucacugcugaagacaaacaaacugcaaaaugcugcaaagagaggcucacccucacaagugauccaagaacugcaaaauaaaacgagauacuauuuuuaacgcuaucagauuggcaaaaaugaaagagugauccuauuuaguguuggcaagaauguagggaaaaagguguucucacagaccauuacuacaaguaggcauaaacacagcucuucucgagggcuguuuggucauaucuauuaauauuuaaugugcucaaaccuuuguguaacaaaguccauuuuucugacucaauccuacacaaauauuuguacagaaggacaggauaaaugugagucuuaaaucuucaaugcaaucuuauuuguaagagcaaaacaguuuaugcaacauaaaugucaguaagggcuaaauuaggccaauuauuuacaugcaaaaaugggauauuacagaaugaaaugaagacaugcacacauacauauacacacacacacacacagagaaauaggucucggcugggugugguggcucacaccuguaaucccaguacuuugggaggcugaggugggaagacugcuugaggccaggaguucaagacuagccuuggcaacauagcaagaccccaucccuacaaaaaaauuuuaaaaauuaaaaaauuaaccaggccgggcacaguggcucgcaccuguaaucccagcacuuggcuugggaggccaaggcaggcagaucaccugaggucaggaguucgagaccagccuagccaacacggugaacuccauuucuacuaaaaauacaaaaauuaggcaggcaugguggugcaugccuguaaucccagcuacuuacgaggcugaggcaugagaaucgugugaaccugggagacagagguugcagugagcugagaucacgcgcugcacuccagccugagcgacggagugagacuccaucucaaaaaaaaaaaaaaaauuuuuaacuggacaugguggcacacgccuguagucccagcuacuuaggaggcuaaggcaggaggauugcuugagcccuggaguucaaggcuacagugagcugugaucguaccacuguacuccagucugggcuacagagacccugucucaaaaaaaaaaacaauaagaaaauaaauaaauaaaaauaaauaggucucgaagaaugcacacaaaacuguuauacguaagugguuacacccuggcguaaagagaugcacuuuaacuuuuucuuuauauauuucagcauuguuacauuacuuuuauaauuuaaaaacuuucaaaaaaauccauacagagaaagaggaaauaaauacaguugucucucaguauccaugggggauuuguuccaggaucccccaaaauccaugaaugcucaagucccuuacauaaaaugauuuaguauuugcauauaacccuaugcacauccuccuguauacuuuaaaucaucucuagauuucucacaauacuuaauacaauguaaaugcuauguaacaguuaaggaauaaugacaagaaaaaaagucuguccauguucauuucagaugaaaccauccguuuuuuggccccugaacgcuuucaaucugcaguugguugaauccacuguuguggaacccacagauacaaggggccaacuguguaccaaacacauuagcaacacuggcuuugggacauauuuacagguggagucuuuucuuuccuuuuuacuuguuuguaccuuccaagucucuuacaauaagcacaaauccuuuccaagucucuuacaauaagcacaaauccuuucuaaauggagaaaaaacugcuaauaaaaauugcaugguauauguggaaggaaugucaaucuagauuccaaggcaucaaaucgauuacucgaaucuuguggaaguuuacauuaccucuuuuaaguguugggauuacaggugugagccacugugcccagccuacauuaccucuugaagacucaguuuccucaucuauaaaauggguuugcuauaaggaccaaagauuacauccacuaagagacaagcacaucccaggcaggugguaggggcagaguagaugaaagcuuccaucacugucuaauacauuucugaugauagauccuguugccuguaccccagguggguugacccaggcagcagccuugaagagguggcugccagggucaggauacgggaaccggcucaguccuagcacacucaugccuccccagucuuggucagcagcagcugacacccuggcuuaccuugcugggcucugccucaucugucaugaccccugucauaaugacagccucauccagggaguagagcagcccuuccacgaagugguucuccugccgcugggacucgugggugaacuuggcacagauagccuccaggccccgcacuggcucgaaacgcagcuugacguacuucuuggcagggaugaugcggaucucagcggccaccaggaaacccagcgucccacaggaccaggguacggcauagaacaggucugaguuuucggacugugagacagaauugauguguugugagcugaaaccuugggccccacauuguggcaugcagucagugggggagcaaagccugggagagucccuauucucucacucucuuguauaaacccaaacaaugagcuuuacaaacugugcuugcugggcuuuaguuuccucccugcagcuucgacaugacauggaaccuaauacugcccucugucucagggacccucacugagagagcauccuccuucucccaucuagguacagccccugacccagaggcuauucaggaaaaagcugggacuggcacugcugcccaacgacccacaauggcaggggcauugcacaagggcaggaguccaaggccaggccuugacacccuuuagugggugucaggcaguguagcuggggaacauuaaaaugccucccuucugaaccauuacuaaaauuuacaaggccuuucccaguccaucggcuugugggauccacccccgacagagcccagggagagcgcuagcacccccuuaugacaaguaaagaaacugagucucucagagcugccaugacucaccaaagucuucccagaaaagucagcugcagcaaugccagggcucaggcaagaccaccuaacuccccggccagcguuuuuccuacaacaccucaucugcuuccauaaaucaauguccaaccucaucauuuuauuguuuugacauuugucuuggacacagacaacugacuuuuccuuggccauucugauugggauucuucaguucuaguaaagaaagcucuuuugaaaaaguccagccaugucuugccuuuacuaagaggacagcccugugcagucuccacaaaaccugaaugcucuugguggugggcacagugaaugcagcagggcaggagagcuggagcaaggaggcucugcagcaggcuggcagaaaccucaggaacagcagcacuacgcucaccaauucccccuugggcccacagcuaaucacauucuccuggccauggcagugaagaugacacacuugcugcaugcugagcucuaugcaaggagcuucccauacaggaccuacuuauuccucucaaccacauauuugucagugaggaaccugggccucagagaagggaaagaauucacaaaugucagucuccuuucucugccgauaauaaauaggucaaaagacagggccccgcaagcguucaggaaagcaggaugaauugaugugaaucuugcuagggguaucucucauccaagaccagugcugccaagcugggagucuuuccuugggcccucuucugugaagugaaggagucggguggcucccugaaauacccacuucaacaggaccaacugucccucccaucccaggggucccucacaccugccaggacagauccaagguuauuuaaagugucacuccuaucccaccccuuagguaaaacgcuuuaaauguuugaaucccaguuugggugguagaaguguuucuuauuuuucuaaaacauccucucuaaucacuuuuacuuacacgauuacgugcuacauaaagacguugcagucaacaaugggccacagauaaaaugguggucucauaagauuauaauggagcugaaaaaguccuguugccuagugguaucacugcuaucacagcuauccuaaugucauacucauguguuuaugguaacacugguguaagcaaaccuacuguacugccaguuguauaaaaguauagcacauauaauuauguacacuacauaauacuugauaaugauaaaugacucugucauugguuuauguauucacuacacuacacuuuuaauuguuauuuuagaguguacucuuucugcuuauuaaaaaaaaguuaacuguaaacagcaucaggcagguccuucaggagguauuccagaagaaggcauuguugucagagaugacagcuccauguguguuauugccccugaagacuuuccagugggacaagaugcggaaguggaagcguuauugauaaucuugacucuguguaggccuaaacuaacaugcguuuaugucuugaccuuuuuucuuugagacagggucuugcucugucacccaggcuagagugcaguggcguaaucacggcucacugcaaucucugccucccaggcucaagugauccuccugcugcagccuccacaguagcuggaaauacaggaacacaucaccaugcccagcuaauuuuuguauuguuuguagaccauguuguaggccauguugcccaggcuggucucaaacugcuaagcucaagcaguccaccugccuuggccucccaaagugcugguauuacaggagugagccacugcacccagccuugugucuaaguuuuuaacaaaaaaacuuuaacaaguuaaaaaaaaaguuuaaauagaaacaagcuuauagaauaaggauauaaagaaggaaacuauuucuguacaccuguacaauguguuugcauuuuaagcuaaguguuauuacaagagucaaaaguuuuuaaaaaguuuauaaaguaaaaauguuauaguaagcuaacaguauuuauuauugaagaaagaaaauuucaaaaaauaaauuuaguguagccuaaguguacaguguuuauaaagucuacagugguguacaguaaugucccaggacuucacauucacucaccacucacucacugacucacccagagcaacuuccaguccugcaagcuccaugcaugguaaguacgcuacauagguguaccauucaucuuuuauacuguauuuuuacuguaccuuuuccaaguauagguauguuuagauacauaaauaccauuguguuacagcugccuacaguauugagcacaguaccaugcuguauaggucuguagucaaggaguaguaggcuauccaaauagccuacgugugaaguaggcuaucucaucuagguuuauguaauuacacucuuaugauguuugcacaaugacaaaauugccuacaacuuguuucuuauaacauaucccuacuguucugugacacaugacuguaccucacaguguuaagacacacagcuuugaugccaaggccugacuuccucuccagagaggcaggauggcauaaugaacggcuaagggaccugggagccugauuacuggggugugagucccagcugugugaccuauggcaaauaaucucucugagcuuuaguuuccuaucuauaaaauagggauaauaauccuucuauuauuuaauaauaaucuauaaaauagggauaauaaaccucccucauuagguuguugaaggauaacaugcaugccuuaauauauauaauggauuuacaacauugccuaagcucauauaaggggcuacacaaauuuuuguuuacagauauagacccagacugaacagguacugggaaugaagcacaccuagaggagccaccucccugaccucaggauccuuaaugcccagagcaggcuggcauggacaucucccauugcugaacucaccggagugcaucgcacaaagcugccaucagccaggaccagcucguaagcagugcagauguguuggaacaggccguacuugugggaugaugacucgaugccugugcccaugaucaagcccccugcagagacaucacacacagugucagcagggagagcuguggguacaggguuggggguggguuggagcuggggggccuccuagcaugagggagguuuggcaggcuagcagaaauggggcuguugacuuaggggagauuucccaccugucaaucuagagagcaggagagggaaggaggggcucagaugggagcaugaggguguccuuagaggaagggaguggcgagcagaccuugucaaguguacucacaccucaccucuggccagacucaaccuagaaaucugugugcauucaucuugagagggacuuuaaugaaaagggggguugaaggggugacaggaagcccugucccaugggaauaguuaaaagaacugaagguguuuucccugaagaagaagaggcuuugggggcuaugaauccuaugggaggagaagagagacuauacuuauucuguguguuccaugggggggaauuggagcaaugggaacaagucacagggaagcagauucaaaccagaaauuaaaagugccuucugauaacuugagcugcucagaaauggaacagcaggcagugaacacccugucauuggagcaggcaaguaagagacugaaugacuucugucacagauggaauagcggcaauuccaggacuagauggaggguggccaaggcccaucagcuccgguccuaggaccgugugucucuucuugcccguuaauauaggguccucacccacugugaggucaucaagcucaggcaacacggggagaguccagccaauggaggucagcagggcagucaccuggcccauggucaccaagggcuccacacggacaaucuguugacacaagaaaagagacccugggucaaaaggaggcugccaggcccaaggggagcugcugcacacagaaggugucaucucaaaccuucccaaacacucacugcagggauuccuauauagccuuuacaggcucuuucuagaacauugccuuuaauuacagggaaugugauuucuggcucucgguuagcuaguguucaaccucgcccuucaaguaucuuuauacuaaauauuugacuuaaccuuuucuaaauuacaggagaaauacucauucacuuagaagauacagcaaaagugaagaagaaaacaaaaaucacccauccuggcuggucguggugacucaugucuguaaucccagcacuuugggaggccaaggcaggugaaucaucugaguucaggaguuugagaccagccuggccaacuuggugaaacccuguuucuacuaaaaauacaaaaauuagccaggcgugguggcgggcaccuguagucccagcugcuugggaggcugaggcaggagaaucacuugaaccugggagguggagguugcagugagccgagaucgugccacugcacuccagccuaggcaacagagugagacuccgucucaaacaaacaaaaaaaaaauucacccuuccuaguucuucagaauuacuaauguuaauaacacaguguauuuacuuugguuuuuuuuuccccacacauacuguauugguacugugaaccgcaaauaucagagacaggucucaguuaauccagaaaguuuauuuugccaagauugaggaugugcgccucugauacagccucaguacguccugacaacaugugcccaaggaggcuggugcacagcuugaucuuacacauuuuagggagacagaacacaucaaucaauauauguaagaaguauagugguucuguccaggaaggcggggacaacuugaagcagggagagggcuugcggucacagguagauaagagacaaauggcugcauucuuuucaguuucugauaagccuuuccaaaggagcuaaucagaauaugcaucuaucucagugagcagagggaugacuuugaauagaaugcggaagcagguuuguccugagcaguucccagcuugacuuuucccuuaguuuaguaauuugggggccccaagauuuuccuuucacacuauuuuguauguuuuaaacacaacacacacaaaccaaaagcauaucucauuuucuguuuugccuuuuuaaaauuuaacacuauacuaugaccaucaucucuuaucauuacacauucuuggaacacaugauuuuuaauguauacaucccuuggacuucuacuucuagccgaaguggaauaacaggaaccacauuuacccugcugccugaaaaaaaaaccugacaaaauauaugaaauaagaguuuucaaugcaguggacauaaacaauuaaaguuagugaucccucagagacaggaaacaaggugagcucugaggcgggaggacugcuugaggccagggguucgagaccagccaggacaacauagcaagaccuaaaaauaaaaaaauaaaaaauuauuuuaaaaaaaggugagcucuagggauggcccauuuaacugccuggaguuaggcagugcagggagggaaacccaggugguggaguccaguggacuuucuaagaguuaaaaagauggaggugaggcugggcaugguggcucacgccuguaaucucagcacuuugggagaccgagguggguggaucaccugaggucaggaguucaagaccagcccgacaacauggcaaaaaccucccucugcuaaaaauacaaaaaauuagcugggugugguggcaagcgccuguaaucccacuuacucaggaggcugaggcaagagaaucacuugaacccauggagguugcagugagccaagacuguaccacugcacuccagccuggaugacagggcgagacucugucucaaaaaaaaaaaaaaagaggugagaguuccagaagaccaaggugaauacagugugcaggacagaguacuggagaggagagaguugcacagagaaaaaacugaagaaaugcaaaaggcguccuugggaauucaacugaguacuaaucgguaaauacacaugaggcuauuaccugaggcugaagccagggaaaaaacugccagaaaagacaacagguaauaggcuaggcaugguggcucaugccuauaaucccagcacuuugggaggccaaggcagguggaccaccugaggucaggaguuugagaccagccuggccaacaugaugaaaccccgccucugcuaaaaaaaaaaaauacaaaaaauuagcugggcgugguggugggugccuguaaucccagcuacucaggaagcugaggcaggagaaucacuugaauccgggaggcggagguugcagugacccgagauugcaccacuguacuccagccugggcaacaagagugaaacucugucucaaaaaaaaaaaaaaaaaaaaaaaaaaaaagauaauagguaauaguaccagggacucacacagggcaggagauagugucuguucccacaagccagacuagaaaacuugaugauucacagggcacuguguagaguacucaaaaugaucuugccucauaauaaacucaagauuaaauacuucccuggccccaucuaaaaaauugagacccagugggaucaaacuauuuccaaguaacuuagcugccuccuagagcaaaacucaaaauuuauaggaacauaaaaauacccagcuccccaaaagguaaaaugucagaguaucacaaugucagaauccaauagaauuuuaccaggcauacagaggcagaaaaauucaacccauaaugagaaaaaucaaucaaucaaacagacccagaacugacauagauauuagaauuagugaacagggacaucaaaacauuuauaauaacuauauucucuauauucgaaaauuuaacuagagacauuaagaauauauuaaaaagauccggccaggugcaaugccucacaccuguaaucccagugcuuugggaggccaagccaggcagaucaccugagaucaggaguugaaaccagccuagccaacauggcgaaacuccgucuacuaaaaauacaaaaaaauuagccaggcgcgguggugcgcaucuguaaucccagcuacucgggaggcugugacaggagaaucgcuggaacccaggagguggagguugcagugagccgaaaucacgccacugcacccaguccaaccuggaggacagagcaagacuccaucugaaaaaaaaaaaaaaaaaaaaaaaaaaaaaauccaaaucaaacuucuggaaaugaaaaccacaaugucugaaaugaaagauacaauggauggcacuaauagcaaauuagaaaucgcagaagaaaagauuaguuaacuuaaauacacagcaacagaaaccaaccaaaaugaaagagaggaaaaaaauuucuuuuaaaugaacagugccucaaugaccugagcuguagaacaacuugaaauggccuagcugucucuaaacuagaugagaaaaaggaggggacagaaaaacagaugaagaaauaauggcccccaaauuuccugauuugaugaaaaauuaugccaaauuccaaacaagaauuaugaauaaaacuauaccaaagcacaucauaauaaaauugcucaaaacuagugauaaaaaaucaacauacuucuaaauaauccaugggucaaagcagacaucaaaagggaaaucaaaguauucugaacugaaauaaaaagaaaacauauagaaauuugugagcugccucuaaaacagugcuuaggggaaaauuuauagcacuaaacauuuauauuagaaaaaaaaggucuaagucaaugacuuaaacuuuaaccuuaaaaaacuggaaaaagaguaaaauuaaacccaauguaagaaaagaaaugaaauaauaaagaccaaagcagaaaucaaugaaauugaaaacaacacacacacacaaagggaaaaaucaaugauaucaaagcuagcuuuugagaagaucaauaaaauucaauagccuuuagccagacuguucaggaaaaaaagagaacagaaacaaaauaccaguaucaagaacgaaagaccugacauagcuacagauaucuaaaggaaguauugugaacaacuuuaugucaauaaauuauacaacuuagugaaauggacaaauaccuuugagacacaaacuaccaaagcuaacccaagaagaaauaaauaaacugaagagcccaguaccuauuaaagaaauugaauuugugcuuaaaaacuuccuuacaaagaaaacuccaggcccagagagcuucacuuuaagguuucuauaaaaauucuacaauaaaauauaggagaaagccuuucugacauuggauaggcaaagauuuccuaaauaaaauaucaaaaugcaaaguaggccaagcgcgguggcucacgccuguaaucccagcacuuugggaggccaagguagguggaucauuugaggccaggaguucgaaaccagccugaccaauguggugaaacccccucucuauuaaaaauacaaaaauuaaccaggugugguggugugcaccuguaaucccagcuacuugggaggcugaggcacaagaauugcuugaaaccgggagauggagguugccgagaacugagauagcaccacugcacuccagccggggccacagagcuagacucugucucaaaaaacaaaaauauaaacaaacaaacaaacaaacaaacaaaacccccacaaugcauaaaagaagaaauuaacaaauugggaaaaauuaaaacuucugauuuggccaggcgugguggcucacgccuguaauucuagcacuuugggaggccaaggcaggcagaucaccugaggucaagaguuugagaccagccuggccaacauggugaaaccccgucucuacuaaaaauacaaaaaauuagcugggugugguggcacaugccuguacucccagcuacccaggaggcugaggcaggagaaucaccggaaccugggaggcggaggcugcagugaaccaagaucgugccacugcacucuagccagggcgacagagugaaacucugucucaaaaagaaaaacuaaauaaagcuucugguuuucaaaagagaagccacagacugugagaaaauauuugcaaaucaugaaucuaauaaaggauguuguuucagggucuaauauccagcaucaauaaggaacuuaaacaaacuuacaagaacaaaacaacccccauuaaaaagugaauauaaaaaggacaugaacagacacuuuucaaaagacaagcauguggccaagaagcauaugaaaaaaagcucaacauuacugauaauuaaagaaaugcaaaucaaaaccacaaugaaauaccaucugacacagucagaauggcuauuauuaaaaagucaaaaaauaacagaugcuggugaaguugcagagaaaaaggaacauuuauacacuguuggugggaguguaaauuaguucaaccaugugggagacaguguggugauuccuuaaagaccaaaaaacagaagcagcauuugacccagcaaucucauuacuggguauauauacccaaaggaauauaaaccauuguaucauaaagacacaugcauguguauguuuacugcagcacaacucacaauagcaaagacauggaaucaacuuaaaugcccaucagugguagacuggauaaagaaaaugugguacguauacaccauggaauacuaugcagccauguuccuuugcaagaacauggaugcagcuggaagccauuauccuuagcaaacuaaugcaggaacaggaaaccaaauaccgcauguucucacuuauaagugggagcuaaaugaugagaacacauggacacauacaggggaacaacagacacuggguccuaucagaggguggagggagggagaagggagaggaucaggaaaaauaacuaauagguacuaggcuuaauaccugggugaugaaauaauauguacaacaaaccccaugacacacguuuaccuauauaacaaaccuguacagguaccacuuaauuuaaaaguuuaaaagaaaaaaaaaaaagauguuuccagaauauauaagaaaaccaccugaauuuuuuuaaauuggcaaaagauuugaucaggccucaccaaagaagauauacaaauagcaaacaugcacauggaaagaucauuagucacuagggaaaugugaauuaaaauuacaaugaaaaacuacuacacaucuauuagaauggcuaaaauuaagacuaaccauaucaagucuauuacaauguggaacaagaacaacacucacgcugcugguggaaauguaaaaugcuacaaucacuuggaaaaaaaauuuggcacuuccuuaaaaaguuaaauguacacccaccuuaugaucuagccauuccauuccuagauauuugcccaagagaaaggaaggcaugugcccauacaaagacuguucacaaauguuccauuuuauuuguaauugccccaaacuggagccagccaaaauguccaucaguaggugaauggauaaaccagcugugauacauccacacaauaugugugggaauaugacucagcagugaaagagaaugaacuauugacacaccuuucaacauggaugaaucuccaaauaaagauguugagugaaagaggcuagacaaacaaaaaguacuguaugauuccauuuauauaaacucuagaaucaaacuaauuuauaguggcagaaaggucauuguuugccuaaggcuguggggggcggguaggggaagaggcagggcuaggggcuagaggaagggauuaccaaggagcaugaggagauuuuggggugugauggguauguuuguugucuugauugugguaagaguuuuaccacacuuuaaauacgucaauaaagcuauuaaaaaaaauggcacagagagauuaaguaacuuggccaaggucucacaauaauaacaaaaugccaucaaguagacauaccauauuuaaugacuacccuauuauuggauauuguguuguugucaauuagaaauaaagcugugauauaaucacucuguguuggguaucuuuauacugaagccuauuuccuuuuuccuuaagccagguuucgagaaguaaaauuacuagaugggccaaaaaguauguacauuucgaaggcuauuaaacaagaggguuuccaggaagcuuguaacaagacccaugucucucagucacuucuguagcccauuuuuuaccagcacacuuccuuaucaggaagggguaaguagauuccuuuuugccucucauuuuugcucacgaauuccccauuccugacuuccuguggaaacgcaaaggguuccccugaccuauuaugacccaucucuccccugguggcugugaggcuugaggacagcaauggcagggaguaucuucuaugacugugggcauugguccuguccacucugcaaugcccuuggcuaaaaucaucucccuaugagucacuugcaccaggggcagugccccaccugcucccagagcccggaaaagugcuacucucaccuguuucuugguguccacuuccagaauguccaucagguugaucaugauguuuuugugugucuucuuguacuucccgacacguagugagacagugagccagccagggcgccccgugcacaugaaggucuugcuacccugcuccuuccauucccgcaccugcaaccacaggacagagggugagcuggccccacugggaauccccagagcagccugcagcccugcuuucuucaagggcgagcugggaaugaugccuccaucaggcacuggagaaacagaacaaugaaaaggccugcuggcccuacccucuggcaccucccuggccagcaaggcugacagaaaagccaacauauugcuacaccacaaggcagaaugaugaaagagcuagaagagaggaucgaaguguucugaaaacauuaacucuagcugggaaguucagaaaagguuuuguaauggugauaauagcaaguauaaaaaugaggaccauuuacuggguauucccaacacacuaggcaucuacugcacacugucuuguguaauuccuacaacagucccaggaaguuacgaugacacccuuuuuucgaggauaaggaaacucaaaagcaaaauaacuuguccaaagucacacaauugguaaauggcagagcugagauucauagccaggacuguuugacuucaggacaggaaagauagauggaguugugguaacaguucacaggguaauagcuaacacguauggaggcuuaucacaugccaaggccuguuuaaacauuuguauauguuaacucaugcaucacuuugaggggaagaggaggagcagggaaggaccaccaagccaauggaaggaagagguuuuacaaaaccucuaagguaagugaccagagcacaaaacacagaacaaauggcccauggaugacaagcccaucagaaaugcaggaggaaguguuucuuuucugcugagauagacaagugcaggggggguggauauuugucauuuugaccugugaccauccauuuccucuucauccacuucuaacaauccccaucuuccuuugguccaagugagacugauucuacuccccuaccccaggagguggguacaugacugaggacugauucuauacuucuggccagagacagauuaaugacaucucauuaagucaagccaaugagaccaguuccaggacagccacucucucuuuacuggggucgcuaagccgguuggauaugagccagaaacuguuggggccucugcagggagagaggcuccagagaaugaagucaaccuagaaaagcagggccaacagauggcagagggauggacagauggagaugggggacagaggauccuggauccagccaugccugauccaguuguacucccagacuuuucaggaccugagccaauaaaaucccuuuuugcucaagucaguuugaauugagcuucuuucacuugcaaccaaaagucuggucaaauacuggucaggucuccuggagaaggcugcacuggagcuggcuaggcaaacagcucaacacggggaaggacuuuucuuugaucagaggccagggcagguauuaaggaagagauuccugugauuugggggaaaagggaugauagguaggauuccacgaccaaccaggucucgucccugccugaaucugcagccacggaguuugacacaagcccagagaugggagggagugauuaggggugcugcacugaagcuggaggccaaacagagagcccagaaaaaagggcaacuaggucagacagcuauuacaagccaggugugaggcaacugaaccagaccuauaggggggaagggaaagccugggaaagaagaaaugucagaguucaggcucugaaaucgagcuaaccuagguucuagccccauuuacugacuagucuuccugagcacaugacucacacucugaaacucaauuuucccuguuuguaagauaggcacaagaucuaccaggguugcugugaggauggcaauggcacauggcaggucugggguagaggcuaguccagcugggccccuguuuuccugcucacagugaaucuuguggcuuagccaagauuaauaggcacucgcuaggcuguuuugagccaggcccuaugggccacaggcgagucacauaacagucccugcauucuaggagcucacagucugacaggggagacaagcagguaaauggagaauuugaacucgagaaaagagcuaggaaacagggugcagguggggagggaggacacgcagaggcucuggagccaugacugugaccagcaaaauccagagcuacagggcaaagcacuuccagacacugcguucucccaccaggccccaggucuuaugccucaugggaacgucucuccgcauccaucuucaugcucuugccugaagcacccagcgcggagcaagcagaauauggaggcugcuacaccuacggaaggguggcagcaggaaacagaagcucucugcaaccugaugccaacaagagaggaacauaaagagaagcagagggagucaagaaacugcccaagucccuggaugcagaggaggcuccacugugagccacagcaggucacaggcuccgugggugccugaggaacugagagauggaccgacugccuuugucaaggagugagcccuccgucagcagaggcugugagguucuucccucccgcuucugggcuggguucuaccuucuugcuuuagucuucuauccuaaacccaaucaaaagcgucuugcuguacaaaauaaaguccaaacucggccuuggcaucaaggccccucuccagccuagcaccaaacggacuuuuccgacguucucccgccccugcccugcacuugucggcuucccagcauuugcucacaccagucccuccacccacacaccuucccccaaucauuucccauacuucccaaucucuagacccagcuccaccucccggaagccuuuccuucucugaaaugcuugggccgggugagaguuaccugagugcuucgcaccucccccucuuccccuucuucaucucccuccagguacccgcauaugcccugcacacagugggcacuuugccuguucuguucccccgcccccaucacauuuuuguuucguuccaaccccucuccaacgccagcuccccacccccccaggaaguccuggccgcccccgcaccgcagcucccgucgccaccucgcgucccgcuauccccgcgcacgccgccuccggcccugagucccggccgcacccggcgccgcucaccugcuucuggaugucccgcacgcgcugcucgugcaggcgcggagcgcugcugagcuugaacaccacccaggcgcgcacguaguaguagauaucgaagauaagcgagagcggcaggaggaagaggcacacgaacacccagcgcugguggaugagcacgaacuccagccccuucaggcgcacccacagcaggaagagcagcgcgcacacggccagcgacacggcgggcuccauggugcggcgccgcgcgguaagcgcugcggguucgcgccuccugucacugccgccagcuccgcgccuggcccgcucugcgccuguagcccacagcccggggagcccgggaucgcccgccgccucgc

SEQ ID NO: 14043 - RNA, 18229 nt, Homo sapiens
ucauaccaaacacaggcuucagugcaacgcaagggcucuuuauugucagcgagagcagcaggccaaacgggcacugaggcuccacggggcccaggcccucuuccguggaagagaggcaagagggguuucaggauucagagggguccuccgcucacgcagcaccaugcaaauauagagcuaaaaacuuucugaaugucucuggcuugaaaccaacugggccaacagguuccuggaaagaacacgguucauuaggauccugcuacuagguuuaacggcagcaauuaaaacaaagauuggauugaaguaaaucuucagugccuggacaguaacuuucuuuuucugacaucgucucucucucggacuaagaaggggcauugaggggcuguagccugggaggacaggaagcauucccagcccccuucagccaaaacaacuguugacgcugcucugcucccgaggcccucucacuuccaccaccaggaaugaugguugaaaugggcugcugcccucucuaaucccagggacaaucaucccucacccauuccacacacauuuauugggcaccugcuugcuuucugcugcgccuauauccugugcuggaaacagacacagcaguaacuugacucugguuccuguccucaaggagcuuaccgucagcuguucaaauagugaaaaugaaaggagacagaccccacugcagaaguaggaaaaagaagaaagcaggaagaaaugacugacuugccgacauuuauacauggaagggugagcagaauggggcagaaagaaaaagaaaaggaaggagacuucagaaagcccagcacaugcaauagaagaaguagaaaugaaggcaggaagggcaagaucgggcuggagcccagggcgaaugcugagggguggagcggcaggagaugaggcugcagaggugaggagaagcugucuccaaaccacaacaggcccagcccugagucaguauccuggaagggagaggcugagggaagagaaccugaagacacagagucaggagggaaaaccugacuaagagcagagagcacggagguggcuggugugacuaugcaggugaacugagggugucuggggccaaagcaaagggcacagacccagcaggcauuucagguggaaacagcacugagagcugcuggagaaccaguucaagaacggaccugcugagaauguucaaaggcucagcgacuccauuuagcaagcccacacucaggccuguguggggccugguuggucccagagcaggcaguaccccuacuccgcuuucgcaguccugacccugcuguaggucucuccagggugcauauuacugccugaugcucuaucaggaauuuauuuagauacugcuacugcccacuacacagagagcaggccuggaccccgucagcugagcaguggggugcagcacaauggugccgcaggaggaacuccguaucugugggaugaaacgaaugcauccccagacccugcccucaaggaucuaggagcuuggaguucuguuugguggaggaaaaaaaacaugugaagagguucuacgcacagcaaugugaucgugcucugaugggggaauacggaggccagggcagcccaccugaggcacuuaagugaggguugggauggggacggugguggucagaaguuucccaaaauaagaaacacuuaugcuaaaccuggaaggacaaguggaggauagccugacaaacaguaauggggaggggagaaggcaagaagccucccagacaaaaggagcagcaccuacaaaggccagagcuaaugaagccgcagagcacccugggagcugcgaggagcuggauuggcuggagggugcaaagggaagcaggagcuggaguggagcacugggcagggccuuagguaggggcgggacugaaggaguccuccaggcagagaucccgggugggaaguccccagggccagggcucuccucacagagcaccccagcaaucccaccugaggcucacaccagguaggaggaggcauggcccuccugggucaggcaggagauggcucaacuuaccacaaccacucucuuuuugaucacugggagacaccaaaaaugcugauagaggagcuggucugaguccacccaggccaaauucuugacacccucguuacaguccaggucugugguauucaguugaaacacuaggaaauggaagacacguccauccgugcccacgcucugcaccaccacgggcugcuccaagaccuuggcaucauucugagaggaaaaggggacaaggaaaacaaaucagaagcuguggaguguaaggaacagcacggcccaggcagcuucuaguucuucccuuuacaacguccaccuacguccacugaauggcuucucuuugggacaauuaaaauagaaugaggaguucagggcacuguccagggccgggccuuccuucacccaggcuggcugugccucauggccccagggugccugcucuucuauuugagcacaucaaaguaauaguuccugccacugagaggcgauuuccaggcaagccagaguucaggcaggccagcugggggguuaaugacagaaaucccucaaacuccuggcguuacuugauaaggaccacagugacaucagcuaucaaaugugaauccggagggucaacggauagauauaaucucauucaguucucaccccauuugacagaugaggaaacugagacucagugagguaaagugacuugccggaagucacgaagaugggugguguagaacccaaacaggcucaugccagaccacacccuucccccacgccccugccuugcuucuaagggccuggcagucacauucacugggcuucaugcugacgcugcaacucagcacgggccauguuucuggaguauccacuccagccaugccagcgccaggauuucaccagucaacuccugcuacugaucucuucuaguuacugccacuugguaauaguaguaacaccuaaaaucauuuacugaaggccucucaggugccaggcaucuugccaguuuuacaucaggucaccucuacucucauaaaucuagagguauauucccacuaacagauaaggaaacugagguucagagaggugguauaauuugcuccaggucacccauggggaucagacuccaugcuauuaagucacugaaagcccuguuguucugguuuaauccuggugucccaguguaucuaauagcggcaccucauuauucucaauggugucccaguuugggagauaaaucauauggugaccugcugagacuuugcagcaauccaguuuggugacugcuacucacugaacaaagauccaacaggcaggccccaugaagcaggccauccuugauucaaaaaugcugccuguguucaccccacuggggcugaaucuggcauuaggaauaccuaaugucagaccucagugugggccacacuggggcuguuggccuuagaaauaccuguucuuagcugcaugaaaaauaaauaaaaagaaaaguaccuguaaguguuagccgagaauucuguauugacucuuaucucccucuacagaucaauaaaacugcagguaguacauaaauuucucagcaauuuuaccuuuuacauggaggcucuucccauaauugcucaacuucacauccccaggaauaauuugugccuggaggggcugaaggaggccuccacuccuacccaacugggugguaauuaguuguaucguugcuacccagacucugauggcaauagcuggcacagaggcuacagcgagucugcaggccugggaccaggguugugacuaucucugccuccuucuccugccugaguugggaguagcacauccuucaaaacuggagagaucauguuccaagcuuugcuuccccacucauuagcugugggaucuuggacaaguuaccuaaucuuucggagccuucaggaaguauauagucagagaaugggaauaaagacaauuguccuaggauuggaaagacacaaggucacauaaagaucugacagcuacuaauuucuuagcuguguauccuugggcaaguuccuuagccucccugagccucaguuucaccaucuauaaaaugaagcuaauagcaucugccacaugggguuaaaaaacuacaaggauuaaauaaugccauguucugaaauuucaguucagugguugccuuuucuuuuuucuuuuuuuuccuuugaggcacagucucacucugucacccaggcuggaguguaguggugcaaucuuucagcucacugcagccuccgccuccuggguuaaagcaacauucaugccucagccucccgaguagcugggauuacacgugcaugccaccacacccagcuaaucuuuguauuuuuaguagagaugggguuucgccauguuggccaggcuggucucgaacuccuggccucaaguaauccucccaccuuggccucccaaagugcugggauuacagguaugcaccaucacacccagcuaaucuuuguguuuuuaguagagaugggguuuugccauguuggccaggcuggucucgaacuccuggccucaagugauccuccuaccucggcuucccaaagugcugggauuacaggcgugagccaccgcacccggccaguucagugguuuuuaaacucgagcuuguagcagcauaacuggggggcuuguuaaaacgcugaucgcugggccccaaccccaggguuucugauucagcaggucugggguaggucugagaguaugccuuuucaacaaguucccagaugaugcuucugcugcuaauccaagacuauauuuuacgaacgaaccacugauuuuuuuuuuuaauaaaaacccuaaauaaaugugugguaugcagcaggugcucaaucugggcaaggcccauuccacucccuauccauuuggcuaaccauggcucuccaacucccccuaggccaaauaagaugggaaacaguacuuuuccucauuccuccucuagaaaagacucaggcucuaaccaagaccuggggguccagcaguggcucucaugaacuaccccccaacacaccccaaaccagggaucuggugucccaggccugcuugagggcucccauauagcccuccccucccuggaggccuuugcucccagagccaggcuuuccccaucuugggacagcucucugugacaaguuaguuuguauucuauaccaucuaggucccugaaaccuccucuuaggaucaggggauaacaccaacgaguaucuuggguccccagcacccauccugaguuggcaggcagggcuuggccaucucuauugcuccacuuccuccugccugugcuccacuucugccacuacaagaacagaggcagcaugcugcagcacaaacaacugaagacuucagaguggggcagaccuagcugcaguccuaucuccaccacuuagugcuguguaaugcugauaagcugcauggccucccuguaauucuauggcauagcuuagaaaguggggacuucaguaaaaacaugugggcuacugugaucaagugagcuacuuaggugaagcacaggcagucacccccuagugauguuggcucaucuccacagggugggcugaaguacuccucccuaaaacuccucagucaagaaaucaguuccccuauaucccuuuucuuccucugagcaguaaccuuaagggaggagaccaacaccacguaaagcaacucaguggucuucuccaccuacauaccccauagaggagccgggccugagccagggcacugccaaaagcaaacaggaucaucuuggcccgcagcugaucugguugaaggcgguguggucguaaauuggcuuuguccaguaaguacaggguauggggauagggguaaggauagccuuccuggaauccugcaagagacacaauuauguggagggguggaaaggauucaucagccugccacaaagccucaggaaagucaccucgccuuagcccagggacaggugcuacagagagacucaacaaagguggauacuaucacuauagcucgggggcuggcaaacuucagcuugcuggccaaaucuggccugcuaccuauuuuuguaaauaacauuuucucuggagcacaaccacauucacucauuuacguaugacuauuggguagcugugacagagaccauauguggccuguaacaccuaaaauauuuacuguuuugacucuucacagaaaaugccugccaaccuguuauaggugcugccugcaagcuaguucuaacuccacaccuuucucucucauucuggcacacagaugacagugauguuaggagaaggagaacuugaaaucugugguaauuauucaaaagaaagcaagucauuugcaaaauuuacuacuuuaauauuagugacaaaugacuugccucaucauucacaacugacccacacaacacuggugcugagaaucaaaguuuaguacuuguucuuuucagccaugaccuugucaagucaugauucucuucucccgcauggcuacgaguaacucuugguaggcugggaacuucuagaauaagugaucuggaucacugaauauaggugaaaagaagaaagaaagacgucgggaaggcugggcaugguggcucaugccgguaaucccagcacuuugggaggcugaggcaagcagaucgccugggcccaggaguuuuagaccagccuagaaaacauaauaagacccuaucucuaaaaagaauacaaaaauuagccaggugugguagcacaugccuguggucccggcuacucaggaggcugagguaggaggauugcuugagccugggaggucaaggcugcagugagcaacaauugugcuacuucacuccagccugagugacagacugagagacccugucucagggaaagaaaaaaaaaagaggcuaggaaaauaauguaggcucugaaaagccuagaggaggcauggcucuccugcauguuugguccuucagccugcucagguauucggcacagguaaauaucuagaacucacucugugccaagcuguaagacagguaccaggaauggaggccaagcagagccugccacugccuuugaggagcucacaguuuagaggggagacagacaggaaaacugaccauaucuguauggagggacaugucaagaugugagguaagucaggggcugugggaggacagccggaaggacccugaugagacuggaagaucccaaagcauuucugagagaaagucauuccuaagaugaacugugaaagaugacaaguuagcaagcugaagaccaaaagggaagaauggccaagagcuucagcagaaggagaggaagugacaaggcauggaggugagagagggcaugaugaauuuagcacagucacaagaaacagggcaggcaggggaggaggcaaagaugaggcuggggauggggcagagaccagaugugaaggcccuuucacgauaagcaaaggaguuccaacuuuaccaacaggccacggggaggugggcaugaagacagaugggaugaaagugguguuggggaaaggcuacucuggaauuaugaacuagauggaccagagagaaaauaguguggggucagacagaccagcugggaggcuguggcaauaggcuagguaaggacaguaaagacugaccuagguuguggcuaugacaaugaagggguuuaugaggaagaugcuacagcucaugaggacacaguggauggcaggaagugggggccagccuagucucacucccuugugaugucuugccugacggaguacaugguggucccuugcuugauggaguuuggauuaauggccccauucaaugucuauggggcuuccucaguuccuaaaggggguuggccagaguuuacaagguaaacagaaaaugggugccuuucaugggaccuaugaauaaagaaaaagccuuggugaaaagccccucaaacgcccaaugauacaguuugcugaagaaaaaaaaaagucccucaagccacucugauguaauagaguuacuucuccaagguaaaaaguaaaguuagucuuugagcaaaucacuuaacuucccugagcugcaguuucuuugccuaugaaauggagauaauaguacuugucucauggggcugccacauggauccuaggagauagguaauacacacgaggugccuagcaccuagcaaguucuuaguauauccuuucccuccagaaaaagcauguccuucuccuccacacugccuaaaaguccaagacauugauccuuaccugugucauuuuucacaucauaaauauugcauucaugaagaucgaugaugggugauaugggguagaaggucucuagaacaugauucuuaguagcuucaaucuccucucuggaggcgauggugggcagaggauccuuagugcucagucgggcuccaccagaaccacggacuugaaggagaagagacucuaaaagggagaaaaaugguuacucuaaccugguacuaaaggcuuucgcagcuaggcgcaguagcucaugccuauaaucccagcacuuugggaggccaaggcagguggaucauuggaagccaggaguucuaggucagccugggcaacaugacaaagccccaucucuacuaaaaaauacaaaaaauuggccaggcaugguaggcucacgccuguaaucccagcacuuugggaggcugaggcggguggaucacgaggucaggauaucaagaccauccuggcuaacgcggugaaacccagucucuacuaaaaacacaaaaaauuagccgggcaugguggcuggcaccuguagucccagcuacucgggaggcugaggcgggagaauggcaugaaccugggaggcggagcuugcagugagcugagaugacggcacugcacuccagccugggugacagagugaaacugucucaaaaaacuuaaaaaaaaaaaaaaaaaaaauuaaagacuuucucaauccugcaaagucuaaagccuucauccucccaugugccucaagucauuuauagcauuucuugaucagccuaaucacagaacacaaaacuuugaguuaggauguuaauccugggaucccuaagaggggaugaaccaaugcacucuucuuccuguguucccuuccuaguaaacccugagggcugauggucucuggggagcgaagccugccccauccagaucuuccugagcaccugcuguaaccuggggaaccagagaugugugagaguuacucucuccucucaaggagcccaccagguagugagugcuacagugaaaaggaugaaacauauucaaaaauuguacagguggggaaaacugaacuucucugggaaugggaaguucccugaaagaagcaaugccuuaaaaugacaucuggaaggauggauaagagcagagauucucaacugcagcacuauucacauuuggaucagauaacucuuuggcggaguggggggagggaauguccuguguacugugggauguuuagcagcauccuggcuucuacuuacuagaugccauuuuaacucccuccccaucccaacuccccacaccccauccacaucaugucaaagaugucuccacacacugccaaauguucuccagagggaaaaacugucccuaguugaaaaccacuggguaagagcuugccaggcaaagaaagggggaaaagcacucuaguuaaggaggaauaaugugcaaaagucaggugcaggcaacuccguggcagaauuuaaggagagaaauccaggugacuagaguaggauacagcagggaagaagugauggagagagagaggagcacugagacuagaguuagagaggagauucuuuuuuuuuuuuuuuuuuuuugagacggagucuugcucugucgcccaggcuggagugcaguggcgcaaucucagcucacugcaagcuccgccuuccggguucacgccauucucccgccucagccucccgaguagcugggacuaugggugcccaucaccaugcccggcuaauuuuuuuguuuuuguauuuuuaguagagaccggguuucaccgugauagccaggauggucuugaucuccugaccucaugauccacccaccuuggccucccaaagugcugggauuacaggaaugagccaccgcacccagccaaggcagaggagauucuuaaacuuaggaaaggggccagauuguccuuaacaacugagagugagaaaacccuagccagucaaacagccucacugaagucggauuagcauauaugcuacaugcagacguaggugacaagaggaaaacaaacucacaucugacucaucagcaagccagccauugugaacaugcauagaugcccuucacagagguccccacaggaggucacaugcuaccaccagacaaaaugugccuggaaaaacaccuugagaauggccuccugaggaguauccacggaggcaaaucuuucucagaaggugcuuggguuuucagaaauagccacagugugaugguaauggaucaaggccgguuuucuuguaugucuaagaauugguuuggucaacagcacugucauuaauuagcauguggccucccuuacuggauagguaagaaagggauacuacaucuggggguggauaaacucugaucugucacaccucaagaauaguuuucuaaaguauuuccuguuuccucacauauaaucugcaagaaaaauaaaugugcauggaccucucuuaaccuuggguuuuccauucuccccacagaccacucuugugugguuucugauucaauucccuccauaucccuccuccagugacagcuccaaaugggguaguuuaauuagagguaauacuugaugaugggccaaguacuccucuauuaaugagguucacuaauuuccuuaguggugucauuaccucugcaaagcugacucauugccaggaagucuauacacaaauccugaccaagcagauguccugaaaucccagaucauuccguagcugguuuuccugcuccaggauuccaccaguuagaacaccuguguucucugaacaucccugccugaaacaccaacaguagguauaugcauuuacacaucccuucagucagcaccuacuguguaccaugaacuguuagacacuguggacaaugugaguaagauauggucccagccauuaggaguucaguugagugggguagacagaaccgacaguagauacugacaauacaguguaaucugugcuaugauggcagaaugggcauaaagaacacagaggaggaaaagauaccccagccuggauucacagagaaggggggcuugagugaagucuugcagauaaggagaauuugguuaaaugaagaaagcagcgggccaagcacgguggcucacgccuguauucccgcaguuuggaaggccaaggcggguggauugccugaggucaggaguucaagaccagcccggccaaaauagugaaaccccgucucuacuaaaaauacacacacacacacacacacaaaaauuagcugggcaugguggcggguaccuguaaucccagcuacuugagaggcugagacaggagaaucacuugaacccaggaugcggagguugcagugagcugacgccacugcacuccagcccaggcaacaagagcaaaacuccaucuggaaaaaaaaaaaaaagaaaagaaaagaaagcagaaaagaguauucuaggccgggaacaguggcucaugucuguaaucccagcacuuuaggaggucaagaugggcagaucacuugaggccaggaguucgagaccagccuggccaacauggugaaaccccaucuccaauaaaaauacaaaaauuagcugggugugguggcauaugcccauaaccccaguuacucaggaggcugaggcacaagaauugcuugaacccgggaggcagagguugcagugagcugagauugcaccacuguacuccagccugggcgacacagcaagacucugucucaaaaaauaaacaaacaggccgggcguuguggcucacaccuguaaucccagcacuuugggaggccgaggcaggcggaucaggaggucaggagaucgagaccauccuggcuaacauggugaaaccuugucucuacuaaaaauacaaaaaauuagcugggcgugguggcgggcgccuguagucccagcuacucgggaggcugaggcagaagaauggcgugaacccgggagguggagcuugcaguaagcugagauugccccacugcacuccagccugggugacagagcgagacuccgucucaaaaaaauaaauaaauaaaauaaauaaauaaauaaauaaacaaaaauaaaaaucaaacaaaaaagaguauuccagacagaaugcacagcaugugcaaaggcacauggugugaaagcuugaugcuaaaaagcugaaaguggcuaauuuagggaugggguggggggcaguaaagcaggagauaagacuagaaagacuaaguggcgaccaaaucaugagggcugguaacccacaauaaaugguuuacacuacuaggagacagugaaggaucugaaacagggcagggacauaaagacuugcacuuuagaaagaucacucuagcaggccaugaugaaaauggauuuggaagacgagagagguguaagugagguaagaagacuauugcaauagaauaugagcauugugagggcggaggcuacaugugcuuuauuauaaauuuccuuaccuucaacauuuaggcacuucccaagcacauccuaagcacucaauagauauggcugacuguuaaugguugaauuaacgucuuagaaagugauuaaaaacaaaaaugguugggcuauggcuaaugauacugagggugugucugagccuacaaaacgagaccacgaaugaugggaguaaggaucgguauuugggggcagggggaugggagcugguggugggguuaagaguagaaaggcaaaaaaaacagaccaaggcuuucugguguacaagaugaccaaccucgguuccagguagcagaaaacguggaguuuuggacacagauccuccuggccagagaaggaugcuugagaaucugagauuuacacagcuguauuagguuguccacgaugaccgggcuugaagacaaaaagagacauuuggggacuuaaagcaacaggucgacucgaagauccauuaguaggaaaucuucuuuacuugggggaacuuaccaguaggucucucucuuggggauuuccucaguggucugccagagacgggcgugagagaucacauucagaacgcacucgucuugguucucuaugugguuccuuggaucaucaacaaggcuaagcacuuucucgggaaggccuucuauuaacuuggucuuggugagccagagggccugcuuuacaccuuugagguaauuagccacaaaaauaaagaaggaaagaaaaagauucaggaagagaugcuuacaccugccagguagcaucuuaguaaaaaggcugccucaagugagaaacuggauuuguucugugacaccugaggggauagaaccaaaagugaagaccagaagcuaagaaagucagauuucaacucaccuucaggaaugaccaccuacuucaggaugguuaauaggugacugagguggugagcgccugccacuagaggaauucacacaguggcuaagaccucugagauaauauggcugaaugcugcaagcaggggauagacccuaggcuaugguacuaaauugauggaugccaaccuuucauuuaagauccuuucuaauaacccacaccccagcccuaacuaccaaauauagucuaugucuaccaaauauaccucauuauuauuaggugugggucuaggcauaagcccaugcugccuucucaagggaaaggaaccuuuggaaauaacugggaauaacuuucggauuuucaugaauauuuuaaggagcugaaccucucuggccuuaguauagaaagguugggcuuuuccuggauacagaacuguuuugucuuuuuuuuuuuuugagacaaagucucgcucugucgcccaggcugacugggcgacaugaugacugagcagcaugaucucggcucaccacaaccuccgcuucccagguucaagcgauucuccugccucagcuucucaaguagcuggauuacaagcauaaaccacagcacccaacuaauuuuuguauuuuuaguagagacaggguuucaccauguuguccacgcuggucucgaacuccugaccugaaguaaucugccugccuaggccucccaaagugcugggauuauaggcauuagccacugugccuggcuuguuuugucuuauagacaugguaaauuguguaacugaaaauauuuuucuguauaccagaggucaacaaacauuuucucaaagggccaaauaguaaauauuuucagcuucugggucacagucucucucacaacuacucaacucugcuagagcacaaaagcagcaauaggcaauaauuaacaagugugcaugguuuuguuccaauaaaacuucauuuauaaaaacaagcagcugaccuaguuagcugacccuagcuauguaccauuuguugauugcuagcaagcucagggccagguuuggggcuucccuuuagaaugcagaaccuuaggccgggcaugguggcucaugccuguaaucccagcacuuugggaggcugaggugggcagaucacuugaggucaggaguuugagaccagccuggccaacaugguaaaaccccgucucuacuaaaaauacaaaaaaauuagcugggugugguggugcuugcccgaagucccagcuaccugggaggcugaggcaggagaaucacuugaaccugggaggcagaggcuacaguaagccaagaucacgccacugcacuccagcuagggcaacagagcaagacuccaccucaaaaaaaaaaaaaaaaaaaaaaaaguaaaugaaguagaaccucacaucaugaauuuuuguuguauuaucuguuuuauuuuuccuuuguacugauccccucgccuguuuuuuaauuuaaucugguuguguuauaaauaagcugcccaaaauacuuugcaagaaaagauggcguauacguagccaggcccaguggcucaugccuauaaucccaguaacucaggaggugggaggaugacuugagcccaggaggucaaggcugcagugagcugugaucacaccauugcacugcagccugggugacagagacccugucucuaaaauaaauaaauaaauaaaagaugguguauaugcaaacuaaaauagauucaguuuagccugauagucuuuaaacauuaaagaaacuuagcuacucucagugggaugggcuguggugccaggcaaagaccucccuagcuucacuuuccccaaauuuggcuucucuaagggaggaacaugcauagaccuagguaucuaaguucuggaucaaguaaacacaccaguccucuauuuucaaaugaaaagucaauacuauauucuucucaaugaucaugcccaaaaauuaacagaaggcugcuggcugccuugguuggcagaccacccaucucagcuggaagaacacuucucugacucaaggucauaucuucauuugaaaauugugucugggccagacacaguggcucauaccuauaaccucagcacucugggaggcugaaguagguagauugcuuugagaccagccuggccaaugugguguaaccccaucucuacaaaagaaauacaaaaaauuagccaggcaugacagcaugugccuguaaucccagcuacuuaggaggcuuagguggaaggauagauuaggccugggagguagagguugcagugagauugugccacugcacuccagccugagugucagagcaagauucugucgaaagaaaaaaaaagagagagagagagacagagagaaaggaaggaaggaaagagaccaugucucggauggaagggagcuuaagauacuuugggggagacacccucaggcaauuucucuugugguaacaaaugaaaggcacuaaguacaauaagacuuuucacuuuaagauccauaagacaucacaccaggaauaugaauauaaauguuuagaaauguaacuuuugggcaggggcaguggcucacaccuauaaucccagcacuuugggaggccgaggcaggaggaucacuugagucccagauuuugagaccagccugcgcaacauggugagaccuccucuucacaaauaauuaaaaaacuagccgggagugguggcaugcgccuguggucccagcuacucaggaagcugaggugggagaucacuugaacuuugguggucaaggcugcagugaggcacgaucaugccacuguacucuggccugggcaacacagcaagaugcugucucaaaaaaaaaaaaaaaaguaacuucuggauuuuguggugcagcagaaagagcccuggacugggagucagauaaacuaaguuuuagcucugacaccgccacuguuccuuaaacuugacaauagauaaaauauuaagacuuuauguucuauuugcauaugaaaaauaggugauaauuagagcugccauuuacugaaagucaccaucuacccugugccaggagcuuuaccugcaaguuagaugggauuucauaaaaugaaaaaugaaacucagagacuaaggaauuugcuccaacucacauacuuuguaagugacaaggcuaggaggagaaucugaguaugucuacccuaaagaacaucaccucucuccauuaccccaaauggcuucucuagcccuguauccugcagaguuuuauuacagccuacagaaccucucugugagcagcaaaaacauaggauacacaauacauuuucagccuaggcaaacgaauguaaucuuaacgucuaaaauacugcuaaugcauucauccacuugguauuguuaccagggucacucaaggaugccaagucuugugagauccuucccacuaccuuguaaggacacuggaaguguuuaaaggcuugaaaaucagcuuucaggaauggaauugagaagcuuaagaggcuggccaauugacuuaaguuuucucaaaccuaggauuuauucucuggcuuagucccccaaucuugccagauuugccuuuuuuuuccccccuaaucacuccuuggaaaauacuguuuccacuuaccucaaccauucuguuuucaagaccugccccaucccuauccugauuugaggaagauggaagaauggagaaagggauaaacaagcuucuccauggacucuggaaaauaauuucugguacuguucuagauagacaggcugguuuuggcaaagucauuuugaucugucccuagugagagugacagaggaguagucaugggcuuaagaggugacaggccuggagauuaaacauccugcugucuccacuauaaacucucuccaacuacuuuuaaaauauacaguuaaucuccagaaugucagaccuggaaaggucaauguggacuguccagucaaaaccauucacuucccaggaaauagaggcccaggauggccagccauuugcccaaagucaaagagagagagccagggcuaggccuagaaagcagcucuuuucaugcugacacgcaaacucucuauuacuccugcacagaggcccagcuccuuacaacucaauucuaacaacccucagaagacgggaaucacuacggccccauuucgcagacgaagaaaccaagacccacagaguuucaaugucuugcccaaagccacagagggucggggucggugcugguuagaggaacacggucccuugccgcccguccuggggccucacccucgagaaggcggcaacgguggugaaagauauagcaggccuggucuuuguacagcggaugcucgugaagagggggcgagcgguagaaccuuggguccuuguagccgcggucccagggcggaaagaucggccgcgccagccagggcacgaagugcaucuuccccgcaaaggugaugggcuccaguccagggaucucguacacccuauccaggggaggaggcuccgacuuccgcguggagcgcacgccccacucauacgccccgcgucucggggccccgaagcccccaaggccgagcugcccggagccagcuagcgcccgccuugcgggcccggacgccaaugccauaccgaucugauagccucaagaccuccaccuggaccccgccauguugccgcgcgcagggccugcugggaacga

SEQ ID NO: 14044 - RNA, 21939 nt, Homo sapiens
ccggccccgccuucgugccggggcccgcgcacgcgcgccuccccggcccagccuugcucccgcccccgccggucccgcggucccacggcgccugguugcccccagcccccucccuccucccaccuucacugugucccacccuuccuagcuuugugcccggggugcugagcccuuccccgucagccgggccgcgggaggagggagccgucaccgaggagcugccgcucgcugccccgggcaggggcacagguagguggcggccgcgggccgggccgcucgcggggccccggguugcgugugggagcgggggcgggguguuagggaggggcggggugggggaggggacgccccagagggacggcggggcgcggguugaggggaggaugagguauacuggugggggcgauggguuuaaggguggcguaggggugcgggggcaggcuauggggacgugugagaauugggguucggggccugggugggacagggagcaggauuagccuggguggacucggggagaggcaugcuuggggagagagcgggaagaaggaagggggaagggaaugggauuuuagggguucaaggaggaaacgagauaggauaggaauagagaggguggggucuugggggcagggaagaaaaguuggggguguggaaugccaaguuggggauagugaggcgugaaggaagagggucuugaagauugagaacagaaggcaaggaaagggauggagagauugggguccuaggagagggaagccccuagagugggaagaagggaagaauagauggugaaggagaggagugggggguggaggaguguggggaaggaaggggaggcaggugaagguugggagaucggagguuggaagguugggucugugggacagcaagccaccuuucaccaggggcucggaagggcuggaagggucugaagguugaaaggggcaggagagcuggggugggcgaagggagugggguuaggauuuuuggugugagaagcgcuagaauugguaagagugucacguugugggagagacuggcauguucuuggagggaaguagggagccugaaaggguaugggugagaaggcagguaggaaagugcauauuauaggaaaaaaguagugaggaaaguugaaaauugaagaauggggacacacagaacaaugaagguggauuguugguuauuggugguuuagaacuacccauaguuuaguuucuguuuagguuuuuauguuagaaauuuucccaagaauacugcauuuucagauaaaccaaaagugucugcagccuugggaugaaggccauggguuggcagauguucuccugguauauggauguagcucauuuugggccuggcugagggaagaagggaggccucguuguaaauguccuggcuguguucccacuagcucuuuccccagaugugcacuguuuuuuuguuugcuuuuguuuuuuaaucuuauccccacccccuccccccaggcuucauccagugaauacuagagggaucgaacaggugggugagauuaauuuuucacauuuuuuuuauccuuaagguugaugucauauuuuuagucuugagaaacagcaucaugccaaggaaagagcuugagcuuuggaguaaugcggcccugagauugaauucuggcucugccacuuauuagcucuguucuagaguaaguuauuuuauuuccgugggucucuuugucuauuaaaaggcaauacugaccucauaggaucauuaaagauuacaugagaucauuuuauauaguaccuaacacagugcuuggcaacugguaggugcuuaauaaaugguagccaucauccaguaucauuaaacaucauaguuacugcuacaacuuguuauucuuaggggauuuuuaucuuacuuuaucuacugaaguuagauauuuucuucuucuucucuucaaauuagccguagauucagcucacaauuuuacccugugggcucccugacaaucccaguccaccugacuggcauagucaugcuuuuugcuugggaaacuggauucaaggucuaaaaaacugucauguguaguuaucaauaauuuugucuggccuuuuucaagaaagcuguauagaacugaguuuuuaauguaauacagcuguguuucauucauuugaugaaaugguacacuucgugguaacuuuggcucgcuuguggugaccaaaugcuagaacauacaugauuguaauauuuuucuaugcugucguauggguuacaaagcugccuuccuguagcaggcugggaaacuaucaaaaugucgcuguuacucuugauccaauauauaauacagcuacuacgaucuacauugggcauuguuauuguuguagugacuaaguauuuuaauuuuucaauuuggauggaguuuucaccaugguuuagaacaggcccugucuccugaccagguccauuuguaauacaccacccaguacaauagugagggacaaaugaacccaaguagugaaguuuuguguagaauucucuugccuuucugguucuuagccuugaaggguucaaauguuaauuuaaugcuuaggucauguuacauaccucauagacucaggaagauccuuuuugggagaaugcaggaugugcugauuuaguaguagaaauuaaaggacgccaggauucccaaaccaaagucaauuccuccaguggcuucuggacaaaugauguggguuuacucuccaggaaaaaauuguauuuauuuuuuccucauuuagaaagauaagugguauuugguggguaaucuaaagaaaaacaaacaaacaaaaaaacaaccagaacugugccuuuuuuuugaaaaugaucccuggaagccaaagcagccaggauuuugaggagcccagguuaggguccuuacucuagccccaagcugcuugugcccucugcuggauggaaucagacuucuaguuuucaucugaaguggucacccacccaccccauccauccauccauuuguccauuuuacaacaguguuuguggaaggcacuguuaggggugaggguugggggcaauacagaugggcagacccugugucauugcucagggaguucacaguguauucauccacuauaauaggguauguuccauagaauuugucuuucuguuguuaaaaucacgucaguccuuuuuagggccauaccuagcgucugcuuucugaucuacaaguagaguggagcucugaauguuaaaugacagggauaaagaccaaaggacaucugccguaauuccucagucaaaauuaaggucugcaagguuggaggguccagaugcucaccccuacuggaggaacagcucagaauaaaugaggugucuccuuagcagcaggggcuguaaaugcuggcaagagaaaaguauggguuauaagagcuggcacugugacaggauuuuuuuccccuguuuuuuaguuuaguugucucccaccccuuguaguaccaguagcaauauauucccaucgucugcuuugccucugccaccugcagaagggucuggcaagugggggaggagccugcagcuguugccuggaaaaggagcuggcuccuagcaacaguaucagcaggcccuacaacugagagcaccaaguuuguccuuugaggucuuacccuuccuuucauacaguucagcaaauaucuuuugagggcuuacuuaguacuaggcacuaugucaagccugagaaagauagaugaaucaaauaaguaccuugccuucaaaaagcucaccacucuggguacauuaacaagugaacagacauaguacaugguccuaagugcuauguaggagagacugggugcucugggaaaaccagacaggcacguacuggugcagggguuagggaagguuucccagaagagggacgaaguuaaugaugaguaggaauuagcuaggucagguaggcagagaaggauguuccagccaaagggaacagaacgagcaauggccagugggacaugagagcauggccaguuuaccuggguaguaugacagggccaaagaguaggacauaaggagaugagcaggaaagggugaggcucuagggcuaggcagaguacucuucucucaugugcuuuuauacacauaauuauccuugagagaaacauggauaguacugauucccacacacagguucauuguuucaucuccagagacucagcauuuuugaucacggaccuaauugugugcugacacucauaagugccuucagggccacauuguggccccacauugaugcagaagaagcugaguugguucacucuaaaacucaaucagauuauuuuagggauauuaucaggcauguaugauauucuaccucucuucucccuuuaaauuguagaaauaauccucaaauaccuucauuuuauguaacauagcaauuuuucauguauuuugaaaucucaugguuacucaggaggaaaacaaguauuccaguuaguucuugggcauauauuauuacccacaugacugcagaaaugcccaacuguuugacuuuuuuauguuaaaacugcccuaauagaacuuuaauagauacgaaguuuccaaaggcuagaauaguuuuuauguagcucuuguaauggagguauuuauuuguagauaaaaaaaauccuguugcuuuuggucuuuguaaaguuuagcaaacgaguaaauguugguuccacacuaucugcucggggacuauaagaugccaggacacuguguuauagagucugcaugaauucagcgugguuccuuuucucaaggagcccaaagcagcagauggcagacucagaaacaaauaaauacaacagugcaccgagugcaaccaagaaguguguggaaugugucaagcuagcaagggaguuauuuauuucuagucuuuuuucugugucuaaacauguuuuuuaaaaauucauaauuuuaauggcuuuaucacauuccaugguacguguaagucauaauguauuuauuaacaucccaauuguuagacauuuaggucguuuuccaauuguuuugcuaauauaaacuugcugccauuaauuuacacauaaaugaaucuuugcugacaucugugacaacuuccuuagcaugaauuuugaagaugagauuuugaccuggguuucuguuuguuuuuuuuugagacggagucucgcucuugucacccaggcuggagugcaaugaaacaaucuuggcucacuguaaccucugucucccggguucaagcgauucucuugccucagccuccugaguagcuggaacuacaggcacgcacuaccacgcucggcuaauuuuuguauuuuuaguagagaugggguuucaccauguuggccaggcuggucucgaacuccugaccucaggugauccgcccgccucggccucccaaagugcugagauuacaggcgugagcuaaugcguccggccuugaccuggguuuugaaagaagagugggagauggccagauaaacaagaaaaagggaagaguaggaaggggcauuccagguagcggcaauagaggcaaccuugaaugccaaaguucccaggcaacuggugaguuuugcuuuuccuaaaccagccaccaggccugccugguaggcucauaaagcccugggcacagcaagaugaaguuacauguuacaaauggcauuuuaauuggauuugcuucccugugccuugcuuuuacaguugcaaccaaggcaaugucuuacuaccucagcucagaaaaccaccuggacccagggcccaucuacaugcgagaaaaugggcagcugcacauggucaaucuggcucuggauggugucaggaguagccugcagaagccaaggccuuucagacuguuccccaaaggcuuuucuguggagcuuugcaugaacagggaagacgacacugcacggaaagagaagacugaucauuucaucuucacauacacccgagaggggaaucuucgguacuccgccaaaucccucuucagccuuguccuggguuucaucuccgacaauguggaucacauugauucccuuauuggcuuuccugagcagauugcugaaaagcuguucucugcugcugaagccagacagaaauucacugagccaggugcagggcugagggcuuuacagaaauucacugaggccuauggaaguuuggugcuuugcucccuguguuugcgaaacagguggguguucugauuagauuauucgguauuuuauuggguguguuaauucugucaagcucuggggcuuagugggcucaggggcuucccucaucaaauagcacuucaguuuagaacuuccaaauaugaaguaaaagaccauauugaaaaaaaucacucuuccuucuccucaccucuuagaugacacuuaacuuuauucugaaaucauuuuacaaggauuaguugucacagcuccuccauuaaguagaaaauauuauucuaacagcuuucaaagagaaaauagaaaagacaaaaugugaucugccaaauaucucuugauacgcucuuacagauggggagauuaguacccagaguuuuugggccuguuuuugguuuucagaccacuagauacugaccauuagauaaaaagugaccuuaaaagauugggugauuaaaauuucaaauauccuaaaguuuggcaguucucaaagucccaacacuaaggucuguggucuuaacaaagcagauauuuucucuugugacugccuuugcucauaugcuuuauuuaaaauuuuuacuuuaccgucauguaaaaacacuuucaaaacaucuaauuuuuuaaaaaacuugcaaaaacaauaaaacuauacauggcaaacaauuuaaacacaaacacaaaguggcauaaaaugaaacauaagccuucuuccuaucucaucuccaguuuccucucuccagagaccaaaugcuguuaccaguuuuuaaaauaccauuccagagauauucuauacacauacaugcuuauguaguucccgucuuuguuauacagauggcagcaugcugcauacacucuuauggaccuugcuuucuucacauaauuugaaaaucauuuaucaucaauacuuguagauuuuuuuuuguuuuuuuugagacagagucuugcucugucgccaggcuggaguggcaguggcacgaucucagcucucacugcaaccuccaacugccugguucaagcaauucgccugccucagccucccgaguagcugggauuacaggcauaugccaccaugcccagcuaauuuuuguauuuuuaguagagacgggauuucaccauguuggccaggauggugucgaucuccugaccucaugauccucccgccucagccuccuaaagugcugggauuacaggcgugagccaccacgccuggccuacuuguagguuuuuaaaauagcuuuauuguauaccacuguaugaacuauucugugauuagaccugaaagguagcuuacuuuuuuuuuuuuugagacggaauuuuccucguuucccaggcuggagugcaauggcgcgaucucagcucacugcaaccuccaccucccagguucaggcaauucuccugacucagccuccuaaguagcugggauuacaggugcccaccaccaugccuggcuaauuuugugucuuuuuaguagauacgggguuucaccacguuggccaggcuuaucucgaacuccugaccucaggugauccaccggccucagccucccaaagugcugggauuacaggcaugagcccccaugcccagccggcagcuuacuauuaagacgcacaaucugcaugagcauuauaacaagggcugaacaaaaaauguauauaagagaaagccauaucagaaaacaggagguaagcucguaugcuuaauaaaggagaaaugaucuuuauuuaaucagcucauagaauuaaugguuucaccacaggccaaauacuguauuuuaaaaagaaaagacauaaacacaugcagaaaagaauagaaacuuggcucauaaacugagcaggcaccuugaaagcucugucucugggcuauggucucagucauggcuggacuugggacugcugccaguggaaaggaaaaaaauuaccuugccuaaaugaaaaagucaagcaauauuucauuguggcuuaugcauuuaaaauacguuuuacccuucauuuuuucuuccaaguuguuuauguucauuguagaaaaguuagaacaauggcaaaauagacuuaugauguauaucuuguuuuaaaauuagcaauacaugcuauuuggggaaugcauaaaauuguaguauuaaaaaauccauaaucccaccaugaugaucauuuucaaauauauuauuuuuauacauuugggaauauauacuuuguacaacucguauucuguuuuuucccccaccuacccuuauagcuuaauauuugccaugcuguugaaaacgccguuuauccauuugcgaugucuggauacuguuguagugguagauuggucagauugggaugagaauagcacuuuucauucacauuugaugaggacauaaauuaguguagcauuucuggaagcaguuuagcaauauguaucaagaaccuugaaaacauccauacuauuuguuugacccauuaauucuacuuacuaagaaucuauucugaucccuaauguaauaaucaaagaugggaacagauauuuuuacauaagaguguucauuguaguacuguuuguacaagugaaaaucuaaaaacuaaauguucaacaguagggaguugguuaagcaaauuauaguauauuuauaugaugaaauauuauguaacuauuaagauaauauuuuaagaaacagauuuuuuaaauguauguauuggacagauagaaggaaaaaagaaaucuaccaaaaagcggucuagauggugggauuggaauugauuuuauauucuuuauacuuuccuauauuuucuuaauuuuuuuccaaugaaagugauacauuaucagaaaauguaagaaacauuuacauuuauauaauaaucagaaaauauaggaaacuuuuuuuuucuuucugagacaagguuucacucuguugcucaggcuugagugcaguggcgugaucuuggcucacugcagccuccgccucccagguucaggugauucucccaccucagccucccgaguagccaggacuacaggcgcccgccaccgugcccagcuaauuuuuguauuuuuugguagagauaggguuucaccauguugaccaggcugguuucgaacugcugaccucaagugauccacccaccucagccuuccaaagugcugggauuacaagcgugagcgaccaugcccagccagaaaauauaggaaacaauuuuaacauaaucuuuuuuuuuuuuuuuuuugagacggagucucgcucugucacccaggcuggagugcaguggcucgaucucagcucacugcaagcuccaccucccggguucacgcaauucuccugccucagccucccgaguagcugggacuacaggugcccaccaccacgcccggcugauuuuuuguauuuuuaguagagaugggguuucaccauguuagccaggauggucucgaucuccugaccuugugauccacccgccucggccucccaaagugcugggauuacaggcgugagccaccgcgcccggccaacauaaucuuuuagcccauauuuuauugcagcaauuccacacuugacugucucauucaaauguaagacuuucaguuguuaucaaaaaccucucuucuccuuuugaauccuuaaaggcaaauagagggcaggaaacuugagguugcauuugcaauccagggcuguagcugcaguccaagagguuuugucagcacaaagggguucaggucaaaaguaaugagcuugaaaaaauaaaugaaaauaaaauaacuggguaggugcaggcacuugcuaucuugggguuaagucacaaagcuaccugccagaagcaagugucuuugcaacugaauuccaaccuuacgaaaacucucuucucccuuguguugaaaccccagugauuuuuaaucccacuggugguaacagggaggcaaguauguuuuccuuaaaauaucacuuuuuguuguugacauaauaguaauagcuacuauuucaugaggucuugcaagaugccauggaauuuuaaaauauuguuucucuuuuucuuaaucauccugaaaagaauuuuguagccccauuuuguagcuggagaaauugaggcucagaaagguuaaguaacugucucacaaucacacaaguaauugggcuguuagaauccaaacucaggucuggucugugcucuuucuauugcuuuuccacuguacuguuccgaacccuuuaagggaaaauuuggaagacugguugcaagcaagaaccuagagcuuugauuauguccuagauuagcaccuaguaaugucuguggccuaacauguuuguuccucaaccuugaguuucguaauguuucuuaaucacauuacacaguguuauguccuuugcagagaacccuuguuucagaauuacuaaaaaucuuuugguuaauugaucaaaguauauguguuuuccuuucucugauugccaguaauccucuaaauccccauuaacacacuucaacucugugauuggaagguggaaaacagcagcuuuauuuacaaugcaauuaaaauacaucugaguaaauaaggcucuuuuguguacccagcugagcucggucuccaggcaccuuagguuccacccuuuaaggggguaucagugccucagaccaucuguaccuagcugucaggcuggugauuaguuugaguacaucuuuuuuugguuggaaguaggaagaaaagagauuaacuccucucuugcccucugauuauuccauccuguuuuuggcaguugugauccugcugauggaagagagguauguacucuuuuagguguaaccccacugauccuaacacaccaucuugcuguggaaacuuccagacauucaagaggaagguggaugagagaggccugcucuugccacaagucaguuucccuguccucuuagguuccucuccucuccauuuccugucacaccuaaucccuuucauuuuuucucacugaccucaucugagauagaugaaccacuagaaagcaggguggaggccccagccugggcuguggaaugcuguuuugaucuccuuucccucuccagaggcuucccugaugcuuccugauaacaacuuggcaaggugcugcaauguaauuaaguugcucgugcucaggguuugucuuaauauccaucuagacuggagugaguccuuguagcagucuugcuguacauacuuuuggaguaaaguuaggauaacaggcacaggggaguguucaggaaagauaaaaugugaugugccaaauaucucuugguauguucuuggggacaugcagauuggaaacgagaguucuugaccuugcuccaguuuucaaaucacuggauguugagcauuagauuaaaagcaacuuuaaaagaauuaguaauuaaaaauucgaguauccuaaaguuuggaaauucucagguaaggucccaacaccaaugccaaggucugccugauaacaaagcagguguuucacuugugacuuuccuuugcuaauauacauuuauuuauuuauuuauuuauuuauucaaaauuuuuauucuaccaucacauaaaaagauguucaaggcauuuacuaauuaaaaaauucagccuuugcccugauaguaauuagugaagucugcuuauuccauaguacuguguccugaugggaugguaggauauugacuaugauacaaauccacaaaugguaaugcuuuaagaguagugaggggaagcuauugauugcucuccacgcuccguagguaucucgugauuucagaaaagcuugaggagauuaagucuuuccgggagcugaccugccuggaucuuuccuguugcaagcuuggagaugagcaugaacuucuagaacaucucaccaaugaagcccugucuagguacugaccugucaccacuugcagaugaauuguuucaguauuguuuuaaaggcugauccaacaggauuaucuucaggaaugcugauuacuucccauucuuauguugauuugcuuuuuuuuccuaaaacauuuucaaucuccauuuacuugguauaagcaauauagauuagacaacccuuagaaagucagucaguugacucaagucaguuaguugacucuuuuuuucuaaguaacuuuuauuuuaauauguaauacuugaagcuacguagguuaaaaagugguuuugccccuuauuuauuuauuuuuauuuuuauuuuuuuuggagacaaaaguuucguuuuugccacccaggcuggagugcaauggcacgaucucagcucaccgcaaccuccaccucccagguucaagcaauucuccugcgucagccucccaaguagcugggauuacaggcaugcaccaccacgcccagcuaauuuuguauuuuuaguagagacgggguuucuccguguuggucaggcuggucucgagguccugaccucaggugauccucccgccucagccucccaaagugcugggauuacaggcgucagccacugcgccuggcccuauuuauuuauuucuuuagacggagucuugcucuuguuguccaggcuggagugcaguggcgugaucuuggcccacugcaaccuccaccuccagguucaagcuauucucaugccucagccuccugauagcugggauuauaggcgccccccaccacgccggcuaauuuuuguacuuuuaguagagacggggguuuugccauguuggccagguuggucucgaacuucugaccucaggugauccacccaccuuggguuuugcccuuuauuuauccaguccuaguuuauucuagcaagggaugagacauuauaccauagucaacaaucauuaucguuugcuacuuuaacuaucaaugagcuacaauuauaaagaaaaugaacuauuaaagacagccaaagaaauucuuuucaggagucaugauuuaaagaaauggcccaguucauaccauucacaaauagucugacugaucucagguuauucuggccagcaaagaggaggacagauggaucccucugugguuuuauaaacacccagaagaacaacagcauuacaaaccuaggucuaaccuacuaccugaggccugcuucugacagugacaccuaccuacugccccauaaaaagaugcuguugugugaggcuagccagcaucaaggcucagauuucuuaugugaaaacggagcauauuaauauaccaauuccagcuuagcaucagauggauuggauuauggguauaccuuauuaacccaaacugaaaaucuagauugauaaagcugguuaaauuuagaggauuguuugcuuugcaaaaauaauucucauaggaguucuuuagcagacuuuccugacauaguuagaauguuuuugauuuucacaccauuugucagaaaagcagcuuuuguuuuaaaguauauuuauccccuaguggaaguccauuuaccucauucaacaauauaccuuuagugcccucugcccucugaaauuaguacugcaugacacuaaauuaacucucacuugguaacugaaauggcaccaaaaaaucuuuuuuuuuuuuuuuuuguuaggcagggucauguucugucaccuaggcuggagugcaguggugcaaucauagcucacugcagcuuugaaauccuugguugaagccaucuuccugccucagccucccaaguagcugggaccacaggcacacagcaccuuggcuagcuaauuuuuuaaaauuucuugcagggauggggucucuaacuccugggcccaagugauccuccagccucagucuuccaaagugcugacauuacaagcaugagccaccaugcccagcccaaaagagcuuaacuuuguuaaaugcauuggguaugaaauagcaagagguagaggauauguuauauuuuuaaaugaaaauguugaaagcauguuuuuauaccuagauugucucaaacucucuuugaguaauuuauguauguacuuuguuucccuaguguaacucagcuccaccugaaggauaauuguuuaucugaugcuggggugcggaagaugacagcaccaguucgagugaugaaaagaggccuugagaaucuaacauuauuagacuuaucauguaaguuuucuucgaaauuauagauuauuuuaauguuggaagaauggccuuagagaucauguaguucuuccucuucauuuuagaggugagaaaggaaaggugacuuuccucggugccauagaaacuugguggcagaacaggauugaggccaaagacucuugacuccuggccaacugauuuuucuagcacauaccaccucuuuaggguaggaaaaacccuuacacauucauccaugccacucgcugugugcaaacagagacaccuuucaucauauucauugcauacuuaaaggacauuugacucaucuuuauuuuccuugagucucugauccuuggugucugucagcuagguccuuuuuuaucaguguuugccugaugaaaagcuggaugaacggauaauuuacucagauuaaccagauauugacuccaaugguaagagguugacagagaucauuuacaauuuaaccgagcauccauugacucuauggcaggacaguaugaugccaaaagaauagaaagagcagugguuugaggucugaggacccuucuuggucuaccacuuuuacuaccaguuauauaccuucagaccaguuauuuaaccacuuugagcauugguuuuggccuuuguaaaaugaggauaauaaugaauguccuggcugggcgcgguggcucacgccuguaaucccagcacuuugggaggccgaggcgggcagaucacgaggucaggagaucaagaccauccuggcuaacacagugaaaccccgucucuacuaaaaagauacaaaaaaucagcugggcgugguggccggcaccuguagucccagcuacucgggaggcugaggcaggagaauggcgugaauccgggaggcggagcuugcaagugagccaagauugcgucacucacuccagccugggugacagagcaagacucugucucaaaaaaaaaaaagaaauaaugaauguccucccuaccucccagggaaguguauucauucaacaaauauuuuuugagcaucuacaaugugccaggcacuacgcuuauggccuugaggacucaaugcuaaguguaguacucucugacgugagaaaguaauauauaagaaaggauucugaaaauaaugcaaguugguaagaguggugauaguaucugugucuaaguucccuugaauaucuuuuuaaaauaaauaaaugcuuuuacuuuggaggugaaauggccaugaauaaaguaugauaaaccauuguaauacauguuuauguauguuuucauaugguuccaaauuaaacccuuugggauaacuaccugguucauuuauuuuucugcucacccccaacuccuagaaaguaagagcuguaaaggaucuuuagggaucauugaguguggcucuuuuauauuacaaauaguaaagaucagaccucuguauuuaauuuacuuugaaaaguuugccaacucaaauguuuuauaguuuaucauugcccggacguuuuucugagcuuauuuuugguugucauuuuaacagcauuuauauugugacagaaugcuacguuguuuuugacaucuagguaacccugagaucacagaugcaggcauuggauaccucuuuucuuuuaggaaacuaaacugcuuagauaucucugggacagggcucaagguaagacuuuugguuccuucucucauuuuucuagacucaacaauuugauauuuugccugugcuaauugguauuuagaaagggcugguauuuaugauggucuuuauuuacuacugaaaacaaguaagaauuaaccaaauguauuugcauuucugaucugucucugccucacuaggacaucaaaaccgucaagcacaagcuccagacccacauaggccuuguucacuccaaagugccuuugaaggaauuugaucauaguaacugcaagacagagggcugggcugaccagguacuccagauuuuucuuccuugcgguugaugcagcuuuucaucuuaauuccaagugucuuauccaacacauugaauaaacaguaauccacuugguaguccuugguuaaauugucaucuucaugucaaauuggagacacugaugggcuauaacuggcccacgugcuuaaagaauuggcgccagaccuuauaucucaugcucuggucacuagguugugccuuaucuuuacuggaccuaggagaaaaugucaucuuacagaugacucagaaaauaagugaauucuggcuugcuacacaaaaaagcagucugacccaacuucagaaggacagauucucuuaguaguguguauauacaggagagagaauaaacuccggugucaugcaaauaaagauucaaauaugauucuucucuuuguuuugggaaaguuucuuaccucccacagccuuagugaggaggugucuuucuuguccuucucucacugagucuuaacagugagagaacuuuacuuugacuuccuuuugucuugauggucuuucuucacuugguagaguacagacuuaagugagauucagagucuucuauguaaguuggaagugugaaaguaaccaaguaggacagcacaaguagaugccaccuucccuguggcuggggccuuucucccuuagaugcuuuuaaccaauguuucuugguggaggccuagaggacccaccaaacuguccuggauccccucuuagcuccaagccauaaugcaggaugguagaacuauccaccugcuggauuguagcgucaccucuccacagguaagcagggagacugcugagucguguuucagaagcacacugagcuugguccagaacaugcaugaugaaauaauuaucauggugcauugccagacaaaguuucuagugcuguaugagaccuagaugcauccaguggaugugggacaggugugggauggucuuacaaaggcuugcugcaguuugguagcaggugacaugguggaaagagcauaggcuguggagucagaaagaccugggcauggaauccuggcucagcaaccccauagcuguacaaccuaaagcaacuuucagucucuguguuuucauccauaaaaugcagaaaccaggaccucucuugagcagggcucaggaaggaucaaauaaaacaccuagcagccuggccugagaguaaguugacuggaccagugcagcuuccugcccuccgcccucagcugggccccuagggcguggcagcagugcuuugccuaugucuuggggaucuguuauugaaacuguuucaggcugauuccacucaccuguccucauucucaucucacaaggguccacuuacuucccuauuucugucucagaauuucuccauuucuucaaccguauuacacuucccuucuauccgagagaacaaguaugcuccuuuauuccagucacaagcccuuuuuuucuuuuuuaaaaaauucuguucccuaagaucuccaacuucccuugugcuauuuacuaauaauuauuuuccccuccugcccaccccccccccaucuucauugucccccuuuguuggcuaucugcuuucuguggauaaacacaagguguccuuauucuagcuugguccucauuccccagugcagcugugcauuguuuccuguccagucugucccacccccuccuugccuacucaguucuuacucccuugcgauuuaguucuggccuccccugcucuccugacaguguccucuugaaggagauauucuucaccuuccuuggcuuuccugcagcauucgauagaaacaugcaugacuuauguauuuuucucugggccucucuccuggcucucccccaacuuucucacuccucuggcuaugacugauuccucuuucuuccucuccucuucucccacaucuccacacuccccaggugcucuuucacuguucucagagcuccagcuguccuugcgaggaugacucugcauuccucucucagacacuagacucauucccaaguauccucuguaaaucuccaccugccaccucaaauucagcuugucccgaaccaaacucauuuucuucuuccccauccccgaccagcucuuauugacauucuuauuucuguuuagcggaaggaagcaccauuuucccuauugcccacugagucaacauguucuauuaauccauccugguguucccugaaaucuguucccauuuuuauaaccagaaaauuauagaaaagauggcaacuaauauuuauuaagugccuuuugugugccagacacugugcuaaacucuuuauguguauuaucucauuuaauccuuaaaacagcccuauggaauguguacuaucauugauccuuacagaugaagaaauugagacuaagaaaucacuugccauggguccccuggcaaauaagugguggagccaacucuggaacugguuuuuuguuuguuuuuaaauagagaugggguuucaccauguugcccaggcuggucucgaacuccugggcgcaagggauccuaccgccucggccacccaaagugcaaagauuacagaugugagccacugugccuggccuggaacuguauuguuuuuuuuuguuuuuuuuuuuuuuggagacagagucucgcucugucgcccagucuggagugcaguggugugaucuuggcucacugcaaccuccaccuccggguucaagugauucucaugccucagccucccgaguagcugggaccaccaugccugacuaauuuuuguauuuuuuaguagaggcaggguuugaccauguuggccagccuggucucgaacuccugugauccgccugccucggccucucaaagugcugggauuacaggcgugagcuacugagccuggccuggaacuguauucuuaaacucuguguugggcugccuauguccugaaaauguuuuucuugaccuuuuuuauggucauuucauugcauuccauaauaaacaaauauuaaauuuaaaguucuuguuauucaugguauauugaaaugaucauuugcuuuucuuaauguauaguuuauauucaggcauauuucuuuuuucuuuucuuuuuuuuuuuuugagacagaaucucgcucugucaccuaggcuggagugcaguggcacugucucagcucacugcaagcucugccucccggguucacgccauucuccugccccagccucccgaguagcugggacuacaggcgccugcccagcuaauuuuuuuuuuguauuuuuaguagagacgggguuucacuguguuagccaggauggucucgaucuccugaccucgugacccgcccgccucggccucccaaaaugcugggauuauaggcgugagccaccgcgcccggccacauauuucuaaaagaauugguagcagcuuauaauaaaaauauauuuuuaacaguuuaaaaaguaaaaacugaucaugguauguuaugagaauauggaaacaugggcauuuuacauacaaaaguuugaguuauaguuggcauauuuuaaggcacgagaguaagucuaggaauguguggaaaguguuaugacuaaaguuuuaaguuuuaguauuuaguuuaaggauauguaauuuauuuccagcuuggaauaaagaugaaaauagacagugaaaucagcuuuauagauuucucuuagucaugcagauacauauauccaacguguuugcauucugacucaacuccugcauuagaacagaaaaugcagacuugacuugguucuuauucuuaucaccagucaucugaaguuaaauuuaccagagggguuuguguuuauggagagggaaaaagggggaacaagaaaggcuugagauuaaaaucucaauauuuuguuuggauucaaaucuuuccaaauauguuucagaucguucugcagugggagcgugugacugcggaagcugugaagccacgggagaccucggagccuagagcagcagcucagcgcuucugugagaaauucccuuuccuuugaaguuuuuugcccuuuauuugcauccuuaaagcaguucgcuuguuuucccuccuuggaaaaauuaauuaugauaguauuggcuuauuuaugaucaccaagacuuguauucccuuagcauagcuuacaguauaaguucacacuuagcuuugagcaccagcaccaggaagacagcuuuuuaaaauuacuuacuuacguaccaucuuguuccaaaaaagauuuguggugguacaaaagcuauauagaauacagaagaugaaaaaggaauugaguguagccagaggguggaagcagcccaggugucccaucaacagauaaauggauaaacaaaaugugaaauauacauacaauguauuucaggcuuuaaaaguaaggaaaccgacacaacauggaugagccugcaagauguuaugcuaagcaaaauaagcuagucacaaaaggacaaauauugugugauuguucuuguauaagguaccuagaauaguuagauucguagagcaagcagaauggugguugugacuagggaggcggggguggcacgggcaggaauagggaguuauuguuuaauagguacagaguuucauuuguacaagauaaaaagaguucuggagauggauggugaugauugcacaacagugugaaugcccuuaauaccacugaacuguacacuuaaaaauggcuaaaauaguaaacuuuauguuauguauauuuuaucaugauuuuaaaagaaaaggaaguaaaugaugaaaucaaagugaaggaaauguaaagguacuaaauaagaauccagggcauaccaaaaaaauguaaaauagguuguaucauuugcuauuuggcucuuagagucaaauccagauuucgaauaaugaaggcugucauuuuuguggccuuuagugugugucaagcauugugcuaaucacuuuauguacaugaucucauguaucuucauaucacccuuaugaaauagguuuuguaucccucuagaggugauuaaacagaaucucagacaagucacuuacccacggucacuucuaggaagaggcagaucuaggauuuaaauccaaaucugucagacuguaguaugccuccaaccugugccgccaugcacaccacagcgaccucacagggcacucaaggcaaaaugcaaucaaugcagauaucacccuguuugggccuuugucauaucccuggguuuauccuagacugaugagggaauuagcauaugccaguguagugaacucaucaucccucccuucugucacagaugggaagcggucucgagcagaagccccacugaaguguccccuggcagacacccacaugaacucuuccgagaaacuccaguucuauaaagagaaagccccagauugccaugggccaguguugaaacacgaagcuaucucaagccaggagucaaagaagagcaagaagagaccuuuugaggagucagagacagaacagaauaacucuucacaaccuucaaagcagaaauauguaugucuugcuguggaagacugggacuuguuaaauuccuauugauuaguagauacaaguugaccuuucucuggcccccagcucuaguguuugaguaaaggagacugaggaugauuuacuuuuuguuugaauuuaccuauggcauuagcauaguaagcagauauuucuacuuuuguggugugggaggggaaugcuauggaaguauguaauaauuucuaauguauauuuucaauacauaguaauuuuuucaaauaaacauuuuugcuguccuuaaguucugcuuguggauuauagacuggagccacaggaaauaacacgguuugggauggaaggccaggugaacua

SEQ ID NO: 14045 - RNA, 12522 nt, Homo sapiens
gcuaauucccugucauccaagcaacuaaaagguaaaaaccuuauaacuuuaaaauaaaaaagguuauuuuuuuccccuauaaaagacaggcaguaugaguuaauacauuaaaauuauuuuguacaucccugcuccaaacaaccacaaaaaugguacuuuuuaaaugccugcccauccucuccuggaaggggguuuuuccaagauucggggugacugauucaucccacagccccaggcagcaguuuauccuggaacuguccucuguucucccaucacugcugagcccugagaauugugaauggcccucagagcaucuaggccucugcaacaaucaggucucuggugacuugaaaugcagcaaugagggagcucagcuggaucuucucguuggugccaacagaaagccuguaccuaacagaaaccaaacacaggguaagaaaaaagacaccaaacacagcugccuuuucuuaagggaccaagagaucuagggcugaaaaucuguugaaggaguggggaugggaauugauagaacaaaugugcccuggauggcaaucuuguaugugucccccuaacauuuucuucucugcccuacacauugauuuauaaaugugauguuucaaacuuguaaggaccgauucaauuuuaaaaauuauuagguaucaggccgggcguggugguucacaccuguaaucccagcacuuugggaggcgggccaaucacuggaggccagccuggccaacauggugaaacccccgucucuacaaaacaaacaaacaaaaaacaaaaauuagcugggcaugguagugcaugccuguaaucccagcuccucaggaggcugaggcaggugaaucgcuugaaccugggaggcagagguugcagugagccgagacugcaucacugcacuccagccugggcgacagagugggacucugucucaaaaaaagaaauaaauuauuaggugucaacagcgguguucugaacuuaacuuuguccuaacuauacagauauacaaaauuuauguaaugaaggauuauuucgucggcaaaauacguuaagagggaaacaaaacagagauuuccuuccucuuaagccauuucaucgggaaguuuggcugauacauuggugggucuguggucuagucaguaaagcaggacacuggaguucaucucgccaccuuuuaaaugcccagccacugauagcaaaaucaucauauucacaaugcaaugaggagaggugaccuaauuugugccugugaaagccaaugccacaaauuagaguuggccuaugcugacgucuauguugaacccaaugcucugucuacuuaaaugauagcugccagcuucacugggggcuaauaacaguguuuacggaaccaggcaaagcagaaaauugaguuuguguuuacuuuuccccccaauaugcuuuaguaugccaaaaugccuuaauaacagcugggugguugaagcaaagcaggccucccaaauaacaagggcauuuucagaaucaaugugggccgagccugugagguccaaggagaggccuucaucucagauauguaacugaucuguacuugaccugugaauuuauccccauguucuuuaagcagcucacacccuuccccacauuccauucaauaucaccagacuagauuguaccguaugugaacgauuuaggaaaaaaaccugaaaccaagaaaguugaaacaaauaacucacaacaggggaaaaaaggaagaaaagaauuaaaacuggggcaagaaguacucacucaaugucugccauuuuggucaauaaauguauucgaacugaagauggaaagucaacugagggaaaaacaaaaucaaaugaguuaggucacucucuacugucaaaaaacccacagaggacaaaugaguuucaacaugaaauccuuaacacugaacuaguccugaggccucagccugcucacuagauaccagaccucuaagaaaguagaaacagugcugguuucauacuuuuuacccacucgauuuugugcuuuauaggguagacaaaaaggaaaaugagcagauaccaaagugauccuaagagcaccaaagaucacacugcucuuagcagcuggguagcucuacaaguuaacuugaaugcugaguucccacuugcuguuuuuauuuuauauuuuacuuuauuuugagacggggucucacugucuugcccaggcuggagugccauggcauggcgugaucaugacucacugcagccuugaccucuugggcuugagggaucuuccaccucaagacccuugaguaacuggggcuacaggugugcgccaccuugccuggcuguuuuguacuuuuuguagagaugcgguuucaccguguugcccaggcuggucucaaacuccugggcucaagugauccacccauuuugacuucccaaaguguugggauuacaggcgucagccacuauaccgauccuguccccauuuaaaaaccaagcacaaacaacugauuuuuuaaaguugguuuaugcucagcuuccacaaucaaggugcagagcugggccugagccaaccauaccuugggcagaaggcauggcaugggccagccaggaagaggccugugaaggccugggcagaaccaacauucauugacccgguuaagucuccaucuugcaguuggccacuguggaaggaagagcuucuccgaaagccuacacaagucaccuggggagcuuagagaauacggaugccugguuguccuccgagaagcugacuuaauuugucuggagugccccuaucugcugccaagguugagaaccaauucucuguguagaagguacaggcaaguguggaacuuaagauguuuuccuuaagccugcuuugguuuacaugguuuacauaucuucucuuucuuuucugggaauauauaucuagauagacagauagauagacagacuuuuuuuuuuuuuuuagaaaugugaauuaauauauacuacuuacugcuauaaaauauaaaccccuagaggaaauaaaguuagccuccaggaguuuucacuuuccccagcaguucuagauauuaaaagaggguuuauggaacacguuuuuuguguuuuguuuuguuuuuuuuuuugagacaaacucuagcucugucgcccaggcuggagugcaguggcaaaucuuggcucacugcaaccuccaccucccagguucaaaugauucucccaccucagccucccacguagcugggauuacaggcgugcgccaccaugccaggcuaauuuuuuguauuuuuaguagagacgggguuucaccauguugcccaggcuggucuucaacuccugaccucaggugaucugccugcuuuggccucccaaagugcuaggauuacaggcuugagccaccguacccagcucuggaacaaaauuuuaaacaguggcaagacagaacugcuaacaagaagggucugauuuacaauucauuaguuucuuugcuucaagaaugaagccuccuguccuaaccauccuuaaccccaaagcaggcuaccuucuccacagcuucucagcugggggauaauguaaguuaccucuaugcacaaacaaguguaucucugucaggauaucaugcagugccaaccccuucagaguuuucaacucuguaauaucuagaggagcaguuaaggcaaagggaacaaguuccagaacaaacauacugcagagaauuuugaauccaaacccgggcaagagacuuuuuaaaguaaggcuuuuaaucccaacacaacuguuucucuuucaacuugaagcugcacguguuggacuccaauucuuuauuuuucuuuguuucaucuucaguaagggcuuucugaaagauagaguuguaacuccuucuaguagagaauaaagccaacugcguuuucuuuuucuuucuuucuuuuuuuuuuuuuuuaagauggaaucucccucugucacccaggcuagaguacaguggcaugaccucggcucacugcaaccucugccucccggguucaagcaauucucaugccucagccucccgaguagcuggaacuacaggcacccaccaccacgcccggcuaauuuuuguauuuuuaguagagacgggguuucgccauguuggccaggcuggucuugaacuccugaccucaagugaucuaccgccucagccuccaaaagugcugggauuauaggcaugagccaccacacccagccccaaaugcauuuccaaaaaggcuuugugucaccauuccuagccuuucauuucacagcacaagagcuaucacuaucaugaccacuugaaaauuccugcaucuucaaugccaaggccuaagcuuuucucccaucugugagugaagcugcuucaagccuuacccugacuugaaggucagagcccuccaagaagaacucuggagugcuaaagacaaguacccacuccaccuacagacaucucacucccacaacaagcugaccagagucgccugcagccagucauccuuugccagcaaggugugggugcuggcugcaaccugaacuccuggggccaccuucaggucucgguggccaggaggucaugagaaaggauacuucuguaggcuguggugaaaucuugauucaacauccaguccaggauguuggcaaugucugacuugagcgggugcccggugcagguguagacagucuccucugucaccuucccaaaggccauauuggugcucuguguagacagagggggaaaggggagaucacaguggcugucacagcugccaccaagcugcagggagccaagaagaaauugccaaggcagcaaugcaggugagcagcaaaguucuaugggcacaaggcagugggaacccacauauucaauaccggaagagucaccucaucagaggaugccacagccuguuggcuauuccagugccaaauccuucccucccuuugccuucuuugcaacaaaugauuccuuuuguuuuuaaaacauuuucuuuugcucucucuuuguuuuuugagacagggucuugcucuguugcucaggcugaagugcaguggcaugaucauggcucacuguagccucgaccuccuaggcucaagucacccuccugccucagccuccugaguagaugggacuacaggugugcaccgccacaccuggcucaugauuuuuuaguggagacagagucucacuauguugcccaggcuggucuccagcucgugggcucaggcaauccaccucccucggcaucccuaagugcugggauuacaggcgugagccaccauaccuggccugcaacaagugauuuuuucaauuaaucaaaauacaaagugaggagggggaauccugcagguuaugagaccaaggucuuaccagcuguagauuucaaaauuuacagauugaucaugccuuugcuuaggucuuucuucaaaaacuauuacaaaacaaugacucaggauuugcugggaccaggcugggcaugguggcucaugccuguaaucccagcacuuuaggaagcugaggcagauggaucauuugaggucaggaguucgagaccagccuaaccaacauggcgaaaccccaucucuacuaaaaauacaaaaauuaguagggcgugguggcgggcaccuguaaucccagcugcucaggaggcaggagauucgcuugaacccaggaggcggagguugcagugagcugagauuguguugcugcacuccagccugagcgacagagcaagacucugucucaaaaaaaaaaaaaaaaaaggauuugcuugagaccauaccugcaaaauguucagagcccuacgcaugucuccacuggaaagagugacuagugcuuucauuccaucuucacuuauaucaacucugaaagaaauaagcaaaagggauuuaugaggcccccugagagcaccagcauucaccaaaggaacaagauggccuggaaugauuaaggcuuuaaagggaugaaggaaggagaggaacagaguuaauaaucuccugaucuauaugaucuagaauucacucugguuuuuagggaccugggcuucacauuaguagucacagccaaccaaaaucgagaacagccugaauuuaggaacaagcauucucccauggagccagucgucuugaauucugcucucuggggaggacagaggccuggcacaagccaugaucacacagccgaaacuccuccuucacaacaagcagcugcucaggucggcuacuugcuuggcaucugacuacacagaaugugaugucuuagaaccuucccuucuagucuaaaaaggcuggaagcaucuuugcagaagggacucagcagccugcaguuuccaaugacaaagaagaguaggaggaaauugggacagcuuccaggggaggaggauggaaucaagaaaaaugaaguaccaaaugacuuuuaugaggaauggccuugagacagcagagaaaaugauagcaguggacgguccccagugccuccccugugcuaggcacucugcaaagucguuuuccaacauuccucuccucuacauacgaaccagccagugaucccacaagccuguuucuacuacacuccauccccaaaggcccgcaaaauacucacuucucuucuuccacgacauguuccaggcggggaaccaugaguucaggagucaggggaccgaaccgaaaccucgugcagcgggacugcaaggcagggaugaucuuugacagauaguuacagaugaggcagaaucugguauuuucugugaauuucucaauuacuaguaagagaaaauaaaaccaccucaugucaaaguccauucugauuuuucagagagcccagaaaacuugaauuuuucuguggucacaaggguauaggaaaagauucaauacugcaaacaagugaggauguuggccgggcguaguggcuuaguggcucacgucuguaaucccagcacuuugggaggcugaggcgggaggaucacuugaggucaggagguuuggccaacauggcaaaaccucuacugaaaauacaaaauuuagccaggugugguggcacaugccuguaaucccagcuacuugggaggcugaggcaggagaauugcuugaauccgggagguggagguugcagugacccaaaaucauuccacugcacuccagcgugggcaacagagugagacucugucucaaaaaagaaagaauguaaacaagugaggcugcagccuaugacaagacagggcagugcuggccuguucagaucagagauuagccacuccucuuuuuucuuuuuugaaacagagucucgcucuguugcccaggcuggagugcaauggcacgaucuuggcucccugcaaccucugccucccggauuaaagcgauucuccugccucagccuccugaguagcugggacuacagacacgugccaccacgcccggcuaauuuuuuauauuuuuaguagagacgggguuucaccauguuagccaggauggucucgaucuccugaccucaugauucgcccgccuuggccuuugggauuacaggcaugagccacugugccaggccaauuuuuguauuuuuaguagagaugggguuucaucgguuagccaggcuggucucgaacuccugaccucaggugauaugccugccucagccucccaaaguacugggauuacaggugugagccacugcgcccugccuagccaccccucuuucacaaacugguaaacaugccuccgugggauuuuacaaaaugcuuccuuuuuaccauuugccaugauucuggcacuuuugccauguaaucccauuaagacuaugagacuucuuguccuuuuacauaaaauuauauuuggcagguugaugacacuucaccuucuaugggcagggagggcggcuuuuugcagacuuuuccauggagacugucuggaggccuuagagcacucaagggagcaauaacccgaacaaagaguugcuuaugacaccgguuccauucuguagguacccaauguucucacauggggaucugcccagaaugacagucacucggcagaacaagaugccgaagaaaggcugccaagcuucuaggaccagaagauauucucgcuguccuccuccuccuccuccucccccaccucuccuccuccaccucccccuacccuccuccuccgccuucuccucccccuccuccuccucacccccuccucuuccuccccuccuccccccuccuccuccucccccuucccccauccuucucuuaacaugugcugccaucuacucccucgccacaaacuccuaaagaucguucuucucucaaagcugauucacuuggaaucuuaaugagagaugacaaguguccuuuaagagaaaagaacugcgcuaggccccugaagacagacaaaucgcagggugcugucccucccgcugccaaaucauucacuuggcaagcagugaaguaauaucagcucucugagcaccucaacuucagauaugcuuuuccuagccauugugguucaaaggguaccauuaguagaaaggagaggguacuauuagcagaaggacuaucugauagcuuaaggaugaaagauuuuccacaccccaucccacggaaagauaugaauucccaacucugaaauugaacccagugucaaaggagguugaacaccagugacuggccagacuuaaaaguccccgcagggcuuagucccuaggcugcugaaggggaagucccgcuacagagguaucuagccugugucauuagaugggagacacagagaaaggcauagagauuucucugggccagaagaugaaaacugaaaacaagccaagccauaucucacauccuaauucuccuguaaucccagcacuuugggaagcuuaaaguuccuaauucuccuguaaucccagcacuuugggaagccgaggcgggcggaucacccaaggucaggaggucgagaccagccuggccaacauggugaaaccccaucucuacuaaaaauauaaaaaucagccgggugugguggugcaugccuguaaucccagcuacucaagaggcugaggucagagaaucgcuugaacccaggaggcagaggcugcagugagccaagauugcgccacugcacuccaaccugggugacagagcaagacucugacucaaaaaaagaaaaaaaaacucccccccgccuaaaaaaacaaugacaacagcaacaaacacaaaguuccuaauucuccuuccagugugcacaccagcccaaacgcuccacagugccucugcuuaccucuucucaaggcauucugggcguccugagucauggcgucugcuucauccaagaucacuagcuuaaagccuuuccuagaaaaacaaauggugcugucuaaagauuucuucaaucucaucucaacaucugggcucaaaccuauaucuucccauugugccaucgggcccugucucagaaagacaauuucuucuagaacuuuggccaaggcagacaucuuuggucacucagagaggaaaugccgcaucacuccuucaacccuuggugggaauggaggagacuucucuacuucugugcgcuguguccucuggcaucuucacuuuccuccacauggcacccuaccaugcuacugcuuuucccgucucccucacucaugccugagucccucacccuuuugcuuuuuuugagacuaaguuuuugcucuguugcccaggcuggagugcagugccgcgaucuuggcucgcugcaaccucugccuccuggguucaagcgauucuccugccucagccuccugaguggcugggauuacaggcgcccaccaccaugcccagauaauuuuuguauuuuuaguagagacgagguuucacuauguuggccaugcuggucuugaacccuugaucucaggugauccaccugccuaggccucccaaaguccuaggauuacaggugugagccacugcgcccggcccucacccuuuuucuuucuuucuuuuuuuuuuuuuagccaccauccuaguuguccuuccugaucucaauuuauuuuuaaauucaaacuagcucauccagucuuaggguaaucuagccaguucucaggaacuaaaaaugaaguuaaugcucccuaaagaacuugguaaugcaggcugggcucacguauguaaucccagcaguuugggaggcugcggcgggcagauugcuugagcucaggaguucgagaccagccuaggcaacauggcaaaaccccaugucuacuaaaaaauacaaaaauuaguugggcgugauggcucacgacuguagucccagcuacuuaggaggcugaggcuggaagaucgcuugaacccaggagguggagguugcagugagccgagaucaugcuacugcacuccagccuguacgauacagggcgacccugucuccaaaaaaaaaagaaaaaaaaaacaaacuugcuaauacaagcguagauaacauuuuauuuuaacaguugcauuauaacgcuucuuacuaccaucccucucguuuaucucuuuuccaugguugcuuuggacaaagucacuuuuuuuuucaacccauauaaacuggcuaaggagaggauuaaaaaauuaacccauaucaucuuacuaaucaaaaucaagggagcgaaauuacacaaauaauucuuacuuaaauauuguccuugugcuagcaaagcucaggaucgguccucgaaugaugucuauuccucggucaucugaagcauucagcuaaauguggaagacagaagacaaaacaaaaaccauguugcugugcuaucugugaguucuugguguuaguguauuuccucaucaguccagcucagcaggcuagcucucuaugucuaaugauggcuaagagaucaucauaaaauaaaaaaucaguuuuacacaaaauucacuaaauuaauaaagauggcuauauuacccccacccuuugaggacaaugacugacauaaauuggagaaauaauuaauugguaugguuacacugaacagcaccucugguaugagcagaaugauacaaauuucagcuaccacaauccuaaguuaccaaguucuuaauaaacugaaauaaggacauuaguagcagcaaaguucugagaccugcgucuaaaaaguaaguuaaacuuuucuugcaauagacaauacucagauuuuugaaucuaaguauauuagucaaggucccagcaauauacagauggcauacucaaaugcagcaauuugaagagaauuaaacaagaucuuuuuaaaggugugauauaggaaaaccauggggcuaugcaauaccugucacccuugagccugaagggcuuagugaagggaguggcuguaggcaccuggagagggcugcaggaaagguaccaccugugagauguacccuacaggugggccaugcugccagccugugucagcccccagggaaggcccaggcaucacucacuuccuucccccaccccugccaaggccccuauuggccaaacccaaccaggagccagaggguaagugagcuuauagucaguagggcucagccuuccaggcaggaauaugguggagaaacguggagaauugaucuagaggggccauggcagacaggcagcaaccaagucaccauaaaguaagguuuggggagaaguuggcaagagcaaagaaaaaggugccaaacccuacaacugcccucuagcugaccaacgcuaauccagaccaaaaugaccauuauaggaaaaagggaauuaaaauauucaaauuuacuucuuuccuaacuguccguggggcaacuuacuuuuaaaguaaaauaaaaccagcagaacugaaauuaagagacuggagucucuuaaguuauuuguagaguaagaacaaucuuauuuaccuccaagaccauggagccaaauucuuugucuuuauauagcuguuucgcacaggcuaggaugguagaugucuugccugucccugggggaccguagagaagcaaguguggcagucggucuucauugauaaacuucugaacugaggaucaggaaggaagaagggcaccaucagucuuugggagcugccucauucacccugggcuccugaguugggcugaaagcucuucaacccaauucaauguccaaaucagaggcagauacaacuugauguaggggccucauaucuacuuucguggaacaacuggaauucacucaauagcgcagccagucaacaaguauuuauugagugccuacuguguuacaggcaccuuucugggugcuggcaacaucugugaacuuaaaugauucuccguaaugcuauuuuuacuccacuguguugcaauuuuaugcucauguuugugacuuacccacuggacuguagcaaccugaagaaaaugaaugaaugaucuuaaagccacauucuacaaagcgcaaucagauucuuugaaguuauuacuuaggagagacaacaucaccaagcaauuuauacaagucgcucaagcaggacaagagcaacugacacaugaauacuuacugguacucagaauguccugaugagaaaugagaucauucagggucuguggccgguauuuuucaaccc

SEQ ID NO: 14046 - RNA, 1536 nt, Homo sapiens
agguggagcgacuuguccaaagucacagugugagcuaauagcagagccagguguagaagcugggccucuuugcucauucugucuuacaagggcacccugcaguagccuggaagaaaggcuuuguuccugcauccugggggcuuguggcacaguguaccugagggagaacuggaggagcccagcacuagcacuguggccccaucccccacuuaaguuagggacucuucuuuccuugccccagaaaacagcugcuggaaggguuccuaaggaggaagccucuuaaaaguaauagaguugcuuugggaauggggcaaacuagagggagucugcagagaaagacaucaucuggaaacuuuucaaaaagaguuaacauggaauagcaacagguaggggagagcuccaacauguuguguuggugcccccuucuggcugauagagagcagagcuggugaaaaaugguuguuggcuuuccaacaguguaccuuccuaagggcacugaccccaaggggguaucaugaacauucagugagccuugauguaguaacagauucaccuuuccuuugaacaaccaguauucaaggguagugagauugguauuuuccugggcucaaguuuggcuucgcucaaguuaggcuucucuagaccuuaugucuucccuccuuuaccuccuucugacuuuugaccguuaaauuguagauggugaguggaagcacuuagcaaaccuuucauuucccagcugaagaauuuuuagggaaagcaugccuagcacucucuuuucaagguauuugcagaaagccaacuaacuaguuuagcagcaagcuaauguaguucaguucauuagguauugauugguuacauacugugccaggcccugugcaggggugcuggugacacaaagaugaagaagucuuugcccuggaggaaagacuguauaauguugugauuaagagcuugugcuuuggagucagaccgaccuagcuuugaguucuggcuucaccacucauuagccauguucaccugaucaaaugacagucucucugagccuuaguuucuuuaucugucuaaugaggauaauccuaacaaccucauaggguuauuaagaguaagucauguaauauaguaagugcucaguacaugauagcuaaauuuuuuaaaguaugcacaauuuagugagacaaacguaaacagagaugguuguaguuuagugugauggcaaauaugguaggaagaacuuaggggcugugagaguccaaaaguacuguuagcauggagucuaaaaaaacacuuacccggaccacugucuuuuuaacucccuccugggucuuuuuuuccccacaggcauacuuuuuugaugcaccagagauggaccaucucccaacaacuacagcuacuccaaaccaaacaguugcugcagccaaguccagcuaaugaggaaaguaagagauucuauuuuuauuuugcuguguggugccauaaaacaugggcagguguaucaauucuguuaguguuagcuuuaagcacagagggccagacccu

SEQ ID NO: 14047 - RNA, 73128 nt, Homo sapiens
cagcgccgccaccugcuucuggcgccccgcuggacccugcuucgaagggaccguuuggucgccagagggcgguuccuggaguuacagccgcguuugcgggacgugucugcgcggcaguccuggccuguugagcuuguccagacgaagccucgcagggauggguuggagccugggccgggcuucgcucaggcagcguuugaggcagacccagcaggguccuccuggggccuuccugccuuugaacugcgguggcgggcgggcgcacggucuccuguacgcccuagacuaggggccgccaucuccauggccacggccgugagccggcccugcgccggcaggucgcgggacauacuguggcgcgugagugcggcgugcacuguggcacgcacugccagggucgggccgggcgggcaagcucugaucgcgcgugcgcgcugggcgggggagggccggucccggggcagcguggagagaacgcguggggaaggcaccacuugggggacugauugcaggguugugggaaguccugaguggaaguugguuacgggguaggagagggguccugaguggaaggaagcuggucagagugggacggauggacugaauggaaauuggaauagggagugaggcggaguuuuacgcaaggguaccguauccaguaggugcaaaauaaauaacuuaauuuguuucguuaagaagugggaaggaaugcacggaauuggaaagaaauguggcauuaguagaggcugggguuaggguccaguaagcagggcagguguucuuuguaagguagaaugggacugagcugaguggaauaguacuuccuccuuaaaguuacggaauuaacaguacuacaucgcuucucuggagugcaaagagaaagaggagaaagaucccuuuuggaaaagugcuucuaucccagugcacugccaucuccccuguauuccaaacuaaaaacuuuuggguccguaagucuuaucuuuuuuuuuuuuugagccggaggcucgcucccuguugcccaggcugcagugcaauggcgcguugucggcucacugcaacccccgccuccaggguucaaggaguucugccucagcuucccgaggagcggggauuauagauacgcaccacuacgcccagcuaauuuuuguauuuuuaguagagaugggguuucaccauguuggucaggccggucuugaacuccugaccucaagugagucauccgccucggucucccaaagugcugagauuacaggcgugagccaccgugccuggccucuaaaauuuuuuuaaaaauuauuuuuauaauagagauacgauaucuucuccagccuggucuugagcuccugggcucaacuaguccuccugccucagccgccuaacuauuugggacaucaggugcaugccaucgugccugguguauguuuagcaugcaugaguacuucauuccuuuuuguggcugaauaauccacuguauggacauaccacauauuuuguuuauccauucaucaguauguggguauuuggguuguugccaccuuuggcacuugugagccaccgcacuuggcugacagugucuucugaagcaaaaaaguuuuaaauauugcugauguccaauuuaucuauauuuuucuuuuguugcuuaugcuuuuggugucauaucuaagaaaccauugccaaauccaagaucaugaagguuuacuccuauguuuucuuccaagaguuuuauaguuuuagcucuuacauguaggucuuuaauccauuuugaguuaauuuuuguauagaaugugggauaggaggcugggcgcuguggcucacgccuguaaucuuaacacuuugggaggcugaggugggaggaucacuuggggucaggaguucgagaccccaucucuacugaaaaaaaaauuagucaggugugguggcgggcaccuguaaccccagcuacucagguggcugaggcaggagaaucacuugaacccgggaggaggagguugcagugagcugagauggcacuguugcaucuagccugggggacagagcgagcugucucaaaaucacaacaucaaaaagaaugugggauaggaguucaacuuuauucuuuuuuuuuuuuuuuuuuguuagacagagucuugcucuguugcccgggcuggaaugaugccuggcuaauuuuuaaaaaauuuuuuauagagacaggguuuuaccauguuggccaggcuggucucaaacuccuggccucaagugauccgcccacccuggccucccaaagugcugggauacagaugugagccaccacgcccggccucagcuuuuugguggacugccuccuaacugcauugucucugguuugguucgugucccaacuccuccaucuuccuuaaagccagcuuucaguaaacagacauguuuuaccuugagcaacaugaauuugauugucacuuucaugcuuaaaaccccucuauaucuucuuguauuauucagcaguaaauauuuuccuccuauaugauagauacgggcaauucaaacaugaauagaaugcuacagugccguaguugcccaguaaagguucauaucugaugauuauaaauacaguuacaguauacaggugguucccauaaaauguguacagccuuuauauauuaauauagcuaucaauuaagccuagagagacaaguauuaguugcucuaaaacagcuguaaaucaaugcccaccaccccucauacaaaguaugauauuugauguugcaccuaacuuuguacuaaugcaggcaucagcucacugauacuauaaauucuuuagugguacguaauguuauuacuaguagugaauguuugaguuacggauuaugaucugaguuagugguuaacauccuguaugaaaagauaggauuugcauaacugaaauaauuuaacugacuucaugagugaggguuuuucuuuuuguuuauagguuuugggcuggaggauaguugcaaguauuguuuggucagugcuauuucuacccaucugcaccacaguauuuauaauuuucagcaggauugauuuguuucauccuauacaguggcugucugguaggugauacucaacuuggggagaaaguuauaggaccuacuucucaacauaaaaauugcauuauguuucaagcaguuuauuuucaauuacugccuauguuauauugacacaucaaaacauucacuuugagauaauuuuaagaugucuccuucguaacauaaaucaccuuuuuauuauguaauaagauuaauaagcuugucaaagacugugaucauaggaacgaaaagaucauuagaagaccccauaaaugaaaacuuaguuucauuuguuuuuccuuugggcagcuuuauugagauuguuugucucuuuaaaauacagaaugguuccugucaucgauucgaaauuguggguagaaaauaugacauguaccucuuuuaaaaauacgucuaaaauuaagagcacuugauuucuuuuuuugaaacagagucuugcucugucacccaggcugagugcaguggcucagucuuggcucacugcaaccucugcuucccaucuucaagcaauucuugugccucagcacgcgccaccacgcccggcugauuuuuguauuuuuaguagauacgggguuuugccacguuacccaggcuggucuugagcuccugacuucaagcaauccaccugccucagccucccgaagugcugggauuacaggugugagccaccgcaccuggccuaaaauguuccuuaaauuccuuagagacuaaguaaaauuacuaaauguauuaaaauuaacuuguuuucuguuaauaacuacccauuauugccuguuuaccgugugccagcuccuuacauauauuacuucuuauccuuccuguaacucuguguaguuaagagguacuuucuacuuuauaaaugggauaacugagauucagguuaaauaauccaugcagagacacccagcuagugaguaacugauuuaggauugaaaauuggucuuucuuuugccuuguaaagugggaaguugaguuuuuaauuucguuuuucacaagaaaaugccaguuuucaaggaguuggacucuuuacccaugaccuuuggagauauugguguuaaguuucuuguugacguacguccaucacuuuuucgauaggucccacuggucaggugaaauuaagccauaagccagcacaggcauagcaaauauuucuauagccaccuuaccugugucugcuucacucacugaucauggcucucugguggcaaccuuagaguacucaaucuuguauuugagagccauuaccaauuguucacaauuggcacuggggacaaaaacuuuuugccauuucauggccagagguuuuuuaauccucaucacacuuucucugcagguuggauuugauuuaugccauuuuccucaucagaagcuuggguuuaauuguagaugcuuaguaaauauuccucauuaauuuaggucaaugggccgagugugguggcucaccccuguaaucccagcacuuugggaggcugaggcgggcggauugccugagcucaggaguuuaugaccagccugggugugguggcaugcaccuguagucccagcuacucgggaggcugaggcaggagaauugcuuaaagggggagugggggguggaggcugcagugagcugagaucacgccacuucacuccagccugggugacagagugagacuccaucucaaaaaaaaaaaaaauuuaggucaaugaauuguacuuuuaaaaauaagugguuaauuuuuaagucuuagcaaacaugcucuuauuuuuauuucauucauauuuuuaggcauuauauauauauauuuuaaacuuugagauggaauaucgauuguugaacuacucuaaaaugugaauguauuaguauuucaugggggcauccugauuuuuuuguuuuugaguuccgcucguuuagaugauguaauguauggcuuauucuauuuccaaaaauguuacuuuagcuauaugagguaauugcauuuaugaagaagagaucugaaaaguauucuuuauauuuuaagaaaaaacuuuguugguauauuacuaaagaugauacuucucuuucacaugauuaaauauuugcauaugcguggcugggugugauggcucauaccuguaaucccagcauuuugggaggccgaggugggugaauuacuugaggucaggaguuugagaccagccuugacaacauagugagaacccaaaaaauagccauggcgggcaucuguaaucccagcuacuggaaggcugaggcaggagaauugcuugaacccaggaggcggauugcagugagccaagauugagccacuacacuccagccugggcaacagagcaauacucugucuugaaagaaagaaagacagagaaaagaaagaaagaaaguuuugccauguucuaguguuuugucugauguuaacugggucauuuaagaaauuguaguauaauuuuaaaguaccuggggccagguacgaauaacucacacuguaacuccuuuuuucucccccccuuuguuuuugaaacaaggucuuucucuguugccuaggcuggagugcaguggcaugaucacugcucacugcagccucaaacucccaggcucaagugaucuucccacuucagccuccugaguagcuggagacugcaggugugcaccaccacaccuggcuaucuuuguauuuuuguagagauaggguuuugucaugugcccaggauggucuugagcucccuggcuuagugauccccccaugcccagcccacacuguaguucuugaguugauaucucauugaaccugucagugguguacaauuaaauucuugaagaaaagauaaccuuuaaaauuaaugacaauugugguucaagcucuuuuuauauugcaguguccugaacgugacuacaugacugaauaaccuuuacuaauucaucucucuuguguuuuagauucuuucagugaccuguauaguuccuauguaaucuuuuacuuccugcugcugucagugguaauaauaauaauaaguauuuucaauguggaguucuaugcaggugaguuuucaaauguuaaccuucuuagaaauaugcgaauuuauuuaacuaagggaagacuuaguacauuuuauaugugaauguguuuugugucaaaaauuuaaaaacguauacagaaucauaugcuucaaauguuguaccuuaaaauuuauuugggugcuaguuucuguuuuaaaaauauuuuuagacuuuuuaggacaaauauuauaugauucuacuuauacgagguaucuggaguacucaaauucauagagaaagaaaguagaaugcugguuaccaggcgcugggggagggggaguggagaauugcuguuuaauggguagaguuguggaagauggaaaaguuugggagcuggauggugguagugguuauacaacaauaugaguguacuuaugccgcagaacuguguacuuaaaaaugguucgaauagugaauuuuauuauuuuaccacaauaaaaaaauuuagaccuuuuaauaguucauaacuaguauuaaagcugugauuuagcagauacauuaugaaaagaauuccuuuauagggaagaccaggugauuucuaaguuuuuuuuucaaauauaauaaucuauaauacugugauuaaaaaaaaacuuauguuuugccuuggagaaucaccugcuggauuccagagcuuuuaauuuuucuguuucucuucauauucuuucugccuuuucagauuccuugagacugccuuuaagauacaaguuguggcagauucacauaaggaaaaaaagauacaauaagaagcuuuuccugacucuuauuuuuuuacuauaacaucauuuuccuuuuuuuuuuuugagacagagucucgcucugucgccaggcuagagugcaguggugcgaucucagcuuacugcaaucucugccuccuggguucaagugauucuccugccucagccuccggaguagcugggauuacaggcacgcgccaccacgcccggcuaauuuuuguauuuuuagaagagaggggguuucaccauguuggccaggauggucuugaucucuugaccuugugaucugcccucggccucccaagugcugggauuacaggcgugagccacugcacccagcccauuuuccuuuuuuuaaacuuaaaaaaaauuuuuuaaauguacauguuccauaugugcuaacaugucuaaaccuuaaauuaguuuaucauaaugucauguuuuagauuuuacauuucauugauuauaugaauauucuguuuauuuauuuauuuuauuauuauuaucauuuuugagacggagucuugcucugucgcccaggcuggagugcaguggcgcgauuucggcucacugcaagcucugccuccuagguucacgccguucucccgccucagccucccaaguagcugggacuacaggcacccgccaccaugccuggcuaauuuuguuuuuguauuuuuaguagagacgggguuucaccauguuagccaggauggucucaaucuccucaccucgugaucggccugccuuggccuuccaaagugcuggaauuacaggcaugagccaccaugcuuggccuauuuauuauuuuuuuugagagaaacagaugcgguaggaucauagaauacucagaccgggaggaauuuuuuuuuuuugagacggaguuucacucuuguugcccaggcuggagugcaauggcgugaucucggcucaccgcaaccucugccucccgguuucaagcgauucuccuaccucagccuccugaguagcugggauuacaggcaggcaccaccacaccuggcuaauuuuuucuauuuuuaguagagaugggauuucuccauguuggucaggcaggucucaaacuccugaccucaggugaucggccugccucggccuuccaaaguguugggauuacaagcaugagccaccgcgcccagccuacaucauuugccuuuuuaguucuucaacacuuccuuguaaaaucuggcguaaaauuucaaauucugacuuuggauguuacaauacguauccuuuucccuugcuugcuuucuguuuuuggucuccaagauggaguccagcuuugucgcccaggcuggagugcaguggcacgaucucggcucacugcaaccuccaccucccaggugcaagcaauucuccugccucagccgccugaguagcugggauuacaggcguaugccaccaugccuggcuaauuuuuguauuuuuaguagagacgggguuucaccauguuggucaggcuggucucgaacucccgaccucaagugauccgcuugccuugaccucccaaagugcugugauuacaggugugagccacugggcccagccucgcuuucuuucuuuuuuuuugagauggagucucacucuguugcccaggcuggagugcagugguauggucuuggcucgcugacgccucugccucccggguucaagugauucuccugccucaaccuccugaguagcugggauuacaguugccugccaccucgcccgucuauuuuuuguauuuuuaguagaggugggguuucaccauauuggccaggcuggucucaaacuccugaacucaugaucugcccaccuuggccucccaaagugcugggauuacaggcaugagccacugcacucagccugcuuucuuaauuccucacuauugacuaguaagcuuuuuccaugcaagcccuauucgaaacuccuuggcuuacagccacacuuaaacagaguguucuuucauacucucccauaugcuugggucaucuucuguauguaauaugucaguugagggguccccagccaguccuucuuaaagccugacuauucacuuuggcucauuccuucaguaaccaucccuuaugcauuuacuauaugccaugcauuguguggagagaaaagagaaaugauaggucccaucuuucuccagagaucgugauuaauggagagacaguaaacaugaagcauauuugauuacaguacauuggaugguaagagcuuguauaggagcaccacuugccccagcaugggggaacuugaggagaugauccuuaaaccaagccuugcaggaugaguugaauuaaguagacaaagaaggaaaaugauguucuagagagaagguauagcauauaaaaaggcuuagugacaugagaggguuugguauauuuagaguguuauaaguuaguugcacagucaguaggaccuugugggcauuucugguugggagggagaggucauaggaaccucuuccucaaaguauaaagcaccugaaacuugucccuucauacuuaauuuucuaccuccugccaucucuuuacuuugaguauaguaagagcaaaauaccuacauagauagaucagggaacccuaggcuagcuguuuccaaagguaaacaucccucauguccuacccauaguugccucccuagcucauuugcagaaaauguuuuuggauugucugaaggguauuaaaaaucccuauauaagcauuuaucuuagcauuuauguugucaguauuuaccuacuuuaugguuuauuuuucguaaguggauuauauauugacaguuucaaaugcugauggcaggaguucuuuuuaaaaaguaggccaggcaugguggcucgugccuguaaucccaacacuuugggaggccaagguggguggaucaccugaggucaggaguuugagaccagccugaccaacauggugaaaccccaucucuacuaaaaauacaaaaacuagccaggcaugguggcaggcaccgguaaucccagcuacuugggaggcugaggcaggagaaucgcuugaauccaggaggcagagguugcagugagccaagauugcgccacugcacuccagccugggcaacaagagcgaaacuccgucucaaaaauaaauaaaauaaaauaaaauaaaauaaauaaauaaauaaauaaaaagucaguauucaggagcugaacccagucacucucccacacugcaagaccauuacaguaguccauauaugaaaaaaaaaaucauuauucuuuuauggugcuuaggagaauacuaggauaggcacuauuggaacuauuaggaaauuuuaaugaaaaauguugaucaugcuguccuuagguuucaucucuagauucuuuggguuuuuuugugucuguuuauucaugcuuuccucaaauuuuuuuaacuuagaauuuuuaacuuuaaauuuuucuguauuguauuugcguugacuguggauuucucucugccuuuggaacauuugugcaaggaugagaggggauaguuuagauccucuaacugcauaugcuguagguuauaaagccacaguaauguguuuccuuugcaguugugccuucuauuccuugcuccagacuagcucugauagggaagaucauucauccucagcaacucaugcacucauuuauucaugcugcaaugggaauggugauggccuggugugcugcagugauaacccagggccaguacagcuuucuugugguucccugcacugguacuaacagguaauauuaaauauauauuuccuuaggaaucucauuuacuuacuaagccaaaggugaccuauauagguuaauccuaugaguauucuuugcuuuccagacuucugcaaaaggugcuuuuugcauauaucaaguguuuuuaauauuuuguguuuauugauuucagcaauuaaaaaaauuuauuaugugcaaggugcuaugcgauuuaugagagugacucaaacauagacuauaagcucuuugagaguugagaacaauagagaaauuaagacauggaugcagagggauguaauaggaugaagaaagugagaugugcagacaaaaccuguggagguucagaaaacaagagggauccacacauguucuuggaagagguagcauuugguuggaguuugaaggaaggguaguauggaaagaaugaagaaaaauuuuuaaaaauuauaacugccuuuuuauagagugcuuuuauaauuuugaaacuuguauaguucuugaacacauggcauugauacuaauugcaaauugauauucugacuuuaaaaauuaaaaaagauuacuggaagccaggagugguggcaugugccuguagucccacugcuuggcaggcugaggcaggaggaucccuugagcucaggaauuagaggcugcagugcccuaugauuaugccugugaauagcuccugcacuccagccugggcagcauagugagaccuuguuuuuuuuuuuuuuuuuuuuaaacaaagaugauuggagugaucuuaaguucucuauuuuccacugacuuuaaaacaguguuacauuauuacuacugaauacuugauuuucuuuuugccuccagcuacuauuauauaaggcagguuguuuuuucccccuuaauaucauaggcuuucuuugguaaaaacuguccuguugguaaacauuaaaugauaaaagacugugaguacaggacuacuaugaaaaaggaaaucccaagugcucaccauggaugagucuugaauuccuuuuugcacuucucuuccuaauggagguggcagugaaguuccagggagcagaaggcagcaguaagcuacaaguuguugaagacauuauaaugccuauuacaaauauauuuccugaugauuucacagucagaaucuuuaacaaaacuaaucuucaucauuuuguaacucggaguucagauaacaguuaaccuugagucuuaccucucauggaguuagaugguggggcaggccuacaaccugugugccucuauuaaaaauugaguucuacugaauuuugauguuggcucuguauacccccagauaucucauagaucauagagauucucaagaaacucucaaaggaguuugagagcuuguuguuuaccaaauagaucuuaugcuuauaauuaaagcuauuguaaaaugauaggguaguggcuuaaagcaguguccagcagggggauccucuuagauuugggaagcaucaggaguuccucuucagcaggaguccuucaggcaguucaaacagaugauaagucccauagccaccugggagcugcagucuugucuguggauaccacucagcuacaaggaggaaaaaaaaucgguaucggacauguaugggacucuaucugcuuuaaaggccuugugccccacaaaauccaguagcaucucuuguagcaauuuuaugggcacaggauccccgugagggaauacucaguuuuaaagagauaacacaaacccaauguuauggcaucucuaucagguauauauaacuuauuuacaguugcugucagcccagacacuuguaagcaauacugcuuguuauuaugguagauauacuuaaucaugucagauuuccaggggaacagagguagaauuaauuaaagaucagagucucaugauucaggaaaaaagguuuuguuaaucuuguucacacuuacugaaaacgagccaucuuguuagaauuugggacauuucuuaagucauuaaaguaauuaagcuuugccuucaguaaacauugagccuaaaacagugauacaugucccugacuguugaauuaauaacuuaauuuuuucccuucagcuuugguagcccugcugcgcaaaccugcuuaaaugaauaucaucuuuuuuuccuacugacuggagcauuuaugggcuauagcuauagccuccuguauuuuguuaacaacaugaacuaucuuccauuucccaucauacagguaagaucauuugagcauuacuugaugucaaaauuuggcugagguaaaauugccuuggugcauauguauauaacuggauuuaucugauucauucaagauuugauaaccaacacuuagaacugaaauccucaaaaugccauuuagcgagaagagauuugucuucaugagacuuaagcauauuuuugagaguugcagcuaccuuuuccuguugccaaucucagaauaccucuuugcuacacuguuucccucccugcuagguaguggcacuugcugugacccagcaggguuuggggaagaugaugaugacauucaugcaaaguacucuguguagcuucuuuuuuuuuggagacagucucgcuucuuugcccaggcuggagugcaauggcgcaaucucggcucacugcaaccuccgccuccuggguucaagcaauucuccugccucagccuccacaugccaucacgcccaguucauuuuuguguuuuuaguagugacgggguuucaccauauuggccaggguggucuugaacuccugaccucaaguaauccccccaccucagccucccaaagugcuggaauuacaggcaugagccaccacgcccagccgcugcucuuuuuuucuuuuuugagacagagucucacucugucacccaggcuggagugcaguggcguggucacgguucacugcagcaucaccugcuggcucaagccauccucccaccucagucugcccgaguaucugggacuacaggugugcaccacugugccuggcuaauuuuuguauuuuuuguagagaugggguuucuccauguugcccaggcuggucuccagcuccugggcucaagcuaucugccuguguugaucucccaaagugcugggauuacaggugugagccaucguggauggccugcuggcuucuuuuugaacuuagaaccuugugaguuuggggaugugcaaguaauuuuagaacauaucacuuacugucuccuaucauuuucagaacaaggcaaaguuuguauaaauaaaacaguuucagcugguuugagugguagaguauaaacuaccuuucaguuaagucuuaaaaauguaaucugguaggagucauuccuggaacugagaagcacuccucuggcaggagagggaaagguggcugagaugucucacagaugcaucagggcucuucgcagccuguuucugcugcuccucauucgcacaauucuauuacuugcuucauucaugcccuggcaggcugaagacugggcauuggagcaaaaauguuagaacuagccucccucccacuaggacucagucugguggggagggagggauauguaaacaaaugguauauuauuauaagaguauaacauauaagaauguguuggauuaacuaaaguuuuuggcugggcacauuggcuugugccuauaauccaagcacuuugggaggcugaggugggaggauuucuuaagcccaggacuuugagaccagucugggcaacauggcuagaccgugucucucucucucucuuuuuaaauuucuuuuucuuuuuucuuuuuuuuuuuuuuuucgagaaagguucuugcucugucacucaggcuggagcgcaguagcacgaucaucgcucacugcagcuuugaccuccuggcucgaacaguccuccuaccucaguccuccugaguagcuggggcuacuggcaugcaccaccaagccuggcuacuuuuguauuuuuuguagaguggggucuagcuauguugcccaagcuguucugacuccuggacucaaacgauauacccaccucagaauacaggcaugagccacuaugccuggcugagacccuaucucuuuaaaaaaagaagagaaagaaaaaagaaauaaaguuuucacaugccuguugcauccaugagaacaagcuaaugaaaauacacacacagcagggagauggugcccacugaaaaggaucuggcccucaccucccugcaaucugaguguaugaaaaaaaaguccuaucuagaaauccuucauaucuugugaagaugaauuaaaagcaggaugucaacuuggcuaccucaaaauuucacaaggagaaaaacuccaaaaucuuauauagaaauguccauaauaaaucaucuuugauucuaacaaaauuaagaauauuaaaaauaaaagaaaguguuagggaaaaaugagaugccccacaauaccuugcuggaccuccaugguccccaguugaaagugaccauguauuuaacaccacagauaugcaguagagugcacauagaagucugauaguugacaaugcugauaaauuauuguuucuaccauguacuguaaaaauuuguaaaauuuuaguacuuucuuuuuguaauuucuuuugguaaaauguuagauuuauucuuaaucccaaaaguuuauucuaugaugguaauauucagcuuuggcuucagcuuugacagaguauugauuuuugauaauugguaauucaguauuuggucaaaaaauauauauggggcaugucuuguagccaugaguguauagugguauugguuugcccaggugggcgcuguucuccagccuggggaugguuggagcagguguuuugcuggguggugugguggaagggcaguggaaugaggaagcugaagauuuggcaagacuaguggaaaugauagcucuuggugcccagaaccauaguuuccugccuaucagguuuguaagugucuugccuggcaggguagguuugccucccgagaagacuaagagggagggaggacaccguagcuuaucuuucuuucauuagcucuagaaguguuucaccuuuccaugugcauuuuaaguugcuaaggaagcaaguuggauugucaggaaacugcaaguuugaugugagaagucaggcccauucccauucugacccucuauagagcgcgaugugaugauugauagccaagcugaccagagaacuuuagagcuuaaagaauuuuauaagcaauaacaaccauuaucauuaucaucauuauuuauuuauuuauuuuuugccagacagucugaguauguuuauaucaucauuauuuuugaugcuaccugucagguagcuuuccaaagugauaauauuuuuauuauaaaauauuuaaauaucauauugauaaauugaauguuuccuugaccaucccauggccagucucaaucuuugucccacugguaaccauuguuaccaaugggauuaaggauauacacuaaacugguaacaguuuaccgguuaaaggauauacacuaaacugguagcaguuuaccaguuaaacugcuaccaguuuaguauauauucuuccagaccguuuaguguacauuuacauguauguaccuauaacauuauauauuuugugaagugggguuuauauaagugguuuuaucuuauauauauuauucaguaacuacuuuuuucauguaauuaugaaaauuugaggcuuuuuuuugagacggaguuuugcucuugucgcccaggccggagugcaguggcacagucccggcucacugcaaccuccgccucccagguucaaguaauucuucugccucagccucaugaguagcugggacuauaggcgugcgcuaccacgcccaacuaauuuuuguagaaaaauuacggcuuuuuaaagaucuacuaauuuuaaccaauuugccauuaguccauuaguuuuuucuuuaaacuugccuacacuacuaaaaccaguucuauugccuuuaucagauucuuuguucugugaguuaccaggaguguaaaaaauacaaauaauaaaaaagaugaaaacaaaaucacccaaccaaaaaagaacaggaacaaaaauaauucuuaaugauggacccauagggaaaagcagacuguuaguaugaaguagggcacaaagaaauggacaucaagacaacuaugccaacaagacuguugaaaguauuacauuuauagagcauuuagcauagugccuggcacacaguaaauauuuagugaaggguaguucauagcuacaucacagaagaaauccaacagagaauugaaaaacacuucagcaugggagcaagaggugggggaaaugguguuuucugccugucugcugaaaugucgaccugcuucccuagccucucugaaccuuugugaagaaugguugaggugaaagcuauaguaggaauagcauaggaacuauggcguuuuuauuggggcaggugugugguggugguagcacccaguggcuacacagaauagugcaauuccacaucuuguacuuugaaaauauuugaacagaccaauauaauugaagcaauaugauuagugaccaaguauuuauaugggcuacuuuuuguuuguuuguuuucuuuuugagacagucucgcucugucaccuaggcuggagugcaguggcgcagucucggcucacugcaacuugaacucucagguucaagcaguccucccagcucagccuuccaaagagcugggauugcaggcgccugccaccgugccuuaucuuacauauauuauuuuuguauuuuuaguagagacggggcuuugccaugauggccaggcuggucuugaacuccuggccucaagugaucugcccaccuuguccucccaaaguuuugggauuacaggcaugagccacugcaccuggccugggcugcuuuuuguaagauacuguaggcaucuccauucauaauaugaagauauaguuucugaauacuauaauuauuugcuguucuucagcuucugaaauuccuuaaggaagaaucagucguaauauaagcauaaaagaagaccagggcugggugcaguggcucaugccuguaauccuagcacuuugggaggucaaggugggcagauugccugagcucaggaguuugagagcagccugggcaauauggcaaaaccccaucucuacugaaaauauaaaaauuagccaggcguggcgugccuauaguccuagcuacucaggaggcugaggcacaagaauugcuugaaccugggagguagagguagcagugagcugagauggcaccacuucacuugagucugggaggcagagcaagacucuuaucuccaaaaaaaaaaaaaaaaaaaaaaaaagagagagaaguacaucuuuuauuuuuuucuuuuuccuuagauuccuucuaaucauuuaucuuguuuuccauugguauuuuaggggcagagacugagaaggagagagagguagacaaccuuuguuucagaaaacguguaguuuuuucaagaaaagacauuuuuuuuuuaauacuuuaaguuuuaggguacaugugcacaaugugcagguuuguuacguauguauacaugugccauguuggugugcugcacccauuaacucaucauuuaacauuagguauaucuccuaaugcuaucccuccccacuccccgauuuuuuuuucuuauuugauuccuuuuucuuagaucaagcuuguccaaccuguggcccaacauaaauucauaaacuuucuuuaaacauuaugagauuuuuuuuugcgauuuuguuuucuuucuuuuuguuuuuuuuuugagacagagucucacucuguugcccaggcuggagugcaguggugcagucuuggcuuacugcaaccucugccuccuggguucaagugauucuccugcgucaaccucccgaguagcugcgauuacaggcaugugccaccacaccuggcuaauuuuuguauuuguaguagagacgggguuucaccacauuggucaggcugguuacgaaccccugaccucaagugacacaccugccucaggccucccaaagugcuaggauuacaggugugagccaccgcacccagcccuuuuucuuuucuuuucuuuuuuuuuuaagcucaucagcuaucauuaguauuuuaugugucacccaagacaauucuucuuucaguguggcccagggaagccaaaagauaaggcaccccugucuuagaucauuagaauuuucagguucccacuaaggaacuauuuagcugguucagcuuucuugucuuucacauaauuagagaggaggcaugacuuacugaggguuguacagaaagagggagcacuagaacucacaauucuugauuccuaggcuagugucuucuucacugccucccauuuuuuugcaaagagcauuuuuaaaaauucagugcaaaggcaguaugcauuaucuuuaagauuggaggcucugaagccagccugccuggauugauagcucagauuuuccuuuugcugguugauaacauugguuguuauuuaaucucucugugccuuguuuucuucaucucuaagaugaggguaguaguaaaaacucccuuacaggguucuuaugagguuuaaaugaauucaaauauguaaagugcuuaggacagacaguaccugguacaugguaagcaacaaaaaaauguuagcugcuauuguuacuguguuucuuguacuuucuucaucugcauagugcuuaguaccaaguauggauugauaugguuaauuuucuuauuucugauuuuauaucagugagauguugaauaauauaaauauuaauuuuuuaacaucugaaauaguugauguuuuugcuucugcaauacucuuugucuucuuauacaauaauuauguuuucuauguagacuguuacaguaaagugcuugcuuuaaggugauguugaguguaucauuugauuugaaugugucauuugauucuuuuuuuuuuccccacagcaauacaaguucuugcguuuuaggagaucucugcucuuauuaguuaaacacaguuguguggaaucacuguuccugguuagaaauuucugcauuuuauauuauuuucuugguaagaauuucugcuuuuugauacagugauauauuaucucauagcccagaaaaugucaguuacaaagucauucuuguguuuuuguguuuucuacaguuauagguaugugauuagcucaacugauucauuguuuaaauugucaaagagaauguauuuaggaaaauauuguugaagaaaaugugacauaugccuauaacgaaauauuauuuagccuuuaaaaagaaggaaaucuuguuauguacuacagcuugaauaaaccuugaggacauuacgcuaagugaaauaagccagucacaaaaagacaaauacuguaugauuccacuuauaugagguaucuaaaauagucaaacucuuaaaaaacagaauggugguugucagccuggagaguugggaagggguggaguuguucaguggguauagaguuucaguuuugcaaaaugaaaaguucuagaaaucuguugcacaaaaaugugcauauaguuaacacuacuguauugaacacuuaaagauggcuaaaaugguaaauuuuuuuuuuuuuuugaugaucugucacccaggcuggagcguaauggcgcgaucuuggcucacugcaaccuccgccucuuggguucaagugauucuccugccucagcuucccaaguagcugggaccacuaccaggcgugcaccaccauacccggcuauuuuuuguauuuuuaguagagaugggguuucaccauguuggccaggcuggucuuggacucuugaccucaggugauccgcccaccucugccucccaaagugcuaggauuacaggcaugagccaccacgcccggccuaagaugguaaauuuuauguguagguuuuuuaccacaauuaaaaacaaaugcauucuuuuuuuaagaaagaaaaaauacugugcaucauuuggucauuacucuaucuagaaaugacauccuccuuuuuauaauuuguaacuugauacuaauacaauguaaauauuuuguugguaggggaaacuuguggaauuuauuaacaugaauauuaagcacaaaaaucaguuuauuauuuaguaucaugaauagugcaaggugaaaacauuaaucuuguuagcaacauguaauaauuuaaacaaaauccuaccuucagaaauacuauuuucagauuauaacuuuuucugauccuauauuuucuauggauauauauuuuauaaaauucuucucacuguguauaggccauccuguuuauuucuuucacuuguaguuuauauaguccauuucuacauagcucuuaugauugucauucuucuguaaauacuucacugucauguuuuucuuuuauauuucuucuuucuuucuuucuguaaguuauugggguacaggugguauuugguuacaggaguaaauucuuuagugguaauuugugagauuuaggugcacccaucacccaagcaguauacauugcaccuuauuuguagucuuuuaucccucaucccccucccacucuugcuugcaaguccccaaaguccauuguauuauucuuaugccuuugcauccucaguuuagcucccacguaucagugagaacauacaauguuugauuuuccauuccugaguuacuucacuuaggauaauagucuccagucucauccaggucacugcaaaugcugauaauucauuccuuuuuaugugcauaguauuccaucauauauauauacacaguuucuuuauccacucguugauugaugggcauuuggguugguuccacaauuuugcuauugugaauugugcugcuauacauaugugugugcaaguauccuuuuugaauaaugacuucuuuuccucugaguagauacgcaguagugggauugcgggaucaaaugguaguucuacuuuuaguucuuuaaggaaucuccacacuuuuccauaguggcuguacuaguuuacauucccacaagcaguguagaaguguuccuuguugaccgcauccacgccaacaucuacuguuuuuugauuuuuugauuauggccauucuuggaggaguaaggugguauugcauugugguuuuaauuugcauuucccugaucauuagugauauugagcauuuuuucauaugucauuugccauuugucauuuucuaugucauugacuauuuguauaucuucuuuuaagaauugucuauucauguccuuagcccacuuuuugaugggauuguuuguuuuuuuucuuacugauuuguuugaguuuguuguagauuccagauauuaguccuuugucacauguauagauuguaaagauuuucucccacucuguggguugucugcuuacuuugcuguuuuuuuuuuuuuuguuuuuuguuuccccaugcaaaagcucuuuaguuuaauuaggucccagcuauuuaucguuguuuuuauugcauuugcuuuugggcuuuuggucgugaaauccuugccuaagccaaugucuagaaggguuuuuuucaauguuaucuucuagaauuuuuaugguuucaggucuuagguuuaaguccuuaauccaucuugaguugauuuuuguauaaggugagagaugaggauccaguuucauucuucuacauguggcuagccaauuaucccagcaucauuuguugaaaaggguguccuuuccccacuuuauguuuuuguuugcuuugucgaagaucaguuggcugaaaguauuuggguuuauuucuggguucucuauccugcuccauuggucuaugugcguauuuucacaccaguaccgcucuguuuuggugacuauggcuuuauaguauaguuugaaaucagguagugugaugccuccagauuuguucuuuuugccuagucuugcuuuggcuaugugggcucuuuuuugguuccauaugaauuuaagaauuguuuuuucuaauucugugaagaaugauggugguauucugauggggauuguguugaauuuuuagauugcuuuuggcaguauggucauuuucauaauauuaauuacccauccaugagcaugggauguguuuccauuuguuugcguugccugauuucuuucagcaauguuuuguaguuuuccuuguagagaucuuucgacuccuugguuagguauacucuuaaguauuuuauuuuuuuugcagcuauucuaaaaggguuugaguucuugauuugauucuccacuuggucacuguugguguauagaagagcuacugauuugugugcauuaaucuuguagcuggaaacuuugcugaauucuuuuaucaguucuaggaacuuucuggaggagcccuuaggguuuuuaagguaaacgaucauaucaucagcaaacagugacaguuugacuuccuuuuuacugauuuggaugccuuuaaauucuuucucuugucucauugcucuagcuaggacuuccaguacuauguugaagaggaguggugagagugggcauucuugucuguuccaguucucagagggaaugcuuucagcucuuccccauucaguguuauguuggcuguggcuuucucauagauggcuuuuauuacauuaaguuauggcccuuguaugccaauguugcugagaauuuuaauuauaaaggaaugcuggauuuuguugaauguuuuuucugcaucuguugagaugaucaugugauuuuuguuuuuaauucuguuuaugugguguaucacauuuauugacuuguguauguuaaaccaucccugcaucccuggcaugagacccacuuuaucaugguggauuaucuuuuugauauguuguuggauuccguuagcuaguauuuuguuaaggauuuuagcaucaauauucaucaaggauaacagucuguaguuuuucuuuuuugguugugucccuucugauuuugguauuagggugaugcuggcuucauaaaaugaauuagggaggguuccuucuuuaucuugugcaauagugucaaaaggauugguacuaauucuucuuugaaugucugguagaauucugcugugaauccaucugguccuggacuuuuuuuuguugguaauuuuaaaauuaccauuucaaucucacugcuuguuauuggucuguucagguuaucugauucuuccugauuuaagcuaggaagguuguauuuuuccaggaauuuaucugucucuucuagguuuggcaguuuaugugcguaaagguguuguucauaguaguugugaacaaucuuucauauuucaguggugucaguuguaauaucuccuguuuuguuucuuagugagguuauuuggauuuucucucuucuuuuuuugguuaaucuugcuaauggucuaucaguuuuacuuaucuuuucaaagaaccagcuuuuuguuucauuuaucuuuuguauuuuuguuguuguuuuuguuucaaauucauuuaguucugcucugaucucaguuauuuccuuuuuucagcuggguuuggguuugauuuguuauuucucuaguuccuugaggugugaccuuagaaugucaguuugugcucuuucacucuuuuugauguaggugcuuagggcuaugaacuuuccucuuagcaccgccuuugcuguaucccagagguuuugauagguugugucauuauugucauucaguucaaaaaauuauuuuuuauuuauuuauuuauuuauuuuuugagacggagucuugcucuguugcccaggcuggagugcgauggcgcgaucuugacucacugcaagcuccaccucccggguucacgccauucuccuuccucagccuccugaguagcuggaacuacaggugcccgccaccacgcccggcuacauuuuuuuguauuuuuaguagagacgggguuucacaguguuggccaggauggucucgaucuccugaccucgugauccacccgccuuggccucccaaagugcugggauuacaggcaugagccacugcgcccagccaaaaaauuuuuuaauuuccaucuugauuuaguuuuugacccagugcucauucaggagcagauuauuuaauugccauguauuugcaugguucugaagguuucuuuuggaguugauuuccaguuuuauuccacugugaucugagagagugcuugauauaauuucaguuuucugaaauuuauugagguuuguuuuauggccuaucauauggucuaucuuggagaaaguuccaugugcuguugaauagaauguguauucuauggcuguuggaugaaauguucuguaucuaucuguuaaguccauuuguuccagguauaguuuaaauccauuguuuuuuuguugacuuucuguucucauaaccuaucuagugucgucaguggauuauugaagucccccacuaucguguugcugucuaucucauuucuuaggucuguuaguaauuguuuuauaaauuugggagcuccaauguuagaugcauauauguuuaggauugugauauuuuccuguuggacgagaccuuuuaacauuauauaaugucccucuuugucucuuuuaacugcuguugcuuuaaaauuuguuuugucugauauaagaauagcuaccucugcuugcuuuuaguguccacuugcaugaaaugccuuuuuccacccuuuuacuuuaaguuuauguggguccuuguguguuaggugagucuccugaaggcagcagaugguuaguuggugaguucuuauccauucugugguucuguaucuuuuaaguggaggauuuaggccauuuacauucaauguuaguauugaaauauuagguaccaucgaauucaccaugcuuuuuguugccuguguacuuguuuguuugcuuuuuguuuuugcuuuucaacauguauuuuuguuuuauagguccuguuugauuuaugcuuuaaagagguucuguuuugauguguuuccagaauuuguuucaagauuuagagcuccuuuuagcaguucuuguaaugguggcuugguaauggcgaauucucucagcauuuauuugucugaaaaaggcuguauguuuucuucauauaugaugcuuaguuucgcuggauacaaaauucuuggcugauaauuguuuuguuggaggaggcugaagauagagccccaaucccuucuagcuugucggguuucugcugauaaaucugcuguuaaucugauagguuuuccuuuauagguuaccuggugcuucugucucacagcucuuaaagauccuuuccuucgucuuaacuuuggauaaccugaugacagugugccuaggcaaagaucuuuuugugaugaauuuuucagguguucuuuggugcuucuuguauuuggaugucuaggucuagcaaggccagggaaguuuuccuugauuauucccccauauauguuuuccaagcauuuagaauucucuucuuccucaggaacaucgauuauucuuaaguuuggucguauaacauaaucccagacuucuuggagaccuuguccauauucuccuuuuuuuucuuugucuuuguuggauuggguuaauuugaagaucuugucuucaagcuuugaauuucuucuacuuguuaaauucuauugcugagacuuuccagagcauuucgcauuucuaaaagugaauccaaaguuuccugaauuuuuuauuguuuuuucuuuaagcuaucuauuucuaugaauauuucucccuucacuucuuguaucauuuuuuggauuuccuugcauugggcuucgccuuucucuggucccucccugauuagccuaauaacuaaccuccugaauucuuuuucagguuaagucagggauuucuucuugguuuggauccauuacuggugaacuagugugauuuuuuuuggggguguugaagagccuuguauagucauauuaccaggguugguuuucugguuccuucucauuuggguaggcucugucagagggaaggucuagggcugaaggcuguuguucacauucuuuugucccacgagguguuccuuugaugcaguacucuccgccuuuuccuauggauguggcuuccugugagccgaacugcagugauuguuguuucucuucugggucuagccacccagcgagucugccugucucugggcugauacuggggguugucugcacagaguccugugaugugaacuguuucugggucucucaggcauggauaccagugcguguuccaguggagguggugagggggugcaguggacuccaugaggguucuuagcuuuggugguuuaaugcucuacuuuugugcugauugggccuccugccaggagguggcgcuuuccggaaaaccucagcuguaguaguguggagagggacuggcaguggguggggcccuagaacucccaagauuauauguccuuuguauugagguagggaaggaccaucagguggggguggggauaggcgagucugagcucagacucuccugggucaguuuuugcugcagcugcuguggggaaugggaguuagauuccuaggucacuggaguugugugccuaggaggauuauggcugccucugcugagucaugcaggcugucagggaagugggggaaaguggcagucacaggccucacccaggucccaugcaaaccaaagggccagucucacucccaccgcccugcaacagcccugagucuguuuccagguggaaggccagaugggcuugaaaacuugcccugggcuacccgccucccagcugggagagaaaagagcuugguucuugccccaccuguggagucuacacauuagauuugcccucucccccaaguucuggccaggaggcuucuugccccauuuaaauuguuacaaaguucagcuggagauuuccuuuucccuguggaguuuuacucccugcuccucuggucaaccuucugauggaucccuguggugccaggcaggaauggccugcuagggagugcagcaagcucccagggccuuucugcugcuuccucuaccccuguauuucgcuugacucucuaaacugguucagcuccagguaaggucagaaacuucucccacagacagaccuucaccuucuccaguggggguguguguucagaagaggagggucuuccuuuuccacuuccacaguuggggcacucacaguauuuggggugucucccggguccucaggagcagucugcuuccuucagagggucuguggguccucuugugauugcugguuuguucuugcagucgaucuggagcuaaaaaucacaacacaagcaucugcaagcugcccuguuuggagcugcaaucuaguccugccacccaucugccaucaugauuaguagugucucuuuucuuuuagagauggggucuugcuauguugcccaggcuagucuugaacucuuggccucaagugauccucccaccuuggccucccagaguacugggauuauaggcaugagccaucacgcucagccucauugcaauguauugaccuacuacauacagucagccugguuguuccucuagaguuguuuauuugggcuauuuuugugacuaugaucauuuccaugauuugcucuuucuccuauaacuucauuuauguucaauucaaauuucguuuucagcauuaucacuuuucauuucuuuguugcacuuugauuuuuuuuuuuuuugccaguuucuucuuuuuuuuaauuaaaaccauuuuauuuuuuauggaacgcuucaugaauuugcaugucauccuugcgcaggggucaugcgcaauuccccuuuuaguaugcgcaauuccaauuuuaguauaugugcugcugaagcaagcacuacuuuccuguuuuagcuauucauuuuuuaaaaguaucauuuggauuuauugugggaaacaaggaggcaacacaacuacaugcuuugcugucugugucuguacugaauaacagauccaagugaccaaucagcaacagacuuugagagaauugaugggauugggucacagauuauaaugcacaucgguuaucuacauauugauuuguguccugaaaaguuagaagugcuauaugcaguugcuuauaguuaauauaccacaguaacuagaguuugaacugcauuuuugggugacugguauuuuuuaacuaaaccaugguaacugaaauguguauauaucagaacuguacaaagcaaagacugccuguguuaauaaguacugucuuuuccuacucauuccuaauaagucuaacauuuugacugaggucuuggugucuguguggccaugucauugaccuuauauucuaaagcuugacuaaaacuuguuuuauaacuuuuuauguucauagcuugguauuuuuucccuucaggcuauauucccaaagcuuggauuagcacugcuaugaaccuucacauagaugaguaagugauaccuaaaaagucuaauuuuaacucuguuuccauucuuuuagauguuugcuauuuuccagauauuuuguuuagauuuugccuuuaacauuuuuuuaaaaauuguauucauuuuugaauacauauaguuuauaugguuuaaaauuccaaagguguauaaaaggguaaaauuagcaggacuuggugguacuugccuguagucccagcuacuugggagguugaggcaggaggaucgcuugagcccaggaguucaaggaugcggugagcuauaauugugccacugcacuccagccuaggcaauagagcgagacccugucucaaaaagaaaauaauaauaauaggguauaaaaugaaaaagucuccuccucugucuccacucacccaguucuccgcagaaguaagcaaugauaauuguucuuagaugcagcuuuuauacuauacaaaaguggcuuucucgaguugcauggaccaggccucuguuucguuuuucuccccaacaaucauuccuucucuggugucucaugauauauaccaaugcuguggcauuauucuaauuuagccuaugagaggaaaccaaaauugagcaaggucagguaaucaguugaaggucacaaguggcagucaagugacagcacgguuguauauuguuguaguaaucuucuaugcacuuugcacauaaagguuuaaucuguauuugccgaauaaaagucagucucucucaguguuuguucuuauuguauauuccacugugaggguuuuuguuucauauauggaauucacuaauaucaguuuuagggagugggaauauugacauacaugguauuuaagagauauuaugguuucucacuuuucaaaguuucuaggcaaaauuuaguuuugucuucugcuuacuugcuagguaugaaaccaaacgcaugagucauuuauuguuuuagcccagauuuuaaacuaggugaaauggaaagagaaaaauaauaauggcauuugauagaaauuuaacaauauuuuuuucuuccuugcacucaaaaaauguuuuguguauauggcugagugccugauaaucuguccuucauuuaugucagggccucaguaaaauguuuacuuagaaguuaaaaauaacuucaucauugguugacucccccagugaaugucaagcacugugcugggcacuccuaauguaagcuguuuuaaaaauuguaauaggacuaagaggaagaaugaacauauuaugccacucuuauauggaugaggaaaccgcuggugggauagguggagugauuuaccuaaucacaacacuuagaaauggcagagucagguuccaauccugguuuucauaauugcugguuguaggauuauaauaacuuugcuaauugaucuagucaaaguuuuggaaagauggcagcauuagcuuuacuuagcagucuaacagagugucuuaaauugcuuuaacauuguuuaguagcaugugcuuuuaacgacuaugaaucugugguuuauagggcauaaggauaaagcugaaaucugguccaggagaaguacuagucauguuuaaugguuuugagguauuagacuacaaagcaacaauaauaaacuuucacccagcugcucguagugaggcuuauaggcuuagcucauuccuccuucguaguaaaagucagugaagauuuugaacacaggaaacuguagccccgauuuaggucuguucuucccuuaaagcucccucauguaccucauaagaaaguauuagggaaagagcuuuauaaagauaucgaaggagaggagucugucaacauuguuauuuagacauaauauuugugucucaauguggagacuuaaguguguuaauauuuagauugcauuuuuccuagaggauuaauaguaauuucugcauucacaggcagguucauaggccacuugacacagugaguggccucuuaaaucucucguuacucuaccaugucuggcuguguggugucuuucuccugacgacuugguaugucucauggauacucuucaaaaucuaugccacagagguauguuuuuuaaaauauuuuuucuuaauacuuuuguguuuuggagugcacaguugauuuuuagcagagcacacugaucagcacacgcaaaaccauuuccguaagcugguuuuuggucucucuucugagacucuuggggccauaucauuuguaaccaccauuuaugugguauuuuuuuucagaggaacaguguggauauucacuuaauuuuuggagauuaaacugaauggacugccacuaugcuuuauugacauccuaguugucuucugggggcuuccauuucucuacugaguacauacuaaauggacuugaauuuuaaauuaauuuuccaugucauuggcauagcuacuauuaaaauauuuaaauauguggcaguaagaauuuuuuuuuuuuuuuuuuuuuuuuuuuugagauagggucucgcucugucacccaggcuggagggcaguggccugaucuuggcucacugcaacgucugccucccagguucaagugauucucccaccucagcuucccgaguagcugggacuacaggcgugugccaccaugcccggcuaauuuuuuuugaauuuuaguagagacaggguuucaccauguuggccagguuggugccgaacuccugaccucaaaaugaucuguccucgaccucuuaaagugcugggauuacaggugugagccacuccacccagccaagauauuuguuuucugaagggaaguuuuaaaauuuauauuaaagaaaugauuuuggaaauugaggugagcuucuggauaauucccacagaaaucuuuuuaagugauugagaauuacauuguuuuuaucauccaaguguuugucuuagaaaauuaguguuucuguuuuauuuuacaaucuccguagguuuguauucuucaguggcuucagagaauccuuguuugugaaagugguuuuuauuauucagagacagagucuaauaaaguugggaaaguaacauuaaaaaaaaugguguguuuggguuuauguaacuuuaaccugucuuugcaaggagcacgaaagaugucaguuugcuugugcugucugucuuuauguuuuaauuugugcaugcuuauugaauguaagaucaugaaaauaaucauuuuugguuuuuaauuuauuugauaggcucauguguuuccuguucaaccaccauuugcagaagggucagaugagugccuuccaaaaguguuaaauagcaauccuccccccaucauaaagguauccaaacuguguugcauaucuucacacaguuuucucuaacuuuauucaauacacuuaauauuuaguauauuuaaguaguuguauuuuuugagggccuauaauauucuuguacugguaugauaaaaaucaccuacuugcuaaugcuguuuauuuuuucaauuuucuuuccaagugacuaaaaugcaagugcacaguacaguguauguguauaagcuaguuaauucuauauucagaaacagauauaagaauauuuccaagcauaaaauacagugauaugcaaucaucuacauuaacuucucacaaacuauucaugauagcauaacaaaauauuauugauuuuuuuuuuuugagacggagucucgcucugucgcccaggcuggagugcaguggcgcgaucucggcucacugcaagcuccgccucccggguucacgccauucuccugccucagccucccguguagcugggauuacaggcgcccgcuaccacgcccggcuaauuuuuuguauuuuuaguagagacgggguuucaccguguuagccaggauggucucgaucuccugaccucgugauccacccgccucggccucccaaagugcugggauuacaggcgugagccaccgcgcccggccaauauuauugauuuuuuaaucacuggaucaaaacauuuuuacucuuguaguauuaguuggcuuuugugaucaaaaauagcgcuuagaaauguauagauauuuagugaacucuccuuaaauaugaauugcugguaaugacccuaaaacuaauuacaaucaagaauuuaaagaaguuguaguaauuuuacaaaucaaucuaaguaagcauaaaugguuuagauugaauuugcaaguugaaauuuuaaacuagaucuacaguaugugugauccuguuaaaagguccuuuaaaaagagcuaaaagaggcuguguguggucuucagcacuuugggaggccgaggugagaggaucacuugagcccaggaguucaagaccagcuuggaaaacauagggagaccucaucucaacaaaaauuuaaaaauuaguugaauggcaugguggcacaugccuguggucccagcuacuugagagguggaggcaauugcauuccuugagccuaagaguuggaggcugcagugagcugugacccugccacugcacucuagccugccacugcacuuuagccuggguggcagagugagaccccaucucuaaacaaacaaacagaaaugcuaaaagaaaguaguuagaacccaguuuugaucacacucuaaagaauuuauaaacaaauaagaaaauaaauagaauuacuuuuaaauauuaauuauaacuaauuuguuagagaaacuuaaaaguaucaguuacucauuugguuacucaccaaauauuuauuuagugguacgucagucucugcuaguuguuugugguagaaugaugaauaagacauagcacagccuaguagaaaauacagacgcccaaaauaacuaaaauguacuguggcaaauacauugggaccucuuauucagcuugggaccaaugcaagaaaacuucagagagggaugguaucuugaaggaugaguaaagggguuugccugggaaaagaugaagauuuucaguaaagaaaaaaaaaaaauaggguggccgggcaugguggcucaugccuguaaucccagcacuuugggaggccaaggcagguggaucacuugaggucaggaguuugagaacaaccuggccaacauggugaaaccccaucucuacuaaaaauacagaaaucaguugagugugcuggugugugccuguugucccagccacucgggaggcugaggcaggagaauugcuugaacccguaaggcggagguagcagugagccgagaucacaucacugcacuccagccugggcaacagagugagacuuugucucaaaaaaaggaaaaaaaaaauuagguaucacgugcuaggcacugccuuuggauaugguagcaaguaagauuuuccguuuucuugugggccgcacaguuugguggguggaaucagaugggacaaguaaacauucaauuacaauacaugauguuagugccauuguugagagcuaugugaguguauguuugugugagggaaaccagggaaaauuccaggaggaagugauguuucaauuucccaccgcagauauaugaaagagcacagagaauucuguaguuccuuguagcuagaacuuguaguagguagggaggguagaggcaggaaaguucuggaagucuagaaaggaagguuaugguucugagauuuuuuuuuucaugaaaaaguuuaauuaauuuccucuuggauauauaaugaugaacccaauuagugagauuuuauguagagguuaaaaaaaauuaaauaauauguguuuuuucccccuguuaguauuuagccuugcaggaccugauguugcuuucucaauauucuccuucacgaagacaagaaguuuucagccucagccaaccagguauugcuaaaaguaauagacuugauuaggcauauguguguagaaaguaauucacuuggccaggcaugguggcucaagccuguaaucccagcacuuugggaggccgaggcaggcggaucaugaggucaggagaucaagaccauccuggcuaacacggugaaacccugucucuacuaaagauacaaaaaauuagccgggcgugguggcgggcgccuguagucccagcugcuggaaaggcugaggcgggagaauggcgugagccugggaggcggagcuugcagugagccgagauugcgcuacugcacuccagccugggugacagagugagacuccgucucaaaaagaaaaaaaaaauuaauuaacuuaaaguuuuuggugagaaagauguauuuaauaaaauaucagaugucaaugaguccauuaaaugaaguauugaauuaaaucuuacacagcuuaagaguuuauuaccuucagcuccuucauuuccuuaaccugaagaaauuauuuaguacacugacaauuuuagggcagaaaaauacagcuuaagaauucuaaaaguuuggcugggcgugguggcucaccccuguaauccuagcacuuugggaggccaagguggguggauuacuugagcuuaggaauucgagaccagccugggcaacaugaugagaccgcucuucuacaaaaaauacaaaaaauuagcccagcaugguagcaugugccuguagucgcagcuacuugaggagcugagcugggaggauugcuugagcccaggagguugauacugcaguaagccaagauugugccacuguacucuagccugggugacaaagugagagccugucccccuccccaccccaaaaaagaauucuaaaacuuuuaaugcuacaaaggaucuuaaaaauuagguggucuacucucuagaugggagauuuaagucucagagauuggcuuaaauaaaguuaaugucagaauuggaauaagaguccugucauuuggcuccauguacaggacuccuccuucugcuaugcuacucugccuccuuuuaaaaaaaaauuaggaagaaacuagauucaauggugacucaaggaugcucucagcaacucugaaacacuuacaguguauacuguucuugccaugcuguucaagacugugacuuugccaguucucuguuguuccuagagggaaaacaguccagucccaggcacuggugggaaacagagaaccuggguagccuuucuucuguauuuuaagagacagggucucacuguaucaccaggcuggaguacagugucaugaucacagcucacuguaaccucgaacugcugggcucauaugauccucucgccucagccuuucaaguagcugguauuauaggggcauaccaggugugcaccaccacaccuggcuaauuuuuaaaaauuuuuguugaaacagggucuugccguguuucccaggcuggccuugaacuccuggggucaagcaguucuccugcuuuggccucccaaaguguuagaauuacaggugugagccaguacacucaaccagcuuuucaucuuuuuuuuaaugauuucuucauuaguuugccaagcuugccaauuaccagauaaaauaccagauaauaaaccuucuauaguuaaauguuauauggaaaugaaauccaguuauauaaaaauguaauugacuggaaccacucuccuuuuaguaacaugagaaacccagagcugauacuguggaaaauuaacuauaacaaugcuuuucuaucagauuugaguuaacauaggaauucuauacucuaaauguuuuuuaccagauauucaaguaaaccguaaaaggguggcauuugcucugccagagaguguacauucuagcacauaaaaaaaauuuaauuggauggacgcagcucacgucuguaaucccagcacuuugggaggcugaggcgggaggaucaucugaggucaggaguuucaacauggugaaacccugucucuacuaaaaauacaaaaauuagcugggcaugguguugcacaccuauaaucccagcuacucgggaggcugaggcaggagaauugcuugaaccccagaggcagagguugcagugagcugagauccugccacugcacuccagccugggcaacauagcaagauuccaucacaaaaacaaacaaaaauuuaauuggaugguuacacaguuccucauguacccaaauuacaguaguacaaaacauccugaggccuagugauagaguauuguguguguguguuuguagguuaagugguauuccugaguuuuacaauggggggaguguuuaaggagagauccaagugaagagggaaugaucauuuggcacauaggauagagaaaccaguuuucaguagacuucucugcuauuaacgcauaauggagcaugcuugauuuuuauauaauaacucuaggcgacaaagaucuacuaugagaaauaagggaauuuuuaaaggaauggggacacaguaguuuaaguuaaauaauaagauaaucuguaagcucucugaguguaaagugugaucauuauuaacgagucauucccacagauguaacagcaaauaggggcuguuauauacaugaaaauguaaggaagcccagggggucagacgcaaaaguuuagaggucacuggggaccauggaggugcaucucacuggacaucguaguguucauugucuuaguucauuguucacagucauagcagucuguuuaauacugcuagugaaguaacccuggucuuucucgcucaaccuaugaucuaguguuuggcuuuauuuuagcgaccaauuugagagguuuuuuguuuuuuuuuuuuuuugguaugugugugguaaaauagcaaguuuuugcuuguagacuuuugggaaacuuaauucauccaaguauucauugaacuccugcuguguauuagaugucaugaguauaaauaguagcuucacuaagaaaaguggguccugaugccaagcauaauguagaauuucuuacugacuuuuucccccacuucaagaggggaauguaagauuauuuacauuuuaaaagcugguguuuggaccuccuagguggacauccccacaauuggacagccauuucaagggaguguuugaaucuuuuaaaugguaugacucagaaacugauucucuaucaagaagcugcugcuacgaaugggagagugucuucaucuuacccaguggaaccuaagaaauuaaauucuccagguaaucccuaggacuacuaagaggggaaaacauuuacauuuuauuuccuaagaaagaugacuguaguagacugggcgcuguggcucacgccuguuauccccgcacuuugggaggccgaggugggcggaucaugaggucaagagaucgagaccauccugacccacauggugaaacucugucucuacuaaaaauacaaaaauuagcugggcgugguggcgugcaccuguagucccagcuacucaggaggcugaggcaggagaaccagggaggcggaguuugcagugagcugagauugugccauugcacuccagccuggcgacagagugagacugucucaaaaaaaaaaaaaaaaaaaaaaaagaugacuguaguuaauugaaggauacuuauaugagugugagguguauauuuuuagggaaaauugauccaacauauagcaucuuauauugaaccaagaaaaugacguggguaucauuguagauugaaaaaauuaagcccaaaacaucacguuguacacucuaaguauaugcaguuuuucauugguuaauuugaaacaaauuaaguucaguguggugguagcauuaaaaacacuaccaaaaugauggcuauuaaauaggagacuucagcuuacucuagcacaaagccaggugaauuuuugcagacaauaucuguugcuguucugguugcaguaguccagagacaaaaaguugcugucccagagaagagcagcugagacgacugggugauuuggaaguggggcauaauguuaguaccccuuccauuuaaaagacaaaagcugagaggaagaaguagagguggaggaaccugucuuguucaccaaaucccuuagguagaagacaccuaugaauguaagacugauaaaaggacuuaauguuccauguguuuuggagccaggcauuuagugaaaauggaugaaacuggcugggugaggaugguggugaaccugugagcacaggcuuccucugaagggggaagcuguugguuagcccugcuucauuguucccauaugggacuuuggaucccauaugugaacuuccggucuuuuuaaaaaagagaagccugaaaucuaaacaaauuuugaggugaaaucuuucaguuguuaaacauuggcaacuaaucuugauauuuaaaaaucacuauauagaucaaagcaaacucaucuaguuucaaaaucaguacucugguggggucauagccccaaaacaaauagauuacauaugaaaaaugauuuaaauaaauuaacacacaucagauuuugaaagguuugagaguguuucagauguuaucagcuuucagaucagcauuccucuauucaacaaauacuuauugaauuccuacugcauaccaaacaaugugcuagaagccagggaaucacagauggaaaacacucuuggaucugaccuuuuaguggaaggcacacaaauaaugauacaauauaacugccaaaaggaaaucuguccaaaaggaguccgacuggauaagaugauguuugauaaugaaaggaagccuuguuugcaacaaaaaaaguuuagauuuuauucuauagagauauggagccauuggagaauuuugaauaggcuaguuccaucaaauuagcguuggaaagaucauuguaauucuggguuggguagaucaugagucugaccaaauauggagcauucauuauuguaaguuuuugucauauaccaucacucagccaaaauuugucucauauuuugaagaauaauuguaaaacucuuaaaaacuccagucuuaauuuuuaaauugauuuuucaaagauuucuaauuuccauuaaccuuuaaaaagucauauaaugggccaggugugguggcuuacaccuguaauuccagcacuuugggaggccgaagcagguggaucauuugaggucaggaguuugagaccagccuggccaauauggcgaaacgccgucuuuacuaaaaauauaaaaauuagcuggcugugguguugcacacuuauagucccagcaacucaggaggcugaggcaggagaauugcuugaacucgggagguggagguugcagugagcugagaucaugccacugcacuccagucugggugacagagugagacuccuucuuaaggagaaaaaaaaaaaaaaagaaaagucauauaaugaaaauuugguacuugggauguuuaauuucuuauauuucuuauggugguuuuauuaagaagauggaauccagcugggcgagguggcucacaucuguaauuccagcauuuugggaggccgaggugggcggaucaugaggucaggaggucaaaaccaucuggccaacauggugaaacccugucucuacuaaaaauacaaaaauuagcuggaugugguugugcaugccuguuauccuagcuacucgggaggcugaggcaggagauuucacuugaaccagggagucggagguugcagugagccaagauugcgccauagcacuccagccuggccacagagugagacucuaucucaaaauaauaauaauaauaauaauaauaauaauaauaauaauaauaauaaaaagaagauggaauccuaaugcaauguguuuguuuuuguggcuugugcuggagugacaagaaaaguuccuuuuguuuuuguauaacagacucuauuacuaaauuggagagucauaagaugacuuuugaaaaagcuguuuacagaucagauuuauagauauucugggcaaauuagccuuuggugugacuuuuguuaacuugaaagaacuuucaggccaggugugguggcucaugccuauaauucuagcacuuugggaggccagugcaggaggauuacuugagcccaggaguucaagaccaaccugggaaacauggcgaaucugucucuacaaaaaauaaaaaaauuagccaggcaugguaguaugugccuguguccuagcuacucaggaagcugaggugggaggaucgcuggagccccagaaguugaggcugcagugagccgagauuacaccacugcacuccaaucugggcuacagagcaagauccugacucaaagaaaagaaaaggaaagaaaaagaaaaggaaaggaaaaaacuggggaaaaugggguaagguuaauauuuuuuuccuguauauguucacaauauagauuugguauguucagucaaguaauacuuaaaauaguaaugcaguaaaacuggauagauucuaaugcaguaauuaaaauugccaauuagaaauaaaaugugaauugaugaguucauucaaaauugcuuagaguuagauaaauugacguugaagaugaagauauucauggggggggaaaaagagagacuauaucgaucugacagaagaagauguauaaagcucuuugaguggagcuugaaugcaguaguaaaaucgaaucuugagacuauaaucauaaauggaaacaaucuacugagcuuuggguaaaugcguuaaacaaaaauuugguauguguagaauuugaaagcguugcugcuagccugcuuggaucagguugccucuucagcacuggaucuguuguuuuacagaagaaacugcuuuucagacaccaaaaucuagccagaugccucggccuucagugccaccauuaguuaaaacaucacuguuuucuucaaaauuaucuacaccugauguugugagcccauuugggaccccauuuggcucuaguguaaugaaucggauggcuggaauuuuugauguaaacaccugcuaugggucaccgcaaaguccucagcuaauaagaagggggccaagauuguggacaucagcuucuggugagaauuauauauuuuuuaagauuuuaaaugucauguugcagaggaucagacagccuaaguucuuaucuugccuuuucuuuuuuaaaaauagaucagcaaaugacugaauuuucuaauccuucuccaucuaccucuauuagugcugaggguaagacaaugagacaacccagugugauuuauucauggauucagaauaaacgugaacagguaggaugauaugguuauaggauuuauauuugcauguaaaauugagaacauuaaggaucucacaugaguaagucaucaggaauaagaagcuuuuuuuuuuuuuuuuuuaugcuucguguauugacucaaaugaaacagccaauauuugacugguuugagcuauacacauuguaauuucauaugacuugaccugauaacuucauguaagaaauauuugaguucuuuauauauccaaggugugcuuuuaggcacugggaaaaaagcaaacaaaacagaguccuugcccauguaauauuuacauucgagugaggggaaaucagugaguaagcaaauguauuauauucuguuucucugaaauauaaaauaucauuaauuauaagacuuaugugcuauuaagaaaaaagaugccuuaacccaugacgugcuauugacuguaagaugcaucucaacaggucauauucaagauauggaaaacaugcauaagaaggaagaaauuugauauaagucuuaacuagaaaaacagagcaaggaagacagagaguuccuaagggagaggguaucauuuuauguggagugauaaggggaagucucauugauaaggcaaugauugaucagagaccugaagggagagcugggagcagcccagugcaucugagaugggaauggccuuggcuugugugaagaacaauguggauaccaguguggcuggagcagagugagugaggggagagugguaagugggugauaagaucagaaagguagcaggcacccagggcucauuggcuguaguaaagacuggcuucaucucugagugggauggaaagucaccguauggucuugcccacaagaaugauaugauguaacuuauauuuugaaagugcugcucuaggggcuguguugggacuaaacucuugcaagguaggcauguaagcccagagacgguguuaagguguuaaguaaucuagugggagauggugguaucugggaccagagugguaguggugggggcuguaagauguggucaaggucuagguauguauuuuaaguuagauggaauaggauuagcuuaugguuugguugugguguauacuagaaagagucaguguucacugguaagguuuuuggccugaagaucuggaauaauauaguugcaauuuauugaguuggaauuuacugaugauucuggagaaggagauuugauagaggugaggggagggaaaucaggaguuugauuuuggacaagccaauuuugagauaccuaugagacaaccaggugaaaauacuuaguaagaaauuaggcauauagcgguaguguaggggaaaguucugggcuagaaauguaacuuuggaaguuuucagaguauagauaguauucaaagcaugagacucgaugcaaacucuugaauguaaauacagaagaaaagagauauccaagaaaggggcccuccaauggcuaaaaguuugggagauaaagaauagcaacagagacugagguggguagaaauccaagaaaagaaagaguuucaaggaggagaaggugggagugucagaugcugcugauggguagcauggggcgggaacuaagaauuaacuguugagcuagaaaugcggaggucacugaguccuugacaagagcuguuggcuggaguaguggggacaaaaaaaugcaugaguucaggagagauugguagacgaauuggagaccacaagaaaaaccacauuuuucaaggaauuuguuguaaguggaacagaaaaauggggcaauagcugggaggaauugaggggucaaggaacuuuuuuaaaaauuuugagauggguucuuggucugucuguugcucaggcuggagugcagugguaugaucauggcuacacugcagccuugaacucccgggcucaagugauccucccaccucagccuccugaguagcugggacuacaggugccugccaccaugccugccuaauuuuuuuaauuuuuauuuuuuguagagacacagucucuauguugcccaggcugaucucaaacucuuggccucaagcagucauccugccugagccucauaaaguguuggaauuacaggcgcgagccaccacgcccagucauguuuuuauuuuuuaagaugggagaaauuauaacauguuugcugauggaaugacugauuaauagggaaugaaugguuaaaggcauuucauaaacuucgggaucccauacggcucuauaugccauuaguacugccgugucacuuucuacccaaccagacacgugcugcuugcugcagccuucugacuagucaugcagcuuugggugagaguaugguaggagcagauucacuuuuaaguuaguuggguuagcuuuuagcugauacuaagaacacuuuuucccccggaauugucaacuaguagaaaacuacuuugugucuuaagauauuuuuuuuccuguaaucucagcacuuugggaugccacagugggaacauugcuugagcccgggaauucgagaccagcaugggcaacauggcaaaaccccaucucuacuaaaaauacaaaaauuagcugggugugguggugcauuccuguaguccuagcuacuugggaggcugagguaggagaaucaccugagcccagaaagcagagguugcagugagcuaugaaugugccacugcacuccagcaugggugauagagugagacccugucucaaaaaaaaaaagauuuuuuuuucccugugagagaaacauacucuuuuuuuggguauuaaaagguuaaagggcaggacaguuauagagaaucgagaaauaauguggccuugaaaaauaucuccagucuguaauccuagcacuuugggaggcugaggugagaggauugcuugaguccaggaguuugagaccagccugggcaagauggugagacccugucuguacaaaaacauuuaaaaauuaaccggacaugguggugugccuguauucccagcuacccaggaggcugaggugggaggaucuguugagcccagaaauuugagguggcaguaagcugugaucauaaaacugcacuccagccuaggugacaaagcgagacccuguuucugaaauaaaaaagaaaaaagaaaaaagaaaaaaauuucaccaaaaccacuuagaauuaauuaauuuuuuuuuaugucagggcucuaauuuggggguuaaacguguauacaugggaauacaguuuaguuggcucaucuugguuguccaauuuguagcacaaagguauuuaguuacauggcguauuguuuaaguauuauuauucuuugcccacaagaugugaaguguuucauuuuuucauuuaaguuacugucuggaagaacuaggaaauguguuauauuugaauagaauuuaaaagguaaauguguuaauucuuccuuuuuuccaacucagauuaagaauuucuugucaaaacgggugcugauaauguauuuuuucaguaagguaagaauaugugguuauagcguugggaauggggagggaggaaaugaaauaugaaauaaaguagcagauaggaucugacuuguaaauauuuuauagcuuaauccuagcaagcuaggcagcuuugcauagugcuucacugaaccuccguuuuaacaauaguugcccuagacacacaucucacuucaguggcuucugaagcuugacucucuaguugccucucguaucucuuggcugcuggcagcuuugugcugauaggcaacacagaccccuuccugcugucuggaucuucacaaagugaacacauuuguguggcuaucuggugcuucuuggcucacguccugcuagcgucuuugugaccauuuugguguucaaaagagagaugaugauaucacagauguuaaauuuaugaugaauaaaaaauuauaauucagaccacacaugaaaugacuucccaacuuguguaucagcuguuccagcugccacaggagaguaaaucucaguuguagaagcuaaagauugauuccuguuuuugcuggcuacgacuguugugucucuauuuaauccuuugaugugcaaaaccuuugccccuauguaggggaaagaauuuuuguuuuuagcuuuuaaaaucuagccucucuuucugcagauauugcaguauuaucuaauaucacgcucacuccauuaauaccuucaagugaaaguuuauauuggcaucuguuauauuuauuauuucggagucauacucugguggaaaagaggucugagcaacccugauagaauauagauaacgcauaacagucauuucaggggcuugaaacugcuuuuccacuaugguggaagggacgauccacccaacuagccauuaccuuuaccaaaaaauaauccacccuggucugcccauuagaggaaggugucuugucuuccaccaaaaggaagagggguugucugaaguuuuacuucagugcuugguuucaaaagaaggggaaaggccgggcaugguggcucacaccuguaaucccagcacuuuuggaggccaaggcgggcggaucacgaggucaggagaucaagaccauccuggcuaacacggugaaacccugucucuacuaaaaauacaaaaaauuagccaggcgcaguggugggcgccuguggucccagcuacucgggaggcugaggcaggagaauggcaugaacccgggaggcggagcuugcagugagccgagauagagccacuggaguccggccugggugaaagagcgagacgccgucucaaaaaaaaaaaaaagaagaaggggaaaauaacucacuaugagugucuuaugugugccauacucuguuuucgcuucaguucccucauuuaauucuaacagcauuccugugagauaugucuuuuuauccucauuuuacagauaaggaaaccugaggcucagaggagucauauaguuagccuaagggcacagagacaguaaguggcagaccacauggugaccaagaucuccuguuuucuugaaagugaaaggcuaauuuucaucccaguuuugcaagugggucuauuauaugauaaauuauagacacugcugcuauuugauguuaaaaaauguaacuuaauagacuuguuguaugguacuuaguaggcuucauuggguacauaaccaaagacagcauuuguucaaauggaccaguuguuccacacuauuccauggugguacguuaaagaaggguaggcagcaugaaauugugucauuuacagcaacauggauagaauuggacaucauaaucuuuuuuuuuuuuuuuuucagacggagucucgcucugucgcccaggcuggagugcgguggcgcgaucugggcucacugcaagcucgggcucacugcaagcuccgccucccaaguucacgccauucuccugccucagccuccugaguaguugggacuacaggcaccugccaccacgccuggcuaauuuuuuguauuuuuaguagagacggaguuuuagcguguuagccaggauggucucgaucuccugaccgcgugagccaccucgccuggccggacaucacaaucuuaagugaaauaagucaggcacaaaaaaauaaauauugcacguucuuacuuacguauagaagcuaaaacauuugaucacaugggaguagaguggaaagauaacagagacugggaaggauggguagaggguaggaggaggauggagagaaguagguuaaaggguacaaauauacaguuagaaggaauaaauccaauguuugauaccagaguaggaugauuacaguuaacaaaaacauauuauacucaggugauaggauacccaaaaugccgugacuugaucaucaugcauuauauacguguaacaaaauuucacauguacuccauaaauuugugcaaauaaaaacauuuuuuacgugaagguuaggcgguuuuucuuugagugggguugaggguagacaauuuaaaagagauaacaaguaggcaguuuuguuguuguuguuguuguuguuuauuuauuuauuugagacgaagucuugcucugucgcccaggcuggagugcaguggcaugaucucgacucacugcaaccucugccucccggguucaagcgauucucccacugcagccucccaaguagcugggacuacaggcgugcgccaccacauaggcuaauuuuuuguauuuuuaguagagacggaguuuuaccacguugaccaggcuggucucaaacuccugaccucagguuauuggcccuccucagccucccaaagugcugggauuaccagcgugagccaccgcgcccagccaauuuuuuuauuuuuauuuuuuauuuuauuuauuuugguuuuuugggguuuuuuuuuuugagacagaguuuugcucuugucgccuaggcuggagugcaguggcgugaucucagcucauuacaaccucugccucccggguucaagugauucuccugccucagccucccaaguagcugggacuacaggcacgugccaccaugcccagcuaauuuuucuauuuuuaguggagacaggguuucgccauguuggccaggcuggucucgaacuccugaccucaggugauccacccaccucaucgucccaaagugcugggauuacaugcgugagccaccacuuccagcuaucccaggcuggaaugcacugguaugaucuuggcucgcugcaaucucgaccuccuggauucaagcaauucuccugccucagccacccaaauagcugggacucuaggugcaugccaccacaccuagcuaauuuuuguauuuuaguagagaugggguuucagcauguuggccaggcuggucucaaacuccucaucucaaaugaucuacccaccucggccucccaaagugcuaggauuacgggcaugagccaccacgccuagccaaaauuuuuuuuuuuuuuuuuugagauggaguuucacucuuguugcccaggcuggagugcaauggcgcgaucucagcucacugcaaccucugccucccagguucaagugauuauccugccucagcuuccugaguagcugggauuacaggcaccugccaccacgcccagcuaauuuuuuguauuuuuaguagagacaggguuucacuauauuggccaggcuggucucgaacuccugaccuuggccucccaaagugcuggaauuacaggcaugagccacugcacccagccccagccaaguuuuuuaaaaagaguuucuguaaccauucucuuaagugaucucagaacugaucucugagguggguugaguauauguaacuuuaaauuggaaacugagacacagagauuuagagacuuggcaagggccacacaaugaguugaugguagagugcuuuauuauaguuaaaugaguaauuaucaaguuaaauauaaaagaauuuauuuuaaauuuuaauucuugagaggcagcugugaauuuuuuguuuuguggucuacauauuuaauuaaaggaaauaauggaguuuuugcucaggggaauucacuugaauguuuuuguuuuuauuuguagcacccagaggccuccauucaggcuguuuuuucagaugcccaaaugcauauuugggcauuagaagguaagcaaugacugugaacuguaacuaugauuuuaauugucaguuaaauauugaaguauaauucaugaaaggucaguucugguccuugauuucagucuuugaauguacagauucguuuuuauaucuuuguuuuauauagaucauuuugaaaaauauauuuaggcguauuuugauuugggcacaauuuuuucuuguauguaagcagagaaacugagccuggguucuuuuuuuuuuuggagacagaguuuugcucuguuguccaggcuguagugcaguguuaugaacauggcucacuguauccucaaccuucugggcucaaacaauccaccucagccuccugaguagcuggggccacaguugcauaccaccacgcccuguuaauuuuuguuuuaaaaacuuuuuugugggccaguugcgguggcucacgccuguaaucccagcacuuugggaggcagaggcagguggaucaccugaggucaggaguucgagaccagccuggccagcauggugaaaucccuucucuacuaaaaauacaaaaauuagccgggcaugcuggcaugugccuauaacccagcuacucgggaggcugagaccagagaaucguuugaacccaggaggcagagguugcagugaguugauaucacaccacugcacuccagccuggguaacaaauagcgcaacuccaucucaaaaaaaaaaauuuuuuuuuuguagggacgagguuaucuaggcuggucucaaacuccugggcucaagugaucuuccugccuugaccucccaaagugaugagauuacaggugugagccaccacacuuagucuuuuuguuuguuuguuugaagagauggagucuugcugugucucccaagcuggaguucaauggcaugaucauagcucacugcaaccuuaaacuccugggcucaugcaauccuccucccucagccuccugaguaguuuggacuacaggugcaugccaccacgcccagcuaaguuuuauauuuuuuguauagagacagggucuugcuaagaugcccaggcuguugagccuggauucuuuuauaucuuucucuacuucaaaaaagugcaacagauagauuguuuuuaacuuauguuaacuuauguuaaauaugaaaacuuaguuguuaaagagcuguuucuuuucaucuuauagauacagccgucucagugcuuaaauguugcucagaggccuuuccugaccauucucugaauacuguaugcccuuaccacauguuuuuuuuuuuuuuuuuaauuuccuggcacauauuauuacgcaacacuauauuauuuuuaaaauuuucuuccuaauagaauguaaagccagagacuguuauuuuauucauuacuaaugcaauugaguacuuuuuucagugccuauuccaauuuuuuugcccguuuuucuauugaauugcuccucccuuuauuuauuuauuuauuuauuuauuuauuuaucuauuuauuuauuuuacuuuuuauuuucgagacagucccacucuguugcccaggcuggagugcaguggugugaucuuggcuaacuucaaccucugccuccugggcucaaguaauccucccaccucagccucucgaguagcugggacuauagguuuguggcaccacacauggcuaauuuuguagagaggggguuucaccauguugcccaggcucgucuugaacuccugggcucaagcgaucugccugccucagccucccagagugcuaggauuacaggugugagccaccgugcccagccuuuauuucuuuuuauauucagaauauuaauccuuccuaaaauagauguauuucaaauaguuuugccuaauuuugauugacuuuuaaccuuuuuuuuuuuucccuugaggucugucgcacuuaguagcagcaucauuuacagaggauagauuuggaguuguccagacgacacuaccagcuauccuuaauacuuuguugacacugcaagagguaagaaaucuguggguugggaggggguagaggucaucuuccccucccacccagugcuuuguuuguuuccuauauaucacauuuaucgagugacaaaacauguuggaaguuaaaauaaugauacuuuuucacccucaggaaauuacaaucuaaaagacagaaaagaugcugguguggcucaugccuauaauccuagcacuuugggaggcugaggcuggagggucgcuugagguggagaguuugagaucagccuaagcaacauggcaagacucgguuuuuacaaaaaauaaaaaauuagcuggccauggugguguaugcuuguagucccagcuacucaggagcccgaggugggaggaucguuggagccaggaguuugaggcugcagugagcuacgauuucaccacugcacugcagccuggguaacagagcgagacccugucucuauuuuaaaaaacaaaacuaaaagauaguuuggaagagaaaacuuuuaaucugcuuauaaaauuuuacagaaacagaaaaagaaaguauacuaaaccuguaggauaugccccugguauuaaacacauuguuuaaaauacuagacuucuguucacugacaaaaguaaauccuuacacaauuuguagcuaccaaaagugaccugugauuaaaugacccaugcagauaaaugcccuauuggguugaggcucaagaacugaggccaguagaugccuaucaccaggcuugauggcuaguuuuagcuaauagguuuucuugguccuagacuuaaagaggagcaaaaaauaaaacacaugcuuucugcuuugcaguaggcuucuuuuucuaacuucauguuacuugguacuuuuuaugucaccuuauaauauuaguuacgugucacaugacagcuauaaacacuaagggcuggaggcauuuagagauggcaucuggaggccgggugcaguggcuuguaccuauaaucccaacacuuugggaggcugaggugagcagaucaccugagcucaggaguucaagaccagucugggcaacaugguaaaacccuaucucuacaaaaaaauagaaaaauuagcugggugcaguggugugagccuguagucccaccuacucgggacgcugaggcaggagaaucgcuugaacccaggaggcagagguuauggugaguggagaucgugccacugcacuccagccuggaccacagagugagaccuugucucaaaaguaaauaaauaaauaaauaaauaaauaaaugaauaaaaauagcaucugguguauauaguaggccuucuggaggaaguggaauugaacuaggcuuaaaugauaacuggugcaucuuuuggucuugggaaaccauuuaagauaugaagagaagccugggcaacaugaugaaacucugucucuacaaaaaaguuuuaaaaaauuagcgaggugugguggugcgcaccuauagucccagcuacuuaugaggcugacgggggagaaccgcuugaacccgggagguagagguugcagugagccaagauuaugccauugcacuccagccugggugacagagugagacccugucucaaaaaaauaaaagauaaugaagaggaaauaugcuucuccauuucuuucuuuaacacucaauucauuuuaccuauuagaaaaucuuacccaucaaagccagugauucuuuugcuuugagcacuuuuugugaguaccuucucauguauguuacuugagaugugugugucuacauggauaguuuuauuauuuguacucuuucccaagugccauucuguaaauaaauaguuuccuagcaauucccugcagcuucgaauauuugguuuaucugacugcacaauaggaugaccaugauuugggcauaucuuugauggucauaacauuauuuuuugucacucuggcaguguaguuaaaacaacaauaaugguacaguguuuauagucuagaguaaugugauaucauuauuauuugaucuuuauaaccaucuugugaagucagcaagguggaaguguuuucacccuuuuuuaauagaugagggaggcuuaguaguacagugacuuaccucagaucucacacacaaucuccuagguggcagagcuggaacuagaacccagucugauugcagggcauuagcagugcaguagacccuggaaaaagcuacagauccacaucccucccccgcuuuuuuuuuuuuugagauugagucucugcucuguugcccaggcuggagugcaguggcgugaucucagcucacugcaagcuccguauccuggugucaagugauucuccugccucagccucccgaguagcugggaguacaggcacaugccacuaugcccagcugauuuauguuuuuuuuuuuugagacagagucucgcucuuucgcccagguuggagugcaguggugugaucucagcucacugcaagcugugccucccggguucacaccauucuccugccucagccuccugaguagcugggacuacaggugucugccaccacgcccagcuaauuuuuguauuuuuaguagagacgggguuucaccguguuagccaggacgaucuugaucuccugaccucgugauccaccuaccucggccucccaaagugcugggauuauaggcgugagccacugcgcccggccugauuuguguauuuuuaguagagaugggguuucaccauguuggccaagcuggucucaaacuccugaccucagguaauccgccugccucggccucccaaaguguugggauugcugcaggcgugagccacugcgccuggcuugauccacaucccuuauucuuucuucagagagaaugauucuacccuuagaacuguggcuuucaaaguuuuuggacugugaucugcagugcauuuacauuagacucaaaauauagugugugcguguguguguguguguguguguguguagauaacagaaauaaaggauucuuggaacaguacucaccuuuuacuauguguagugcauuuuaauauuuuucauucuauuucauuuuuuaaaaugcugguuaaaacucacugaauugauuucauaaagaucacacugccugcccuagagguauucuauaccaaaauuacucugcuuuuaacucuaccaccaucagaauuucugguucuucauaguugguuagaaggaaagcaaucuguuugauuauagucauucauaccuuugaguaggaaaauaggaauuacagauuugucaaaaggucaagcccugucuugcucuguuucaugcugcucuaacagaauaccacagacuagguaauuuauaacgaacagaaacuuaauuuggcucgugguccuagaggcugggaaguucaagauuaaggggcugcaucugguaagggccuucuugcggaaucauaacauggcagaagggaucaccugaacaagagagagcaagagaucgaacucacaguauuaaaccccucuauaaucugcauuaauucauuauugagaguggaguccuccugaccuaaacaccucccauuaggccccaucucucaacacugcugcauuggggauuaaguuuccagcacaugcuuuugggugacaaauuuaagucauagcaggcccuauuuacuuagaaacaggggaguuggauuggagaauacuuucgaggggcagaguagaacgaggcaaagaggcauauuuuuggauguugagaaaagauggaacaaagagaacaggaccagugaccugauacuuagcuucucaguauaaaacuccuccuuauauaaggcuuauaaugucuaucuucccuuaagccacaucaugaccaaccuuuuggucaugcucugccaucaucagauuuugaaaacugccucauagucuuuuuuuuuuccacucuacauccugagguugauuguaaugaguaauucagagucuguguggguaaucugccccacacccugucugcacaauucuuugacuuccuccucuucacuacccauuuguauacccucucaacccacaacuaucaccuaggcccaguuauccccugaguacuccaccgccagaucuugaaacuccaggauucuacccuguaagcuagagucuuuaaauguuuuuguuccaaagauuccuuuggcagucuguugaagcccauggacuucucagaaucauguucuuaaaugcauaaagugcuuaggauuagaaaaaaaaucaguuauauugaaauuaucaagacguuaaauuuaugauauaguaauaugugguuuuuaauuacugcauuacauaacaagaucugucagugaguccaauaacuuauuuugagguagggauaagaugaaugauauuucaagauaacuauaacaaucguauugggauauggagauguuggugauuucuguuggugacaaagucacaggaacuacuaaugcuacuaugauuuguugcuuacauucauaguugaaggaaaugcuagauuuuaauuagaucuuaguaaagauaaauguguaauucaaguuuguacccccugaauuuuucccuuaggccuauggacccaauguaagagcccuugcuccaggcacagccguuucauguccuugcugcuucuguacaguuucuuugauccuaccaggauuuccaguuccuuuuccccauguucuuugucuuucagcucccuccugacuugcguauaugccuuucuguguccaguuuagaccuugcagucuauuauuucaaccacuuuauuaccaauuccuucaacuccuuuguccccauguccuugagcugcacccauguggcaguuccauuacccacccauucucuugcugauccuuccugccuugcuucaggaucuuggcauuuuuguccugaauuauuacauccucuugcuccuauggacucucaacugaguuacuucgugcucugauuccagccacucugcuauucccaugaguccucugcucuuauaacuaccauagacuauucagucucugccucccaccaaauauaucuuauuuucuuaacuugacucuaacugcacaugcugccuuuucuuuccuuuuuugucuagaacauauuuuucuccuuuggucugacucuacucuguaacuccccccucaacacuuuauugucuuuauugacuuuuauugucuccucuucauauuagcuagaguagagguggggacuuugucucgccucuauucccaucaucugauauaguaccuggcaaaugacaggcacuuauuaaaugcuuguuggauggcugcuggauugcaucauugcugguucaguggacgaagacuucuguuuuggggcuuaaauuuagugacaguucugaugcaauggguugauuaaaaugcucccaaaccaucuuuuuguuuugagaggcaggaaugugaugugacucauaugaucccuguuauauauuuuuggcuuucuguucuuuggucuagaagggaucaaagugaagagcguaaguuuaaguaucucuguaauuuaaggcaaguuguacauuacuggcuucuggguguuacuaaggaacaauuguguggaacuguucuauccuuuuguuuuacuuuucaguaugaauaacaucagccauuucacugaaucauuaaaggcaaaaugugaaagggaaggggagccuuucauccuucaaaguauucagagggcaaggaguagagugauggauaugcuagcuagcucagugguuucagccaguggccagaccauccuggagaucacuguuauuauaagggacauauguacuuucauuugaaugauuaccauuucuccaacauauuugcagcuguuuucucagagguuuuuacaugcuguuuugguuaauuaaaauacaaauucauuugaaagcauugcugaguucauaguaguuauuuccuuuaucaguggauggacaacaaguauuauccucuggagguccauaggauuuuauuguuguuuuuaaaaagggugcuuacauacaaaauguuaggaaccaaaaugauauauuuuauaauuaaaauuuuuuuggcuaagugcguuggcucaugccuguaaucccagaguuuugagaggcugaggcaggaggauagcuugaggucaggaguucaagaccagccagggcaacauagugagacagugucuauaaaaaaaauuuuuaaaaauuugccaggugugaugaugcuagcuuauaguuccagcuacuugggaggcuggggcugaaggaucacuuaagcucaggaauuugaggcuguagugagcuaugugacuguacuccaggcugggcaacagagugagacccugucucuaaaaaaaaaaaaagaaagaaaaauuaaacuuaguaaaauauacauaacauaaaaauuaaccuuuuuaaucuaauuuuuagugugugguucuaugacauuaaauauauucacauuguuaugcagucaucaccaccauccaucuccagaaccuuuucaucuuuaaaauauguuuuacauucuuuagauagccuugguuucuguggaaaggccaaugucauccuaaugaaguugaucaacccuaucuauuauauuuuuugccucgucacuugaaggucaaauuuugaucuauuuggaauauugauguuuaccuuuaugccauucacagauccaucccuccaguaacuauuuaauuaucaagcaauuagcaugugauacgauacagaauggaaaaagacaggguuccugcccuccgggagcuuacaggauguaaaacagauaaucauacaaagaacuacaguuguagucagugccacagugccacugugcauagaaaugcaguaugaggcugggcgcgguggcucacgccuguaaucccaggacuuugggaggcugaggcggguggaucaccugaggucaggaguuugagaccagccuggccaacauggugaaacccuaucucuacuaaaaauacaaaaaauuagccgggggugguggcggacgcuuguaaucccagcuacucgggaggcugaggugggagaaucgcuugaaccugggaggcagagguugcggugagcugcgauugugccgugauugugccauugcucuucagccugggcaacaacagcaaaauuccaucucaaaaaaagaaaaaaaagaaaugcaggaugaucagagaacauaugacaggugaaucugagcuagucuugcaaguaggggauagagagaugugagauaauuaauggcuccuggagaauguagggguuggaaggaggaaugggggaaagaaaggaauauucuugagggccagagcuauggauuugaaggcccagagacccuugaccaacauuguaucagucagagucuauucucgguuucuaugaaguccuaugcugcuuuaccuaacauuugcauaguauuccaaaagaaaugcuuuaaaaauguuuuuuguaaaacccugugagguuaaaagaaggcuuauuuugcauguugaagucucuuucagaaacuauuuucugugugaguacaacuuauucaugauuguaccuaguaaauggcugagucagaauuggaaacuaggguuuuggaccccaaguccuucgcaggccacccuuuuagauuaccuuugggagagcuuggcagaguuuugcauuucuuaaccuccuuuuucacgauagaauggcaguauggcagaugugccaaagugugagaucuggaaucagacugacuugugucugaauuccagcuucuacuguuuccuaguuggaaaauaacauuuauuauauuucuuugaaucuaagaugccauuaauuggaacauauaccuucauuucagaaaguauaaaauguaaaaaaaaaaaguauguuauagaacuaauaaauauggcaaucucuaaacaucaguuuuuauaucuggaagaugggagugaugauaaugguagcuagcuaccucauaggguuaugaagaguaaaugagauuaucucuguaaggcccuuggcaugugugacccauacuaggugcuuaguaaauguuagcucuuacuacuuuguugucauuauuccuauguuacaugacaauuuuuuuuuuuuuuuuuuuuuuuugcgacagagucuugcuuuaucacccagacuggucacugcaacuucacacgcugggcuuaauugauccucccuccucagccucccaaguagcugggaccacaggcacgcaccacuaugcccaauaauuuuuuuguauuuuuaguagagacagguucuugccauguuguccaggcugcucuugaacuccggagcucaagugaucugccugccucggccucccgaaguguugagauuauaggcgugagccacugcauccagccacaugauaauucuuauacaggagaaaagaucuuucagauuaaaagaaagguuaaaaaaaaaguauugcugucaauacuguuagcaagcaaucuagcagacauagugucagacagauacccaguuuaaacuauucauauauuaucuucauaauuuuugucauaacuauauuuucacauacuauugucauuuagucauauuuuauuucccugagcuuuuauuuacuuaguguuuuaagucauucauuuauucuuuuuuuuuucuuuuuuaauaaagagacagggucucacuuuguugcccaagcuagucuccaacucccaggcucaagcgauccuccugccuuggccucccaaaguguugggauuacaggcgugagccaccaugcccguccaagucauuuauuuuaaaaggaaacuuuaugacuacuguaaaggaaauuuuaugacuauaguaaaggaaaacuaguuugacuugcuacaaauagaauaugggucuauaguccuuuaucucaaaccuuaccauguauuucagaauucagauguuuauuaauuuuaaaaaugugacaguguguguguguguguguguguguguguguguguguauauacacacacacaucauauacuauauuacauuccuuuugguaucugagguagaauccccuuaaucggauacauuaaugcuuuucuccgguuaacugaauauucagauuaagugggguaaagugggaugaagacuauaaauagccugugucagcacaggucauguuuuacugccagaugaguccaagucaggucagcuuuugccaccaaaagauuuacaucuuuuguuacaacaucacaucacuuuaaaaaaaaaaagauucuccgggcgcgguggcacacacauguaaucccagcacuuuggaaggccaagacugauggauugcuugagccccuggucaacauggugaaaucccgucuccaacaacagcaacaacaaaauuuagguggggaggugcacacgccuauagucccgucuacuugggggcugagcagggaggaucacuugagccugggaggucaaagcucagugagcuguaaucauaccacuacacucagccugggcaacagagugagacccugucucaaaaagaaaaaauaagguugcagaaguuuuuuguuuucagugcuuuuuggauaucagaauugaggauaaggcaauuaaagugagaaaagucaaugauuuuaaauucuagcuugauacucuuacuugcugaggucucugaaccugaggccugcuuaucuuuuguuacaaauguggauagugugagauuaguaagaacuagagagggguuaaggacacauuuacucuaaacugagauuuuccuucuuaauuuaacgcuuauaccauuaggguguguuggaccuaauuuuuugcauuucuauuuugagcauuucuaacuauuuauaaagauugcuauuuuaugaccuuuauucuuucuuagaggucuuuuagagaacaaagagagcaauuacuuauuuaaaaaaaauucaacaagguuggacaugauggcucacaucuguaaucccagcacuuugagaggcugaggugggaggauugccugaagccaggaguucaagaccagcuuggucaagaaagcgagauccugucucuauaaaaaguuuuaaaaaaaauuagcugggugcuguggugugcaccuguagccucuaauagugaggaggcugagacaggaggauugcuugaguuugagacuacagugagguaugcuugcccuacugcacuucagccugggcaacagagugagacccugucucuaaaaaaaaaaaaauucaacaaaauuuauucucuugcaauuauccauguaggucuguugggcccuuuuaaaaucuaagguauauuauagaucuagugauuguacauuuucacuaucuuguaacaauuugcuaucgauuauccuaggaauuaucauuacucauuaguuauucuuguguuguaaaaaagacuaauaugaaaacagaauaaugauaaaaucauguaguauugcaugauuuuucaugaaaagcuauaugaaaagucuagacacacaucuuuguagucuuuuaguuuucauugaauacaauugauaauucauaauuuuuaaauuuucuguccacaugguaaagggaagaaaauugccaauauguuaaaacaauuacugagacacauuggaagacaaaugcagagagacagauagcagcacucuagaccaguucuguccaauagaaauaaaaugcagucaccuauguaaucuuauauuuucugauagauacauuaacaaaauacaggugaaauuaauaguacaguuuauuuaacccaguauuuaagguaguaucauuuuaucauguaaucaagauaaaauuacuaaugagaucuuuuauauccauuuuuacaugcuaauucuuagaaaucugguguuuguuuuucacuuuguagcauaucucaauucagaccugccacauuucaggugcucaauagcuacauguggcuagugguugccauauuggacagcauagcucuagacuuuaaugaugauggugaaauugaucauauaagaggaauuucaggaccgggcgcgguagcucacaccuguaaucccagcacuuugggaaaccggggaaggcagaucacuugaggucaggaguucgagaccagccuggccaacauggugagaccccgucucuacuaaaaauagcaauaaauuagcugggcaugguggugcaugccuguaauccuagcuacgagggaggcugaggugggaggaucgauugaaccagggaggcagagguugcagugugcugagaucgugccacugcacuccagccaagaugacagagugagacuccgucucaaaaaaaaaaaaaaaaaggaauuucagacugugaaccuucaguugaugauauucuagauauauuuuccugaaacucaaagauuacagaacaauauguuuuuaaggagagcaaggaaauauaugugguaugcuuaucuaguaagucauucaacaggaaagacuucaucccacaguauuuuauaauaagaacuuaaaucucucauuuugcuaagaguacacaugaccaguguuccuucauuugcuguuguauuugugcaccaaaauuugcuuuauacaauuuguaaggggauaagugcugaagguagcuguguguauacaaagauaagaaggcaauaggugaugucaaagaaaaaaagccauuggaauugaucauuugaauuuguauuuauaaaccuaagaaugaaaguguuuugcagccaggugcgguagcucaugccuguaauccuagcacuuugggaggcugaggcgggcggaucacuugaggucaggaguucaaaaccagccuggccaauauggugaaacccuaucucuacuaaaaauacgaaaaaauuagcugggcgugguugcgggcgccuguaaucccagcuacuuggaagguugaggcaggagaaucgcuugaaccuuggaggcagagguugcagugagccgagaucacacuacuguacuccagccugggugacagagugauacucugucucaaaaauaaaaagaaagaaaaagaaaauguuuugcaauuaaggugcaaagaaaauggcuguacuuucuucagcaaaauuaugaguugucaaaaguuauuuaagguacugcauuuugauggugcaaaugcaagaaaaagaaccagaagaauugaugagcuagaaccuauuagagauacagccuaaauuuugaguuaguauuuacaagauggauauauuccagauuuaugcauaauagcuggugaacagcuaguugcauucaaaggacauugcuuauuucagguguguauaccuucaaaaccuagaaaauauggaauaaaaauuuggauuugccguguuuauauucuuauuuucauuuuuauuuuauuuuauuuauuuaguuuuuuagagacagguuguugcgcuguugcccaggcucgaguacaguggcaugaucaugguucacuguaaccuugaacucuugggcucaaguaauccucccacccacaucagucucccaaguaguugugacuacagguauuggaccacauccagcuaauuuuuaaauuuuuuguagugacagagucuuucuguguugcccaggcuggucuagaacuccuggcuucaagcaguccuccugccucagccucccaaagugcugggauuacaagugugagccauugugccuggccuucuuauuuaaaguuuuaugguguuauuuuacauuaccuugucaucuguaaauuguuuguaaaaugauuuuagacuacaaaaaauauaaaguauucauaggacccaggcauuaaugaugaugauuauuuuuccugguauacugaggguuaaucaggacauuugcaagaaaauugaaaagaauauaacuuuuccauuaugauggaacaagauuugaugcauuuguucaaucugccacgauaacucugaguccaaucauuuauuuuuucaacugucacuuuuaaaaguguuucccaagacuggaacaugcuugagauaauuuuagguaguaguugaaauucagugaaauacuuaaauaacacuaaauucagugaaauucagugaaauauuaaguaaugcuaaaguuaccguggcagacugaacacaugcaucaaauuuuguuccuuccccaaaacucugcuaaacuauaggaaagguauuuuauaauacuuaaauccauaaacaggagaggacauaauagcaacaaaacuuucaaagcuggaaagcagaugguugagaucgcuaacuuagcaguuuccagaggcagauuucaaauugguggugggagaagcaccaaguaacucuagaaccacgcgugaagggacagguacccaaaauaaagagguuugggugagagcuguuugaaaauuaguuagaucccuagauccuaugaugugggguaauugcuccucuuccacuguagucugagguuuauccuuuaagagagaguagaacacccagucugggggaguugugggugcugcacuaaaggagagggaugaguuccaaagcccugguguccaccuggcuucagaacacuggggcaggcccuguagucaggauacuagaagacuuuucuuugggcacucugaccaguccaagaagaaagaccuaaagugacugaguugaagguucacgccccaaaagucccugcagaugacccacugugaagccgcucgucuguaauccccagucaugcacuuagaauuggugcucagcucuuuagcaggucccacuugcauuugugaacgaggaucacuagauuucugaggaaagucucucaugcagaaguuggagacuaaagggagcaaagggggaaaaucagcuuggaagaaacuaaaaaacaaaaaagcugucaucagaauccuuagaaauaagaaaggauauugcaucuuugaaacaaaaauaggaugcuaaaauuaaaaagaacagaugauguuaaagagcucuugaaauuaagaacuugauggcaaaaauaauuuuaauuauuuuuguuuucaguucuuuuggugguuacauucauaacuauaaauaguacgcuuauacuguuguaucuugucaguuuauuuuuccauggggaccucaugauguaacaguaucauaaaugccuuaucugaauugaaaaggaagauaaacuauuuagugaauaacuauuucuguaaaguauaaaguuuuggucuuuuuuuuuuuuuuugcugaggucuuuuaauaaagcuccuccuggcugucacaucauaagcagaguaggacaucaguguuugacuucaagcuuugcauuuucaaggauauugaaugauagcuucauuuccaagggcaagucuggauuuuggggggggccugguaacugucauaguagcugagccucccuauugcauuguuuaugaaacuauuuugacugugaucuacaguaagaaauguguuacagcauagcuauagauauguguauaucucucuguauauauccauuuguaucuaucucaaaucuuaauucuuuggacugaagugacuuuuuucuuuuuaauuuuuuauuuuauuuuauuuuauguuauauuauguuuguuuuguuuuguuauguuauguuauguuauguuauguuauguuauguuauguuauguuauguuauguuauuuugagacaggaucucugucgcccagucuggaguacaguggaacuccugggcucaagcaguccucccgccucguccuuccaaaguguugggauuacacaugugagccacagcaccuggccuagguuggcuuucuuuauaaucuaaacugauguguuuucuuucuugguguaggcagucgacaaguacuuuaagcuuccucaugcuuccaguaaaccaccccggauuucaggaagccuuguggacacuucauauaaaacauuaagauuugcauucagagcaucacugaaaacugccaucuaucgaauaacuacuacauuuggugaacaucugaaguaaguuuaccuguuuugauccaugaugauaccuauucuggggagcuuuccuuagaaauagguaugggaaugauaaggcucauguguugaaaguguucuuuugggaccuugaugauucucacuguaaacuuacagcuuggauguggacuuaauauuuauauuuuaaaauuuggcccaucauaaagcuuuggggauuucuuucaaauggacaaaagaagacagaaaguuauaaaugcagcagauuaauuauauauauauauuuaaauuaucaaaagauccuuaagggagaaaaaagagcagaaaacccgaguaccuuuccagaaaagcauauuaaaacuaauucuauuguuauaucuuggucagcaaacugaagacuuggggugagcaaaguauuccagaaaugaaucccuggugcuuugugauucaugcuggaaaaacaccaacagaucacaacaccuugagaaacagaaccagagagaaaaccacaaaugccaagccuguuuauauuuaguuuuauucauguuuacugcuuuccucuugugaaaugaucuagcuaggcaggaugagggauacuagcuuaguaacuaaacuguauuuauauuuaucacaauuauaaaugaacuuuagaagacacgagagauugcucugcuguuuuuguaugcaaucaaugaauaguuuaagacuuccaauuuaaauuaaaguuaaauaaaguuaaaaauucaauuugucagucacccuagccacauuugaaguacuuaauaacuacauguguuuaguagcuacuguauuggacaacagaaguauaacaucuuucccuacuuccagaaaguuuuaucagauagugcuauucuagacaauacacuuagaacuuaauguuuuuucauuuacucuuuucaaagacccugugaaguguagaaauuaucauaauuguacagauacgaaaacugaggcauagagauguuaaaauuugccugauagcacaaucuagugcguauuaaacaugaaccugaaaucaagucuuucuuucucuuaaaaaucuuucaucuuucuaucuacaacacuagacugccuccaagauauaaauuaguauguaggacacauucagaaaauacugaugaauuuagagaaugaaauagauaugacauauauuaaugauagaacaaaagcaaggagaagggcauacccguagaccuugccugacugugcucauguccaggcaggggggacauuguauucgagauuaauuugaaguuccugccagcuuuauccagcuuaaucaguggcuggauaaauagcaggacuguaacauuccccugggggaaaaaaggcaagaagaaaaggggagcauagggauuuagauaagaaagcgauauaggccaggcacaguggucuaugccuguuaucccagcacuuugggaggccgagguggguggaucaccucaggucaggaguuugagaucagcccggccaacauggugaaaccccgucucuaccaaaaauacaaaaauucacugggcgugguggugcucaccugaaaucccagcuacucgggaggcugaggcaugagaaucacuugcacccaggaggcggagguugcagugagccgagaucgugccucuguacuccagccuggacaacagagcgagacucggucucaaagaaaaaaaagaaaaagagauauagaugacugauuaaaaauuaugagaauggauuaugagaaugggccgguugcagaggcucauggcuguaaucccagcacuuugggaggccaaggcgggcggaucaucugaggucaggaguuugagaccagccuggccaacauguugaaaccacuucucuacuaaaaauacaaaaauuagcugggcaugguggcaggcaacuauaaucccagcuacuccagaggcugaugcaggagaaucacuugaacccgggaaguggagguugcagugagccgauacugcaccacugcacucuagccugggcgaccgagcaagacccugccucaaagauaaauaaauaaauaaauacauaaauaaauaaaauaaaaauugugagaaugaaauuccgccuuaguuucuuuucucugaaaagagccauauuuuagcgagacccugccucaaaaauaaauaaauacauaaauaaaauaaaaauugugagaaugaaauuccaccuuaguuucuuuucucugaaaagagccauauuuuauauaugugccaaagcugauaaaaucaguggaggcuauuuguacaaauguaggacagugucguauaguggaaagaauguuagaucuggaguuaaaauaucuggauuucugucugcuugcaucauuagcuaucugugauugugagcaaguuuccuaguguuuuaaguaauucacccaagauuaugcaaguagugaguugcagaaccaggauucagaugcaaaucuuucuaacccuaggguucuaucucuagugucuauacuccuaaccuagacugugguguuuccccuaacuucugaaucuuucugauacaguuuuuguccccaugaaagggaacauucucacacccacuugguuucauuuguuguuaguaaagauaaaaugggaucauacguagguaaagcccacugugcagucuacauuaucaugauacuuauuguauaauaucugauuauucacuauucaaagcucuaccucugagaacuagguauaaaugaaguuagcucuugagcucugaaaaucaacuaacaaacacagcccacucauuggagacauucauucaacacuauuuacuuauuuuuuaaaagauaaauuguauuguguauauuugagguuuauaacauauguuaugggauuuauauauaaauaguaaaauguuuagugaaguaaauuaacaugucugucaucucacauaguuacuuucuuguguguaugucaaaggcagcuaaaaucugcuuauuuaacaaaaauaccuaguacauuacaauuuuguuagccauagucgucauguuauacauuagaucucuagacuuguucauccuacauaugugcaacuuucuauccuuugaccuacaucuccccauucccugccaccucccauuuacuccuaauuuaggcuaauuuaauucugguuuuccagccuauaacauaucaaaaaaauuuuuuugagucagggucuugcucuguugcccaggcuggagugcagugacaagaucauagcauaguucacugcagccucaaacuccugagcucaagcaguucuccugccucaggccucucaguguugggauuacaggugugaaccaccaugccuggcccauaucaaaauuuauuugaggggcagagauugcuacuagagucaggaguacuaauaguaaauuguaagggacacuuuacuaccugcuagcagagagaaauauaaugggaaagccacagauuugguguuggagagaauuccagagccauuaaguuagagaagacagccucacuagcaccuagagggcaucuuuguacaguaaaauacuugaaaugguucaauuggagguacaugguucaagaaagcaaagaugucuauaagacauuuuagggcaauucauaacacaauuauuaaaauaagaccguuuuggcacuuuuaaaagcggugaccuauucaagaacuagaaaaccggaauuuuucauuauauucaauuuuugcccaaaaguuuaagaggaaguauuauacuaguuucaguauauauuugcccuaauuuuaucaagguguaauauauuuucgugauggugaggguggagagagaacacaguguucacauccaaaacauaacuuauguucaaagggagaaguaaaucuaaaccaccaagcuguuaccuuugaaaacaauuaauggagucuauuguguuuuaaccaaacauuuuagauuaaaggauuuuguauuaaaggcaauucagauacuccacaacucaaagauaauguuggaaucugguuuaaauaaaauaauaaaauccagaaaaucuacuccaaggccuggaacuccgcacagcagguuccauagcagagcagguuaaagucaaugccuucacuugucagucuuaauuuguuuggucuuuuagaagauagaagcaugccauuacugaaugcaagcccuccucuucauuagauuaaaaagaguuuucauccagcuuuuucagaaauaguaauaagugaagauuucuauucauuuuuaauuguuuugaaaaauauugucucugugcucugugguucacuuaauaugcuuaauguaaaauaaagcuuaugcuuugaauuuauguuucauuuagugcugugcaagcaucugcagaacaucagaaaagacuucaacaguucuuggaguucaaagaauaguuaaguaauauaaacuguguucauuacacugcugauacaacuacagaugggacaguaaauguucagcauucuuggaucagaagaaaacggacuaauuagaugcuuccuuugucguggugguugcuuugaaaacuauacuuuaaugggagaaaucauggaaagaaauucucaacagaauaacugaaaacugccuuuucuguaccgauugcuuuuugugugugugguauaauaaaaucuuuauucaauuuuacagaagcauugauggcagucgaaaugucucuagcucauauaacuuaauaguaauaacuaaaaaacuuuuagaauuuacuuuugaaaggagggaagccaguucugaaaugaguauagguugauuucauagucuucuuaauuaagaguuuagcucuuuguaaacucaaaauacauaaacuuuuuaaguguaguuucauuuacugaaggauaaaaaugguaacagugcagcaauauucacaaaaaauauugucuaacggacauauuuuguuaaucuguuagguuggguuuuuguuuccagggacaaauuaaauuuguaugauuacccaaaaaagggucucaguuuacagaugcuaacucuauauaaaggaauguggaaaaacucaguucuuaaguuacaagauuaaaaauucacauuuggucuuuaagaaacaauugacugacaucuaugaauuuauuuuguaucaugcuaguaaacacgaaguauuaauguauggguauuuucccagcuaguuuugcuuucuuuuucuggagcaaaacauuaagugauugcagaguuuuucaagcaagagaaaaagguuugcaaaaaaacccaggaaauguucccuuuuuuccccaccauucaucuucauuagaucaaauucugugaaacuugucuggucucucaaagggagcagccucuguaguguuaaauggcuaauuaaaauaggaagaucuuuauagccagaaacaacuuagucaucaaauagcaagugaaaccaaaacgucagagggauuacuguacuuggaaguauguugugugucccaaaugugaacgaaguauuguuagaauuuauuagaucagcuucuuuggagaucaaagauuggaaauccuagucauagauauucacuggacuggcuuuggacugaaaugcuccuuuguaauucuuuuccuauugucuuuuccuucuagugucccaaaauauuuucuuuaaagucagcacaguacuguauaugaaucuuuaaugugguaucauauaugucuacuuuugucugauucaucgauguauuauaucuuuauaauugaauauuuuagcuccggguccuguugccccuucaagcaguacaugccaaauuauaaauaggugcuacuggccuugagcauaucacugugggacaguuccccaauugucaaguguuuagauauguagacuauugccauuuguuuuuuuguuuugguuuugcuuugugucugaagcugaauugauuucuuuuuuuugaaugugaaaguugaauuucaaacguagucauuucuuacagauggccaagacagaaaauuguggcuagguugacugagaacuguugucuuccauguauuaacacaauuaagcuuuuuauauuccacucucugugcugacccuggcugaggcauuuugggagacaaggacucugaaucuucugcuuccauuaaagaagaacugugauauucaacauuggauuucugagaauaaagauaggaugauuccuuugaacuuugacuuacuuguauaaaauguccagcuagguuagguuuuugccauuuccuauauacuuuggguaaagcuacauuugaugagcaaugugaauguuucugagaauguucauuccuguuuucucuuaagagaaugugcuguguacuaaauacaggccacauagugucugccuguugaagaucuggaaacugccuccccagaucuguauuguauuugguagguaagggggucaguuucuuuuucucauuguguguugauaaucuacacaccaucuguuggaaccaggguguuauuauggggaacuccuccuguguacuaggaggaggaccuuagggagaccaagaggagagaagcauuuccuuugaugaagucacauccugucuaugagcccacuaaugcuguaacauuggccugaaagagaguguucuuuaaaagccuuucucggcuguuaguauaaaaacaugaugguaucagcucuuagcauguuugcuugacccuuauggaagguauaaauccacagaacuuccuucccagagaacugggaaauuguccuagaaauaaaccuuguacaguugaguggacauggauaagcaacaauuuguuacuuugcaggauuuguuccuugguaauuguuuggugugucauccuguaaauauucaugauagucuguuuauauccuuuuguauaucguugauacuggauuggguagaaaaauaaauuggcaauuuaaaaaaauggaacaguuaauugaaauauguguguuuauaaggucaauu

SEQ ID NO: 14048 - RNA, 19324 nt, Homo sapiens
cuccuaugcuaccgggaaagucucaggucucugcugcuggaagccaaaauaaucaagcagcaggccaacugugcgugagggacccugcuagaugcuggcacgcccugcaguuagguaagaccuucggagguggccaugucuccagguguugguucuggcagggccgggguucagggcucuggccgggaccacccacccaucugaggccagccccagggccagcaguauggggaugguucauggccacaagccccagcucagcaccuccaaccagagcugggcagaaggggacagacauggcugugggaggcaagaagaggaaagguguggggucaugugcccagcaaacccucaccgcccacuggcauccuggcccagaccucagccacaccggccacuucucagagccccuuacagaggggugcccaucagccuagggguucugagccagcauggcucccccaguaagacaggucccacuacagcuugaagaggaagccacuuuuaaacagccugcccagugagcacugcuggcugccugaagaugauuccacucaccuugguuuuuccugcaagugaaccuuccucccagaacuaagguuuggaagaucccagucugcugccugacauggccauucucccacaaaaacaggugaaggaacgcaggacucaaaucacgccuuugucccuuacuagcuaagcgaccucaggcaggcuaccugaccgcucugagcccauguuuccucauuuaaaaauguggugguagauccugacucggagggcaguugguugcuagaucacgucuaucagugcccgacauaagggauggcacacagaaaauauucagugaccgaaguuccuccucccuuuaucccagccgcuguggcagccccaccaccaggcuuuguacacagugaguccuuaagagguuuuuguugcaauuuuuaaagggcaucuggaggccuagccucugucauccugggccaccugguucuucugugacuuguuuucuccauguauaaaguagaaggccuguuccuuggagaaaaaggucaaggcggguggaauuauuaccuggcagccagcggggcucacagugcaggcuacuucagaagccucgucccuggcuaacaccacaaugguuauaacgccaagcggggcagcugagacuggcccaccuggacacacaggcaaugaguggaggucacaggaggucuggccaccagcuucccugcaccuccaccccugcccccacacuagucucuccucagccccacagggagccaggggccucuagaauggccucuccuccacccacgugcaugggcccuggcacaggagaggcgcugaggaggaagcuggaaggcacccagccacccacuccagggugaacggugagccugcccaagcaugagcucuuaugaggcccagacugccagggggccagggugucugaggcgcacacauuccucacucucugggaguugggaguggaggacccuccuccccuucucuauucuauugggaagcuuuccacgaccccaugugggaucagagaccucuucugauccacagccucaucauccuguguugguggcacucaaccaucuuucucuaccagacuagcagcucgguggaggcaggcacugaggaagcgugugcugaaggcaucgcaugcaggcaaucuggaagccuggggcuuuuccaucuauacagaauguacagcccaggacacaaacccuauuuacccuccagcauucugcauaccuaggaaaagcaguaaucauugaagccuugcuucagauccuccauucaugcaggaaguggggcucuggucuguucuagugcugucuagcuggguggcacucccacauccuuuucuccaggcaugugaacuagcucuuguguccucuuucucuugccaaagacagugguaugguaccaaggagaacagagccaggggccaggaggccuggguuuuggucccagcucuaccccccgagcugcugcguggcuuugaguaagccacucccccucucugggccucagcgucaacaccaguugagggguuggaucccacugcucccugggucuguuccugcuuuacuucacugccaugagccaugugucuggggcuggaguuggaggagagugcuggcaccaggcagaugguucugaggacagguucagagucugcaaggcugggagggcaccugccucuguccugggucccaccuccuggccugcuccucaggaaacccugggacacaugaacuugggccucagcuuuggcucugaucguauugugaugccaucucugggccaggcccucaucugucuacaucaccucaccucaucuccugguuuacgaagcccuuuguauaugucuccucauuuaguucuuacaaucaccccugagguucagagagggacaggaugggcccaggucacacagcagucagaggacuaucaggcccagcauucuccagcagcccugauaucuccuccuugaaacaggaagaacacaggaugugcagugggaauccugaccuugcccccugagcaauacugaguagggggggugguacucucucagaaccacuuugagccaccaugaaaaucuaacagcauaaagaugccaaaagcauaggugccagccagggcagcagcccgcuggaacagaaagagcaccacgcagggagccccagagcccaggcuccaguuuuggguuuucccaucugucaaaugagggcaaggaugccugcccugccucacccacugaaggccagcugugcacuugccacacuuaccccgucccaccuucuacacagcugucugugcccaccaccucagccaggaggagucacgagccccuucccuaucugcacacagcucagccuggcucacugcaccaaaaaggcaggccugagcauggaccacacacagagguauguucagacagacgugcagacacucaggcacaugcacacagcgcauguacuugcagaugggcacccgugcauacagcaaggcacacaccacccacuugcacacucaggugugcgccacauacugaacauacucagacacgcaugucaugcuggacacacacugcagcacacagaccgcauacccacacaugcacaguuggcuucauaugaugcucacacacugcagacaaauaugcauagauuuucuugccucucccaugacagccagauggugggauucucccagagggcugccauuuaaugcucuaauuaauuuuuuaaaauucuagguacccaaagccuggguuuguucaauugguccaggcacgacccagucugaggccaaggcgggaagcaggaccuaggacgagggugucccacuauacccaggagaggcuucccccucaccuggugaguagauaccuagccuagcaaggggcuggggucacaggcccagaaucugagccugauccugguuccaacagugcuccuaugacccaggacagggagagaccccuucccagcagcccuggcggaguggucuggccccaggugcacaccucaggaugcagggcgcucagucccugcggaggcugcuggcucuccuaucagacugcacugcagcgaggcuuuccugacauggaggugggcucggggcugcacauccaaauccaaacacaccuuugcugagcccuacugugcagggcacacuucaaggcacugugggaggacagcgcagggaacgggauguucacagagcacagagcuaccagagaguuagugcugagacagugcucaccgcaucuccaggcaguaugcuccgagcaggccagaauuucauucucacccaggucuccuggggagccccaccuuauucucuaggccaugaggauccugggggguucaggcuagcaggaaccaagcaucacuggcccuccaggucucuccucugccuuuccuggggcaccgucuuugcugcuaaauguuuggaaaaagcagcaauaaauuuacugccucacuuaugagcaauuugcugucaggagccauguguaagcagagggcugaauuaacaaggcuuaauuaacauuaaugugacggaucucaagugagucgggaaaucccccauccucaccgcccggaccuugccugcugauucccugcucaugugggaggugagaggcccaaggagggcucucagagcugcugacagacgugacugggggcuggaggcuugcaggagaucagcacaggaagccagagccucugcaacuccaauuccaaaggagcucucacacuaaguccuuuaucccuugccuggugcacuggcuaacacguggaccuuggagugcaagagacccgcuuuuaaauccugcugcugccacuccuaugcuacgugacccuggguguuuccccaccucucugugccucaccaucucuaucaguaaagagacaggacagauccccccucagagggcuguuaaaggauccaugggccgggcacgguggcucacaccuguaaucccagcacuuugggaggcugagacgggcagaucaccugaggucaggaguucgagaccagucuggccaacaugaugaaacuccaucucuacuaaaaauacaaaaauuagcugggcauggucgcaggcgccuguaaugccagcuacuugggagucuaaggcaagagaaucacuugaacucaggaggcggagguugcagugagccgagaccaugccauugcacuccaggcugggcgacagagugagacuccaucuuuaaaaaaaaagaauucaugaagucaugcauggagagcagaggugcuucccaccccacuccccauaagcauaagcgucauugaugauagugcguggggcucaucaucucauuuaaucuucccagccaacagcccuuugagguagggccugccaagacgccccugugcagaagaggaaaccaagacacugagaggggagguggcucauccagcccacaugcugugugacguugggggaagaggcuccagucacccacuacagucacuggcaggagccccuugaaggauccagagagccacggugaggggagaggucaggcugcggggccaugcuguggaccaguguacccuuggacagugggcaucucgucagagaggccaggucccuguuuuucaaugacuaaggcauuacuaagcugcccccugagggcccagccugugucaggcuccggggaugagauaaagguggugaaagcugugccccugcucucaggauggauuccaccuccgacuccucucagcuguccccagggcacccagcccagcccuggcacggggcaggcacaccuucauuuaucaucagugaucgccguuauucauaugaaugggaggaugcuucugagcagaaccaacuuugagcagcagcagaaaggaagcccagccccacccaccuaccccgacgcuucaccagagaugggaguccccacgcccccagccauaacccugcacgucucggaucacuggacugaccuuuccugucaguuuagcggccuugagcucugccccggagcauacccacacccuggccuucagggggacaggaagggcucugggccccagguucacaggucucaccucugggacuaccccaguuggagucuuggugucagggauccauuuggagacagcauggggagagggaagagacgggcuggggcaggggcaggggcagauuccaccuccagaaaagcccuugggccccuccucagccuugcccccuccugccaagcccccaguauccccaagcccugccacaaucccaugcuccaggaggucuuccuccagcccaccccagcccaccucccacccuccugacucagauguucugucuccugcuaagccgugugaccuggaggaagucauuuuucuccucuguaaaugggggaugagaacuaccugccuuacaggcugaugugaauggaaugagaugcugccuggcacagugagggcuccauaugugacaccuaugauuacugacaacccagagguuagugcaguggagacccagccgugcaggagccugugaggagcugggcuggcucagaggucucuggucuuuucugcgcugcucugaggacgcaggaucagccagggugucuguguggccccuguggcaagccugggagccauggagccucucgggaagaaccagaaagaacuucguuucugaaaaucuuggaaccaauuguuguauaaaggagugaggccuccaucccaggagguaugcaagcagggggauccauucauucauucaacaagcauacaaugggccccuccucugugcugggcccugugaugggcacugggggguugggaaagagugcaugaaagccaguccugccugaagaaagccauacuauaaagacacaggagaugacaaaggugccaaaucgaccccgggucaugccugcccagcccugcacaugcuucagagcccggaggaaaugcaggaggcccuaugccaugaaaaggggcuugggaaacauccaggguagcacagugagggcugagcuccagccagcagaugcaagacccagaccccagccugcucugagcugccaugcccuccgguaucccgggggccucccugcccugguccacccccaucacagcucagggccaguccccaggccccugcccacccccaacaccgagugaggggugcgcaggaggaauccauaguuuacagggagggcccugcuggcagcagggugugaggagcggggagggguagcugucucugccuggacaggggcaugggcacggccagucccaggcagguggcgggcuuacccuuugcccacuuucuuguccccuggcaguuccuggggugugggcuccaaggaggcccagcagccagaccaccagcugcuuccccuccccacacaagcccuggccacaaagcgcccucccccaacucugcccgccuguggugacagccucuuggcacuagcucucuccucccuccaucugucaggaaucggugcagacagacugugagaaccacagaggaaggagcgauacugcguggacccucccugcccccagccuccccagugugcuccccagcccaccccaucucucucucccuacuccucugucucugccuucucuuccaucugucuccaucucucccuacugaugaagacaucgacagagugggcauagggaggggaagaggaccagccaaccagugaccccacucguaaccaccacacgccacggccacagcccagccacccauguggcuucccuucuccccaccauuaaggagucagaugcugugggacuaugggcucaguguccccaucuguacaauggguggagucauuccugcuggcccaccucccaagggccaccaugagccuggaggcaacaugugggaagggccuugucgacugcagagacucauacaaggcacguggccagcgccuccagcuucuuucuauucaucaugagaacaacgaucucagugcugcccuccacuugggaggagugaggccaacaugggacacagacagacagccacaugccuggaagaauagaaauggcggugguaacacaggcaggcccaugaauguuaugauucucaccacagucauacgaggugagcagggcagagauggggaaacaggccagggagggaggucacacagcugggcuagaggcagucuguaacagcggccaggccuccuggcccuauccacacagcucccuacucagaauguuuggcccugcucuuccagaccuuccaagauccucuguuucuuucuugaguucucccaaaaggugaggaagaaaucagucuuuucuuuuggcaggcagggguugagacagggucuggcuuccuuacccaggccagagugcagcggcaugacuauagcccacugcaaccucaaacuccugggcucaagcaauccuccugcuucagccucccaaguagcuauaggcauggaccaugacaccuggcuaauuuuuuuuuuuuuugagagacggagucucacuauguugcccaggcuggccuugaacucccggccuuaagugauccucccaucucagccucccgaaaauucugggauuauaggugugagccacugugccuggccuuuuucuuuguuuuuaauuaagugagccgugcccagcuagcagauuccacaagggauggggaggaccuccuggggaccugagagagcaguggccagggcuugggggcucagcuagacuggucaagugucccaguuugcucacaacugaagggguuccugagaugcaggauguugaguuuuaaaacugggauaguucugagcagccgaggagccguguucaauuuaugcauggcaagcacauggcaaugcugacgugcugggcaaaugaagugggcguuuucgcugaaaagagagcaaaaccucugcucaccccuugcuccugugaagcuuggaccaguguuccagaggcccaguggagggcaaguucuggucuagcugcagccucagggucaugcggggccaugucugaucccagccacagcauagauguacccaagguaacagggaagggucuuggguccucauccccuucacagcagaggaagcugagguucagaaaaggucacacauuaaguuaggggcuggugcccccagggcguggccugcuuucccaucuguagauccuccccagguucuggcagggcaccuggcacagaacaaacccucagugaauguuggagcugggacccaaaggcuccaguccacagcaggcgcuucccagggacucacagaaaaccacacccagucaugugcggcaagaggggcuggaaaccuagcaaggggucaggggcacagugcacacucggagcccagaggcacccuccaccccuccuuccuccaccguccuccacaggucccugucccccugaggcuuguggacugcauugugaaccacagacucuaaaucaggacaucaugguauagaguguggggaaacacaaggaugagagagcccagaggagacucugacccaccuaggggaggaagcacccuggaaauggugacuccagaggucaggugaggccggacaagcagagauggagccuuccaggcuaggggccugcaugcaaaagggccugaggcuucucuuggagguguggcuggacaggagacgccuggggcuuggggucagugccaggugagaccuggagaggagacagguacaugucuggucuugaagggcucugaaugucaguuaagaagacuugguccuaugaggggugggcgucacugcagaagcugagcgaggaaaggguguagcuuugcaucucucagagcacucagcugcagagcgaagauggguuuggaggacagaacagaaacuaggcaggggcugcugcugagauccaggaagggcauggcaguggguggcaggggcgggggaggcccaggcuggcagguaggcagggugagugucgggaccuucuuccuuccccuauucaaggugaggccuugggggaaggaagagagggguugugaugacucccagguuccugcccaaggcccaggcaaugccugcacuccggccuaguccaagaggcagaagacguucagccacagccccccagugcuaugugcugugccacagucauugcaggaucugggcgcugcugcccugcuacccaggagagcaagcuguccauaacgauaccuuugccuccaggcacggcauuucuguccucacccuccacuucucaaagcccugggaggcaagucacaggaugcagcuaacauuuauagagccugcgaaugugcacgccaccaggccccaugcuaggggagccaaagcagcaauggccccagagaggaugguccuuaucugagcccacaccacaagucagcugucacaggcuggacuucccuaagcaugggggcuguggcaagaaugcagguaggaagggacauggggcaggcuugccgugaaggugggggcagacucuguaagcagaggccccauuaacagagcugggaucagagagggcaggagagcugcaggagacagaucugggauugacagaagagcagguuuucuaacaggaagagcaguccaggggcggggagcugcuucgucagugggugagcgcccaguccccggacgcauuggacccccugaccuccaccccacuaggcugcugaggaaacuccugcacugggauggaagggggaggccgcuuuggccuaaugaagaugcugcccacagcucacacauccauucacucaacaccuucaccagggccugcucugagccacgcuggggacagugggcaccugggcuggguggagcagaaccagauaagccuccucugucacccuucuccauccugaucugggaggugaggccagagcccagggggaguaggagauagaagcaugggucccuucagcccuggcugaccaugcaccaugucacaggccuguguccuggccacuaaaggaccaaguguccauaacuuccuaggcauauuuagggcacaaagccaggggccaggcagggccaaccauaauguaaucuccuucugcaccccaccccuccugaaggucccuaaggcucugggcucauuuccuaaugaggucccuagaaggccucucccuaauuaaacugggccagcaagugacagccuggagcggcaggggagaaagggagauaaaggagucuuucugggggcucccuggcuccuccuacuccaccccgcagugcagcagcccaguaaggauggggauuccugaaggacagaugggagagggagguucagagaaggaggucaaaagaagcccaggcaaucuugaauugagcacugcgcaugcaccaugcacugcucuuagugugccucagaaguuaacucaccugucaaucccacaaccaccuugaggggcggcuccauccuccagaugaggcaggugcucagagaggugaagucauuugcuuagggccccacaucugggaaguggugagguguggacuugaccccaggcggccugguagggcccugcuguuauccaugucgugauagauccucuccuggaugagguaggggcccguccuggggacuugcacaucuacaccucccagcuggcuucgcaccaaaugggccuggaaggggcuggggcagaauuuaaaaagcugccccaagugacacaaaccacugaucuaauccucagucucucagagccccagagcaggaauacacccagaucacauggcauguuggggacaaggugaggcugacagccuggagggcagccagccagguaggucaguuagccagcagcaacaagggaucaggccucugucacagaggggagacaucagcacaggaucuucaagggugggagagaccaagggccagaggggagggcaaggcauggugggggagguggcagagagaacaggggcucaagccacaugggcugccagaccacucugcccugguuugcuugguccaauucagugguguaagaagaaccgacuggcucauggaacucacacacugagggccaaggagguuucugcuacuuuacauaggccaggaauuauuuauuacccauguuguucagagcgggagucugggguuccauucaagggacuugccccggggccucccaaccaggaagugggagagcugcagcuggaagccaggucuggcugcugcuggagaggccacgcuggccugauguaccacuuggccccuacaguaggcaguagaggcaggcugggaauggggaggggagggagacaaaagaguguugcauaggcagcugauguagagucugcucucacuggcucauagguauuaaaaaaucagccccgucagagcucagcacaaaaauaaguagguguaaaaagccuccaguagauguaggcucugcuaauaaacaguugugugguuuaggccaugucuccuguuggggccccaugggguuggauuucacagccccugcccccaugcuuccagcccugggccucagagaacagggccagcuccuuggagcacccuguaccuggggccuggccauggcagacucccaccaugugaaucccugacucuuaggggaaaacaaaagaauuccacagaaugggauugagaggggcuggagaugcccuacucccaaggggcagagaccccaagaggggcaagcaucugccaaauggccacucggcaaggugggagcagaggaggaaggcugcuguuuauaacaagcagcccucuccgggugggaccagagcacacauggccuggggaggagaggcugcuguggcagggggcaggccaggaagagagacugcuggcgccucuccagcuacaaaucauuccccaccacgacggccugguggggaggcggggagcucuggcuugguuugggcagacuuagcggguaugggagaagagugucaucuuggccccauagccuccacggguccagaauagucaccucccuccugguacacagccccuccucugaagcacacaccccaagcacacgcacaugugcccaugcccauggccgagaaagggcucugagaguguagggcagcagauggcggcucaggguccaggaagugggggagggagggaggggaggagugcuggcuugaaugucccuggauucaggccaccaggaaagcccacccuuggccuccagcuauucagucgggcagcuuaaccugggccugaugggaccuuccugccucucaucagcugccaagucucugauguuagccuggacccacuggggaaccaaggccccacguggcuaacuaccguggcaggcccggcuggcuaaccagccccacugggccacucaggaagcagccacccuggggccccagcgcagauggggugggaugagauggcuccgacagucccucccagcccgaggagcugcuguucucucaggcagccaaguccucccaacuggccaguugaccuaaaucucuccugcugcuauuuugcugcugcccucuuguuguguccuugguggaggaggaggaaagcugaggacgguuccuuuuacucagccauucccugugcaggaaucacaggcucaggaagggaagggaaacgcucauuuucagggccaggcucugggcaaaguacuuuccucagcccgcacaccuccggaauaugggcucauuuucccgcuuucggaaagucucaugaagcuggugggccucacuccauuuuucuccaucacugcacugcauccggcccaauugugagugcaggaagaaggcagaagggaaagucacccaaggaaccugggccucaggguggagcucuggaaguggagcuaaggaguccagcugcccuguuucccugcccagaauccagcccaccaagccagcuauacuccccgcacugucaccagguaguaaggcacagaucccugcccuaggcaaggacuggccagcuccagcccugaacccagcuccaggcacaggagucugcuccaagugcugggggcagugcagguggaauaaggaccaaugagugaaaggaaaaugaaguucagagagggagagccauucacccaaggucacacagcaaguuaggggcauagauagaagaauuagaacgcugcggaggagaugccuucuaccaauauccugagaagaaugaaggaacaguuuuguacucuucugcuuuuuuuuuuuuuuggugggggugaaagcccuuggggccagaacaccgcucguuguucucucuccuggcuuugcuuucuguggccuggauauggcugcuuugucccaugggaccagaaugagguggcccugugcucagagaagagggaaguccuucagcugccugccucgcuggaaaggagagccauggggccauagagggagagaguugugagaugggaaagauucuccccucuagagagcagaacggcaaugaugaaaaugcacacacucagcagcuccuuuccuaagaacuuaucuuaaagaaaggaccaagcaaaugcacaaggauggaguucaaggauguccauccuagcauugcacagagcagggaaaaacauggaagcaaccaaacacacaucuaucaacgggagaaaaugucauuaaauuauggaagauccacacaauacaauacuaucuagcccuuuaaaacaaggaugugaacuacuguuauugccauagaaagccauaugugaaaacaaccggcauaacauggccucauuuuuguuaaaaaaaaaaaauacauauguucaugcccaagagcucacaugcagagaaaaaucucuagaaggcuaugcugcuuacauagugguacuagcaagggugagaacuaccuucguccaagcuggagugcaguggugugaucucggcucacugcaaccuucguuuccuguucuuuauuaacuauguuuuucauuacaaguguaaaguuacuuucagcuaaccagaaguuacuuacccuggaaaacuaaauaaguaaaaucaguugaagugaguuuuagcuccagaacuaccaauaacugggugagucucuuauccucucugagccucguuuuccucaucaaggaauggggaucauaaugaacuccugcaccgccugccucccaggagcacaccugugaggcaccaacuggaaaagccauccaaggauuacggcagguugagagggcuggaaacuaagaugcccuccagaguggcugggaugaaguccccugugguaccucaaggccagugaccaggggaggaugggggccaaaugaccacucccguggacuccuagacagacuggcagacagcuuuggggugucuguccugccacaugccacguuccaaggggcaggcguguagaggccaugaggggucaugggaacugugugcaccacaugagccccacagcccugggcucgcugggugacucucaguuucccaaggacacuccauggcgccugagagcaugccgcauucuaugcccccaaagcagcuaggcccggcucucccauuguggguaccuaggcugggccccaccagagacaaagaggucagagcggguacagucagugaggaacucggucaagacugagcaggauuccccugaaggcccucagccccuccccugccacuccggcugcggggugauuacuggagucuaugacauauggcagcuugugagaggagcuggggugagcagggcugauaauuaaaaccgcugccgggggacccagcucaugcuggagggcgcccaaggggcugggcugcucaggagggaguuggcacacccacuagcaggugcuggcaaagagggacgccuggaaaggaagagaggccccagcacagccugcaagccacacuuuacugucaucgugacugggaugugugaaugcauaucuccuuucagcugccucagaccugcagccagacaggcauggcccaguccugccacugaccagcggggccacccggggcaagugacuucaucucucagagucuugguucucuccucugcgaaaugcagucaugauaccucaaggcaccggcugaaggaggucuugcaugagaaagccccucacuagcucgcucccuaacucuucuuaguguuaacgugaguauuuuagaugacuucuuggcaauccagaagugggcaagcagggcccaguggggccaguggugcaccugagguccccagucaggagcccaaagcccuucgguacugcaaaaggcuuguguccaccccucagccugagagcacccuguucccggauccagcagggaacaaagagggugggggugggagggggaagcacauacaguucugacuccagucccacccagaauugaggacaccugaguucugagaauggugcccuacugacgauggagccaauucgaccaucagggccuuaguuucaccuuucuaagccugggugcgaggaggcagccaggccccguguuacuacagagaguaaaagagaugacccugggcugacacucccugaggucaugugcaucacuaucaucagguucucaguuuccccuuccauacagucagaagaagaaucagcaucuaacaggcaaaggcugagagaagccuaugaaaacuggaaugucauccccaugggagcuggaaaaggccuaugugagggcucugcggggucuccagagaacagggucccuccccagucccacuccccaggucagaaacugguagcucagggaggcacugcugaguccugcagcugcucccuacuuccucccacacccuccaagcaccagccucugaccccaccaggguagacagcgcucagcggggaacggcuuaagaagagucugggcuccagaccagacagaccugggucagcuccuggcuccaccacuuaauggucaugacauuggccaaguuccgucuccuuucugagccucaguuucaucaucuucgaaaugagaacgaaaaacuagcccucccaggguugugaguagugaaguuaaaggaugugaauuguccaacguggucccaggcaugggauauaggcagccaauagcuguuauuagcuaccccuugaggaaacgacuuuggaauuccuacugcccagcacaaggcuggcggagugcacaauguugagaaggaucugcaacugcgggaagaaaaaggacacguugugggagcucagggccugaggggcuggaggacaggggucuagaaaggcaucucuggaggaaguggcaucccugccaggccuucagagccugggugaucuggaugugugggcauuuggggggcaggugcuaccaacguuacuuaggccuggggcugcaaggccuggcuccacaacccuaaggacacaaccccacacccucccacagaccccagugcuggcccccugggacagcaugggccugggaguagaccacuaaccuggugcugggagagcaugcaugcauuuacuuccuucaagggcgugccuguuccauccgcccucugggcucucgcuccucacugcccccugggggucucucucucucuggcuucaccugcuaccagcauuuccccaaggaggaaaguugucaagucggccaccagcagacaacuggggaggaagaagccaaccaucccugaggcccaagggacucacaccggggaaugcugaccugggagggcccaagggaaagucuucagcaaacacucccaaggccugcuagggccugcugggcagugccaugggggaugcaggcccuccucuccuccccaggcacagccaagaggaaaggagcagacaggacagaagccagccucuaggaccagcacacagccagagggaagccauccgcugccccuccuagggcccuaggccuguuugacucauuucuucccccagcuccuuuccaagcagcuuucugucaccucuacgguggcugggcaacucccuggcugaggcgagcaccagcugcaggaaccucgacaucuggcuaagcagacaggagcaggggaagcaagggguccggguuggccugcaaagaccagacgucagguaccuagagaccucagugaaaccccucccaccaagaacaaccucacccacugccauucacugaacaccuccugcuuaccaggcaugugaccucauuuaauccucacauuuaaucuccgaaaaggagggccuaguaucauccucacaaccauucauccaggaggcgacagcugggauguaaaaaccaggugugucugaguugugacuuugacaugggucucuaaguaacucaaauccuguaucucagccuggaggcaauggggugucagggaaggcuuccuagaggaggugacaccugcaccggaucucuuaggaugauaaaaugaauccagccagugagggagcaggguguccggcaggaggaauagcacacacaaaggccuggaggugagaagcagcaggagggugagaguguggcagaagcuaauuuggugucacaggcucacaggaagaggcgggaagagguugcagggaaguggguaacaggagcaggucacagagggccaaauacagaggagucuacacugacuuuauucucuggauaguugggagccccaggaggacucuggaugguggaguugcccggucaggugaagacggggagguucagaaaggagccacacugucgucagauggcuccauccacgaaggagaugaggcuggguccagugucaggagcacacguccaggccgcacacugagggccagaugcgggcuacagcacaggcagggagcuguggccgagcuuuaauuauuuaugaggcuguuucccagcaagacucagcacuccugcagccuggccuugcccagcuaaugaacucucagccaugggagaccucccuguggccacucuuuauuaaaccugggauggaggggugaugggugcugggauaacaaaagaguccaaagaagccugaacaaagucgaggucagugagcacaaaacugguccaccugucuacccagccuuuccgcgagaagcacagaacuuccuagaggaggaagcgagguggaguagccuuaagaugucaucucaagacagggaaaugaaggccugggaaggaccuaccuaagucaccagccaguacuugagacaguacaaguuccauagcuggucacccgcauucacaccccagcaguucuacacccuugggccaguuacguaacccgucugugccucgaugagauaggacuauuucagguacuucauaguguugccccauuuuauagaauagaggaacgaggggcgauguguggacaaucucagcacgaugcccgguccacagcaagugcccagacagcguucaucggcgcuaugguuacuguugugacucugggaguaaaggccaggccagagaccggaaucucugccucugcccccagacacuagggagcaacaggaaacugaggcccaggggccagcuggccuacgugacccaggcccacagccaggaaucccacccgacuuccccuggcugggcuuccuugggccuggcucucuagcuuccagcuccuuccuccacuuugaagguucuuugagcugagaacuaaagccccaggagcuuuucccucuuccaucccgcaagcuccaucugugucuccaaagagccaagucccagccacuguggaugaggcucgggacuuagaaggccucaguuugaguuccagcuccaacccugaggagcucugugacuuugggggagucacuucaccucuccaagccuauguccucuauaauauaggaacaauaccacc

SEQ ID NO: 14049 - RNA, 890 nt, Homo sapiens
gaaaaaaaauuuugggggaaauaacaguucucaccuccaaggguuaugaugagguggggaaagaagguauaugaaauccuggcauauaguaauugcuaguaaguuuuaaccauuauuacugcucuacccuugaaccaaaggcucggcucugcccaguuuuuuagacaauccuggccaacaugggggcagaaagcuucauuuauaauagcaggcagggccaauaauuagacuggcuugggauagaccaggugugaccccgguucaguuugcacaaguggucuuuagcugaaauucuccugcuaaauacaccugcccauggucaucagccuguauaagucuuacuaauccuaacccagguagggaguggugcuggauccugcuccuuaugcaaccagcuggcauauggccaugagcagacagaaaacccagaaccacaauguuucuccacaucagacuuuuuuuuucauucuauauuuuuaaaaaauaauagagauggggucuugcuauguugcccagacuggucucagacucauggacucaaguauuccuccugucuuggccucccaaagugcugggauuacaggcaugagccacugcacugucccagacucuuauuacugucacuuacugccuagacucuggcuucugucaccuaaaccauguauccagagugugucuacacucaucacacucuuugaacacugugcauuggcccaagaaguucuuaagucuucuccucacuagguuuccacuucuucugucuucccccagcccaauggaaaaauaagaaaggauuucaacauuuauuagauguuaggcaucuuucuuacuuaauuuaauccuaacaacuccaugaaauagguauuauuuuucauuuucguuuuacagau

SEQ ID NO: 14050 - RNA, 33959 nt, Homo sapiens
cggauucuccuuaccccuccacaaaucaagacuggacaacuggauuucauuguuagguuccugcgagggucucugaggagaccuggcaagccuguucugcggugcgugggcucgugccgugcagacaugcacuuucccgcuggagaagcucuguaccuuauuuuuccuugcaaccgcaaaucuucuacucagggaugaugcaaccaacugaugcaagcuccaagaaaaccaaacuugggaccucuuauugcaaaacugacuuagguggacuuaggacaccaggauauaagucacugcaggcuaaaguguaaagcuucugguuauuuuucuuguagcuugaggauuucuucccaauuuuuccccuucgcuguauaacaaacaggugaaaauguccggucuuuuucuuccugguacuaguugaguccuaaaguccguacuuaaugcauagcgaaaaagcgaccuaacaaaaguacacacccaaauaaaaacauaccgaccacccuuuuauuagguucccuaaaauuguaggcagggacacaacagaacgcucgggagacugcaagccccaggaugccgcgcggccaccugcaccugccgccacuagcacuaagagggaugcgcaaagcaggcggggcguuggaguucagauguucgcucccgggauaggcugccccggagagggagaggcggggucggcuguaucacguggaucugcucccgccgccgccgccgccgccgucgucuuucucugucucggcugaggcagccaucuuucucuugccgcgugcugguguuggaggacccucccugcuucaggugagacccccggcggucccgccacuucacggccauaggccgcugcgcacggucuccccccgcccuccccuuccgacacccgccaaccgcucaggcugccacuuccgccguggugcggcgagcgggggcggaggcggcuggcuuggccugucgguuaccggcggcgcagcugggggucggcaccugugggaagguccccagcaccaccgcccccugugggagcgagcgggcccgcccuguugccgcccagacccugucccaggaggcagguggacgccccuccucuguuccauuacuccuugcucacaacagcaguguugugugcuuugagcuuuauacaggcucucuguugucaucucauuugaugcucccagucuacagauagggaagcugagguuaccacuucccgcccuugaguccagggaaccgaacucaguuacagcacucuucaccuuguaauggcaguguuuguuuacaagucggcgucccuugcccaucuuuauaaccccccucccacugccugcugaccgacaggcucaguguugcacagcuagugaauggcgguuucaacuuccguucccacauucuugcaguuuaccauaguuguccccucgggagugguaacaauaguuaccaguaacuguguaucuucugugaaccauucccugugguugauaauguuuuaacccucaaaacaacccugugaaguacgugguguuauaccuuuccaaaugcaggaggaauacaaguucagagaagaaaaauaccuuucccaacugguagaaccuuggucuuucugauuccaaagccugugcuugucuuagagaaacccuacauaauaaaaagucaggacucaagguugcaauuauuuuuaucucuguguaaacaugauguaugugaaagugccuaccacaaugcuucuaacuuaggcacuuaauaaauauaaaccuguuuacacccuuucuugaguccuugagaacagugcuaaaagauccuggaauccccaaggaagaacucauuaaucauguggcuuuaggaaguuacuucucccuuuugggccuaggaagggacuucucccuucugggcccuuauuuccuaaucuauuaagaugggagggagggaacuguuucguuuguaauuuauacuuugcuggugcuagcagauguugagaugacaucacagauaggaaugaugggugcaauaaaguagagguugauugagaauagagaauuaaaccaggugaucuuggaggucuacuccagauucugagcuugacaucgcauagacugaguccaguccucuuuccuacuugaauuccacacaccacaacuugccaagaaacaaaagacuacucuuguuccuccccuacugccuugagcucucagucucccuaaaaucauuuuucucugagauacuccuuaggaacaaaauuucucaauucuguuguccugaccaccuggaauggaaucuguucuuucaucuauaccuugauuugaagaguuaauuuuguucuugcuuuuauuucaaacaagucaagacuuugucuuggcaucccaaccucugucuguucucuugggaauuguuacuucaaaaugcagaagaaucccaaaggguuuaccaaguaucuaggucuaauguuuuuccuuagccccuuuuuuuuugcaauaaauuccuuuggcucuuuguuaguucacuacacucucauggccacauuccuuugagaaaagugaauguugguccuuuucuguggauauuugagcauaggaauugggauuuaagucaucaaauuuaagucuauggcagagcuaagauuggcacacauuuaagacuucuuguuuuggacucuaaacacacuuccuccuauaaaaguguuuuuagcugcuucagcauugugauacagcgcugagcagagugaagaaucauaaauucuaaauauuauuugggaucuggacauuagccuuaaagaagagauagauauauagguuauugccuaaggauagugucaaaguacaaaaugguuaguaauuauauagucuuugaugcugcuuuuuuuaaucucucaaaugaagcaaacaguauuuuuuucaugugaaugaugacuauacaggguuuagagaauuggccaaagaagauuugauaacaaccuagucccuuauucccucccucacaucucaguaaugauuuguugaucugcagaacaaguaaaacaagacuuuuaauuuggcuuuuuuuuuuuuuugagacggaguuucgcucuuguugcucaggcuggagugcaauggcaugaucuuggcucaccgcaaccuccgccucccggguucaggcgauucuccugccucagccuucugaguagcugggauuacaggcaugugccaccacgcccggcuaauuuuguauuuuuaguaaagacagguuucuccauguuggucaggcuggccucgaacucccgaccucaggugauccauccgccucggccucccaaagugcugggauuacaggcgugagccaccgugccgggccugaauuuggcuuuucuuuguuuauguaauguggaaugugaugacccauuauaaacuuaagaauguuuuuuucuuagugggauuaucacugaccagacuagauucaugacuauaauuuuagaaucuucaaaaucaagauuaacuuuaaaaagcuuguuuuaggagucuccucucugcccccccccaacauuuauuacuguagcaaagauauguuuuuguuaaauugugcaaugaagcauuuuacccuguaugcaagaaugucuugacaaguauaacauacuauaucagugcaggguauugaaugaacucuggagagugcugcagaagcaccaaaugucugaaaaccugguucucuuuccccauuauuaacauaccaucugaccuugaauagaggacaugacuacuugauaucuugacagcuagacagccuuuuguugaauuucuucuuuguucagcuuuuuuuuccuuuugucaucuuuaugguuuauaagaaauacagaaugugauuugggaggaaaaaaaucuacuugaagauuuugcuaauaacauuugguaacagcucucugcuguaaaaaucuuugggggaaaaaaacuggcuugccuacagagauuucauaauugguuaggcuuaacugaaugccaaaggauugaaucauguuuuaaggagggaucuuugaauaggugacuuugaaucccauucuacuuucuguuuguauauuugauucccucaugguaauuuaauuuugauuuuuaaaaauaucugguuuaugaagcuagaacaaguuauuaauguuuauuaagaauauagacaguauuaauauggucaugguguugaugcauacuacaagcucagugaaccagaagguacuguugcauaaacaguuuguuaauuucggcaaaagagugacuuuaacaaaucuauuuuucccccccuagauuuaccaacagcaugaaucaagaaaaguuagccaaacuucaggcucagguccggauagggggcaaggugaguguggcauaagaaaaauugauaggagaauguaugauuaccagauaguguuauuauuucggauuuguggucauugaaaaucuaaaaucuuuucaauaaucaagaucaaaccacauuccaauuugaaaauaacuugucuagaucuaaaauagguaacuagaacacuuuucucucugaugaugcaauggaaauagccacauuuguuugaauccuaacucuuaccaucugcuaguuauaugaugugaacaaguuauccaaccuuguuaagcuuccacuuucuuaucugcaaaauagaaauaauccuacauaagguguuuaaagauuaggguaauauuuauaaaacaccuaauguggugucuagcacagaguagaugcuuaauaaauuauagcuauuauuaugguuagacucacuugcagggcauaccagauguuaggguuacuuugucuugacuggauguuaccuacuuguacagagguuuagcuggagaugcuuaaguugauuauauauuuuguucauugccagguuuuccucacaaauucuuaccuguucuuccauguuggugaauaugaauaucagcuuucuuauucccuguacuuuuuaaagccuaaggaagaacuaguugugagcaacugaagucuuugauucucuucagcuguggcaccaggcucaaggagaauauucuacccauaucucugcccaacacaaucuuugcaaaagugaaagaaagaauaguacuuaccucagaccugaagugguagguaggacacuacuuuuuguagugggucccacugugucauuuacacugaugauaaccacaguuccuggggaugagcacaagggaagggaagggaagaagagccaguacuuucuccuucucccacagugauacaguuauaugagucuggaguuagaauaacacacucauguaaccacaguagucacauuguagcaucaagugugaugugaugugccaaugcagaaacuagggauauucaagaaccauagaauauaccuagaagagcuugauguaccacaucgccauuguguauuuuaaaacugugguugguacauucgauuuagcuguuguauauugagcaccuacugugugccagcacauagaagauaaacaagaucacagcucugcuugggagagagaugcucacaauuauaacgcagaauagugaguguuauaaugaaguacaagguacucuugccuaguggagacaaggaaguuaucacugagcucuuguuuaaaggauaaacaauuuaucacuaggcgaaaagguaauggcuggcagaaagguaaugggugguggcucacgccuguaaucccagcacuucgggaggcugagguggguggaucaguugaggucaggaguucaagaccagccuagccaacauggugaaacccugucuccacuaaaaguacaaaaauagccuggugugguggcgcauacguguagucccagcuacuugggaggcugaggcaggagaaucacuugaacccgggagguggaaguugcggugagccaagauugcaccacugcacuccagccugggcaacagagcaagacuccgucucaaaaaaaaaaaaaaaaaaagaaauagguaagaggguucaugagauagaguaaaaaggguugucauuuccauacuugcaaaggcacauauggugcuaagauaacacaguacuuaauggaauggcuugcuuuaauaugguacagcuauucuuuuuuuuuuuuuuuuuuuuuugagacggaguuuuggucuuguugcccaggcuggaguucaauggcacgaucucagcucacugcaaccuccgccuccuggauucaggcaauucuccugccucagucuccugaguagcugggauuacaggcauaugccaccaugcccagcugaauuuuuguauuuuuaguagagauggaguuucuucauguuggucaggaugaucuugaacuccugaccucaggugaucugcccaucucggccucccaaagugcugggauuacaggcgugagccaccgugcccggccucuuuuuuuuuuuaagauggaaucucucucugucgcccaggcuguagugcaguggcgcaaucucagcucacugcaaucuccgccucccagguucaugucauucuccugccucagccucccaaguaucugggacuauaggcacccgccagcaugcccggcuaauuuuuuguauuuuuuucaguagacacagaguuucaccauguuagccaggauggucuugcuugaucuccugaccucgugaucgcccgccucggccuuuuuuuuuuuuuuuuuuuuuugagacggagucucacucugucacccaggcuggagugcaguggcgugaucucggcucacugcaaccuccaccuccuggguucaagcgauucuccugccucagccuccugaguagcugggauuacaggcacgcgccaccacgccuggcuaauuuuuguauuuuuaguagagacuugguuucaccauguuugucaggcuggucucaaacuccugaccuuaugaucugcccgccucagccucccaaagugcuaggauuacaggugugagccaccgcgcucggccgguacagcuguucuuuaguguacguaauggauagagaauggcaggaaaugaaaugaccagguaguuugggauuccauuauacuuuuauaugccauacuaaggagcuuggaguuuuauccuauaggcagugggcaacuauuaaaggauuuuaagaaggaaaugacugccauuuuagaaagguagcugcuggcguuguggaaaauggaacaaaauggaaguuuggccuauaggcgaacaauugagacgcuauugcuagagucuaaggcagcaguccgcaaucuuuuuggcaccagggacugguuucguggaagacaguuuuuccacggaugggaggaugaugguuuugggauaaaacuguuccaccuuagaucaucaggcauuaguuagauucucaugaggagugcgcauccuaguuuccucgcauacgcagcucacaacgguucgcccuccuaugagaaucuaaugcugccgcugaucugacuggcuguggagcccaagcaguaaugcucgcucaugcccccuaccccaccuucugcugugcugccguguuccuaacaggucacagacugguacuggucaguggccuggggguuggggaccucuauuauaugggauacaaauuuaggaguuggaauugacacgauuuagugacugaugggauaugggggguaaagggcaugcagaagaaucuaggauaacccucagauucaugauuuuagagacuugaguauauggugguaccaccagcuacaaaaguuaggaaauaagaauagauugguggacugauaagcuuuaagacauauugaauuugaggugccugaggaucauucgaguugaacaagcaccaagcaguugagcuaucccugagucaggaaugcuucacaaaugagugccuauguaaauagucaguccuucagcaacuagauuucaaggcauccucugcugucagaucucuccuccacucccaccggaauugcugagacugaagccccuaccuuaccucuauaaggcugauucccugaguacuacuauaggagcuacccagagauugaaaccacuauuccuuucuccuuacuccuaccaguuuuagaaagauuuaacccucaagacuuaauaaacugauccaggaauccauuauuuuaaauaguauuucaauggaaaaauguauuuagaguuucacaguaucaauuuagaaaugaacuuuuucuuucucaguaacuaguauaauuuucaaccuguuugcucaggccaagauucuaagcaucauccaaauguccucuuuuucucauaucccacguguaauccaucagcaaagucauguggucucuugugagaaucugaccccucaccaucuucacugccauaucccucaucucuggccaggacggcuacaggagccuccugacuggucucuuuauaauccauuuucuacauagcaacuucagucauaaguaaucagaucaagucacucccaugcuuaaaaccuuucaauggcuucccauugcaaucaauaaaaucuagcuccugcccauggcauucuaggcuacauaaucugguccuugccuaucuuucugauuucauauuccucuuccguucccauuauucacucugcucuagccauacuggcccauuuucucucuucuagaaaggacaaguucaaccuuguuucauucugcuuugaucauucuugcccuaguuaugggucucaacucauauguuaccucuucagagggggcuuuccuggaccuucuaauaaaguauugcuuugccccuacuuagucauucuugcugugcucuaguuuugcuuuuuucuuaauaguacuuaaucccauuugaaauuaucugauuuguuuauauauuuauugauuuuuuuccuccuacuguaauguagacauuaauuuucaguuauguccuaauuccccaaauuucagaauaucuuuagacuacuggcagggggugguaguuacuauaagaaaagauaauguuuuaaaauuguuauaaaguauuuaaauugucuugaaguuauaaauuauguuuuauuagcaaacaguaucuuguguugaaaugacaaaggcuggauauuagauaagaauaauucaaccugaaaaagcugauaaggaaaaaaaaggaacuggcuagaaccaaccuuuagaaaucugcguuaggcugacaaucacaaccucugagaagucuuauaacauuaaucauuauuauuuuguccauuuuuuaauguggguuuuagauuauugugauacguaagaugugauugcaguugccagaugccaggcaugcuaacacuucugcuucuguuugguuauuuuucaggguacagcucgcagaaagaagaaggugguacauagaacagccacagcugaugacaaaaagcuucagaguucucuaaaaaaacuggcugugaauaauauagcugguauugaagagguaugaucacuuugcaaguuguuaaauuguguggguacaugcacaaauaauugucuggaccuuucagauguaaaauaucagcuuagaaaaaucuuugauauugucacucugaugucuuugaaggacuguggcacuuugauuuuuguaugaaauuaaaugauggucaaaaaaauaauuuuaguagacaguuaaggauuuucaucauacuuuucaagcucaagauauuugcguauauggcaaaauuauguaaguguucuugaauauuaauauaaaauaugucucuaauaauguagaaauaaaccccaacauuuccucagaugagauagaccuuuuuuuuuuuuuuuugagauggagucucacucugucacccuagcuggaaugcaauggcacgaucuuggcucacugcaaccucugccucccggguucagacgguucuccugccucagccucccaaguagcugggacuacaggugcgugccaccaugcccggcugauuuuuguguuuuuaguagagacgggguuucaccaugcuggccaggcuggucccaaacuccugaccucagaugauccgccugccucggccucccaaagugcugggauuacaggugugaaccaccgcgcccggccagacuuuuuuuuauuauuuaagauuuuggacucauggcucaauagagguagacuuuuuuacccuaaugcaccuguauauuuuacagagccucauuaguuacuaccucagccaaaaggcuuuagcaguagcuuuacauggguuagauuucuuauuaaaacuguuucaaaaauuguuuaaaauguauuagucagccgggugcaguggcucacgccuguaaucucagcacuuugagaggccuaggcaggcagaucaucugaggucaggaguucaagagcagccuggccaacauggugaaacccugucucuacuaaaaauacaaaaauuagcuagcugugguggcacaugccuguaaucccagcuacucgggaggcuaaggcaaaagaaucacuugaacccaggaggcggagguuacggugagccaagauugugccauugcacuccagccugggugacagagugagcauccgucucaaaaaaaaaaauuguaugucaguuuauuguauuuugaugacacuauuuuucucaaauaugagaccaaagauuaauguuauuccagaagauacuuaauaaauaacaacaacuacuugugauguuaccaccuagaugcaccucugccugaugauuccauuuguuuuuuuguuuuuuaagacagaaucucacucugucacccaggcuagagugcaguggugugaucucugcucacugcaacaucugccuucugggcucaagaaauuucugccucagucuccagaguagcugggauuacaggcgcccaccaccacacccggauaauuuuuuuuuuuuuuuguauuuuuaguagagacaguguuuugcuguguuggccaggcugguuucaaacuccugaccucaaauaaucugcccaccuuggccucccaaagugcugggauuacaggcgugagccacugcacccagccaguuccaucugugaugguaaccaaaguuuacgcuuuuacugccauaaguuaaauuuaaccggccgggugcgguggcucacaccuguaaucccagcacuuugggaggccgaggcggguggaucacgaggucaggggaucgagaccauccuggcuaacacggugaaaccccgucucuacuaaaaauuaaaaaaaaaauuagccgggcaugguggcgggcaccuguagucccagcuacucgggaggcugaggcaggagaauggagugaacccaggauggggagcuugcagugagccgagaccacgccacuguacuccagucugggcaacagagcgagacuccaucucaaaaaaaaaaauuuaaucauuacuguguuugguaucaccucacaauuuuaaauaggugacuaauguacaugugcuauaaaacaagaaucagaaauaauguggagguaggggcugggcgcaguggcucacacuuguaaucccagcacuuugggaggccaaggugggcagaucuucugaggucaggaguuugagaccagccuggccaacauggugagacccgucucuacuaaauauacaaaaauuagccaggcaugguagugcgugccuguaaucccagcuauuugggaggcugaggcaggagaauggcuugaacccaggaggcagagguuugcagugagcagagaucaugugagacucugucugaaaaaaaauaauaauaauguggauagagaucauuaauaaagaaauagcagaguuaaauggcaaagaaaagguaguggaauggcaaagugccacauguuccuuccaccuugcauauauaaaugaauaaaauuaacacaucauuuaaaucugcuuuguacauugaaaaucaguguacugauaaaauaguagaaaauguaagccacaugcaucuuuuuccuuucagcuugaugugacugugccuuguuacucugagauacagauuagagcuucauuuguaagaccugaaauuauauuuagagauuauuuuuucugaguuauugaaagcuuuuauauauuuucauggaccucaaauauuuuagagaccguucucuuaaucuuagauacauauuagaaaaaacaaaucuaaguccuuucaaaccucuuuuuaaaaaucuaaaacuugguaaaaaugaauaaguugcaauaauacacaugaauucugauaauauuaaaccuaaccuacuuguaaauguuuaugcaauuuuauaucuuugccuaccuuucuacccuucaacuccucugccccccaaccucagcccuguugacauuuugaacucgauaauucuuugcugugagagcuguccugugcauuacaggauauuuagcagcaucccuggccuucacccacuaggugcugguaacagaccuauacuccuaguuguggcaaucaaaaauaucucuagagauugccauguauacguaccuugcaggcaaagggcaggcacccuuagcugagaaacacuucuuuagagaggaaaaaaaauuauaccuuccuugcaguauagauuuaacuguguaauaucuccaaggacauguuuuucuaaaguuuuuguucagauuuggaagacuuuaugccucucauaauuaguaaaacuuuuaguguaggggcagcauugauuuuauaaguguuuuacauugaaauaaggaaccaguuaguaauuuuugaucucuucagaauauaaucaaaccuauaauacugugccgaggucaugguguugcuguaauugaaaucaucauaacaaaguacuuaaugauagucaacguuuauuaaacaucugcgugcuaagcauuuugccaaggacuuacuggacagugguacaagauauucugcauggccucugucuuuuguagcuuacgaucuggugaggagacuaauuagacaacuagacaaaucaauauguauuauaucguaccauuucagcuucacaauaucccuuugaguugguuguuguugguuacagaugagagagcugaggcuuagagaguuaggugccuaccuaagaucacguagccuaguaagugcuagaauuccagguuugaacuaaggugugucaaaaccagaguucauaguauucauuaauuuauccugcuuuugcuguuuucauuuauacuugauuauacucauucuuggccuuuuaauuuccuccugucccuccucccccaccaaaaaaaagggaagguaagagguucaccugccuuauauagguacugagcaccuaccaugcagaauucguuccuuaaaccauuauagaaaagaaauccccaucaguauuuccaaggacauugcuguuucuccuuuuucaggucuuaauauaggcauuauuuccucccagaagccuuccugguagcaccuguacagcauuugugcagagaaggguuaggugccuuucguguaugccuccacaaugcccuguaucugcuuuuuauuauagcacuuauuaaauuauauugugaauucuuuuuuguuaauauugccacugcaauuuuuuugaguaguuaauacaccucacaacaucacgcagagaauuaaugccacauaauagauauguggcauguguguacacuauagcagcuucucugcccuccccccauccugguguugucuucuaacccucacaggauaguuguacagggaaaacguacaaaguaauaauacaagguggcaaccauaaaauuucugaauauuugaaccgaagauggagaggaguuuuacuuuuuguucuucuuucccucuuucuaaaauugauuuuuugagaaccaagauauuuguuacuuuauauaacccuuaacaaaucugaaauauuccucuuugggaacaucuaguauacuauauauaaccuggcuugcucauacacuuggguuaaaaacagcuucuugagaaggaaaaaagaagcuauugcauuaaauguauacaugaaaauauagauaugauuuucagaaacacucagauaugaacauauauauaugucagaguagggaacacauuaauuaaaacuuuguuauuuuuacuuugggauguuuaaaacuuguuacaaagugugaacucaggaauaugcugccuuuuugaguuuuggcaguuuaaagcagauaaaaacuuuugagaagaaaagacacuuuuugccauuauugugaaacaauaugauaguacuuucugugcuuagaccuucaaaacaugaaaaaguagaaagugcucaguuuagggagugaggaacagggagagcaguaguggaucucaaaauucauugaaugcacuuaggccaaguaaaguguuucuccauaccccuaauuuucuacugucaguacugaaugucacuaacauuaguacuauccaagcuaucaguauuugugauuuuuuuucccccuuccagagcuuaauugguguccucuucagaaacuuuaaaaacuaagguugggugcgguggcucacuccuguaaucguagcacuuugggaggccaaagcagguggaucaccugaggucaggaguucaagaccagccuggccaacaugguacaacacugucucuacuaaaaauacagaaauuagcugagugugguggugcaugccuguaauccuagcuacucaggaggcugagguaggagaaucgcuugaaccugggaagcagagguugcagugagcugaaaucgugccauugcacucuagccugggcgacagagcaagacugucuaaaaaaaaaaaaaaacuaaaagacuauuuggaauaagacaagcuucucugaccuucuuugguucauugauuugguauaauaguucauugguauaauaguucauuugguauaauaguucauuugguauaauaguucauugauuugguauaauaaauuauauauagguuuguuuguuuguuuuuaauguuaccaaacaaagaaaaauccaaggcugucagaaacuaaaggauaggacuucaggaggcugaggcaggggaaucgcuugaacccuggaggcagagguuucagugagcccagaucaugccacugcacuccagccuggugacagagcaagacuccaucucaaaaaaaaaaaaaacaaaacuaagggaugagggguuucagagacaguuucauacaaaggucaaauaaauaaccagcuuuuuuuuuuuuuuuuugguggggggauggucucacuguguuacucaggcuggagugcaguggcacagucuuggcucacugcaaccuacugccuccuggguucaagcaauucucaugccucagccuccugaguggcugggauuauaggcgcaccaccacaucuggcuaauuuuuauauuuuuaguagagacgggguuucaccacauuggccaggcucgucucaaacuccugaccucagaaguuccaccugccuuggccucccaaaguccugggaggauuacaggugugagccacugcgccuggccaauaaccagcuuuuugaaaggaauucuuaggcagacuuacagaguaucauccagaaccaaauuucugaaaauguuuuauguucuguaacauuugaaaauauuugaaugugcuuguuauuugguaaucuaguugaauguagugacugugcugucaccuuuucuuccccaauugcaugaauccauugacaaaaggaucuguuuuauuucucagaaacaacagauuuuuuccaguuuauuugguaagaaguguaaccaaaaagcacuuuccgauucagaugcccuaauuguuccaaguugcuucauagaguuuuauaauaauauucagaggacagcuucugucuuaaucaggguauaauucagccuccaugaaacccuuccugucuuuccagguauagucaacccuuucucuguacuuuuacugcuguuagccuaaguugcucuucuauaauauguuuuucgcuaucucauaucgugguguauaaugguaacuuauuaauccaguagucuguuuucaguagcuuauaaagagucuugacggcugggaacauguuuauucguuguuucuaguuuauagcaugcugauucucugugaugaguuugcuuagaaccuauuaaauuuaagagguacugauuauuccaggugggauuguucugcaguaaguuagcuauagggagcuagggcuuagagaaagcuuaaggcugggaauauaaauuuuguaauuggacacauaaguuuuacuuuuuacauuuuccucuuccugguucuuguuuuuucugaaccaguuguacagaaagaggaccuaaaguuaauggcgggcucuuccugcaguuccuucuuccuccagcuagagccucaggugcccauagauagacagcucugaguacacgagaguaaaagggaagcaccauguccuauucacuuuaccauuccauagcauccuucuuucucucuuaggguccuguucuuuuggcuuuuuguuuuguuuuuuacucuguguguguguguguguguguguguguguguguguguguguguagauauaucuauauauauaucacaaaauuugccauuuuagccaggguuuuuuuuuguuuuuuuuuuuugguuuuuuguuuguuuuuuguuguuguuuugaggugcagucucgcucuuuugcccaggcuggagugcaguggugcgaucucggcucacugcaagcuccgccuccuguguucacaccauucuccugccucagccucccgaguagcugggacuacaggcgcccgccaccacgccuggcuaauuuuuuguauuuuuaguagagaugggguuucaccauguuagccaggauggucuugaucugcugaccucaugauccgccugccuuggccucccaagugcuggauuacaggcaugagccaccgcgccuggccagcuguuuuuaacuauacaauucauuggcauacaucacaauguuggccaaacaucacuacuguucaucucuagaacuuuuuucauuucccucaacugaaacuugauacccauuaaacaauaacuccuuauuccccucuaccccagcccuugguaaccgccaaucuacuuucuauuuuauggauugccuauucuagauguuucauaugaauagaaucaugcaguauuuguccuuuugugccuggaggccugaaaacacucacuuaacuuaguguuuucaggguucaucgaggucauaguguaucagaacuucacggauuuauagcugaauaauauuccauuguaugcguauaccacauuuuauccauccuuauuggcauguuuuguauuuaaaaagcuuucuuccccucaacauaaaaauauauugccggaugagugcagugguucacacuuguaauccuagcacuuugggaggcugagguggucgcaucacgaggucaggaguucauaaccagccuggccaacauggugaaaccccaucucugcaaaaauacaaaaauuagccacgugugguggcgugcgccuguaaucccagcuacucaggaggcuaaggcagaagaaucguuugaaccugggaggcggagguugcagugagccaagaucgugccauugcacuccagccugagcaacagagcaagacucugucucaaaaaaagaaaaaaauuggcugggcgugguggugcacgccuguaaucccagcuacucaggaggcugaggcaggagaauuggcugggcaugguggugcacaccuguaauccuagcuacucagaaggcugaggcaggagaauugccugaaccugggaggcagagguugcagugagcugaggccaugccauugcacuccaaccucggcaacaagagugaaacuccgucucaaaaaaaaauauguaucuguauaucuauauagauaauagauauugccacuguaggaaaucaggaauauagagaaaaugucaagaagacaauauucaaccauaaucccuaccacccagagagagcuacuauuagucuuguauuuaaucuuucccaucuuuauguacacuauauauaugcacuauauauaugcacuauauauaugcuacauacacacacacacacacacacacacacacacacacacauaugauuacagcuagauguacaauuuagaauucuuuuuuuuggcaggugcaaugacucaugccuguaauuccaacacuuugagaggcugagguggaaggauugcuugaggccaggaguuugagaccagccuagguaacaucgugagaugcugucucuacaaaaaaaaaaaaaaaaaaaaaaaaaaaaggccaggcuggguggcucaagccuguaaucccaguacuuugcgaggccaaggcagguggaucaugaggucaggaguucaagaccagcuuggccgagauggugaaaccccgucucuacuaaaaauacaaaaauuagccgggcgugguggugggcgucuguaaucccagcuacucagggggcugaggcagagaauugcuugaacccaggaggcggagguugcagugaacugagaucgugucacugcacugcagccugggcaacaaagcaagacuccaucucaaaaaaagaaaaaaauguaauucgcugggcaugauggugcaugccugugaucccagcuacucagagggugaggcaggaggauacuuugagcccaggaguucuaggcugcagugagcugugaucucaccacugcacuuccagccugggugacagagcaagaccuuguuuuuuuuuguuuguuuuguuugguuugguuuuuuuuguuuguuuuuuguuuuuugagauagagucucacucuaugcccaggcuggagugcaguggcacagucuuggcucacugcaaccucugcuucccagguucaagcgauucucgugccucaaacucccaaguaguagccgggauuacaggugugugccaccacaaccagcuaauuuuuuuuuuuuuuggaggcaguuucacucuuauugccuaggcuggagugcgguggggcaaucucggcucaacacaaccuuggccucccagguucaagcgauucuccugccucagccucccgaguagcugggacuacaggcaugcaccaccaugcccggcuaauuuuguauuuuuaguagagacggguuucuccauguuggucaggcuggucuugaacuccugaccucaggugauccaccugccucggccucccaaagugcuaggauuacagguguaagccaccacacccagccccauacccagcuaauuuuugaauuuuuaguagagauggguuuucacuguuuuggccaggcuggucuugaacuccugaccucaggugauccaccugccucagcuucccaaagugcugagauuacaggcaugagccacugcguccggcuuguuuuuguuuuaaaagaaucauuuuuacuuuuuuaauuuuuaaauuuuuuauuuugaaacaaggucucacucugucacccaggcugagagauuccaucaccaugccuggcuacuuuuuagaauuauuuguagagaugaggucucccuauguugcccaggcuggucuugaacucuuggccucaagcaguccucccaccucugccucccaaggugcuaggauuacgggcaugagccaccacacccggccaauaaucauuuuuuaaaauagcauuauauuauaaaaauuguuuuaugucauuaaaaaaacuccuuuuaaucauguguagguaucuacauacauuccaguauauggauauacuguacuguaauuuaacacuuuuuaauuauuuauuauacauuauaauguuuugauaauaaaagaaucaugugaugaacuuuucuauauauaaauauaucucucugggccgggcgcgguggcucacgccuguaaucccagcacuuugggaggaucacgaggucuggccaacauggugaaaccccaucucuacaaaaauacaaaaauuagccgggcgugguggcacgcuccuguagccccagcuacucucaggaggcugaggcaagagaauugcuugaacccaagaggcagagguugcagugggccgagaucgcaccacuacacuacagccugcugggcaacagagugagacuacgucuaaaaaaaaaaaaaaaccauauauauaaaauaauaaauaaaauauauuuuaaaauauauauuauauauaaauuauaguaauuauauauuauauguaaauaaauauuuuauauauuuguauauaauaaaauauauguauauuuuuauauauauaaaucugaguucuuucaacucucuuguugcccaggcugaagugcgguggcgcgaucuuggcuaacugcaacccccaccuccuggguucaagugauuauccugccucagccuccugaguagcugggauuacaggcaggcgccaccacacccagcuaauuuuuuguauuuuuaguagagacgggguuuuaucauguuggccaggcuggccuugaacuccugaccucaggugauccacccgccucagccucccgaagcguagggauuacaggagugagccacugugcucggccucuguagauucuugaaaguguaguuacuggcugaaagagccaugaacauuuuuagaacucuucaugcauuuugucaaauugcuuuucagaaagaauaugccaguucacacuaccugcagcauauauaaagagaauuccuagcugggcacgggaauucuuuuuuguacuuuuagugguggcguaugccuguaaucccaacuacuugggaggcugaggugggagaauugcuugaacccaggaggugcagguugcguugagcagagauagcaccacugcauuccagccugggugacagagcgagacucagucucaaaaaaaagaaagaaaaaggcugggcgcaguggcucacaccuguaauccgagcacuuugggaggcugaggcgggcagaucacgaugucaggaguucgagacuagccugaccaauauggugaaaccccaucucuacuaaaaauacaaaaauuagcuaggcguggugguggcgcgugacucuaaucccagauacucaggaggcugaggcaggagaaucgcuugaacccgugaggcggaggucgcagugagccggagguugcagugagccgagaucgcaccacugcacuccagccugggugacagagcgagauucugucucaaaaaaaaaaaaaaaaauuccugucuugucagacuugucaccagagaauaagacaaagugaucccagcauauguuauagacuaaugauagcguaagcuuuagcuuaauaauagccauuagaaauaagcagaugcugagcuagaauugaaugugaaggauacugacugauuuauaagagcgugugcaaagcccauuauccucaaaaucucacauucuucagucucacaacaccccagacgcuuaugugccuuauucuuaagaagucuguuguuuuacccuauuaagcuguaagaagaggcuagguguggugacuuguguuuguaaucccagcacuuugggaagccaaggcaggaggaucacuuagggccgagaguucaagaccagcuugaguaaaaugacaccgugucucuaaagaaaauaaaaaauuagccaggcaugguggcacaugccuguaguccuaccaaccuaggaggcugaggcagaaggaucccuugagcccaggaguuugaggcugcagugagcugcuauuaucaagccacuguacuccagccugggagacagaaugagacccugucucuuaaaagguauaggaagaagucaguaaaagaugaauuuucugguaaacauuuaagugccauuacauguaggauggaguaggcaacugcuggcugggcgcgguagcuccuaccuguaaucacaacacuuugggaguccaaggugggugggucaccugaggucaggaguuugagaccagccuggccaacauggcgaaaccccaucuguacuaaaaauauaaaaauuagcugggcguggugucacaugccuguaaucccagcuacuugggaggaugaggcaguggaaucacuugaacucgggaagcagauguugcagugagcagagguugaagugagccgagauugcgccauugcacucuaacuugggugacagagcgagacuccaucucaaaaagaaaaaaagagacaacugcuaauucucuuuuaucauucucaguuggauucaaaaaaagucacaaagaagaauucaagccuccaugaacugagagggcaguuauuagcaagagcuauggagucaaauauaauuuugugagccuccucuagccacaaaaauguacugcaguauaggaacaaagugagcaucaaauuuaccagguaggaggcuacuaugacuaacuuacauacccuaugcagagcccagcaaagguagggauuguuaagguguuugauagcagcauaaaagggccacccagcaguugccaaagagugacuuaaaaugccccuaauucuggaggguagguugggcugauucugaaaggucaaaacuauaggaaaagucaggcuaaagauacagcccaggagauucugggcaucuucguuggaggcacugcuggugcuauauuuaaaccuuaaugugacccaucaucuagcauuuggggaguuggucugacaauauccuuuuuuuuccuuuuuuaagacagggucucgcucugucacccagguuggaaugcaguggugugaucacagccucgaccuccuaggcucagcaauccucccaccucagccuccugaguagcuaagacuauagacauguaccaccaugccaccuggauugcuuuugcuuuuuuuuuuuuuugguagugaugggguucucgcuguguuguccaggcaucuugaacuccuggauuuaagcgcgccuccugccucaguuucccuaagugcugggauuacagacaugagccaccaugcccagccaugauuuuagaauaaauuguauaggagguauccauucauucauucagcagauuugagugauuauuauguacuagauauugggggaaauacuaugucgaauaaggcauggucucugaucuuaagaaauuaaccuucuaguauggucagugauuuacaaaugcaauuauacuacaagacaauucuguauaauagcaguaagugcauaaaccaccuuaaguuuucacagagaaagaagcaucuuaccucaaucuuggauaaaugggaaugugcaagauggagaaguaggaaaugguucuucuaaacagugaaaacagcauauauaaauacacuaggaaugagaggacaaaguuuacugcuaacuacuauacacaucaguauuaaagcaaaaaaugagagcaagggcauucugugguuuggacuggggucucaaaaugccucuuucuccuuagcucaaguggcauccuuuaccuucagcuaucuuuagggaaaaaaaaacaaauuuugaccuaaaggggauguuugguugaaaaagagaccucagugcugguauaguugcuaauuuaauaguccuuuuuauuuggcugcuccuuguucuuauauuguacauauauuauauggcuuacucaaaccacacaguauaaaaucacugaaagaagugaagucucgauauuaaaugcauauaauuugcuuuaugacuuuaacaaguuccuuaucccuucuuuuacccaaaaugguaggagaggugucuaacuggucuuguucagccaaacaauucaucguuugauaguuuauaauagcucgugcccagaagcuuuauauaaccaugucauuugcucagaaggaaggaauguuagaaauaaaauaauuugaauuagucgggcaugguggcacacaccuguaaucccagcuacuugggaggcugaggcaggagaaucgcuugaauccgagaggaggaguugcagugagcagaggucacaucacugcacuccagccugggcaacaaagugagacuccaucucaaaaaaaaaaaaaaaagaaagaaaauauucuagcuguuuuaccuucuaguauuucucuauauucuaaaauuaacuaaacucuccaucccuuucuggaccuuucuauuccugaagcugcaucuuuuagaccacuccauuuaaaacagccaugaauaaauuuauuuauguuucacaaucugagauggaauucaucuugcuuuucacacuaaacucaagcauauuucaaacuagaaagaccuauauaucaggguguaaaauauaacaacauuuagccuucagaagagaaacuugaacauaagaaaaaacuccaugaguuuguuuauuguuuuuggcuccauguuagccucuuguuuuguagccaauaagauacauuuuaucuauauaccuguguuguuuuucuuuuguguucucgauuuggccuauauccugaaauaaaucauucucugacaagcucucaugaggccauggaauuuucuuuuucuuuucuuuucuuuuuuuuuuuuuuuuugagacagggucucgcucugucgcccaggcuagagugcaauggcaugaucugagcucacugcaaccucuuccucccggguucaagcgauucuccugccucagccucccaaguagcugggauuacaggcacccaccaccacacccagaugauuuuuguauuuuuaguagagaugggguuucacuauguuagccagacugguugugaacuccugaucucaggugauccacccgccucagccucccaaagugcuggaauuacaggcaugagcacccagcugaauugaauuuuuguaggcaaauaagcguuuuaaguaugagaaugauuuaguaggaaggaaacaagaacaaguugggaaacccagguuaaaguccucgguuugcacuuaacaagcuauuuguccuuggguauguugcuaacaaagagcuuuugucuucaguguuuauuucuuuaacauaaaggauuugaacuggaagacuucuaaguucaacaaauauauagccugaauuuuuugaacaauauugauuucagauuucuugugacuuuaaugucuguaaauaaaaaaaaagucucagauuccaauauuugagacucugcacccagaagcauuuuagaaaucuuugguuuuuuggguuuuuuuuuuuuuuuuuuuuuuuuuuuuuuuugagacggagucugacucuguugcccaggccagagugcaauggugcgauuucggcuuacugcaaccuaugucucccagguucaagcaauucuccugccucagccuccugaguagcugggguuauaggugccugccaccaugucugucuaauuuuuguauuuuuaguagagacaguguuucaccaugcuggccagacuggucucgaacuccugaucucaggcaguccaccagccucggccucccagagugcugggauaacaggcgugagccacugcgcucggccuucuuuuuuuuuuuuuuuuuuuuuucugagaaagucucacucgguagccaggcuggaaugcaguggcacaaucucagcucacugcaaccucugacucccugguucaagugauucuccugucucagccucccaaguagcugggauuacaggcacaugccaccacacccagcuaauuuuuguauuuuuaguagagaaaggguuucaccauguuggccaggauggucucuauuuccugaccucgugauccacccgccucagccucccaaaguguugggauuacaggccugagccaccgcgccugcccuauucuuuuauuuuuuugagaaagagcuucacucuugucgcccaggcuggagugaaguggugcgaucucaccuuacugcaaccuccgacuccuggguucaagccacuucugccucagccuccgaguagcugggauuacaggcacccaccaccaugccuggcuauuuuuguauuuuuaguagagaugggguuucaccauguuggccaagcugauucugaacucuugaucugcccaccuuggccucccaaagugcuaggauuacaagugugagccaccgcaccuggccugaaauccucuuuuaaaccacgugauuuggucuugauuugaaaaauauaguccuaccauaucuuuuguucuuuucccauucuaaaauuaugugauucuaggcuaaaugcagagcaacaucccauuucacauccacugucauccuucucgagcccagauuucacccacuuuaacauuuaacuuuuuaacaaaacuguaauuaucuucaaaacuauauaauuuaucuuuucugaaguuaacauaacucacagugcuguguuuuuagaacagcuggguugaaugcuugugugugauauaauuaauagaacccuaaguguaauagugagagagggaaggguauagaauuuaaauagugauuuuugucagaaaaaccuggggaaauuauuuguggguuuaguuacaauuuuccagggauuugccuuuauuuucucuguguuccaggucuugccugaaauuuagaagccccuuucuugcccuuccuuucuggugcuaucaauggugguaaucaccucugaggaagaaaagcccucuucccacuguccauggagaacacucagcaucuaugcuugauuuugacagggcagauuuuggaugaaucaugaaaugcuucuaaaguagccaagaguuaacucuuccuaaccuuuuuauauaguaagcauguuaccccacaagguaacuuacccaggggaaucaacuacauaguggaaucacguuauucacacauuuaacuuacacaaauucaacucuacugaaaaaaacaugaaguacaugagugagagagaaaaauaacaaucuuaaguagcacauguuaaaccuuccauuucaguaagucccaggcaauggaugaaaucaaaucugaaauaguucauauuggugaaaguuauggaaagaaugugaggaugauuuuuaaagguuuccuaguugauaaagcauguucaggucacuaggugagugggugggacaauuucuuugaccuuuacagggguuauuaaagauuguugagaagcuacccuuaagaauuagaggaacuggcugggugugguggcucaugccuguaauccuagcaccaugagaggcugaggugggcagaucaccugaggucaggaguucgagaccagccuggccaacauggugaaaccccaucuguacuaaaaauacaaaaauuagcugggcauaguggcaugugccucucaucucagcuaccagguugggaggcugagggaggagaaugguuagaaccugggaggcagaggcugcagugaaccgaggucaugccacugcacucuagccuggaugacacagcgagauucugucucaaaaaaaaaaaaaaaauuagaagaacuagcaaaaucccuuacaaagaauggcaugauuagaacaaguugaaauuuuuauaaauguacuaagugcuugaaggaaugaaacaccugguuacguuucugaguguucuuuauggauuuuuagugguuguuuuuaccauauacuauuuccccuuuguaaccaguccccuaaguaagaugcuacccugccaaguggaaauugcacugauuuuguuugacaguauaaauugaguaagauaaugaguaauuucauuaagaagcugguuuuuggcugauacuuccauuuuuuaaaaaaacauggucauguacuuccuucucuuagaagucuuugaauuuaaaaucuagauucuauaaugaauugaauauuucuuguccauccuaguaauuugugccaucuacaccauuuuacuuuauuacuaugaucuuuuuccacgaauguccguugcuuggccaguuacuaccuugggauuacauaacuaccaaguaaagaaccauaauuggcugaauugcuuuuuaaaaauauauuguuuuaguguaccuagcaugugaaguacauuuuucuucugugaucauacaggugaacaugauuaaagaugaugggacaguuauucauuucaacaaucccaaaguccaagcuucccuuucugcuaauaccuuugcaauuacuggucaugcagaagccaaaccaaucacagaaaugcuuccuggaauauuaagucagcuuggugcugacaguuuaacaagccuuaggaaguuagcugaacaguucccacggcaagguagguauuucaauuuaguaaaucuuucucuccccaccuuacuuaaagaaccuaaucauuuaaaaggugucccaucuuaauuuggauuugccuguauguaauuauuuuacuuucuauaaaguuauuucuaugcuucauaaaauuuugaguuuguuuaaugauuauguagugugacauauagaauauucagaaacauggcugggcgugguggcucaugccuguauucucagcacuuugggaggccgagacgggcagauugccugaggucaggaguucgagaccagccugaccgacauggugaaaccucgucuguacuaaaaauacaaaaauuagccaggcaugguagcaggcgccuauaaucccagcuacucgggaggcugaggcaggagaauugcuugaacccgggaggcagagguugcagugagcugagaucaugccauugcacucuagccugggcaacaagagggaaacuccgucucaaaaaaaaaaaaaaagaauauucggaaacauuuugguaguaauaauaguaaguugagaaguaauuaccuaaaaggguagugcccagaucuucaggccauaauuuuauuuuauuuuauuucauuuuauuuauuuuugagacauaaagucuugcucugucucccaggcugaagugcaguggugcgaucucaggucacaacaaccuccaccuuguggauucaagcaauuuucaugccucagccucccgaguagcagggacuacagguggugugcaccacugcacccaguuaauuuuuguauuuuuaguauacacaggguuucgccaugguggccaggcuggucuugagcuccuggccucaagugauccaccuaccuaccgccucccaaugugcuaggauuacaggcgugagcuaccaugcuuggcccaucauuuuaaauaguuaauuugauauucacugcuaauuaaugacaaucagaaaauacuguuauauggcugggcgcaguggcucacuccuguaauaccagcacuuugugaugcugaggagggaguauuucuugaggccaggagcucaagaccagccugggcaacauggugagacccuaucuguacaaaaaauacaaaaauuagccaggugugauagcacgugccuguagucauagcuacucaggaggcugaugcaggaggaucacuugagcccaggacuucaagucugcagugagcuauggaaagccacuguacuucaaccugggugacagaggggggagacccugucucuaaaaaaaaaaaaagaaaaaagaaaauaauguugucagacaucuauguuuuuguuaaauauugauugcccuauaaauguggcaaccguaaguucugaauuuccaagauaguccugguuucaaaugugucauguugccccuaaaaaugaaaaaaucuaguauuguagugcccauacuaccuagcuagauacuuucuuacaccaaaagaaaugaaaaaaaucuuuuuuuuuuuuuuuuuuuuuuuuugagacagagucuugcucuguugcccaggcuggagugcaguggcaugaucuuggcucacugcaaccuccaccugccggguacaagcaauuaucugccucagccucccaaguuagcugggauuacaggcgcccgccacugcgccuggcuaauuuuuauauuuuuaguagagacaggguuucaccgucuuggcccggcuggucuuaaacuccugaccucgugauccaccugccucagccucccaaagugcugggauuacaagcaugagccacugugcccagcuuuguuguuguuguuguuguuguuguugcuugguuuuuuuuguuuguuuguuuuuuuguuuuguuuuuuuuuugagacagagucugacucugucgcccaggauggagugcaguggauuacaggugugaaccaccauaccuggcugaaaaaaaccuuaauauuaauuuuuuauuuggagaauauggccacuguaaagucuuuuuacucagugaucaguuauuccacuuugcauauaaauuuuaucuuuguaggccgugugugguggcuuaugucgguaaucccagcacuuugggaggccaaggcagguggaucccuugaggucaggaguucgagaccagccuggccaacauggugaaaccccaucucuacuaaaaauacaaaaauuagcuggguauggugguguuugccuguaaucucagcuacuugggaggcagggagaauugcuugaacuugggagguggagacuguagugagccaagaucgcaucacuacacuccagccuggucaacagagugagacccugucucaaaaaaugaauaaauaaaaauaaauaaaauaaauuucaucuuugucacacauggaaauugccagcuguguuaucaguguauuaacugauuaaaguuuuauuuuuaauguuacucaagcaaaaaauaugaauggcauuuuagauugacaauauuuagcuauuucugagcaacucugugugauuuauacaggaaaaaagggauaaacauuauaaguuuucuuuaaggucuuuguucucaaugacuaauauuaaaauaaacuuuuuguagucuuggacaguaaagcaccaaaaccagaagacauugaugaggaagaugaugauguuccagguaagugacauuuccuuagacuuaagauuuuaagcauccuguuuaucuccuuucagucauugcauagauaacuuuuagguuuguguugauuguaagcucaugaauuuaaauugauucacaauaauguggauaggaucuaaugaaaaacaacguaagcacccaccuuagaaccuagaaucagaaauugucacacaaagcucugcugccuggauuuauuaaauugaaaucacugugauuauaaauuugcauagcuauuguuauaacauuucuguaugaauuauaauugacauaugaaaaugcuauucaccucaguaauuugcauagacaaaagaugaacauuuccuuaggauuacuguccuaagcaaauaauuaaaucauuguuaguaaaaugccaccaguucauuucugccuccuuauguuuucaggcuaauucugguuguacuaauuuuauuuuuucggggguuagaaguuaggaguuccauuuaccucuuuuuccuuuuuuguauucuuugauucauauacuuuguuuuucuuuuucagaucuuguagaaaauuuugaugaggcaucaaagaaugaagcuaacuaaaaguuugguuuuuggaagcuggcauggacuagauuuaacaaaucagcuaugugguuccaaaguuuuacagacauggagaacaucaccuguuacuaguucaguaauauaaauauuuuguauauuaauaaugcuguuuguucagcauuuuucggucauuugauuuugcauuuugcacuuccucccaggauauuuuuuuggucaaaauaugaaguauuggugcaguuugaggguguuuugguuuuugauuccugguuuuuuuguuuuuuguuugggguauuuuugguguauguauguuuauguauguguguggguauguguguauacaguggagagcaaauuggaaaacaguucuauuuauccuccucccuccccaguagaaauaaaaaaaaucuuuacauuuguuacuuuucuuuuccccccguaagacacagaauuaauggaaagugaguaucuuggauuucaaaucugaagagauuuuuaccauuagugguuugauuuuaauuugcuugguuaacuaucauauuuuucauacacuucucuggauuuaaaauaucuugagguauuuugccacuggcuucaugcuggaguaauggguaacauaucuuugguaugguugccuuagauuaacuuaccuagucagacccagaagaacuucuuuuacuagcuugcuuccuaaaugccuuuuuuccucuccuuuuggucuccaaauggccuggucagcuuuugguaauauucuuccucaucuuccaccuagcuugagaaggauguucuccauauagaguuuagcgagugccuaaucccuccuuuuguaagauuuuguucccucagcuugaggaacaacuucaucuucaacuuuuuauuucucccugauguuacaguuugguagauuucaaacuggaauagcuagcaugugcuugcuaaauaauuuuaugccagccuuauccuguauccuagcuguucuuaacagcagguacaaaaaugccuguuuuucagcaagguugaaauugggaauguccuuuugaaucagaagaaaauaggccauagacucaucucccagcacaaaugggcauucuaugaaaugguacuggcccuaggaggauuuccucaaccacucuccuacucuuggccuugaaccuaccucuggguuggaucuuacuauuguagcugcucacuauacccuccugcaugcuuagaauaaugcuuugaggggagcacugguaaaacacaguauuuauuuuuuuaccuccuuuaagaggacuuggagguaaguugcauucauucacucaaguuucccucuugcugucuaauagaagcuuacuuuuugcuauaucagcauuuguuacagccaauauuuaaggacaaaauuuagaaaauauaucauuuccuggcccaucaucaaacuaauacagcuuaaccuugcagcuaccaacuuuugugucaagcuagauaucuuuauuugauaucuaaggugcaagaccaacaauauauuaagagaucuguagacaugaaggcaaagcucuuguauuuuuuuucauccaaacaccucaauuuauuuuauaaauucguucauuuuuccuguuauguuuuauauaauauauggacuaaacaaaauaaaauaacagugcaaaagaggagaauauuuccucuugugcuuuucuugauguuguguacagaauuuccuuuuauauuauuccucuacccuccaccuguaaaugaauguuagugcaguaauuguuugaaauaaugccucauccaguguuaggucaguagcuccacagucuacacaguccagaauucuuucucuaauugucccaaagggggacauuguggaggcagaguuagggggaaccacuucaagugguuagggacagauaaauaauaggcaguauagcacaugaaagaaaacacacacuuggaagccaggagacuuguguccuagucaaaacucuggcauuaugugaccuuggacaggucaucuaacuacucugaaauuuaucaucagucaaauaagauuuuauucuguuuuguuuuguuugagauggggauuugcucuuguuguccaggccgaacugcaauguuguggucucggcugacugcaaccuccaccucccagauucaagcgauucuccugucucagccuccacaguagcugggauuuuuuuuuuuuuuuuuuguauuuuuaguagagaugggguuuuaccauguugcccaggccggucuugaauuccuguccucaggugauucauuugccucggccucccaaagugcuaggauuacaggcgugagccacugcacccagcccaaaugagauguuucuaaaucuaaaguuucuucugcuucugcauuucugugaaucucauuugaaauuuuucagggaagggauuuuaucauuuguucagagaugucuuuauuuuuauuaauacccauaaaacguuuguguauuugcuucuuccucuuucuccuuuugaucacauuuuagcuacuuaucuagaggaucucuggccaaguauucccuuuuauuguauugauaacaauucuuaauggcuggccucucuuguguacaaugagccaauauucuuuuuuguucuauauuuuuguaucuuccccuuuccugaacaaagcauauuuagagucucaaagaaauccucuccacaaagacauguuccucccucugguguggguagacauaggguaagaguuuggaugaaacuuuuguaaauuguaguguucuuggcauaaauaugaauuaaaucuuuuuuuauau

SEQ ID NO: 14051 - RNA, 35274 nt, Homo sapiens
cuacauuuucccgcuccgucccgggaccuggacacccagaauccacgaaaagcaacucgcgcucgagaacagcucucguacccuucuacgugaucugcaccuuuaagcucacuccaucccaaaccggaccccggaggcaccacccacauccgucuaacaucacuuccuucagaguuugaaaaaaaaaaaucugggaaguagagguguugugcugagcggcgcucggcgaacuguguggaccgucugcugggacuccggcccugcguccgcucagccccguggccccgcgcaccuacugccauggagacgcggccucgucucggggccaccuguuugcugggcuucaguuuccugcuccucgucaucucuucugauggacauaaugggcuuggaaagggucagaccgcguucuuaucuucucuuuacugaucuuuacuauacugaucccaguauaaucucuucuugcccuagcaccguuccccucccauucuaacucuuaggccacuccagauuucuuuuuaucuuccccaaccgcuccuggaguuugaagauuucuugggguagagaguagcgggucuggggaauggagaaguuguacuugaggccucucuaaauuauuggauuggggggaaggaauggcccguaaauuaaggaaagcauguuaagagcccagcauagugccuagcacuugggagguccugaggaacggucaccuucccaccugggagaaauagagccguuggggaccugcauaugcagaggacccuguucugggucugaagauuucucucguuacuucuuccgcgaagagcuagguuacugccacuugcuugccuuugggaaacagcaccugcaucccagguagcuguaucuagugcauaagaagagccaagcgaaugguagaaggucugcuguuuaaggguccccaacaauuguccuugcugugguucagcgaaguuuuuuuguaagugagcgaucagugguuaugaauggagguuaggagguguggcccccuacuccauccauuaccuacaucuccauucuaaguuuuaacaccucucuccucaucagcccuuacuuaguugaaaguuggacugacagucugugaacucagaguuuaugcuuuucuaaguagaugaauuguagcauggaucccaaccccucuuccuuuuuuuuuuuucacugaccuuacuguauggaaugauucugcugcaauccuucuguuuuuguuuucucuuauccucucuauuuucacaucuauuggugaguaauaagauugggugggcauucauuuugccugaaugcaaucauuccuucauuccguaaauaauuuuugaucaccuccuauauuucaggcacuguccuaggcacuagggauauagcuguaaacaggacagacaagguuccuacucugguggagcuuauauucaugucagagagacagaguagacucaugaacaaauuaauaagacaguuucaacuaggaacaagugcugggaaaacaauaagacugugauggaauaggaaguagaaaggcuggggagguugguggagcuggcaucacuugaauuaugaaggucaggagaagcuuuuuggagaaggugauauguggguuuccaucucagugaugaaacugcaugacaaauccuguuaggccagaauguuuuaaauacugacaaucccauuuuaaaacagacuaccguuuuuuuuuguuguuguuuuguuuuguuuuuuagacagagucucacacuguugcucgggcuggaguccaguggcaugaucuuggcucacugcaaccuccgccuccuggguucaagcgauucuccugccuuagccucccgaguagcugggauuacaggugccugccaccacgucuggcuaauuuuuuguauuuuuaguagagacgggguuucacuauguuggcaaggcuggucucaaacuccugaccucaugaucugcccgccucggccucccaaagugcugggauuacaggcaugagccacugcgcccagccagcuacuguauauuuaaaguuguaaguacugagaguaacagaagaguagaguguuggguacguggguuuagaucugaguuuuuucuuugcuguuuuuucuguuuguuuguuugcuuuuguuuuugagacggagucucacucugccaggcuggaguggaguggugcaaucucggcuuacugcaacuucugccucccggguucaaaugauucuccugccucagccucccaaguagcugggacuacaggcaugugccacuaugcccagcuaauuuuuuuuuuuuuuguauuuuuuuguauuuuuaguagagauggaguuucaccauguuggccaggcugaucucaaacuccugaccucagguaauccucccuccuuggccucccaaaguauugggauuauaggcgggagccacugcgccaggccuagaucugaguuuuaauuuguucugccacucacuagcugaguagccuugggcaaguuucuuaacucucaaagccuccguuccucaucugcaaaaugggcaucauaacuaccucagacacucaacaaauaauuugcucuguucaaguuacuguguuagguguagguaauaccuuggaaucagguauuuuguauuuuuauuccuuguuagauauuaagcuuugugugguuguuccaguuaccauuguuguguaauaaaucacuccaaaauuuagugggcaugaagaaaucauuuuauuaugcucacaauugugugaguaaggaauucaaacaaggcacacugggaaaggcuugucccuguucuaugaugacuggggccuuggcuaagcugguuaccucuccaugugaucuuuccgcaugggcuccuauggguuuccucacaguagcuuuaugggaggcuggauuccaagagugcgugccauaagagaacaagguggaaaugcauggcauuuuugucaccuagccuuacaaggcacauagcaucacuuccacaguacccuguaggggcagauucaagggaauggaauauuaggacccccacccucacccccaaugggagguauguugaggucacauuguaagaagggcauaucugccacagugaaccaggacuauuucugucuuguucaugcucaggaauauuuguugaaagaggaaaugaaugauaaacaugauaauugugauuccuguccuuuuucagcuugcagucugguaagauaccaagacaaguaagcagacaguuacauggcagcaugauaugugcuuuaagcagagaaauaccagguagcugcaggagcacauagaagggcagcuuagggcaguggggcuggguugggaggauucaaucaaaaaacaaaaggcacuuaauauugugucggacacuuagaaaauauuuaauaaacauuaaccaguauuauuucccccauggaaauaauaauaauaaucccuaaaaggaauuaauacuauuucaaacuuuuguuuuauguaucucuuggguauggauucuugggaaguagauuauaccccacuuacccuaccuuccaaaaaagugcuaccugaggcaaugguugcugaaagucuuaaugagauggauuucuucccagauguuuccggacgauggccuggugguuuacagagaggagagacugaaugaucucuacuguuuucauuaagaagaagcagcacagugauguggacuuagcacuaaauagaaauuagaaggcccaggcugggcacgguggcucaugccuguuaucccagcacuuugggaggcugaggcaggucaaucaccugaggucaggaguucaagaccagccuggccaacauggcgaaaccccaucucuacuaaaaaaaauacaaaaauuagccaggcgugguggcacacgccuguaauccuagcuacucgggaggcugaggcaggagaauugcuugaaccugggaggcggagguugcagugagccaagauagugccacugcacuccagccugggcaacagagugauacucugucucaaaaaaaauaaauaaauaaauuaggaggccuggauuguaauccugaucaggccauuuaguucugguccuacgugacaaccaauuaaucaaugagaaaguuguacuagaaguacuuccuaagaucucuuccagcucuaacguucuauagaguuccaaaauaauuacauuguucuccauggacuaaaaauuuggaguacaucacccauggggagaaguagugaccaauauuuacuguacauuuacuauccuccaggugcuguugugugcauuuuucauguauugacuaagccucauaauaacccuaugagauggacaauguuuuuaucauuauucccacuuaacagaugaaaaaaccucaaaugaggcaaaggaguccaguggacuagcuggaauacaaaucccagagccagugcccuuaaccagcauaccauuccagucucucagugcagaaacuccucuaaaguuuaaaggagaaacuagaaagcugucauugggagugguucuugugcucuucugccugaaacaaaaauggauaacuuugucaagucucuggaauaaaaauuuggcacuaacacauaugaaguguguuuaccucccacacaguguucuacucacauucacaacagccuaugggauacauguuuuuguuagccauaguuugcauuuaugaaaaugguaaguggcugaacaagaauucuaaugcaggucuguuugacugagacaaucaguauuuagccacuauguucuaugucucagguacaguguucccuguuucagaggcuuggcugccagcucugaugcuugaccuuuuguuauuuagguuucaucagcuaggaggggguggauaauacuuuucagaugucuuuagcuuacauucauuaaaacaauuuuuggaugaagggauugaaaauucugauugaaugcuguguuuagaaaugguugcuuuucuuuuuuaaaaaauuaauguuauaggguaagaguugcugaugugggagacuuuacuuugcagauaacuggcauaaauuaaguggcuauacaggugacacuuuaggaaauuggacugccuucagauguuccauguuggcacaggugggaguguuaguggugcuggggaauggauguuuuuaguaacaagguaaacauuguaccuuuuaaacaucuuuuugagagggaaacaaaaggcccaaguuuuccagaucugaaguugguguucccauucugcuuuggugaagcugcauucguuuguucauuuaauguuugcuagagagacaguaaaguguagugaaugguuguuaacuacagacccuggaacccaaccaccuagauucuagucccagcucugccacuuaguggcaacauaaccuugggcaagcuguuucaguucagcuuccuuauuuauaaagggauaauuagaguuucuaccucauaaaguuguugugaagauuaaauaaguuaacacauauaaaagcauuuaaguaccuggcacauaauaaauuucauguguuagucauuaauauuguuacuauaauauaauuauuacauaaaauaagcacuuaggcugggugcaguggcucacgccuauaauccuagcaguuugggaggccaaggcgggcagauugcuugaggccaggaguucaaaaccagcaugggcaacauagcaagauccuaucucuaccaaaaaaaaaaaaaugcaauugcuuaauaaguggugguggugauuauuacuauuauaaaaaauuccaauguaaauuuuaauaugaauucucaaggaaauuuuguacaugcaguagacuauuuuguuguuguuguugagacagucuugcucuguugccuaggcuggagugcagugacgcaaucucagcucacugcaaccuuccccuccuggguucaagcgauucucuugccucagccucccaaguaguugggauuacaggcaccugccaccaugccuggcuaauuuuuguagaguagagacgggguuucacuguguugaucaggcuggucucaaacuccugaccuugugauccacccgccucagccucccaaaggcuugagccaccacgcccagccacaguggacuauuuucacguuauaccucuagacuuacucuagggauauugcagcagaacagcuugggaaguacugggguauuagaaaagaaugcuaauuaggagucaggagacuuaaauuuugguuguggucuaccuuggaguguuggauaacuucuuuucuaggccucaguaaaauaagaggguuagacuaaaucucuaguguugugacucuuuaaauuuauuaaaguuaaauaaaaguaaaaguugagcucagcuggauugucuacauuucaauuguucuguagccacauguggcuagugacuaccauauugaacagcucauugcaguaaguucuacuuuacagugcuguucuaggucucuauuaguaauaaccuuacgugauuguaagguuugacaccuagcuucugaguggccuagguacauggagaauuuauuuuaauuaauuaauuaauuauuauuuuuuugagacagagucucacucugucacucaggcuggagugcaguggccccaucuuggcucacugcaaccccugccuccuggguuuaagcgauucucccaccucagccucccagauagcugggauuauaggugugcgccaccacacccagcuaauuuuuaaauuuuugguagagaugggguuggccaggcuggucuugaacuccugaacucaagugaucugccugccucagccucccaaaguaaugggauuacaggcaugagccacugugccuggcugagaaauuuuauuuaaccuuauauuaaucuagcuuccuugacucuaucuuguuuggcauuggacuucuguaaguccuucuguuuuaggcaugcuuuuuuuuuuuuuuuuuuaaagaaaagaaacagggucacccucuguugcccgagcuagagugcaguggugccaucauagcucacuguauccucgaacuccuggccucaagcaauccucugacaucagccuccugaguagcugggacuauaggcacaugccacugcauccagcuaauuuuuaaauuuuuuuguagaggugagguuucucuauguugcccagacuggccucgaacuucuagccucaagugauccuccugccuuggccucccaaaaugcugggauuauaggugugagccaccacaacuggcuagguaugcuuuuauaagcaucguagagguacuuuuuucuuaaaccaagucugacaauuuuugucuuuucacuuuaauuggcaaguuuaguccacuuauauuuguugugauuauugacagaacagcucuuguuucuguuauccaguuucuacuguuuuuuucugugcuuuuuuuucuuuuugcccuuucuuuggggguugaauauuugcuuguucuuauuuuaucuccuuuauuaguuuggaaguuggcauucuaguucuuuucuuuuaguaguaacucuugaaauuuuacuugcauacuuaacaaaaucuaacacuauuauacccccagugguaagagggacuuuagaacauuuaauuucaaucacccacucuucacuuauaaggaguugucucauauuuaguucuaauuuuaauuuuuuuuugaaacuuaguuauuuauuuuuuagagauagagucucauccuguugcccagacuggccucaaacuccggggcucaagcaauccuccugacucaaccuccagaguagcugggacuacaggugcacauugugccuggcuuaguucucucucucuuucuuuuuuaacucuacaaaucgggcauuauaaauugcuauacagacaauauuuacauauuuaucuacauguuugcugguuuauuugcucacuauucuuuguaucuaggccuuccucugggaucauuuccuaccugaaauauguccuuuagcuauccuuuuuauuuucucugauucucuccuaggggacuauuucauacuucuuccugucuuuucaaaucuccaauacuucuuccauaguccuugcucucaguuaguaauuauagucccucuuuaccagaagacagaaggaaucggaagaggccuuucaaaaauuuucacuacugcauuuacccacuaguguucauacaugcucccuuuccuguuguuaccugauaaaccaucauuauuccuagcaaaggcuaaucccucuacuugagugcuaaaucccgucuccucucaccgacucaccaauauuuuaccagugacucucccuucuaauguuguauuaccccuuuuuccuaucuuuauuguaucauuucuaucagcuuucaguugucccugguacagcaaaauucuuuucuuuuagagacagagucucacucuguuacccaggcuggagugcaguggcaugaucuuggcuuacugcaaccuucgccucccaaguucaagcaauucucaugcuucagcuuccugaguagcuggaauuacaggugugugccaccauacccggcuaauauauauauauauauauauauauauauuuuuuuuuuuuuuaguagagaugggguuucaccauguuggccaggauggucuugaucucuugaccucgugauccgccugccuuggccucccaaagugcugggauuacaggcgugagccaccgcgccuggccuaauuuuuguauuuuuaguagagaugggguuucaccauguuagguuagaccaggcuggucucgaacuccugaccucaagugaucugccugccuuggccuccaaaagugcugggauuacaggcgugagccacgacacccagucaaaaauuuuuugaaagaguuguauguauucgaucuaauuuuucuccuuggacugucuuggucaugcucuaaucaugcuuucauccucacuguaaauggcagcuccauccuucuacuuguccaggccaaaaaccuuagagugauccuugacuucucuuuuugcucucauaucccauauccauagcaaaauccugcuaacuuugccuuugaaauauauccagaaccuauugguaucuuaccccucuaccaccccagcugguccaguccacuaucaucucuugccuggauuauuguaguagccccuuuauuagucuccuugcuuuugccuugcuccccuguauuaguuugcuaaggcuacaguaagaaaguaccacaaacugugucuuuuuuuuuuucgagacagaaucuugcucugucacccaggcuggagugcaguggggcaaucacagcucacuacaggcucaaucgauccuccugccccugccucccaaguagcuaggacuauaggcaugcaccaccacaccuggcuaauuuuucuauuuuuuauagagauggggucucacuauguugcccaggcuagucucaaacuccugggcucaaaugauccucucaccucggccucccagagugcugggauuacaggcaugagccaccauccacagcccaaacugugucuuaacagaaauuuauugucucacaguucuggaggcuaggaguccaaaaucacagugucagcaggauuguuuuuucugagggcugugagggaaggauggaaaaaucacucagcuuaucuaaaaaugucuauuuugcucuuacuuuugaaagauaguuuguuacaauugacgaaccaauauugauacauuauuauuaaccaaagucccuaguuuacauucggguucauucuugguguuguacauucuauguguuuugacaaauguauaauaacauauguauucguuugcuaggacugccauaacaaauacacagacuaaccggcuuaaacaauagaaguuuauuuucuuacaguucuggaggcuagaaguccaauaugaaggucuugguaggguugguuucuucuuguggauggcugucuucuaugucuucacaugaucuucccuuuaaguuugucuguguccuaaucuccucuucucauaaggauaagggcccaccgcaaugaccucauuuuaccucagcuaccucuuuaaagacuuuaagauaugaacuuuggaguggggugggggacacaauugaggccauuaacaguauguauccaccauuacaguuucauauagaauaguuucacuguuacaaaaauauccugagcuccacuuauucaucucucucccccagaaucccuguuaaccacugaucuguuacuaucuccauaauuuugcuuuuuccaaugucauguaauuggaauuauguaguauauagccuuuucaaauugcucuuuccacuuaguauauguuuaagguucuucaaugucuuuucguggcuugauuacuccuuuccuuuuaucacugcauauucauucacuuuguauuucaacaaaacuguauuuuuaauuucuagaaguucuguuugaugacuucacagauuugacuuucuuuuuuuuuuuuugagacagagucuugcucugucacccaggcuggagugugguggcgugaucucaacucacuguaaacucugccugccagguucaagcaauucuccuacuucagccucccaaguagcugggacuauuggcuugcaccacggcaccuggcuaacuuuuuuguauuguaguagagacaggguuucaccauguugcccaggauggucucgaacuccugagcucaggcaauccauccacgucggccucccaaagugcuaggauuacagacaugagccaccacaccuggccagauuugacuauuuauuuugcaugcugcaugccuguuuuugugauuccauguguuauuucuuuaaacauuucaugcauagcuauuucuguauuuuguggcugauaauucuaauaucugaauuccucagggaucaaaaucuguuuguugcuuguguucuuguggcgacuucuuuucucacauuuuuggugauccaugauugugagcucauaaugguuguucuucuucauuggcuauccuggaagccuaaaguggagaaucuuuuccuccagaaaguuuuggcauuugauucaucugaaaaccaggggguaccacucacguggaaucacuuuagucucuuuugaggguuguguuaaugugggaguuucagauucaucuccauuuugccacaucauaauggacgcuugcguucagggcagccucacuugcuuguugcucauagguuuuagcuugcuuuguguuuauggaggguucugucauuacugagucuagugagcacauucugaaaguccauuuuaucuaggauuucauuguuuuguagguguauaucccuucagacugucugguugggcaucuugccaaagcaggauucaguugccugaguuuagauauugaccaauagagugauggugaucauguuagacaccuugcaguucuccugggcauccucucaauuucauucucaaucacucacucuucagagucaaaucuugagccuuaggcaagugacagcaucccaugcuguugggaaugaaaagugaggaugguuaguuucgauacugccugcaugugcucaucuggaugaccuuuuguuucccugugguagcacugaugaaaauuagauuugaauuuauuucugagaaagaaaaaucugaaagaugaguguaguaaaccagaauggcacacgauugcaauuuaaaucucagcuuggccauuuagcaguuaugugaccaguacaggugauguaacuucucugagccucagaagucucaaucguauagaauaacaaaagcuacuacuuacugaucauuuauaauaugcuaagcacuaugcuaaguuuuuugcauauauuucuuauuuaauauucaguaaccuuaugagauauaauuauuuuaugccucuuuuaaagaugagaaaacaagcauacagagauuaaguaaaacuggguuauuaauaaggccaaauuuaaaugagauaacacaugugguaugucaggcacauauaagguggucaguaaacagcagcuagcauuaugaucacuaauaauuuuuggauauaaaauucuuuuugugauaugaucuaaauaagauucauuugcucaacaaauauuuuauggagcacuuacuguggccauguguacugcuaaaugcuaaggaaacagagaggaauaagaaagauaugguccagagauggacacauaaacauuuacaagucagccuggggagugcugugaugggguaagaauagggugcuuugggagucagggaagauauaccagaagaaaugcccucuaggcuuauaccugaagaaugaguuggaggugagggacggaaggaauugcacagguaguagugauugugaaagccuggaggggagagagugcgugcuacucucauuuaaagaagugaaagggccgggugcgguggcucaugccuguaaucccagcacuuuggaaggcugaggaggcuggcagaucaccugagcucaggaguucgagaccaggcuggccaacauggcgaaacccucucucuacuaaaaauacaaaaauuacaguccgggcacaguggcucaugccuguaaucccagcaguuugggaggcugaggcgggcagaucaccugaggucgggaguucaagaccagccugaccaauauggagaaacccugucuuuacaaaaaauacagaauuagccaggcuugguggcacaugccuguaaucccagcuacuugggagacugaggcaggagaaucgcuugaacccaggagguggagguugcggugagccgagaucaugccauugcacuccagccugggcaacaagagcaaaacuccaucuccaaaaaaaaaaauuagccagucgugguggcaggcgcuuguaauuccagcuacucaggaggcugaggcaaaagaaucgcuugaaccugggagguggagguugcagugagccaagaucauaccacuuuauucuagccugggugacagagagacucuaucucaaaaaaaaaaaaaaaagugaaaguauaguauaggguguauauauaagauuuuaggaaaaauguggaaagugaggcuggagaggugggcaggugccauauucugaaaggcuuuguaaacccuacugcaagaguuggaccuuuaucuuuagggcauuggaaagccuuugaaaguuuuuuuguuuuuguuuuuuguuuuuuuccuggaguaacaugauuuagaaagaccauucugugcuauucuacaaaacauguucaagaguuucaaaaaauaaaauaggaagauuacucugggugaauugugggaauaauaauaacaauagcuuuaaauacuuacuucauuuaauccuuauacuaacacuuggagguaggucuuauugucuugcuuuuacagaugaaggaggaaaauaagaaagaaauugggacuuggagagcuuacuucacucacaagaauucacacacguaauaggaaguggagucauggaccuaggucuuucugaaucuaaagcuguauugcugaaucaccuucaauugguuaugauuuguuaugaccugcuuuauguuuacucugugggaaauucucguucauucuuacaguauuauuagcauauuccgugauaguuuacaaagcauuuaacgucauuuuuaaauuuagccuccuuugaaacugugaauuaggugguggugucuccauuuugcagguaugaaaacugaggcuugagguauggucccauacaccuagaaggugguggagcugggacuugaacaccaagcucuugacagaagaaaaccuucuuaguggguaucuugugaacaugcacacuuccuucuugggacugugcccuuuguucauuaugugaaugcuuauaaaguucuuuccuuccagguuuuggagaucauauucauuggaggacacuggaagaugggaagaaagaagcagcugccagguacaagacaugguuuuaggucauuuauggugguaaaacacuuuucagcuaucaacuuaacguuaauuucaggugaagggcuauaccaaggcagagcaagaacugaauaguugccuaauuacaacaacagcaauaauaauggcuaacauuuauaguugagccuugaacaacauggguuuuuuuucuuuuuuuuuuuuucuuuuugagauggagucucacucucucgcccaggcuggagugcaguggcacgaucucggcucacugcaagcuccaccuccugggcucacgccauucuccugccucagccucccgaguagcugggacuacaggcacccgccaccacgccuggcuaauuuuuuuguauuuuuaguagagacgggguuucaccguguuagccaggauggucucaaucuccugaucucaugauccacccgccucggccucccaaagugcugggauuacaggcgugagccaccgcgcccggccuuuuuuuuucuuuuuugagacagagucuugcuuugucacccaggcgggagugcaguggugcgaucuucauucauugcaaccuccaccucccagguucaagcaauucuugucaagccucagccucccacguagcugagauuacaggcaugugccaccauugccggcuaauuuuuguaguuuuuaguagagacgggguuucaccauguuggccaggcuggucuugagcucccaaccucaggcgauccaccugccucggccucccaaagugcugggauuacagaugugagccaccacgcccggccaaacaacauggguuugaacugcacagguccacuuauauguggauuuuuuucaguaauaaaugcauuggaaacuguuuuggagauuucaagcaguuucaaaaaacuugcagaugaacagcauagccuagaaauaucaaaaaacuuaaaaaauugguauguuacaaguguaaaaauauauguagguauuagucuauauuaucauuuacuaccauaaaacauacagaaaucuacaaguuaaaauuuaucaaaacuucugcacacuggcugggugcgguggcucaugccuguaaucccagcacuuugguagguugaggcgggcagaucacuugagcccaggagguugagaccaaucugggcaacauggugaaaccccuucucuacaaaaaauaccaguuacuugagggggcugaggugggaggaucaauugagccugggaguuugaggcugcagugagcuaagaccaugccacuguacugcagccuggaaacagagugagacccugucuaaaaagcuucuggccaggcaugguggcucacgcuuguaaucucagcacuuugggaggcugaggcgggcagauuaccugaggucgggaguucaagaccacccuggccaacaugguaaaaccccgucucuacuaaaaauacaaaaauuaccugggcaugguggugugcaccuguagucucagcuacuaggggaggcugaagcaagagaaucacuugaacccgggagguggagguugcagugcgcugagauugcaccacuguacuccagccugggagacaaagcgagacucugucuuaaaaaacaaaaauaaaaaauaaaaauaaaaauaaaaaaauaaaaaacuucugcacacaaacaccuauagaccacacaugcugccauuugcagaagggagaaauguaaacaaauguaaagaugccauauuaaaucauaacugcauaaaaauuaacuguaguauauaacauuacuaauaauuuuguggccaccuccuguugcuauggaggugaacucaaguauugugaguauccacuuaaaaugccgugcaacauuaaucaucuucagugagcaguacgucucuccaguguauugcguaucgcaguauaacguaguuucucagcugggcgcgguggcucacaccuguaaucccagcacuuuaggaggccgagguggguggaucacuugaggucaggaguucgagaccagccuagccaacauggugaaacccugucucuacuaaaaauacaaaaaacuuagcugggcauggugggcgcaugccuguaaucccagcuacuugggaggcugaggcaggagaaucgcuugaaccugggagacggaguugcaguaagccaagaucacgccauugcacuccagccugggagacagagcgagacuuggucucaaaaaaaaaaaaauuaaucucuuacaacucuugcauauuuuuccugguauuuaguacaauaucauaaaccuagaauaacaccaugaaacccauacaaggugccauuggugaugcuggaaguguucccaagaagcagagaaugcucaugacauuacaagaaaaaauugaauugcuugauauguacuguagacugaggucuacacagguaguugcuugucguuucaagauaaaugaacccuuuuuuuuuuuuuuuuuuuugagacggugucuugcucuggccuggccagaugaauccauuuugagagucugaggcaggaggacugauugagcccaguagauugagaccagccugggcaacaaaguaagacccugucucuacaaaaaaaaauuuuuuuaaagauaaauccagcguaaggaccaauugcguaaaaaaaaaaaaaaaacagaaaaagaaaaaaaaaagaaaauucaugaaguugucacuguagcuaugccaacaggugcaaaaaccuugcacuuuuugccaaaugccuuuuuaugugcauaauauguagcuuuuacauggguacuauaaaaaggcauaccuauugacucuaauaugauuugagaaaaagcaaagucauuauauggcaacuuaaagcaaaaagaaggugaaggaucuaaagcuggaguauuuaaugacaacaaaugaugguuugcugauuuuagaaagagguuuggcuuaaaaaaugucaagacaggcugggcgcaguguugcccguaaucccagcacuuuggcaguccaaggcggguggaucauuugaggucaagaguuuaugaccagccuggccaacauggugaaaccccgucucuacaaaaaauacaaaaacuagcuaggugguagugguccaugccuauaaucccagcuacuugggaggcugaggcaggagaaucgcuugagccugggaggcggagguugcaugagccgagauccccccacugcacuccagccugggugacagagugagacccugucucaaaaaaaaaaaaaacaagauacaggagaagcagcuuaugcugaccaagaggcagcagaugaauucucagacaccguuaagaaaaucauugaagagaaaggauaucugccugaacagguguuuaaugcagauuaagguacccuacucuggaaaaaaaaagccacaaaggacauuaauaguaaggaagaccaaccugggcaacaugggaaacucugucucuacaaaaaguacaaaaauuagcugggugugguggcacacaccuguuguuccugcuacucaggagucugaggugggaggauugcuugagccuggaagauugaggcugcaguuagccaugagugcaccacugaacuguagccugggcaacagaauaagacccuauuucaguuuuuaaaaaggaaaaaaaaaaauaggaagagaagcaaguaccaacauugaaggcaagaagagacaggcuaacucuacucuuuugugcaaaaaaacccagcacuuugggaggcagaggugggacgauuaccagagcccaggaguuugagucaaguuugucaucagaacugcccuugucuauaaagcuguuaaccuccagccucgaagagcaaagauaaacaccagcugccaguguuuagguugugcaauaagaaggcuuagacaacaagaacccuuuuucuggauugguuccaucaaugcuuugucccugaagucaggaaguaccuugccaguaagagacuaccuuuuaaaguucuuuugauguuggacaauacucuggccacccagagccccaugaguucagcaccaaaggcaaauuaaaaagucuauuugcggcugggcccaguggcucaugccuguaaucccagcacuugggaggccgaggucgggggaucaccugaaguugggaguuccagaccagccugaccaacacggagaaacccagucucuacuaaaaauacaaaauucgccgggcgugguggcacaugccuguaaucccagcuaaucaggaggcugaggcaggagaauugcuugaaccugggagguggagguugcagugagcugagaucgugccauugcauuccagccuaggcaacaagagugaaauucugucucaaaaaaaaaaaaaaaaaaaaaagguggucuauuugccuccaaacacaauauuuaaaucagcuacuacaucagggggugauaaggaccuuuaagguucauuacacacaguacucucuagaaaacagauugucaaagcuauggaagagaacugcaauaaagagaacaucaugaaaguuuaggaggauuauaucguugaagaugccauugucguuauagaaauagcugugaagaccaucaagccugaaacaauaaauuccugcuggauaaaacuguguccagauguacacaagacuucacaggguuuaugacagauaaucaaaaucaugaaagagauuguggauauggcaaaaaaaggugagggguaaaggguuuuaagauaugaucuuggauaaauucaagagcuaauagacaccaaaccagaggaaugaacagaagauaacuugauggagaugagugccagaugaugaggaaaaacacguagaagaggcagugccagaaaacagaucuggcagaagguucuaauuauuuagagcugcuuuugacuuauuuuacaacauggacccuucuaagauaugugcccugaaacuaaagcaaagaaaaaagauugguauuguauagaaacauuuuuagagaaaugaaaaagcaacaaaaucagacagaaauuauauuuccauaaaguuacaccaagugugccugccuguucuaccuccccuuccacccucuucugccucugccauccugagacagcaagaccaaccucuccucuuccucuuccuccuccuccucagccuacucagugugaagacaaggaugaagaccuuuaugaguauccauuuccacuuaaugaauacuaaauauauuuuugcuucuuuaugauuuucuuuuucuucuuuuuugccccccugcuuccuggaaagauuuucuuaauaacauuuucuuuucucuaguuuacuuuauuguaagaauacaauauauaauauuacauucaaaauauguguuaacugaauauauuauuaguaaggcuuccagucaacaguaggcuauuaauaguuaaguuuuagggagucaaaagguauaugcugauuuuugauggugucaggggucagugccccucauccugggguuguucaagggucagcuguacuaagugcuacugugcauuaggcauuaaauuaugcaaaucaacucauuuaacucucacaacaacuuuuugagauugguauuauuguuaucuuaauuuuagagaugaaaaaaguaaggcaccguuuuuucuaaguuuacuaaaauaacuugcccaagagcacacagcuagcaaguggcagacccaagcacucuggcuucagagccugcucuuuaaaccuguauaccauacugccugcuagaaucaaguugaauagucuguaaagucucaaguagguuuaguuuaugcacagacaauucagugcauaaggaggaggaaaaggcagggcaggggagggaaagcuaagcacuggucuguguuuacuuuuuuuuuguuugagacagaguuucgcucuuauugcccaggcuggagugcaguggugcgaucuaggcucacugcaaccuccgcaucccggguucaagcaauucuccugccucagccuccucaguaaugggauuacaggcacacgcuaccccacccgacuaauuuuuuaaaaaguauuuuuaguagagacaggguuucaccauguuggccagacuggucucgagcuccugaccucaggugaucuacccucugccucccaaagugcugggauuacaggcgcgagccaccaugccgggccuguguuuacauuuauuuaacccucacaacaaccuacagauugguaaaccugugaaauagcaguuguuauuuuauagaaggggaaauugaaguacagaaaaguuacauaauuugccaguaguuacaacacuaguaaguggaggagccaagacuugaauguuuuuuacuauacuguacaagagagauacaaagaccccaguauaugugcaucuacaauauacacacaugcacaggcacacucacauuucugcaccuaccauccuauagugcuugcuguuuauacaagagauccaacaguuucauggcucugggucucaaaccuacaauaauagaguugccagauugagcaaauaaaaauaacggauggccaggcacaguggcucaugccuuuaaccccagcacuuugggaagccaaggccaguggaucaccuggggucaggaguuugagaccagccuggccaacauagugaaaccccgucucuacuaaaaauacaaaaauuagccagauaugguggcgcacacccauagucccagcuacuugggaggcugagacaggagaaucgcuugaacucaggagguggagguugcagggagcugagaucauaccacugugguccaggcugggugacagagcgaggcuccaucucaaaaaauaauaauaauaaaauaaaauaaaggaugcaggccaggcaccuuggcucacacaccuguauucccaguacuuugggaggcagagguggcacaauuacuugagcccaggaguuugagaccagccuuagcaacauacaaccucaucucuaaaaaagaaaaaauaaauaauaauaauaaauuaaagaugcccaguuaaauuugaaguuuagauaagcaccaaauaauuuuaaauaugucuaugcaauauuugggacacacuuaagcuuaaaaauguuuuugguguuuaucugaaauucaaauguaacugggcauccuguauuuuaucuggcaacccuacuaaggagaaaaauuccuauuugucuuucaaguucuaagucaaaugacuauuucuacauaaagucuucagugauuucucuggguaguuuguuuuucccuucuguucuuuuauaaccucaccugcaucuauccauuauaguauuuauuacucugauuguaggcgccugauccuucccauucagaccuuuuaucuuuuguggggaaagcguuuuauguucaucucugaauucccaaccuuggagauguugaaugauugaaaugguaauugaauaaacauuuacugagagccaguagguuuaagaggaggaaugaaggagaaccagcauuuauuaauugccuucuauaugcuaaauauagugcugauugcuuacaauauuuaaugccccuuaggccuuauuaauaaaauggacgggcagucuuucgcugcaggaagaucacauucuccugaggccuauaacauuuggcauaaauaacugaugccauuauagucucuguaucuccuuucugagaaagcugaaccugggccuagcuggcguagaacuccuguuuccauagaaacaagagggucuguaaaagucaagggagacaggaagagcaguuugcacuuccggcuuacgucggagacgcguacaacccggaaguuggcgcagcgcgguugccaauggucgcucccugagaggaugccgcucgugguguuuugcgggcugccguacagcggcaagagccggcgugcugaagaguugcgcguggcgcuggcugccgagggccgcgcgguguacgugguggacgacgcagcuguccugggcgcagaggacccagcgguguacggcgauucugcccgugagaaggcauugcguggagcucugcgagccuccguggaacggcgccugagucgccacgacguggucauccuggacucgcuuaacuacaucaaagguuuccguuacgagcucuacugccuggcacgggcggcgcgcaccccgcucugccuggucuacugcguacggcccggcggcccgaucgcgggaccucagguggcgggcgcgaacgagaacccuggccggaacgucagugugaguuggcggccacgcgcugaggaggacgggagagcccaggcggcgggcagcagcguccucagggaacugcauacugcggacucuguaguaaauggaagugcccaggccgacguacccaaggaacuggagcgagaagaauccggggcugcggagucuccagcucuugugacuccggauucagagaaaucugcaaagcauggguccggugccuuuuacucucccgaacuccuggaggcccuaacgcugcgcuuugaggcucccgauucucggaaucgcugggaccggccuuuauucacuuuggugggccuagaggagccguugccccuggcggggauccgcucugcccuguuugagaaccgggccccaccaccccaucagucuacgcagucccagccccucgccuccggcagcuuucugcaccaguuggaccaggucacgagucaaguacuggccggauugauggaagcgcagaagagcgcuguccccggggacuugcucacgcuuccugguaccacagagcacuugcgguuuacccggcccuugaccauggcagaacugagucgccuucgucgccaguuuauuucguacacuaaaaugcaucccaacaaugagaacuugccgcaacuggccaacauguuucuucaguauuugagccagagccugcacugaccagaggagguaggggggaagccauggcuucugaucuccacuccacuuuauuucucugggaaaaauaggcugcaggucuccagagcauaucgaugcaguacuguacuagagcuguugugacugauucacucaaacuuuccugcauaccccugugccaggccuuggguuuacagcauaaguucagacuaaagagaauggagaacuauuguggugcaaccuggcaaaucccucagaggacagagcuaagguggacagggauuaccuagauuggauccuacuugggcuaucacagagcauugaccauuggcuucccucaucugaggcgugggagagcagacuggauagaugagaauuguuuuaaaacaauugugaacagaaacugaagaugguacaguucuacaucugcaccugcccuuuuuucauaccacaaaaguauuuuuugaguacuguacugacuuuuugcuaguuucuauucugggaccgaguucacagauaaauccauugguuuguauccuugagaaacuuuguuuuuguggaaguaagaaaguuaucuacuagauuauuuccucuaauaaaaucuuuuaaaauagucuacuggaaucucuuucacuuaauguucccuguguaacuucauguaacauuuuagguauacuugucauuguucugccuuuaagugaaguaguauuuugauaguucugagagaguagauguuuugagcuacucuacaguaauuauauuaugacaauuuccguaacuguuuugcuucauucugcauuucaaggcaaauaucauuguaagcuugucuuucauucuucauugauuucauugaacaaaugguagguaccuacuuuaacaguggcugugauuuucaaagaccaauuagauacaguguuuuugcucuugagauauguggugagaagccgggugugguggcucauacuuguaaucccagcacuuugggaguccaaaaucgaggucaggaguucgagaccagccuggccaacguggcaaaaccucgucucuauuaacaguacaaaaauuaguugggcgugauggugugccuguaaucccagcuacucuggaggcugaggcacgagaaucgcuugaaccugggagguggagguugcagugagcugagaucgcaccacugcacuccagccugggcagcagugaaacugggucuugaaaaacaaacaaaaagagauauguggugagaaauacaaguaaaagauagaauuaggcugggugcgguggcucaugccuguaaccccagcacuucaggagcccaaggcggguggaucacaaggucagguguucaagaccagccugaccaacauggugaaaccccaucucuacuaaaaauacaaaaauuagccgggcgugguggcacgugccuguaaucccagcuacucaggaggcugaggcaggagaaucgcuugaacccgggaggcggagguugcagugagccgagaucgcgccacugcacuccagccuaggugacagaaggagacuccaucucaaaaaaaaaaaaaaaaagauaggaugaaaugggcugguggucagaggaugaugacaaaagacaaaaugcuuuggaaaccuggugaagaggacuaacuagcuguugggggaggugguuuuggaaagguuuuaagaggaguuaacauuugaaccaucacuguagaauaaagucaguaaagggccaaaugguaaauguuuuaggcuuuguggaccaucaaaugcuguugcuacuuauagaugguaaguaaacaaauaagcaugaauguauuuuaauaaaacuacacugaaaugugaauuacaauuaauuuuaacauaucacaaaggagucuuuagauuugcuuugcaaacauugaaaaauguaaaaauauacaacaaaauauuugcauaucaugggcccuacggaagcagacggugggcuggauuuggccugcagacccuaguuugccaaccccugcucuagaaggauaaacagauguuugccagggagaaaagagaaagcaagacauucgaaaacaugcaugcucugaaacuauggagcuguuaaaagagaggguagaugggcugccuugguugaugguauauuccuugcucaucagguaaucuauacuaccuuuuguuucugauaaacaggauucaugugugaaauggaagucuggaugaggcaaacucaaaaggcuuuuuccaaccuucauuaaguugguuauugauugaauugggucuaaccauggauucuggauuaccauucuaaauugaaguagacuguaaccgucagaaagaacauugguuuuggagucggacuucugaguuagcuaguaaguggcagaaccuagguuuuuguuuuggguuuuuauuuuuuuuuauuuauuuauuuuugagacaaggucuggcugucucccaggcuggagugaagugcugugaguagcugggacuacaggcaugcaccccacgaccggcuaaguuuuguauuuuuuuguagagacagguuuucaccauguugcccuggcuggucuuggacuugugagcucaagugauccuccagccucggccucccaaagugcugagauuacaggugugagccacugugcccggccuagaaccuagauuuuauggggccaaauauuuacucuauugagcaucucaauuuucucauuucuauugugagaccauuaauaguaucuacccuaggguuauuuugaggauuuaaaugagauaaugcauauacagcacaaugucauauaauaaacguucagcacauuuuggcuauuaugguuaccuauauccuacuacccaccuaaacuugcccugcucauuugguuuacaagcuuuuacaaguauugcaggcagaaguccauccagaugugagguaggccuaaggugaggugacugaaugauucauuugacacuuauuaaaugaguuaauuuauguauauuuacaguagugccuggcacauggcaaaugguauauaaguguuugcuaucaauaauauaugugucagauguaaaggauauagagacagcuaagaguuccuugucuuaggaaucuccaaguccaguggagggagauggguaaauaauagguacagaucaauauguuaagugcaugguagcuauuauacaguguauguuguuauggugacaugggguugugugauggagaaagcuaauggcuaccuacuuacauggggucuuccuacugucauuugagccuugagagcuuaagagcuuccucuagccagucugguucggguggauugcauugcucauugugaacaguuuccucccugauuaugaaaauuauauuguagaaaaaucaugaaauacagauguaguguaaggaaaacauccacagucccaucauccacagaaaacugcuauuauuauguuuugguacauuuucuuuuaggcucuuuucucuguacauauuuuauaauuaaaaccagacuauagauacauuuguauccuaguuuuuuauauaagcuaccaaugaaaaauuauuuucaaugauuauauaacaauaaucauuuagaaauacuguaacauuuuguuugcuuugagacagagucuguucugucggccaggcuggaguguaguggugcggucucagcucacugcaaccucugccucccaggcuuaagcaauucucauauuucagccaccccaguagcugggacuacaggcacgugccaccacgcccagcuaauuuuuguauuuuuaguggagacaggguuuuguuauguuggccaggcuggucuugaauccguggccucaagucaucugcccacuucagccucccaaagugcugggauuacagacaugagccacugugcccagcccucccuaacuuuaaagcccaaguuugcagaauuuacagaaguguuagaacuuaacaauaauuuuguuacagcaauuaucuauuauuauugaacauuugucuaaagauuuucccaauugaaauaauacuacagaaaugucuucacauauuaaucuuuaucauuaaauuucaagaaguagaauuacuagauuauaauuucuuuguuuugcuuuuaaguggacugccccugauggugauuauucauaaauccugguguggagcuugcaaagguaagugcaaaugcucaaucuaaauucaaaacucagauguguuguuaaauauuaacauuuaacaaauauuggcacugacucuggcccagcacuacugacuguuuaaggaauacuaaagaaacauaugacauagauuuccugccuucaugaaauuugcaauuauauuuggaggggauuuuagggaaguuaaggugauuaagauacaguuaugucacguaugggauuaagugcuaaaaugucaaaugaacaauacauguuagaggaagcugaaauguacggacagagacaugagaaggaaguaggacccaaauuagaacccaaguuaucugacucuguggcauguguucuuucugcuauaccaccuugccacuuccccagacaggcuuuuucuuuuauuuaguaugcugcacuuaaaauccuagauggaaaaggaguguaaaaaauaguauaaaagaccaggcgcaguggcucaugccuguaaucccagcacucugggaggcugggccgggcagaucacuugaggccaggaguugaccagccugcccaacauagugaaaccccgccucuacuaaaaauacaaaaaaaguagcuggauuugguggcacgcgccuguaauccuagcuacucgggaggcugagaaucgcuugagcccgagaggcggagguugcagugagcugagaucguaccauuguacuccagccugggugacagagugagacucugucucaaaaauaauaauaauaauaggaauguauguguguauauaacauauauacacauauauacauaacauauauaacauauaauauauacguauauauguauauauguauauauaacauauauacacacauacauauauguauacacacacauauacacguguggcagacugucacucuauugucuuucaugucaaugguuuuugaaauguaacuauaaaaagcaaauaaugcuuuuccccccuauucguaugccauuauccuuauuuuauaaaugagguaacagcuucagagaaaugaaguaagucacucaaggucacauagcugugcagguucagaauccagguagccuaauucuuguuuuuuagaguguaaaaaaaguuuguuauaugaaucaacuaaacaaaugccuaaacuaccaaagagaaauagugaugcuuauguucguuaagguuuaguugugacaaugauguuuuuucuucuauuccaaaaucuuuuuccccccagcucuaaagcccaaauuugcagaaucuacggaaauuucagaacucucccauaauuuuguuaugguaaaucuugagguaagacuuugagaguuucuccuuucugcuaugauuuuaagacuuuuaaaguuaguaucauucgugcauauucauuacagcuucauuagugguaugaagucaaauuuauguauguguuuuucucuugaccgcuaauacuaaggcuugcaucagauauguuagaaagccaucuaacaucuauuucugggaggaacuaggagaggagagauugaauaagaugacuaaauuuuuuuuuuuuuuauauggagucuggcucuguugcccaggcuggagugcaguggugcgauccuggcucgcugcaaccuccuccucccggguuaaaucaauucuccugccuccgccucccgagugguugggacuacaggcaugcaccaccacaccaggcuaauuuuuauauuuuuaauagagaugggguuuugccauguuggccagguuggucucaaacuccugaccucuggugaucuacccaccuuagccucccaaagugcuaggauuacagaugugagccaccgcguuuggccaauuuuuguauuuuuaguagauaugagggucucacaauguuggccaggcuagucucaaaccccugaccuuaagugaucugccugccucggccucccaaaaugcugggauuacaggcgugagccagcaugcccagccuuaagaugacuagauuuuaagguccuuuuauccuuaguuuaugauuaugacauguuuuaugucuuuguaaagcuagacuaaagguauagucauacaugcagaccacaacuuucugcaaaaugugauucaacugagcaccuaaucuguguugggcuuauaugugcaaccugcuuguuuccuuaugaaaauagcuuuuacauaccucauauaggcugcaggucuuggaauccugagucauagaaugucagaucuuagaguuggaagggauuuuuaggcuauugguacuauccucauuuuacagaaagaaccaucuuaggccugaagcagguaugugauuuggucaaggucauagagccuaauaagugauaagaauagguacucucaccuagccgugcucucuuucaggccauacuuuucacaugugagguacucagaugcucuaugaugauaccgcuagccauacguuucuguaaaaauaauguuuacuugggccagacaugguggcucaugccuguaaucucagcacuuugggaggcugagguggguagaucaugaggucaggaguucaagaccagccuggccaauauggugaaacccugucucuacuaaaaauacaaaaaaauuagcugggugugguggugcgugccuguagucccagcuacuagggagccugaggcaggagaaucgcuugacccaggaggcagagguugcagugagcugagaucgcgccacugcacuccagccugggugagagagugaaacuccaucucaaaaaagagaaaaaaaaaaaaaaagauaauguuuacuuaaacauaggucugggacucuugugaacacauuaacaguuaacagugaggcagcuaagggauugcuuauauagcuaggggauagccugaaugcugauacaccucaccauagcgaaguauuuaaccccugaaaugggaaccacaucauaaauugugaaaguauugauugccuuugcacaugaauuccucaccacuuucuguggugaauuaggauuccuacucaaaggaaacaguaaaaacgucuucauagaggauucuccaacuuuggaaauuucuuaaaaagaaaacugauuaggccgggcgugguggcuuaugccugugaucccagcacuuugggaggccaaggcagguggaucacaaggucaggagauugagaccauccuggcuaacauggugaaaccccgucucuacuaaaaauauaaaaaaauuagcugggcaugguggcgggcaccuguagucccagcuacucaggcagcugaggcagaagauggcaugaacccaggaggcggagcuugcagugggccgagaucgcacaacugcacuccagccugggcgacagagcgagacuccgucucaaaaaaaaaaaaaaagaaaacugauuguguagguuuuuaaucuccugggaggacuaugaguccacaacuuugacuaaaaugccagucuuauugauucaugcacuaaagaaauacuaugugcaagucaaugauguagguacuaggaauauagcagugaacaaaacagacaaaauuuccucguugaaauaacaugcuagugugggaagacagaaaauaaguauuuuagaauaugucagauggugguaaaugcuagggcuaaaaaagaaagguggaagggaugacugugguuuuaaauagaugguuugaaaauaaagggauauuugagcaaaggucugaaacagaaaagggagucaaccauguggauaauaauggggaaaguguguucagcagagaguuaagagcaaguccaaaagccuguguuaggauuaucccuggcuuguuuaaugacagcaacagcaagaggucaguguagcugaagaggacuuaacaagggguaggacauuaaguuagagaagugccuaggugauagaucauguagggccuuauaggccacugcaaggacuugggguuuugcccugacaaguggggaagccacugaaugguuuugaggagagagaggacguuaucugacuuaagguuuacauuuaaucuuaauaggaugaagaggaacccaaagaugaagauuucagcccugacggggguuauauuccacgaauccuuuuucuggguaaggcacaugaucuuaaccugggaauccaugauguggauggagagagaaaugaaucaaggcacugacuucaccuagugaaacuauaccaggaugaccacaaacaaauaaaaaccaguuucaagagagagugggggaguucugaaugcuagaacuacaagucugaaggaaaacuuuucccauuaacuaacugcuuuuguaagcaaugacaaaaguuuggccgggcacaguggcucaugccuguagucucagcacuuugggaggcugagaugggugaauugcuugaguccaauuugagaccagcaugggcaacacggugaaagcccgucucuacaaaaaguacaaaaauuagccgggugugguggcacgcaccuguagucucagcuauuuaggaggcugaggcgggaggaucaauugagccugggaggucaaggcugcagugagccauaaucacgccacugcccuugagccugaaugacagaaggaaacugaaugacccugucucaaaaaaaaaaaaaagaguuugaucauuuauucacuucaauagccauuugcgcaucagccauaugucaagcacuguauuagacacuacagagacagauauaagccagaauucucacccuugaaccuauagugcaccuaaggcaauggaauaauauaaccagauaaaugucuuuccacaaauaauuuuauaagagauauuuaaugaccaccuaaucuuuguucagcauaaauucugcuagguuuuaugggggauagaagucaaaaucaucaagcagaaaaggaagcagaaauguaggagguauuauggugagguaaugggcugcaaauaugggcagaucuuauuucccagagggcccgauguaccagguaguguuugaaguaccugucuguuguaauuacugcaaaacucugugucauuuugucuauaacagaucccaguggcaaggugcauccugaaaucaucaaugagaauggaaaccccagcuacaaguauuuuuaugucagugccgagcaagguauaguuaugcugaagggagggaggauuauugcuagauugaacuaggaugaaccacaugcaaggucugugauaggaaaguaaauucagcauguuagcugagcaucuccugcaugucuauagcuuuuggccagauccuguguaggauauaggaggaagaugagacugagccccuucccuuggaagagcugacugacccacaggcagcugugaagaacugaggcacacaagugacugagguagucacuugcccauaguuucauaguuaaguagcagagccagaauuugaguccagaacuuaguuuuuuuccuacugagcuaauacuguuuuuccuaugaaaauucaguggaagaggaauaguguuaggugaacaagucuaagagguuuuauagauauuaaacuuaaauaggccgagcacaguggcucauaccuguaaucucagcacuuugggaggccgaggcaggcagaucacuugaggucaggaguucaagaccagccuggccaacauggcaaagccccaucucuacuaaaaauacaaaaaauagcugagcgggcugggcgugguggcucacgccuguaaucccagcacuuugggaggccgaggcgggaggaucaugaggucaggagauugagaccauccuggcuaacauggugaaaccccgucucuacuaaaaauacaaaaaauuagcuggcgugguggcaggugccuguagucccagcuacucgggaggcugaggcaggagaauggcgugaacccgagaggcagagguugcagugagccaagaucgugcgccauugcacucuagccugggugacagagcgagacucugucucaaaaaaaaaaaaaaaaaaaaaccaaaaaaaccccgaaacguaaacggaccuagaaggauaaaaauuucaucucuggacagauaugaggaggacauuucaagcuauggaagugaaguggcgggggaauguagcccaacauagaguuuguaaggcuugcuagaagaaauaaugacuggauuaagccuuagagaauaagaccuugucaguagcagaaugggaaaagcauguuccaggagagagaagagcaccagcacaaacaagugaaggaaguuugcaaucgucagccagucaugcuuuuuuguucucuaaucuuugagcacagucauucuggaggcagggguuggaauucaugccauguauuguugcugcuuuccuuccuuuuccccucaucuaugaaagggaguugugugcuaaguugccaugugucccuauuugccaugcugccaggcuguugaucacuuuaugauuugaguccuugauacucuuauucucagacuagggacggggaggagaucuguagaagcuauuaccuucuuccccugaguaaggagaaugucauguuccuuaaccaaaugcagaucacuggagauugguaucaaagggaaauuuuccacguggagaagggcagcugggcuuuaggucuccaauucuuguaucuugagauucaccuucccuuuagaauuucauccaaguuaccacugcugucuccacacugacauaguccagaugugaacaugagacccuucccugaauccuccaucucucagcugacaugaaacuggaacauucaaacccagcuuuacuaaaggcauaggcaaaacaaaacagaaauaacaaacuguauuaucugccucuuaugagcuuaugguuuggcuuugcaagauucauagacucuggcucaacccagcuucuggccugccauuauauaggggugcuuuguagaaccaccauucaggagccuauacugaaauagcugucccccuugagucuaaauccauaagcaggaugccccaagacagacaagaaguuucaucucgagucuacuuaaggcccuccuuccagguuucucucucucuuuuuuuuuuuuuuuuuuuuuggccugagaacuuggcuucauccauguauaguugauacuggaaaugacgacccccuucaguagagacacccccgccccagcacacacaccccucaguguaaucuguaaccuccacaggaaguaaaauaagugcaacauucauccaaaagauacaauggggacgguaggaagguguuuccucuucccugggggugaagugaacaucuacagucuaggacaggggaucagcucuaauccuagaggguaagccaaaauaacugcuaagauuuugguaugacuucguaguugauaaagcacuuuuauuauccauucucccauuuaacuuuuauaauacugugugaagugaguuacauuauuucauuuuauaaaugaggaaacaaauucaaagagauaaaugacuugccagggccaaaauccagagcuagaucuugaguccagaucuuguacuccucucauauuucuucugaaacauuuaaaaguguacauugguugucaaaugucaaacauuacuuacuucauacuuuuuuccuccaaucuuuauuucacaguuguucaggggaugaaggaagcucaggaaaggcugacgggugaugccuucagaaagaaacaucuugaagaugaauuguaacaugaaugugccccuucuuucaucagaguuaguguucuggaaggaaagcagcagggaagggaauauugaggaaucaucuagaacaauuaagccgaccaggaaaccucauuccuaccuacacuggaaggagcgcucucacuguggaagaguucugcuaacagaagcuggucugcauguuuguggauccagcggagaguggcagacuuucuucuccuuuucccucucaccuaaaugucaacuugucauugaauguaaagaaugaaaccuucugacacaaaacuugagccacuuggauguuuacuccucgcacuuaaguauuugagucuuuucccauuuccucccacuuuacucaccuuaguggugaaaggagacuaguagcaucuuuucuacaacguuaaaauugcagaaguagcuuaucauuaaaaaacaacaacaacaacaauaacaauaaauccuaaguguaaaucaguuauucuacccccuaccaaggauaucagccuguuuuuucccuuuuuucuccugggaauaauugugggcuucuucccaaauuucuacagccucuuuccucuucucaugcuugagcuucccuguuugcacgcaugcgugugcaggacuggcugugugcuuggacucggcuccagguggaagcaugcuuucccuuguuacuguuggagaaacucaaaccuucaagcccuagguguagccauuuugucaagucaucaacuguauuuuuguacuggcauuaacaaaaaaagagauaaaauauuguaccauuaaacuuuaauaaaacuuuaaaaggaaaugugcugu

SEQ ID NO: 14052 - RNA, 4701 nt, Homo sapiens
ccaagugaugcacuacguauaguccauacugaagacagacaaguaugugucuguucuuauucauuuggcagacauugauaagugccuacucuugucagcccugaaugaggcacacaauccuugccuuuaagaaugucuuagucuagucagggagacugacacaaagcaauuaaaauauuguaguuaaguucuacaauagaaauauauauauagggugcuugguguguguagagcgagcagagaccccaauuaccagauucucugaaaugucauuuguguuuucucaucaaaagaaaauuauguuauauuugcuugcaggaacuaguuucagaaggaccaguucccuggguuuccaaaaacaguguaacauuuguggcugagcagguuucccaucauccacccaguaaguuacagagcuccucugcaaccugugcucucaaaacuauucugucuaaagagggucauuaaaagcgccauagcugaggguacugucaguugugugacuagcuguguguuucuuauucccugaaguggaaacucaaguugauuuguuccucauaucuuuuccuuuuguaagcuccagacucuuagcuucacaaauuaagugcguauaaaaagaagggauuuaggaaaccaacuuuuaaugcuuccagagucaucuuauauauaguaauuugugcuguagagaccucagcaacugugagacaguuuauauaagugauacguaguuucuacacaguauauuccuggcauacugcagauaccaaaaccgaggaugcugaagucucuuacauaaaauggugucuuuuauauucauauaaccuaugcacacccuccuguauacuugagucaucucuagauuacuuauaauaccuaauacaauguaaaugcuauguaaauaguuguuucacuauuuauuuguauuauuuuuauuuuguauuuuuaaauuuuuucuuuugagacagggucuugcucugucccccaggguggaaugcaguggcacaaucauagcucacugcagccuccugggcucacaugauccucccaccucagccucccaguuagcugggacuauggacaugugccaccacacccaacuaauuuucuuauuuuuuuuuuuuuuuuuuuagagucaguguaucacuauguugcccaggcuggucucaaauuccuggccccaagugauccucccgucuuggccucccaaaguacugggauugcaggcguuagccacugagcccagccucuguauauuuuagauccacaguuggcugaaucuguggguacaaaacccauggauauggagggucaacuguacauacccucaacaucugguuuguuuagugcaguauuaaaacuggaaacacuggcugggccuagguuggggcuggagccuggguguacuugcagaccagaacagauagcccuuuugguuuuaagcuuccuggguuggccacagcaucauuucagggaugauccugcccacguggcucugaaugaaugcuugcauuggggaaaaggguauaaaaggcagguagguaccuccuggcguaauuggaggcuguuugaaggguaaaggauuuccccaugaagccaauuauuuccccagguuaugugauuuuggagagguggcuguagguauauauaaucuacuaauugaaaauuucuauucaguuucagccuuuuaugcugaguguuuuaacaagaagauacaauucaaugcucauaucuggaccaaaucaaaauuccuugggaugucaauuggggugcacaacauagggcaggguaaguguguuggcauuggguggacuacaauguuauaggagaauuuuaugaaaauggcuagacuagaugucauuguuagcaacuaagcauugguauugggggugagagcaaaggguggggaacuagauagguuaucccuaaauugaauggaguauccuggaguaaccaucagcucgacaagaaagccuuguggccacuuggcacuacucaucagagauucugucccuucucuccacaggcugugucucaugucuagacuaugaugaacauuacauucucacauuccccaauggcuauggaaggcaaguguguccauuuccucugaucagcaguagacucugcuguuccuugagacaugccccuucccccucuuccucuuaacugucaaccuuaccuaaaaacuuuugauuuugcaggucuauccucacagugcccuggguggaauuaggaggagaaugcaauauuaauuguuccaaaacaggcuauagugcaaauaucaucuuccacacuaaacccuucuaugggggcaagaagcacagaauuacugccgagauuuuguagguauuuuuucugccuuagagcucuuaugcuuuucugaaauaacugccuuuugucuugaacuacagcuucuggauuaggagugugaaagaaugguucugucuuuguaagcguguuucacauuuuaugugucaugucuuuugcugaagucccauaucagaagaagaccuaaaacauauauucagagcagucagaggucauugauagguuuccuuccuaaaaaccugacuugcaauguugaacuaaaagaggccuuccuagguugccuagcuaaaccagauuauggaucccuaauuuauucuugccagauugaaugaugagcugguccuuacagcagacuuugugaccccugcagcacugccuccugguccucacagcuaucccuuuuucugugccuuugcuggggaaaaacaguaaccaucacauuuugcacgcaucuggcuugcuuccacuugacacucuugggucacgugcagaugacugugccagucaguggaaagucuauagugauggcaccaugacucucucugccucuggaacccuuaacugggggggaaggggacagugggaaagaaaguuucaggcguugauagcagcucuccucccucugcccuggucaugucucccuuuucuggccucuuucaauccuguuuaugccuugcccuuccuaaccaggccuuugcuguguugcuuaucuucucacauuccauaguuguguguccaaguagaggucuguuacggcuuuugcagaauggauccuugcucagggaaaguauucacaccaucuggcacagaggucccuuucaaccugaggaugaaagccugcauuauauucuuaagcaaagccuucccugacccccagugcccauguaagcucaccacagcacuuaccaccuagaauuucaauggugguuacgucucucuccacuacgcugugaacagcuugaggauagggaauuugccaacucuguuaugguccuugcacccagaauaggacguucuugcccaaacccaccauucuugggaucucaaguucauaagcguccuguugaaggcccucauucuuauaguuagcccuggggaguccaguucuguuaagaugcuuucaucaaaaacuucacaguugcucuucugugcucuacucuguaguugggccacacugagcagauucuuugguagaauuuucaacuugagacuaacacaaguauuuccuuuucuguucaguucuccaaaugacaagaagucuuuuugcucaauugaaggggaauggaauggugugauguaugcaaaauaugcaacagggguaagauccucuauuuugccacuuguuuuaggcuacauuagauuguacucuaucccuuuuucuggcuuccuucauuaguacuuccuucauaaugcauuuccuucuacaguauauuagagcuggaacuuuaggacagcuccaguguaugucaucucuucagggcaagcuuuuucuuuccuucccccaccuucucccagcaguauagguaauuauaaucauuuuuacuuuucucucugcucucaaaacacuugagaauaauauauguaaaacaaugccuggcacauaguaagaacccaguaaauguuagguauguggcguauguuuauaaaaugaagcacuaaacuguguguuuccauacacacacaguugaagauuuuguauaauaaaauuuacugacugccuggcaccagagauaccaaaaugaguuaagauagaccuuuccuucaaagaacuugcacucuguacuacugcccacucaguguucuuaaacagaggaaagauguuaugaaauuaacaggaggagccaguuaacugcauuuuggaccuagagaauuugaagugucaaaagcacuacaaugcaucuaacauuagguuagggguuuaugggucuaguucccauccaccucuauuguuuucuaggaaaauacagucuuuguagauaccaagaaguugccuauaaucaagaagaaagugaggaaguuggaagaucagaacgaguaugaaucccgcagguaagccgacauuguuaaguggaacuauugcugcagugcuuaaacuuugccuaggcguaggcacagggcuggguuugagagacaguagggcagagcauaauaguauagaccaaguuugaauuccuggguucguaugucagaacuaccacuuacuaccuuugugaccauggauggcucagucagcuaacuucucuuuaccuucuuuccugaaaugagaauaaaggccuugagaggaagccacaucuuaacuaacuuuaaagccucuguaauuuacuucuugacccuuauucucuccauucauacuauuuucuccaucauauuguu

SEQ ID NO: 14053 - RNA, 1588 nt, Homo sapiens
ccgccucccgcucuccaccuccucccgucaagucucucgcgccggcucccuccugccggcuaggcggccuguccccagcuggagcgggguucggccccgcgaaguccggccugcccuucugcuggcgggcuugagucugugacgcgaacccccagcugccccaauuccuacgggggcgaggacagggguuuguuauuuaagacgguuguggagggccgcagggucuuugaggcuccgcagcguacgcugcgggaaggcggacagcgagcuggcauaaagggagucguuccucagcgcuagcggggcaggucggcccgccucugugcucccccgccaggcucgcaaaguucgggcggccaggcugcggcugcugcugccuccucuaggcgcgcgcgcucuguaaacucggcguccuucgcugagcccuggccucggccucgcaccugccagauccaugcccgacggcgcggugggcagggguggccgcggggguggagggaaaaauccggacugccacuaagcacagugcucacaaaaagcaagucuuguguagacugaauuuuaugaaaacuuaagacauggcauauguaagaacgaacucugaagccuuaauuaaucaaggacuggaaacugcgaaauaguccuauuauuagagaaaaaggagaaaagcaauuaaauuuaaagcaaaauuuaaaauaagucgugugaaguguuuucuaacaaagccauuucuugguugccgaaguucucucacuacuuagaaguggcuuggauuuuggggaugugggguuggggagggugucuagaauggucucucuccuaauccuuuauuuaaucauccgacaccaauuuccaguacuuuuaacuuccucuuuuagcuaugugagauuaauuaacuauugcuuucuguauuuuuauacucuuaaaaauauccaacacgguugcaugaugcacccaguggucaaaaugaaaccaagcaaaaaaugacaagucuaauuagaaccggccuuuggcaagcggauccucaagcaguaucuguacccuucuugaaguacacugggaguauuagcaacaaaacacaccagaaauaucuggguaaucauccagcaagagauugguagguagagggaaaguugaaacugggaagaaucuggcaguguuuucuuuaauguaauuguugagaaaaaaacuagaguucuuuucuuagguaacuaaacuugaauugugaaucaaaugagaacuacaaaacaagaaauuaacucucuuuuucuuacauauauguagacguuucaaauagaaacauuuaagauuccauuuauaccaguaagaaauaaauaauaauuuacuuuugauuauucugggaacuguguaaucuuuucauacagccagagggugugaggacauauuagcacuguuggcugauaaaagagaacugguauuaguccaauuuaugaggauugccuucuagcauuuauuaugguuucuugcuuagagauaaauuguaaagaggaagaaucuuaaauuguaugauuacauaaaguacggguaaacguacuauaauuuucaugaaauaaaaugcuuauugcug

SEQ ID NO: 14054 - RNA, 1041 nt, Homo sapiens
caguuucuuuggcccuaggugucuggcagugggugggccuacacuucggugugccagggcuuaucagggaggugguauggauagagccugucaaaaaggguccaagugcugcuggucaguuuccaguucuuccacucuucaacuucugcaaaccgauuuuucagaggcaacaugaguugugagacugagcuaacuugccaugagacccugggcaagucucuauggguugagagaauguuggguucaucuuuuaggcuaaaugugaggaagcaaaggaacuugaaaaaaauagagaaggucucaaaauuacaaaacaucuucauucagucacuaacccuucguguucuuucugguagaaggcaggaacacuauuugcccacuuuaagguucauucuccuuaccagcaggagcuaaaaaggcugcuccccaaaacggagaugauacuucccccuuccuugcuugucuagacucaaacuuucuggaacuagcugggaaagagggccagcugucuucucuuuacaaaggaaaaggugucucagcauggcaggaagaacuggagcauaggaggauaaagggcugguuucuuucccuaucaccaacugaaccucaguacccucaucuacgaaauggagaugagacuagcugccuuagcccaucucucagggcccuggcagggcagggaugagagguccaguguuauucugacccagaaacucucuccuggcccucaacucucucauucagggagccuucugggagauucagaaagggguguggaggcugagggaugccuuagggccucuaccuccuuaccucugccaccuggccagggaggggcaggagagugugguguggagcccagugcacugagguucauggccuccucauccuguccaauguuggcccggaugggacaaggaugucauagcuucccucugugaggagggacucccaccuagaagaucugacaauauccuucuugcuccucacuccaaggagguaccaacagccuuuaaagggagagagacagacagcuugaga

SEQ ID NO: 14055 - RNA, 760 nt, Homo sapiens
ugugauggcaggaagguuuuaggaauaagagaggauaagcacuuuugaagugucucuccuugugcugcaugugcuauuuuccuguuguccaaagcaagucacauggucaguccauuuuauaaaugguauaacacagucacuuuuuaaaaguuuuacuaggcaugaacaggauccauuaaggaauaaguaggguuagacagcaugcauuuguaguagauaguauguaauuuauaacuuucucuaguaguaugcaguauuaaaagcuuuaauaaagaugagguuaauuaagguuugauauaaucagagguauauauauaagaaagaacuuuacagcauugcugaaauggaugauuaugaguuuaguugggucuggagguaagagauauuaaaaauguguaaagaacuugggggaagaguucuagggacugaggagaugagaagggcaaguaacagauucagugagucaagaaguagguugaggaaaagagguuuuggucagcaagggauuuucagaauuggaaugcaagggaucugcauauuuauuaaauccaagauggaguagaauuagauaauuaaaacugaaagacagaaacucaugauuccaaggucuuagaaagauucauugcuugaauguuuuaguaaacucaaagaucauuucuagugcugacauucuuugcuucuguaagucugugaugucacagagaugggugaaauggauaugguagaaaaauucugaauuacuuuuugaaaucauugaaca

SEQ ID NO: 14056 - RNA, 862 nt, Homo sapiens
gauauugaacucgaguuggaagaggcgagucuggucucaaaauggagggccaugauccaaaggaaccagagaaguugagaaaacuguuuauugguggucugagcuuugaaacuacagaugauaguuuaagagaacauuuugagaaauggggcacacucacagauugugugguaaugagagacccccaaacaaaacguuccaggggcuuugguuuugugacuuauucuuguguugaagagguggaugcagcaaugugugcuugaccacacaagguugaugggcguguaguggaaccaaagacagcuguuucuagagaggauucuguaaagccuggugcccaucuaacagugaagaaaauuuuuguuggugguauuaaagaagauacagaagaauauaauuugagagacuucuuugaaaaguauggcaaaauugaaaccauagaaguuacggaagacaggcagagugggaaaaagaggauuugcuuuuguaacuuuugaugagcaugauacaguugauaaaauuguuguucagaaauaccacacuauuaaugggcauaauugugaagugaaaaaggcccuuucuaaacaagagaugcagucugcuggaucacagagaggucguggagguggaucuggcaauuuuaugggucgcggaggaaacuuuggaggugguggaggagcuauggugguggaggugguggcagcagagguaguuauggaggaggugaugguggauauaauggauuuggaggugaugguggcaacuauggugugguccugguuauaguaguagagggggcuaugguggugguggaccaggauauggaaaccaaggugguggauaugguggaggugguggagga

SEQ ID NO: 14057 - RNA, 931 nt, Homo sapiens
cgcgccagcuuuccuccaacccuugggugguuauuagugcuuucugacugcagauauuuuauccugcgcccucaagugucuggugcugagcuggaggcugggacgugauccgcgggagagcaaaaccuauugucucugcucgcaaugaguuuccauuccagccagugagguauggggagguagccagugugaaugaguaaacaccaguacauacaaaaggcaguacgauuuugaagaaauaacaaguaggacauaagauggccagggucgccagagaaggcuucagaagaggugacauucaagccaagacaaaaggauagaaaagagcgaaaccaggcaaacaccaggauagagugucccacagagaaaagcaugugcaaaaaaucuaaguugguuuggcauguuaaagcaauugaaggaaggccuggcugggcgcgguggcucacgccuguaaucccagcauuuugggaggcugaggcaggaggauggcuugagcccaggaguucgagaccagccuggacaacaugacgagaccccgucucgaccaaaaauuuaaaagccgggcaccgugacccgugccugugaucccagcuacugggauguucacuugagccuaggagccguaauagcaccacugcacuccugccuaggugacaaugagacugcuucaaaaaaaaaaaaggaaaaaaggccagugacagugagaccagggcugagucaaaugaggggagaauggaaggugaaaaguugagaaagugaggucgguggcagaucaggacuuuugauuauggaaaggaauuugggcuguauucuaacagcaauggaagcccuuuaacuccguucgccugcccccuucauuagggaagaaucuuaagggagaagaaaaggagacguucaagaacugagccuuggugcauacaggccuuuaaaa

SEQ ID NO: 14058 - RNA, 44061 nt, Homo sapiens
uggcaggcggcgcaggcggccgcugccaaaggggaagugaucuggggcuggagcgauggcccggggcuggagcucgcggccgccgccgccgcagccgccgccaccaacgccaacaacaacgugucgggagcagccgcggccgaagccggagcaggggccggagucgcggcuggaguggggccugcgcgugugaguggccgagaguugcccgugccggagaccucaaacuccgggcgggagcgcuuucggucggccgagccgccgucgcccgcggcaccguguccccaaggcccagacagcggggcgggggucuaucaggcgcgggacuggcuucucucaggccgacccuucuagccgggcuccggaucuuccucggccucgggcccccuucacguucaggacggaggccggagaacggugaucaucacacaccccagccggcuuccuggccagggcauuuucucugcggccaagcaguguugggauuguagcugcugggagcccccuccugccgccaccucuccugcaaggaagggacugacgcguucccacuuucuuacucugcaccuccccacucucuucccauucaagaacgaguuucucuucccucuccauuggaaaucuugcuccggagguccgaaacacguauuuuaagcgugcccuuccucaccuccuggagcacccuuagaaguauugccuacuuauccgggcugagaauccuucauuuuugaccuggcuuuuuuuucgcccuuugggagauaaaggucccucuccacccucuacuaacacucugcacccaaggccuuauccuuuggggucaccagcuccuuggccauuucuaugugauuucccccacccaucugaguuccaguuuccucugggcuccaaucuccagucccuggcggaucuggucagucccaccccuaggugggagugaccagggggcucuggcccaggauucccaacccuggaaggcagcuccaaggcaggaagagaauugggcaucggguacgaaccuggcagcucaggagucggggcuccacucaccccacacaaaaagaugaaaaagcgcaaagagcucaaugcauugauugguuuggcuggggacagccggagaaagaagcccaagaaaggcccaagcagucaccgccugcuucgcacugagccucccgacucagacucugaguccagcuccgaagaggaagaggaauucggugugguuggaaaucgcucucgcuuugccaagugaguaguggugaaagguggaaugggaagaaggcaucuccuugcacuaccaaggggccacauugacaggaaggagaaaggaaguccuuaggaagaaaaaaggguguaggccuuggaagucaaagagggaaaaacgguuuuagggagaagguaaguucagauccugaaugaagaauaaguuagagaucugucuuuagguguagaaagaaaagcuccaaaucugagguggaaauguggacuuggagaaugugccaagagcccagggaguccuaaagaagcaaagaauggagacagaggagcagagaagcuuuggggacuagacuuuuuaaaacaguguagaacaaaggagaagcagagacuuuaagacugcagauuauuucguuuuugcacucuugaugagucugaauauuggugguggggaaauauggugagagauauacuguaggaaguaugagccuugagaguagguggggucggggggcaaaagaagaggcaucauuuucccuagccauucauagguggagagaccacuaggcaaaucaaguaguaagauuugaggacauugggauuggggcucaggaugggaaaggacuaaagggaacuucaaaaacguccuuugacucucucagagcacacuaaaagaaaagaggauucugcugaggauguagaaacaauggcuaggcagaaggucggggugcugacauugagugguugguugguuuaaaaugucuuguuuuguuaaaggaagaguuugauuucuaaugagcuuugucagcuaaggcuguuaagggcaauccuggguuuggguuaugaagaucaguugaaguguuaccuucaucagaagguaccuggaguaguaacccuacuaaguuaguuuagaccuugaagguugguugauguuuugugugaaauccagccccuucuauguuuccuuacuucugagccaauaagcuagaauacaccagguguccacuuaaaacuacagauccuguuucuuucauuucuuuugcaguaaaacuugcucaaaaguuuauaaaguuucaguaaacuggagcaagguuccccggagugaguauguauuucagagagaaaucaauaggcaaauuccagugcagagauggaauugcagagaaacauuggucuuuacacuuuugugaccugagcuuguauucaaagaccucccuccugauaaugacagcugcagugccuuuagguucuuccuuuuaccugcaggaacuccuucuguuuuaugugacauuugaaaccuuuguauccaguagaugaacccuuaauaggucauauuauuuauucauuuaagugcuuuacccugccuccccugguuaauucacugguuauucauuuaaaggagauaauugcauggcaaaacguguacuauugcuaauaaagcuauacccauaaucacuuuuguacucaugguugaauuuguccucuugagcaggggagacuauuuacgaugcugcaagaucuguuauccgcucugugguuuugucauccuugcugccuguguuguggccuguguuggcuugguguggaugcagguugcucucaaggaggaucuggaugcccucaaggaaaaauuucgaacaaguaaguaagugguuacucucuuuuuuuuuuuuuuuuuuuuuuuuuugagacagggucuugcucugucgccuaggcuggaguacaguggcgcaaucucggcucacugcaacauccgccacccagguucaagugauucucauggucagccuucugaguaacugggauuacaggugugugccaccacacccagcuaauuuuuuugucuuuuuaguagagacgggguuucaccauguuggccaggcuggucucaaacuacugaccucaggugguccaccuaccucggccucccaaagugccaggauuacaggcgugagccaccacacccagcaguggucacucuuuucaggguguaauccuggacuccuuuccagguucugggacaaagucaacccugcugaacgaagauuuuugcccauucuagugaagcaauuauacguuccucucaguauuuuuauacucuuuuugagcucucugcuugaauguuguaacacuuauuuguuuuuaaacucacaaauaaaaggcagugcuuaugcaccagcaggacaaguagcaucugaaauaauggcauugcagucaaugcuuagcgugcaaaaggcaagagacuccuacccuagggguaggagucuagaacuugguguaaccucuacuuauggcuugcaucuccccaagcauaaaguggcaaugacaacacugggcuauuccuuccaccucacagggccauuugagaaagaaugugggagcaucugucaaacgauugccucuuuagaaggacugaauaggagcauaggaaugggcaauaauaagaguagcuaacauuuguggaaggccuacucugugccaagucucaaaucauuuucuuuacaaaauaauccggugagauggguauuauuuuuauuauuuugugcucuuagaaggauuaaguaauuuguucagugauuaaguaugacagagcugagcguccucuugccccuugcugcccaaauucacauuuauaacacuacugucugcaccacuguuccugguggccuuguaagccuaugcacauuucuucaagugccuacagaucucuuugauaucaacuuggucaguaaucuaaaagaaguuuaguagaagaaacaggaagaacugguuuucugcauacuuaucaguuuucaagcuuagagcaaggacugauagauuucucuccuuagcugugcuuauacuaguaacacgaucucuuucaagaaaaaaacauuuaaauaccauuaaugaguguuaucauuuuaaaguuuuaggaaacuugaacuaaguuacauacucgugaagggcuuacaacaaccauaccuacuuugaacacugugcaacugucagaaauguuuaucucaugagugaguuuuaaaguuuaaggagguuuugaagucacagaguuuuguauauucuaaauuguaaaguuauauuuuacacauccaaauuacuuuuucauuucuuuuucuuucuuguuuuuuuuuuuuuuugagauaaggucuugcuugcucugucacccaagcuggagugcaguggcaucuggcucguugcagccuugacuucaugggcucaagcagucuucccgugucagcaccccacacccccaaucccaauagcugaaacuacaggcacgcgccacccucugcuaauuuuuguauguuuguaaaagacaggguuuugcuauguugcccagacuggucucgaacuccugggcucaagugaucugccugccucagccucccgaagugcuggaauuacaacuuugagccauugugcucggcccaaauuacuuuuuccaaaagguauguuugcauaauagcuuugaccgaauuuaacauagaauuuuuuuuuuuuuuuuuuuuagcaacacugaaacuuuuggcucuagguuuaaggguuaaucuucuaagcaaaggaaccaguuucaacuuaaucacaaauacccuaaccuuaauagcaugagcacaccaggaaacugaccacaaggcuuucucaaggucauaaagaaaucuggcuccagaacuggaauuaaaguucuuacuuucgaucuuaagccuagauuacaguauccucacuuucccaucugaagccuagaagauugcaauaucccaacuucucuuggcugccuacaguuacucaaguuuugaacccagccuaagaacagcuaauuuuuaguguguuaaugauguuucuagugauguugcuuaaaaaaaaaauacugacuuugguuuucuucugaguuucugauucuggggcuggggauucaguaugccacaauucucugccagaauccuaaccuggauuaccaauuuuuagaguaugauauaagaaacaaugagauauauaccccauauuuauuuuuccuccuuuauaguuguccuugcaguauuguacagugucucugaggccaauuuuuccuuuguaaguaguaagcauaacuuggaaauuagguucucagaaacaguguucaaccauaaguaaccacugaagacaccugucugugccgucaucucucuguaguuaauugggucuccuaacuacagcccuguaguuaguuaggcuuguaguucagcuauaggcuugugcuguagcuuguuuugaucacauauagcaauuauuuauuuauauauuucaaaacauugcucaauucaccuauccagggauuccuuuuucugacugcucuguaccuguguuuacaggauacuuauguaauuuauagcuuagcugagcuuuucagguaauuucuuugggaaugcaaauaaaguacuacauuuuaaaaauguaguacuuguacauauaauagaccuggcaaucagucaacaaauauuuauugaacacuuguuaauaccaaucccuggaaauacuauauugucuucaggagaugucaagaauuauacccuggacugcggacccugcuuucuaccauugagccacauuccccugggacccuaacuacauuugucagccagcugaaugaagcagauuuggaauugucaguccagcuguuuuguuggcuuugauucgcuacaauagaaaugccagcaccugcaaugucuuccugacauugcaaagcaggacuuccugagggaggguagggaaugggguguagucaguccauaggcuaaaccaucauagacuacuuaggaguuauuuugugagaaccaauaucuugacuaaauggaaccaaucuuguuagguuuaaauaaucuuucuuugaauuaugcuucuacuuuaaaaaaaaaauuuuuuuuuuuugguugguugguugguuguuuuugagauggaguuuugcucuuguuaccaaggcuggagugcaauggcaugaucucggcucacugcaaccucuaacucccagguucaagugauucuccuaccacagccuccugaguagcugggaauuacaggcgcaugccaccacaugcagcuaauuuuuuguauuuuuuuuuaguagagacaggguuucaccuuguuggccaggcuggucucgaacuccugaccucagguaauucacucuucucggccucccaaagugcugggauuacaggccugagccaccacgcccugccuaaauauauuuuuuaagguuaauuuuuuuuucuuguuuuucaagaagacagugggauucacgaacuuggauaagaccaccugcuugucuggcuuuaauaccuuuuugagaaauccagaacuucuugauuuuauuucuauaaauuuuccaagacacuugcaaggaaaggaaggauugcuaaaauaccugaaauagaaagcaaagcagauaggcuuggccuuuuuuuuucuuuuuuuuuucucgucaaagagaaacuugauccuuaagcuaaaaguacugacuggcccugaaacucuuagcucaguauucuuuuuuccaaaaccagauacuucaaaaaaccuccacaguuauucuaaggaagauucuauucucaaccauccuuuucugucacuccacuaugaaagacuugaguaaaugaaaagaaauuuggaaaaguauaaauaaaucaggcaccuccuuuucuggccauacagacaaaguagugacuuggucauuuagcacagaaguuaaagauggucuugugcuaacgagggcauuagggaauauagguaucugugaccucuaaaguauacuagaaaaaguacugguccuaggagcagaagguuugacuuuuugaauucuggcuuugcaaaacuagcuguaaaacuuagacaagucacuuauucuuucugggccuucacuuucucaucuauaaaacauaaagauguauuugugcuaccaaagcacuuugggcauuccucugucauaacaucggucacacuguauaguaauucugugaccgugccuggcuccccacuagacuaagagcuucagggucuuuuguauauacuagugccggugcagggauggacacauggugggggcuuaauaacaaguuguugaauaauuaauacauaaaaguuuauugcaaacuggaaagacauuguauaaauauaaaauauugcugucagcaauauguuuacuauuugagugguauauguuuacauuuuuccauuuccucaucuuaaagauuaggaaaucaaaagaacuagguaaauucuuuugagcauuaacauacaaaauuuuaaguuguuugcuuccuuuguuggaaaaacaugaauuaguaaucagaaguuguuuguuugcuacacuuccucccauuuauguaauaaaaguaccucuacuugacuugucucuccuaaaaagcuccaaaccagauaaucauugugauccccucuuggcucauagaguccucaggauccagaauauuuucagggcuggucagcuuuauguguuucuuaguuaauaauuguaacccagguuauuuauguauuugucuauuuccucuuccacuccuaccuccuaguucaugcguauagacugcaggaaagagagacuucgccccuugccccuucgggguaccugaguauggcagauguuuguuggaugaguuuuucuuuauaaccuaacugaaaauguauaggaaauucagugaaaugaauuuagacuggcugguaaaauguuucuacuguaugagauagauagauuccuguaaaccauguguaaaucaagugcuacauuaaaagcaccugcugggaacuacugggcaaaaggaaaucaguauguggaagaaacauccacacccccauguuuauuauagcauuauucacaauagccaauauauggaaucaaccuagguguccaacagcagauggaugaagaaaauguaguauauauacacaguagaauacuauucagccauaaaaagagugaaauccugucauucucagcaauauggauggaacugaaggacguuguuaagugaaaugagcugggaacggaaaguuaaacacugcauguucucacucauauguggaagauaagaaaaguuuaucucacuggguaugguaacucacgccuguaaucccaacaacuaaggaggcugaggcagaaggaucacuugagcccagggguuugagaccagcccagggaagcauagcaagacaccaucucuaaaaaaauuaaaaauagcugggcgugguggcacaagcuuguagucccagcuacucaggaggcugaggcagaaggaucgccugagcccaggaguuugaagcugcagugagcuaugaucaugccacugccuuccagccuagguaacagagaucucaugucuaaacaaaauaaaaauauauuucaaaaaaaucugauucuauagaaguaaaaaauacaacagaggauacuagagacugagaagaauaggggaagaagggauagggagagauugguuaaaggaugaaaaauuacagcuagauaggaggagaaaguucuaguguuauguaccacuguagcaugacuagaguuaacacuagauaguuccaaauagcuauaaggaggauaucaaauauucccgacacaaagaaaugauaaauguuugagaugauggauaugcuaauuacucugaucacuauacauuacauguauggaaacauugcuguguacccuguaaauauguacaauuaccauauaucaauuuuuuuuuaauuuuaaagcauguaggaagucugucauuauaaugaagcccuuuggcaaacauuuuuggaaaaugaauaaauauaucucauuucuuuuaauuauucugaauuuucaguaguaagcuugcuuaaaauaaggauaccaccaucacuccucauuuugugggggaucuuguuaaauguguuuggguuuuuuauuugguuuuguuuguuuguuuguuuguuuuugagauggagucucgcuccggccgcacaggcuggagugcgguggcaagaucuuggcucaacacaaccuccaccucccagguucaaaugauucuccuuccucagccucccgaguaacugggauuacaggcaugccccaccacgccuggcuaauuuuuguauuuuuaguagagacaggguuuugccauguugaccaggcuggucucaaacuccucaccucaggugauccacccaccucagccucccaaagugcuaggauuacaggugugagccaccgcacccagccuggguuauuuguugaggguuuuuuuuguuuaacuuaauaguauaacauuaacuccauuucauacccugcaauuauuucacagaacaagcauuugaacccuucugaguaccuggcucugugcuggcugcuggaaaugcauacccaaguuagaucuagucuuuguccucaagcaucucaccauuugguagaggagaccgaugaguaaaguuacaguaccacguguuaagugcaugguagaauuuggagugaaaagaggugcagugguccgaguguccuggcuguuggugcugaaucuuagaaggaaugaacuaggccaaagugguagaaauaaagaagagacaagccaagggcaucuaggcaaaaaccauagcaugugcaagggucaugaggcuucaaagguuagugugucaggaagaucagcuuggccacaaguagguugaagagguagguaaagugaugagaaauguaauuggaaguuaagcaaaggugaaauauuuauucaggugauaaauauugauugagugcuuaaaauuuuaauuuuaauuaacauuuuaaugugucaggaguguucuaaguguagaagugaacaaaauagcacaugaacaaaugaacaaaauguagcugaccauguagaaaugaacaaaauagucuuggagcuuacauuuuaggaaguuauuuuauaugggucuuuuaugccaguuuuuaguuuuaaggaagcauauaauaacuaaggcggucuguggcuuuaaaaaaaaaaaaaggauguagguuuuauucuggaggaccagccauuauuaauauuuuauuuucuaugaaaagggaaaaugcucuuuaaagaaagaagagaaagcauuguuucaggccucugccuucaggcuggcaaaucccuaaaccauucaggagcuauuguuucccaaaagaaaggccaaauaucauacuauacuucaccuagcauauucuuuuaucuucuauuucauuuugaguuuuggggugauuuaagacuuaagaaaauacuguuuacuacuuaugaaaaagauuaaaaaucuuagcccucguaacagcauucgaaaggugguaaaaccucccccuugcaguugacuaagguagaaaaagauuuaagcauuuagaaauauaacuuauaaucucaccuugggcauuaauggaguagauuuauaaaucuuaauugacuaaucuaaaagcuccuuaauugagcuggucaguacuuagcauuuaucaucuaugaccagcugucuuaagugcuuugcagccauucucucacuuaauauuaacaguccugugaaaguauauuuuaucgcuguauuacagaugaggaaacugagcucuaagaauuugaguaauuugcucaagaucauagugagucacaaaauugagauucaaagccaacucuuucugcucacauucuguuaugauuuuuaguuggcuaacuuuuaaaaguugcauugccagcagugaaauagccccaguuaaaaugggagcuuuagugugaaagauauauauuuacauaaauaaaagaacaaugucagaauuaacuuuuauuaauccaucuucuuuccuacuguuugaugauuuuuucaucuuaggaccaugagggcacuuuaugcuaguuaugauuguucuuauuuugucuuuuuaguggaaucuaaucagaaaagcucauuccaagaaauccccaaacuuaaugaagaacuacucagcaagcaaaaacaacuugagaagauugaaucuggagagauggguuugaacaaagucuggauaaacaucacagaaaugaauaagcagguacuaaaaguuugauuuuugcuguguaagcuaugaauauuuguuugguuguuuaguaugaauaggauauagagaauuguagguauagggaauucauuucaguuuguuuuacuuuuugaaaugggguuuugcauacuguaaucccagcauguuaaagucagguaaaauaguuaugcauuuaccagauauuuaaaauguuaauccuuucugcaaaagaaaauaauucuacuaaauacagcaguugagagaaaguuggaaguuucuugaaucacccuuuccuacauaguagaauaggugucagauaaaaaaggagugucaucuaacccccaagaaaaguagauaacccauuuuuauuagcuaaugagagcuuauuucauuugaguuuacaaaaucuggaaaucaucaacaguagucauucuaagaauagcuuaggagugggugauggaguugguuaaauaccuuggucagucaaauaagccuaauacaacauaaacuuuuccagucccuaaauugaccagaguugaguaggcauugauuccagaagugggacucugccagagaauaaaggcuuauucuaaggauguugaucaagcaucuuguauguauaaggauaccauauuugucacaggguaacuauagccccaucccuacuuuuuccauuuaguuaggaaauguauauguguagaaaagaaaagucaaguaccagaugaaugacacacaugcaaagugcuuaaaaauagauauuauuuuucuuggggcugagaagguauugucuuguucagaguagaaucacaaaguucagaaugagccaguagugacaaggagugcugugcuagaagaaagugcuugcaaauguaucugaagccacaccuuucagcaaugguccaggaguggggcaguucagcacuuaagaccaaugauaaauaguguggggcagugacuuccaaacuuuugccuggaaccugcaguaaaaaauguuuuacaucauuacccaguaaacgcauacauaccuauuuguaacugacauaaacguuucugaaacaguagcucacucuuaauguguauggugccuuaugacacuuuccauucaguucuauuuaaucuuucaaaauuauucaugaaauaauucaugaguuacagccgucuaguauuuacccucuguccuuuaccuuuggacucuaaguaauuagagaaaagcagguauucaccccuuuuuugcaaaaaggaugggagaaauuggccuugccuaaauucacacagcaaauuacaucaggugaaaguagaccacauugaagcacugaaagauaaucagcaucucuccuggggcaaacuggggauuccauauagguagccagccaugcaguuuaccauucugagaggaggaugauaccguucagcaugaaaaggcaaagucagcuaucuauuuuucaucucguucuuguaaacugacauuauaggaagagucaaaggggauauugguacauggugggagaaaacacauagauuuucaaaucuuugguacauauguugguuucugaguucucuuuaaccaggaagcuagacacaaaguaaucauuuuauucuuagccugccauuauuuuuaaugcaagaagcaccugagaaggcagauacaguaaaucucaaugucauugauagguuuuuggaaacuguaaacuuaaguaaauggcauauaaugaaaccaguuuuaucauaggcuaauuaauauaaagaagacuuaaggucaggugugguggcucacaccuguaaucccaacacuuugggaggccaaggugggagaaucacuugauccaaggaguuccagaucagccugggcaacaaagcaagacccugucucuagaaaaaaauaaaaauaauuagccgggcaugguggcguacaccuuuagucccaguaacugaggagucugcagcaggaggauugcuugagccuuugaguuugaagcugcagugagcuguaaucgugucacugcacucuagccugggcaacagagcaagacccugucucaaaaaaaagaaaaaaaaaguuaaauuccuagggcacauuucuggccacaaaaaaaaaucacuacacuucuagauaaagaccaaaacacaucuaguauucaacauugaaauaaacgugagcgauacauacauuuacaaaagaugaauaaaagcaaguaaaauauuuauccguuuauuucagcgcaggaucgggucaugaguggccagagccuauccugcuuaggguacaaagcaggaaacagcccuggacaggacgccacccccaucgcagggcuuacucauacacacgcucacacucagacugggacuguuuacacaugccagcuaaccuaacaugcacaguuuugugaugugggaguaccuggagaaaacccaugccaacaugaggagaacaugcaaacagacaguggccccagccaggagucagauuuuuuucccaucaacguuauaaccaaaugacauuggacaaaauauuauucaagaaccugcuauaaauaggaaaguuugcuucuguccuagggcuucaucuaugaaacuggaagagauugcagugaaacccuuuccauuucagcaucaauaugccuucaaagaugcugggacugacuuaugaagccagccugauaacagaggacuucaccaugagcgcaggcccagagcauuggugaugggaaagcagagacuuguguuguuuccuaagggagcucagcacucucugucugagugguuuucuaaaauuaauguuacacaucucugauggucuguugaagucagaggcaucuguccuaaaccaaaguagguagaaaaauuaaaguaauauuuaacuauguuuccauaucuaaacauaacugucacuuaagaugcuuuuaguggcaguuguuuuagaagcaauucaaacuggcucaaacaagaaguguuauuauaucacuuaacgagaacuguucuuaucacaauguaaguugaaguuaauauaaucugaaaaaaaagccauuaguuugaaaaaaaaaaaaguuaaaaucaaaucuucccuugaaaaagcuuuaaauuaguaguugaaaucuaauuuacuuuucuguuuuauucaugaaaccucugguuuuauacucauucccucuugacuguuauagggagucuccuuccuugaagacauuauucaacaauuaccuagcugcuuuuauggagcuaggcuuuggauucugucuaaauccauucgggcugcuauaacaaaauaucguagacuacguaacuuaaaaacaacaggggcugggaaguccaagauaaggcaccagcagauuuggugucugguggaggcucauuauuucauacauggcacuuucuuguuguguccucacauggcagaacagaaugggcaaacaagcucucugaccuuuuuuuuuuuuuuuuuuuuuugagacacaaucucacugugucacccaggcuggggugcagugaugcaaucacagcucacugugcagccucgaccucccaggcucgagugauccucccaccucagucucuggaguagcugggacuacaggcacgcaccaccauaucuggcuaauuuuuuuucuuucucuuucucucucuuuuuucuuuuuuauagagacagggucucacuauuucccaggcuaguugcaaacuccuggaaucaagugauccucccaccuuagccucccaaagugcugggauuacacaugugagccacugcccccaguucccucaaggaucuuauaaucagauggaggaaauagaaaaguaaacaguuguaaagcagccugauaagcaaaaagaaauagguccaaaugaguauugugagggcauuuuuaaguauguaucucaccuagauuggagccaggugagauuuccuagagaucuugaacugaguccugaagggcaaauaggaguuggccagcugaauucuacagaaagagagaagaauauuuuagguagaacauuagugcaguugauccucauaauuuaucaauucuguacuugguaaauuuauuuguaaucucaaaaucuauacuuguggcacuuuugcagucauucaucaacacaugcagagcagcaaggaauuugagucacccagcaugcauauauacagcugaguuugaacaaggugacaugcugccuucuugguucagcucucauacuguaaacagugucuuuuucacaauauauuuaaugccauauuuuuuauauuuuugugcuguuuuuggugauuuccauguucaaaaaugucccucagccauagugcuaauguguugucuauuguuccaaagugcagggagacugugauguucccuauggaaaaaauacauguguuagauaggcuucuuucaggcaugaguuaugguucugcuggcuguggguucaaugcuaaugagucaacaauaugcauuaaauaagaugucuuuaaacagaaauacauauacaacaagguuauguauuguauugaucaguuuaaaaaaauugagcaggccgggcacaguggcuuaugccuauaaucccagcacuuugggaggccgagguggguggaucacgaggucaggaguucgagaccagccuggccaacauggugaaaccuugucucuacuaaaaauacaaaaauuagccaggcgugguggcgagcaccuguaaucccagcuaccugggaggcuaaagcaggagaaucacuugaacccgggaggcagagguugcagugagcugagaucgugccauugcacuccagccugggcgacaagagcaagacucugucucaaaaaaaaaaaaaguacgagcagaggacucacaggaaccuaaccuguguuuccccaaggaacaguuguucaauauucacuaauugaauguuuuguugcaaguuuucuagaacauaacuaccacuaauaaugagaauugacuauaugugcaaaaguauagaugaaugaaaacaugguguguucagggaauuuuagucacucauuauagcuacaguaugguuugguaaaaaaggccagagauaaguaagucagcaagagccguaucaagaaggaccuugagugcccuucuccuauaguacucuguguagcucucuuuuagcacucaguccaaauaccuuaugugaugcuuauuugcauauacuucuaauugcacuagaaaguuguacacuguacucuaagccuuaagcaugaugauaaagaaaacgauggcaaugaugaugauaacgaugaugguauugacgauaacugccauucauuaaaugcuuucuuugugccagccauuauuaggugcacugcacaugugaucuccuuucuuggcuucuacaguccuaugaaguaggagguguucucuccauuuuacaguuaagaacacugagguucaaagaaguuaaguagcuuguccacagucacucagcuguguagcaauacuaaaaguaaaauauucaaguccuggaagccucucuucuuuccagcuucccaugcugcguuacaucuugguagccccuguaggauucaguaggugcucaguagauaaagcugaaaggauaugaugcugagucccugcuaggacuaauaaucacucaucauugaugauugucuguuuuaauaacuuuuucuuuacuauuuaaaggacacuuaacuucaaccccaaagcaaaaaagcagcauuuccaacuucauaguauaaaaugauguauuaagcaaauggucuacuguagcuauuuuuaauuuuucuaaugaaaagucauguaauaugcauaaaagucaugacucaucuuuuggcuggaauauggauuuuucuuaauggguucuauuuaauucaacuuuuuagacucugaauuccaaagugugacuuuucuaaugccugaaucugaucugacauucuagaaugcaucuguuagaggccagagcaauuccagagaaaguaaugggagggugccucaucuccauuuuaguuacauauauaagcuuugcuauagcuuuccacagauguuggcauuauuuuacugaagagagaaaugcuagaagacggaauccagcuuuguaauuuauggguuaaauagccaaguccuagggaacagugggugauccagguuuuauaagugaguaagaagaccuaagugauguuugguaccuggaaaguuaauggucagcucuccagagcaugcuuuugcagugaggcagcugauacacuaggcauagaguguuugcagcacagagaaaagugcagcagcaccucacucgauccugcuggcauuggcuuucagcugcuucuuaacuuugggugaaacggcagcugccaaccagucacacuggcuuuuugugagaccacuaccauucccgagauacuucugauuagccaugcacucugccauagccucaggagguuggaacuuucaguaccuggaagaagaguuuuuacccaaagaacagcuucuuccuuuaggaucuggccaguugucaguggaggaagguguuuguccccucagguggcugaaagguaacuacauaauugauaagaguauuaggaauaacuauagucuugcccuucaaacugaucuugaaccaacuguguacauacuuuggggcacuaaggaaaacauaccuggggcaggaacccuuccuagcauuuuaugauugggcauguuacaguggucucagaaagccccgugagggcauggaagaaagggucagccaagaaaacccaucaaacccuuugcaaaguuauguggcgucuuuuuccuguguguguauuucuuucucaucuuuugucuuuuuaaaaauuucuuaaguaauuugugaguggauucuuauauaagguuuaaacuauaaaacacauacagaaauccuaugaaaauuuuccuucaauucccaucucuguguucccaucucacaugcacacacacacacacacacacacacucacucacucucucucucucucucucucucaugcccccauagguguccagucaguaaugugggcuucauccuccuaguucucuauuuacaaaaucauaauaguuuuuaguaugaauuagccuauggguuaacaugcguguguguuuguaaauaaauaaggucauucaauauauguucugcagcuugcuuuuccacugaauauaugcacauucuuagugauauacauuuaaauuguuucuaguauuuugcuguuacaaauaaggaaaaauuauuuuaaaaaauauaucauguacaugagcuauuuuauaagauuucuagacaugaaauugcuaaaauaaagaauauaaacauuucaaauuuugauggauauuccuagauaaacuucuuacaagucuucucuaauuuauacucccauaagcagagcaugaaaaugccuguuucuauauguccuuuucaaaccuggauaucauucauaucuuuuuaaaggcaugagugaaaaccuccuuaauguaauugcuucucuuaggaaguuuaugguuugcugagaguaucucuguggacugagguuucucacccaucuuguuuuuaaaugaacagaguuacaauguugaugauuagucugguuauucuggaguccuuauguagaauugcauguuuuagugcuuauuaauuucacuauuaaagaacugucacuuauuugauauuucaucuguaccagguacuaugcuaagagcuuugauuauaugucucauuuaauucucauagccuguauugaucaucuguuccuugguuacaaauuaccccaaaacuuaguggccuaaaacaacagucauuuaguaucuuacgguuucuauaugucaggaauuugggagcagcuuagcagacugguucuggccaagaucucuaagguugcaauuaagaugucauccgggucuuuauaaccuggaggucugacuggggcuggagguuccucacucacauggcuuuugguaggaggccucaguuccucccaacauggacuugucauucuggggcuacucgaguguccucacagcauggcagcucccuuccccagagugacuaauccaaggagagcaaagaagaaggcauaggaccuuuugugaccuaauuucuaaaguugccaguugucacuuccacuuuauucucuucuguagaagcaaguuacuuaugucaggcuacacucuagggaaggggaaguagguuucaccucuugaagggaagaagacuaucaaagaauuuguagacauauuuugaaaccaucacguauccuuauaagauaguuguuaaauaguuguuguuguuauuauuauuauacccaguuacugaugaaaagaauaaauucacuacuuaucuagccuuaucuccuaccccccggccucugucuucuacucugcuuagacuagccuucucaauguccaucccagacacagaguguuaauucucagccauucauucaacaaaugccagucuuuguaucacggguauuguggaaaguaaaagagacaugguccuugaucauguggagcuuauagucuuguggaagagagaaaccucaaucaaauaaccaccuaaacaaaucauugucacuuugagaagugcuaugaaaagaaaguacuccugagccuguucauacuguguucccuaucccccgaugccacccucacccuucuaaccuagaaagaaugccugcuugguuuuuauguauaaaauucuaacuucucugucagaguccaauuugaguccuccuucagcgaagccuguuucuuucagcuugcauugauauccuuuucucagaacuuuauucaguaucacguuuaaugcuuaauuguuucuuuaauguacucuugccuugucucucaguuauauugaaagcuccuugaggugagagaccuaagaguuucccuuaauucuucuaucuuccccacuguuaacacccagucccagcaaaucguaucaucucuacuucugcuacuaccucuacuaccacucaagucuaaaccaccauuaucucuugccgagacuacacagaucuccuucuuacuggucucuccauuucuacugacagccauaguagucuuccuccaaggugucuccauucauguaauuauccugcuuacacaccccugccuaucacaccucaaguaaaacccaugugcuuguucugguuuacagaguccugucuguucuggcacuuuacugcacaacuggccucaccaccuacuuugucucucugucucucucacauacacacacacauuaugagauccugccaccuaaacuucuguucucugaauaugccaagcucuuuccuguacugggacuuuuggucuagcaguucccucuucccugaaauaggcuucauccaaucuucauaugauuaauucuuucuuacuauucagaucucaguuuaaauuuuaucuccuuacagaggccuccucagaccgaucagucuaaaaguugcuacccagucacuccugucaaguuacuuuauuuuaauuuuuuucuagugcuucccacuaucugauauuuuucuauauaaaagugucugucugcuugcacuaaaauguaaacaccacaggaucccugacaucuguguuguucaccaguggugaauaauaggguccaguaguauuuguuuuauuagugaguggcugaaaauucaucuuaagccucugaacuuuugccuucuaaaagaaaagagggaaaagagaacuugaguucccgaguucccaggcuccuuaccagacucccugucucagaccaagcuacuacuacuuacucagggagcuuuguuuaaauuaaauucuuugcauagccggacaugguggcucaugccuguaaucccagcacuuugggagaccaaggcagguggaucacuuaaggccaggaguucaagaccagccuggccaacauggcgaaaccccuaucuuuacuaaaaaugcaaaaauuugccagguguaggggcaugcaccuguaaucccggcuacucaggaggcugaggcacgagaaucacuugaacccaggaggcagaggcugcggugagccaagaucacugcacuguacuccagccugggcaacagagcaagacugucucaaaaaaaaaaaaaaaaagagagagagagaaaggaaaaaauucuuagcacaguacuuauuacaaucugauuucuuuucuuuguuuuucugucaccuuuuacuaggauguaugcuccaugagagcagagcuucauggucuuguuugccucucugcugucuccacaaugacugcagcagugucuggcacagagaugccaaacauuugcuaaaggaaugaguagggaaucagguucuguuuugucuuacaccccccagugccuaccacugugcuuggcccauaacaagugcccagaaacugguggguacucugaggccacucugaauauaauugcuauugguagaucuguguucucauccuagaauuuagaaugggaaagcgguuuagaacuaagagucuuucaaguguuucgagccaaacugcaaagcuuuuagaauauugucucugcagccugaaacugacuauuacacagguucccccaguucccauucaagagcgaagucuagauguuuagaauucuaugccuaaauagcagaacggaagccucauuuuauuuugauuaaauuccuauuuuaauacauacauugcaucagucagugagucagugaguauuuauugagccccuucaggauacaaaguagugcucugguagagcuauugaguuugaaauauuagucacauuuuuaaaccaaaaccaaauccccaaguaguugaaagugcuguucaaauugucagagugcaguuccuguagacuguauuuugugagaugggcuuuuacuuuauauguucccacuugggcaggaacaaaaguuugguaaauuacugagguauuacauuuuaccaaaaugaaauuuugaagugauccuucaucauuagcuuucuuccuguccaauuguugagggagugugugauaauuacagcaucuuuugaguaauuuaagauuuugggaucuugugcugccaggacaggguaaagaauaacacuugccuucacucuuugacacuaguguucaaauugggcagggaaagaagggguauuauuguugccucccagaucccaacucuauccaaaguacugucuccuuuacuucugugagcugacaggguugcagaaacacauaaaauccuagacuaucuugacaucaccaaccguagaguuugugaagguaacguguccucuacaaauucucauuuguuuucauuguuuguuacucuuuuuuguucagauuucucuguugacuucugcagugaaccaccucaaagccaauguuaagucagcugcagacuugauuagccugccuaccacuguagagggacuucagaagguaggugccauguguggguacagagacuucagaagguaggugccauguguggguacuauuugccauaauucuagcuucuuauaaguuuucauugaaagccuagcauuugaaaucagcugcuccaagagggcaguaauggaguguaucacuguguccuaaagaauucagaacaauuuuguuuuggucugguuaguuaggccuuuaauuugcaacagguuaccucagcugugauuuauauggguucauaccuuuuuauuuggcucucugagucccagaauugcucugcuggcacucuuguguuagcauauauggguucgcuuuucagcuugcuuuuucaguucaccacucacaauaucuucaucaaagcagaccaauuguacaugauaguuacccuaaaucucuguuacuuuccauaauuaagaaaguuaaaaaaaaaaaaaaaagaugaccuggggaaaugcaaaaauuaaaaauucaggaaacaaguguuggcaaggauauguggaacgaaggaaauuuucaaacacuccugcuccugcuaggaguauuaauugguaaaaaucacuuuggaggcugggcaugguagcucaugacuguaaucccaacguuuugggaggcugagccaggaggaucacuugaacccaggaauuacagaccagccugggcaacauagggagaccucgucuuuacaaaaaauuuuaaaguuagcugggcaugguggcacacaacuguagucccagcuacaugggaggcugaaguaggaagaucacuugagccugggagguugaggcuacagugagcugugaccaaccagaugaauaguacucagggauccuuagagauggacgggaagaguggauagggguaggaaggcagaagaggugccuaauucgaacauaaagaacaucauccccugacacaggaaauggaagaagggauuccccaaacgguggauaucaaaucuaggaucuuugaauuauaaaaauaugugcuaaguuuggucagauuaugugccagggucuaugagcauaugaauucuuuccacaaaggagcaagaaauuucuaagccauaagcgaagacaaaauuugcuauuuuauagccacaccaucugugugugcucagucuccauaauuugcuacuuguccaauguggccaucuacuuacaaauucggggggaaaaaaaagggguagggacaacucugaugaggccagauucuugccguuguuccuagggccaauucaggaaaugauaggcuucuguagccauuaguacagaagcagcucucacagucuugcauuagaaaaggaaacugguuuauucuuuuuuuuauuacacuuuaaguucuaggguacaugugcacaacgugcagguuuguuacguauguauauaugugccauguuggugugcugcacccauuaacucaucauuuacauuagguauaucuccuaaugcuaucccuccccccaccccaaaacaggccccggugugugauguuccccuuccuguguccaaguguucucauuguucaauucccaccuaugagugagaacaugcaguguuugguuuuuuguccuugcaauaguuugcugagaaugaugguuuccagcuucauccaugucccuacaaagaacaugaacucaucauuuuuuauggcugcauaguauuccaugguguauaucugccauguuuucuuaaucuagucuaucacugauggacauuuggguugguuccaagucuuugcuauugugaauagugccgcaauaaacauaagugugcgugugucuuuauagcaacaugauuuauaauccuuuggguauauacccaguaacgggauggcugggucaaaugguauuucuaguucuagauccuugaggaaucuccacacugucuuccacaaugguugaacuaguuuacagucccaccaacaguguaaaaguguuccuauuucuccacauccucuccagcaccuguuguuuccugauuuuuaaugaucaccauucuaacuggugugagaugguaucucauugugguuuugauuugcauuucugugauggccagugaugaugagcauuuuuucaugugucuguuggcugcauaaaugucuucuuuugagaagugucuguucguauccuucacccacuuuuugaugggguuguuugauuuuuucuuguaaauuuguuuaaguucuuuguagauucuggauauuagccguuugucagaugaggagauugcaaaaauuuucuuccauucuguagguugccuguucacucugaugguaguuucuuuugcugugcagaagcucuuuaguuuaguuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaaguauuuaauccaucuugaauuaauuuuuguauaagguguaaggaagggauccaguuucagcuuucuacauauggcuagccaguuuucccagcaccauuuauuaaauagggaauccuuucccauuuuuuguuuuugucagguuugucaaagaucagaugguuguagaugugugguauuauuucugagggcucuguucuguuccauuggucuauaucucuguuuugguaccagaaaaggaaacugguuuauucuugaauuuauucauucaauaaacauuuguggaacuuccuccaguauguaccaggcacuuugcuguugaugggaauacuaguuucagaguuuugcuccagaguucacauggcucugucaguugcuuccuuaggggaaaaaagaaaagaaaaaaaaaauccuuaaacaagagcuuacuaucuucuggcaucccaauggguucauacauccagccagugaggauuggauucacaaacaguaggugucuuugaaugccuguagcuuuugcaacaggcauucagagcuuacauagauagcaacagagcuuacauagauagcaaaccagcuuagauacuuuuacccaguguguugucucuuugcaaaucuguguguuuaucaugccaggcacuguguuucuuucaaguggcucaguuuugaagugguaggucaugccaaauaccuaacuuuauuguaucucauguaauuuuuauuagugucaucucguguucucuuggauucuuggauaucaguguaauaaaaaugaccuugguuaaaaauacuaauguggcacuguaaaacugucagcaugucuugaaaaggccaaaacucacugaauaguaacacccuuuuagauguucccuuaggacaggcuuuuuuuaaaacauggcuucugaauuauaucuccaaguucccuguccacuugggcuuuuuagggcuaaugaaagcaaaguaagccacuacucauaucccuauucagugguugcugacaggauucuacuuuuuuuucaucucugcaguauugaguuucccaaagccagauaugguucccucccacuuuugcucgaaguguccuuugcuccuaacaaguggcagucuacuguguuagcucggccaucugccuucccacagcagggauugacagaggcaguuugugagagaaccuuaucccuggguuccagauuuauaaacuaauauuuuuucuuuagggaagauuugguuuuccucuaggaaaaaucauuuaaauuaagaaaauuacuuguuugauugauagagaaagaguccuguuaauuaucucaguauacacuacauguaaucauaguuugaagauauuugaaauaaucagaaacaccgauuuucauuagggcaguguuucauuagggcaauguaaauuaaaaucacaauauacacuuccauuagaauggcugaaguugaaaagaaugacuguaccaauauugguacaggauuggugaggauauggaguaacaggaacucucauucccugcuggugggaauguaaaauggcauaaccauuuuagaacauuguugggcaguuuuuuaacaagugaagcauagaccugccauaugaucagccauucaccugcuagguauuauggcgauuagaaagcauaugauaaaggggaaugucuauaaguccacaugaagaccugaacacgaauguuuauagcagcuucauuuguaauagucaaauauugaacacagccuaaauguccaugagcagggggagagauaaacugugauagagccacacaauggaaugcugcucggcagccugccaaguagccucaacauggaugaaucccaauucugcugaguagaagcagccacacuuuaaaaagcacuacuugcucacugguucuacuuauauaaaaucuagaaaaugaagacugauuuauugugacagaaaguggaucagugguugccugggaacgaucggcaagggagugauuacagagagucaugaggaaacuuucagaggugaugaguguuuauuaucuugauuguaguacugguuucacaauuguuuaugugucaaaacauucaaauuauacauuuuugaauauguacaguuuauugcaugucaguugucucuuaaagcuuuuuuacaccuuccuauauguuuccauucagaguguagcuuccauuggcaauacuuuaaacagcguccaucuugcuguggaagcacuacagaaaacuguggaugaacacaagaaaacgauggaauuacugcagagugauaugguaaggagacccagcaagucagcaugcuccugcucacccuuuuuuguguaagagucauguugccaacuuuccacuaaucugaaaaggcccugcuaugcaucuguucaaaagaucuaauaagcaguauacauugauuguucuacaauuuguuaauaaagcaauuaugguagauaaaauuaaaagccaaaucuuuugcaaacauaguacuggaggagguaagguaauaagacacaguuccugaggauggaauggguaggacagaaaauggaaaagaaggaaaggaaguggaaaagugucucauuguuuauuacuacauaacaaagcacccccagaaguuuguggcuuaaaacaaguaauuauuucucacuauucugugcaucaggaauuugagcaaggcucuuagacucccaaaugcugaaacaugugcucguggaugaaaggcaggcugucuagcauguuccagcuccagccaggcugucaguuaaaugcagccuacaacacauggaacagcaccacccccaucccucaacccccagcugagcccagucaacccacagaaucaugagaaauacuuaauuguuguuguucuaagccacaaagcuuugggauaauuuguuaggcagcaacagauaacugacagaaucaaaccccugcagugccuaggaauuguuuucaaauaucucuggaucacuuagugcugcugcagauguaagcugucugcagucauuuggaggccuuaaucaaucacuuaaugggugacagccccgugaaggauuuaugaagaguaaaaaaaggauggugcagcccuugccaucuugcuggggagaugaguuauauguaacucaucugaaaucaggacuauucaaggcacacaaaaguucccuagucucucugccaauuucuggaucugcccucccacccccaccugcucuuugcaagcuucagaauuucaaguuuaaauugggaaguuuguaccaaggagaccugggcuauauuagagagcucuagaagagaguuuuuuuccauuuucuucaggacuggcacaccucacuguuacuuaguggggcuaacccagaggaaaaaacauugaucugggugucaagacccuugguucugguucuaacugccgcugaguaacugugugacccauaguaacaaagaccccucuaauucagcaauucuuuuauuauuuuaauaucuugauuaugcucucaaguaauucacuauuuucuaaaauaauuuuuccuaacuaaaaaauuuccugccuucuagaaccauggauuccccccuccuucucuccuccuuuucucuuuauuguugccuuuugguuuucuuauaaaaacaggguugauuucagauuucaaggaaaacaacuuauuuucaccaguugcauucuguuauaauuaaaucuacuucuuuuaaauuuccauagcugccaaugguaauccuccuacugucauucuuugugcuagauaagucauaguuaugggcucugaaggguuaagccaugcaaaguuuuccucacuaaaggaaaaguguauauaaacauguuauacuucagucucuggaaagaaacuugagcagugggaagggaaugggaaaggaaagauaacccucaaacauaagucuuacuuagcauaaugcuauaagggaaaaacuaauaaugcacaugauuggugguuaugcuaaaugcccaagccagugguuacaugacuggcugccuuuuuaaugucaaagcucuugaguccaguggaaacaaugacacugucccagguugagaccgaguuggucccuggaaaguuacagugaugcuauaguuucucugggagcacaggcaauggggcaaaggagaaaugguuucuagagaguucauuccuuuaagagauugagaaauagacuaggaggaucucaguucccuaauguaaucuuggugcugcuggccuagugcaugcucaagcuggguucucucagaaccuagcacaagacugguuagccuguacauucccuggcaauacuuacugauuaaucuguggaugcauucugggggaggcuagaauguucuaggacaaucucagauaguuaaguagaccuaauaauuccuuguugccuacacuaaacuucuuuccucuuaacagaaucagcacuucuugaaggagacuccuggaagcaaccagaucauuccgucaccuucagccacaucagaacuugacaauaaaacccacagugagaauuugaaacaggugcuuuuuaucucuggcuuaacucccugugaccacagugcacugcagaggcagccaaauaguuugggcuuaguguuuggugucucagcaggugcauccuguauuuauuugccugccugggagcugagcagagaggaauguguguugguaucucggggauccauauugcuguccuuucccuucuuuggcacuuugcaguuuuucccugcaugucagucaguggaguaaauuccuuuucuuaucuugaaagacauagaaugagcagauuauccugaaacucuuuaugaaaaaauagcuaucugggcagguuaaagaugaauggauagcuaaguaauccagagugauggcuauuuugagccacaguaaauucuaagaauguuagaaagcauauccuugaaaaucaggauuuucuaaagucuaaagacgaaaaggcaagagggggaaaaaagacuuugaguucagaaucacauuaaagagaauagaggaaaucuucacucagaagaauuccuguccugaguuuaaugcccuuuaaaaccuauaguuaucauucuuuuuaaaguagcaaucaguacuggaggaugucaguaaaaauaauugaaucuuauacuaaacaaugcacuacuuguuaugguauuguuacaugagccaauucaguaaucgguauuguuccugagguagguuuguucugacaaauuagguuaauggaccuuucauuuaauaacccagcaagccuuuccuccagcaggugagguaaacauuggggaaaucaauucccaagcucucagcuuucugggaccaaagagugaaucauguagguaguccucuucccucuuucccccuccugucuagcugaggccaaacaauuccaaaaggagcaauuuagagugcgagggacaaagcaaagacagacgauugauggucaaaaccaggaaaaggaguuuacuucaguacuugacauaguaaugguuguucggugcugcuggccugcuugucuaauuuacgucuuuaguggauuccauaacuuuauuuauuuccacucuaggauauccuguaccuucacaacucuuuagaggagguaaacagugcccuagugggguaccagagacagaaugaucuuaaacucgagggaaugaacgagacagucaguaaucuuacccagagagucaaccugauagaaagcgaugugguugcuaugagcaagguagaaaagaaagcaaaccuguccuucagcaugguaagccuuuucugaucuuuugugacaugcaguguguuuugucugugcauggauaacauucuaccaccuuuugagaacagccuucuggcauauuugagaggccacacauuuguguugugcuuaauccucacaauguguugucucauuuaauccucacacuagcugugugaugugaauggccaggcaguguuuguccugauuuggagagggagaugcggagaggucgagucgcuuaccaaggccucaccacuaguuguuggcagagaugacaaggcuacugucauguuaccagugcgccaucugguagggaagugcuggcacguauuuccgagggccuuuugggucuuuucuuuuuuaaguuauuaggggugggagccaugaaaaugauaguaaccaaaaaucuuuuaucauuucuuuaagccugaacuuggcuuucauauuuauccugcugucuauauauuaaggggaaccuuuugcguaugucaggaaacagaucaggucagaucagcuccccaacuuaagaggucauugaguucaccuccucauuuuacauguaaggaaacugaccuacuaagucacugaugcuggccgacugugcacggcuuacugauuuucauauuguugugaauaaaaugugcaguuucacauaaacuuugugcagggauccacauggauucuuuuuuuaauaacugcagcccccacccuuaaagauuucauauagcaaagacacaggcauauauuuaaaaauagaaaccaaauacaggaaauugugccauaaauucaaguaaccaccaaagcuggaaguaagcccacaaauaaagucaaacucugguucauggaaagcagcauuugaacuggcucugccacaguggagccuuggcaaguugccuggacuuggcuuugaaggguggaguuggaagaccuguucccccuccugcuuuacagaguuguauaauuuacuacaaagcugugaagauuaaaggagcuuuauuuuacgaagcccuuuugaacucagcuaaacuagguuggcuaagaauuuuggaugaugaguauuaugccuugaaaguuuucaaggcuuauugugaaaacuuaccacuccuaaacucucuuuacugucucugcccucucccccuacuuuauauuucuccagcagagaaaauagguaauaguauccaucuguccuacuguuucuuagagcaguaucgugcucagcaugguauuuugaguaaaaguucuaccaccuuuuauccuucaaagccuuaaaguuugugacugaaacagcuagaagcacuaguuucaacuucgucucuggccuuucucccucucuccucccaucucccacuccucugcaauuucuguugagaguguucugagauccuuuaaauaaguuugacgaauuuguuuaaaagugcuagguguucaaguuuuaauguuugccuuuaaucuucccuuuguuuguuuguuuuuguuuugcccuuuaagaugggugauagaucugccacucugaaaagacagucuuuggaucaagucaccaacagaacagauacaguaaaaauccaaagcauaaagguaaauaaugggaggcuuacccugaaguaaaaguaaaugcagcagcaucucugugcuuuugaucuacugcuacuuuuucaaagggcguacuuuuguucucaugugcugaaacuucaaaacaaagcaauuaguaaauuaguauguuagugaauaaaugaauacuuuuuuaggcaccuacccugugccaaacacuuuaguaggagcuggggggaccauagugagcaaggcagacaugugaccccuauugugguggagcucaaaguccugucagucagaaaaucguuaacacauaauugaacaggucaugaaucaugaguaugauaaguauuauaaaggacaaauacaggauaugauaagaucaagaaggcuucccuaaggaaaugacuuuuacacuaagacaguaaguuaucuguacuaaugaugggggacagaggcagagauaaucuaaaaauggugucuaaucuaaaauuuauuuccuauuuuuguauugcaaucucuauguauucauaguccauuuaaaccucagccaguucccuucaccuuguaccuuccccuuuuuuguucuuccuagacauacugucaagacagcaaucuaugauaugcuuugauauuccaggaaagaaagugugauuacaguauucucugauuagaguguuaaacucugggcuaagauaaaagaaaagccaggaagauuaugaccaagugacuaaauuaccaucucaaaugcauauuauguuugagaaguugggaggaucugagguucagagaaaaugaacuugaacuggaaccacacaguaaaggcagcuuuugauguaaugcuuuauaucuuuauuuuuccuaccuuaauaguuuuauauuaucuagauaaagucacaauauauuaagguuuuaaugcaucauaagcuaagcuuuuguugaguuuucuaacugcuucugcagauuuuuuuuaaaccucaccuagagaagacagaaaaacuuaagagccagauguaaauuuugagcacaaaaaaacuaauaggugguuucuauuagaaaguaguagcaauuucagccacaguucacauuuuaacaauaaauaucagaacacaccaguacacauguauacauaaauuucaucuuggcuuuacuuucaggccuuuuuuguuuuuaacugucaucgcaggguaucaguuccuuuguccuaccucauccaaacauccuaaccagauacaauuucuccuuaccauuaguucuucaaacauuuaguaccuaguuuucacuacauauguucauauuuuagcucccuaaauaaacugagugaacuacuauacaguaacuauuagaguagaaauaagauggggcaagagaaguuaacaauuacuuauacaagaaaaguaaaucaauaauaaaauaaauguguaaugaguugguguucuaauuaaacauaggaucaggaccuuucacacucaucuaagcaguuagaaaugagccucauagaaaccagaugucucucuuuuuauaauuaaauguauuuguauaugccacucuugauacuccugggaaugaggcaggguaugggcgaaaaaacuuuuuuaaaagauacgagcaagcaagacuuugaauuagaaauauuacagcuccuucuuuaugucuuaacaguuucugccaccaguugacucaucaccagggagaaacagaggaaagaucaggggaaaacuugugguuuguuuuuguucaguugcuucuuuuuguaaggugguaagagcaugaaauucugccuaaaguggucuagucacaaggugaagcaagauauuucggaaaguuauuuaguuagugugaaauagcuccuagaaaacaagauccugcuuauuuaggaaaugggugucgcauaggcaccugagcaaggguacauuuccuuuacugcugacacaugcauuccuucccccaucaaccaaauguucacagugaaucagaucaucuguagcauaauguucccuuaaugguuucaaauccagcaagauacuuaucagugcugaggaccaaagacaucaccaguauauguugauucauucuuuuauugucuuuauagggaaccuacugagggucaaacacuacaugcuaaacaggcucugggaauacaguggacacuuagaugaagucuuacuaccaccuuaaaccuucuauaaucuuuguuuugugcagaaagaagauaguucaaauucucagguauccaagcuaagagagaaacuccagcugaucagugcucuuacaaacaaaccugagagcaacaggccuccagagaccgccgaugaaggugagagcagagccggcuucuuaauauuucauggaggcuugagcagcuugccucucacauggggagcagggaagguguuccagcaguacugaucgcaccaagcgagugaugccugaacgcaccgagaugaagcugauacacuuugcuuucauuuagaaaaggcccauuuuguacaugauuuguacucuagucuauuaagggaagaauugguaauguuuagcuggaaauagaauucuccaugcugucugcauccaauuauaggcaaaaauguuacugucauagaguauauuaagccagcccuaaaaguuguuuaugagagucuuuuccuuucuguaagugcauaacauguauuuaaaaauaaauauucgcccuucugaaaaucguuaacaaaaauaaugaugggaucuuuggguuggaagggucuuuggcuuuagguauggaccugucuaaucaauauuagcagauacaugagccuccacugauuuagacccugugaggacauaaccaaggcacuggacuguguuagcuuugaccuuuucccccacacaaguauuuuucuauuuuagaaaagcaguacaaacucucuugaauucuccuuuaguaggagacagaacugugguggaaugucuuguccuaacauugugcuacaucaucuuacgguugcacucuuagcaccagcuuagcggguggcacauaccccuagacuggguuuaaagcacaucucccaggaugucaagaucuuugauauccagccacuguucuugccacuugacagcuuaagcucuuaccaucuaaacauguuuaaugcuagcuuguacuguaagaucuucuaaugggacugcugcugcaaaccuuaacguaauauaauacugauugguguucccuugcccacaaauaugucucaauccaagccuuuaacuucacauagucacuaugcuacuuuaucuucaaauguuucucuaaauuaauuguauauccaauuuuccuaaaaggugaccuucgauacuaguuuaauuugguguuagauucaauaauacuaaauaaaaccuuauguauuuguuacagagcaaguagagaguuucacaucaaagccaucagcauugccaaaauuuucacaguuucuuggagacccaguugagaaagcugcccaacuaagaccuaucucccuaccaggaguuucuagcacugaagguaaauuuuuauaccacgggguaguaaugggaauguucaaaguaauaacuuuuuaauguuuauuuucacuugucaaaaauauauaugaucuaacauuuauugaggagauaucaagugccagauacuuuauaugcauuaugucauauaauccugauaaccaucccaugaacauaaguauuuauguauuauacccauuuuacugauagggaaacugccuaaguccacacagcaaauaauugguugaaacagaaugcaaaccaagacagucugaugccaaagcuugugcuuuuuuuuuagacccccaggcuggagugcaguggcacaaucugggcucacagcaaccucugccucccaggguuaagcaauucucaugccucagccucccaaguagcugggacaggugugugccaccaugccuggcuaauuuuuuguauuuuuaguaaagauaggguuucaccauguuggccaggcuggucuugaacuccugaccucaagugacccaccugccucagccuacugaagugcugggauuacaagcacaaaccaacucaccuggccgaagcuugcacuuuuaaccaguguacuauauuaucuuucuguuaauguuuuuuagggucuucauucacugagugccucauuaaaccuagugcuaagcaauaagaauacaguauaagauauggucucauuuucuuucuucaaggauauuacagucuaauggagaaggcauaaaagcaaauacaauaccaugagauuaguaaaauaaaguaaaaguugacccuguuugucagggcccuccaaaaaugaaggacccuuuuacugaaaaucagcaaaauauuaguacaaaggauaugauucacagaaaaauguguuugcacugcuuccagcagugcauguucuaucccucauggugauguuuagugccucccgauuuuguauuagcuggcugccuggcaaaucacuugcuccuguccaccacaccuuccucuggcucuucucuuuagccuagauaccauucuaccaggaacauuuccuuaccuccagugacuggauuaggcuccuccugugugcucuuaaauuuuguuugccccuguuuagcacaugucacucuguuggaauuuccuggggagauacaaaauauaacuuccuauggguaaggacuaugucuuguuuacucccagccccuagcacaguaccugguacuccugaauauuuguuaaauaaaugaaugaguuaccuacacauugcaauuaaaugcuuaaagcauagaagacuuaaauuuuucuaucaccauuuaaaugugauuacuuuucuucccuguuccugacuuuuuuuuuuucuguuuucuggggaggaggggaaguguuguguuuaaugggaacacaagcuuccugccacuuuccauuguuaaaucaauauuugaugagaaugaaugggggaaagcuauuaggucagaguaaggaauagcagucuuaacacuugugcuucaguccucagcauaggccuuaaauacuuuuggaugacuauacuuuuggaaugaccugaggcagcaaucauauuuuuauuugaauacugcuaccaagugcguaguguagcauguuguauaaacucaugccacaaaaaaaaagaaaaaaaaaaacagaacucuucagcuagccacuugguguaaggcauugggaacaagugucccacugcuuuccugccuuucagagagcuuuugacauuuuauuagcugcauugcugcaccuauuguaggagugagaguagggcccuauucaggagcuuguuuauaggagcuccuugauggacuggaccuugcacugcaacuguuuucccucccuucaagcuauuuuuauucuuccugaauaccaaacaucaagaggccuauuuuaccuagguaugguguggaauaaaugaugaaauuaaaggaguuugggaagauuuuuaaagaaacauaaagcucauugaccuucuuugguauuagauauuaaaucuucuauuugauuauggggacacaaguauuuuuuaaauguuauguauauacggccaggugcaguggcucaugccuguaaucccagcauuuugggaggccaaggcaggcagauggcuugagcucaggaguucgagaccagccugggcaacacagugaaaucccaacucuacaaaaaauacaaaaauuagccaggcgugguagcgcacacccuguaaucccagcuacucgggagaauagccugagccuaaaaguuugaggcuacagugagcugugaucaugccacugcacucuaaccugggugacagagggagacccugucucaaaaaaaaaaaaaaaguuauguauauaacugaccuuccuaaguguuugugaugaggcccuugagaaaaugccagaagaaacuauugauagacauucucuaaucauuuuggcucaauauugccauugaaauaaaaaagauacagaucaacugguaauauugcucuuuuucuuuuuacugauuuuuaaaaaguagagagcaugcacuuuggagagauaauuccucugguucuuuuuuauugaaauacaauucacauaccauaacauucaccuuuuuaaaaugcaguguuuuuaauccaguguuuuuuaguguauucacaaggucaugcaaccaucaccacuaucuaauuccagaacauuuucaucaccccucacagaaucucuguacccauuaaacagucacucccaguccccucuccugccagucuccagcaaccacuagucucuuaaucacuaucucuauggauuugccuauuugggguguuucacauaaauggaaucauacaguauguggccuugugugugcuuuuucuuucaauaugauucuuucacuuagcauaauguuuuuauggucuauucauguuggagcauguaucaguacuucguuccuuuuuauggcugaauaauauuccauucuguugaccuaacacauuuuggucuguucauccguugauggacauuucgauuguucucacuuuugggcuauuaagaguaaugcugccaugaacauucaugugcaaguuuuuauguaaacauauguuuucauuugccuugaguauauauauaccuaggaauggaauuaaugggucauaugauagcccuaacuuuuugaggaacuccuacacuuuuccagaguggcuguaccauguuacauucccaucagcaaugugugaggguucaauccacuuucuccacauccucccuaaugcuugguaaggccugucuuuuuuuauuauagccaucguagugauuaugacaugguaucucauuacacuuuugagucacugguucuugagcugcuuaauuucuggauccagagagacaagugucacauaguagaaagagcacuggacuagguaauaagaaauuuguauucuaggccaggugugguguccuagcacuuuggggaggcugaggugggcagaucauuugaggcuaggaguuagagaccuggccgacaugaugaaaccgcaucucuacuaaaaauacaaaaauuagccaggccuggugauacacaccugucaugccagcuacuaaggaggcugaggcaggagaauagcuugaaccuaggaggcagagguugcagugagccaagaucauaccacugcacuccagccugggugacagaguaagacuccaccaaaaaaaaaaaaaaaaaaaaaaaaaaaaaaacaggcguggugguucacgccuauaaucccagcacucugggaggcccaggugggcgaaucaccugaggucaggaguucaagaccagccuggccaacauggugaaaccccaucucuacuaaacauuaaaaaaaauuagcugggcgugguggcgggcgccuguaaucccagcuacgcaggaggcugaagcacaagaaucacuugaacccaggaggcagagguugcagugaaccaagaucgcgccacugcacuccagcgugggcgacagagugagacuuagcuucaaaaaaaagaaaagaaauuuguauuguauuccacuuaagaguuacaugaccguaggcaaguuacuuuccucuuugagcuuuggauuuccugucaaaacugagaaagcuaugaguguuugggauuguuuuaugggcuuccaagucauuccuccagucuccacucagccauccaacaagaaaucucacaauaugccacagucuguuuuaugagcuagcuccuaucacauaacucauuaggccucugcauuccuuuucaccccuucaacauaagaauaaauucaggaaaaucuaaagggaagacgcuggacagagagaagaugagaccauucauucuccugcgauuaucugucacugcuucuacuuuggcagugucucacuguguugcccaggcuggucucaaauuccuggccucaagcaauccuccugccucagccucccagaguguugggauuauaggcauaagccacugcacccagccuuuuuuuuuuuuuuuuuuuuaauauauuuuuaagggaucaaaaauuagucuuccugauuuagugaaauccuaaacuuuaccauuuggaaacaaaauuugcggaguagcuuuucuuuuaguguuuuaaauucaguugagacuacuuuuaacuaaauuuagcuguauguuuagacguauacauuuuuuguaauucauuuuugacagaucuucaggauuuauuccgcaagacuggccaggacguggaugggaagcugaccuaccaggaaaucuggaccucccuagguucugcuaugccagaaccagagagcuugagagcauuugauuccgauggagauggaagauacucauuccuggagcuaaggguagcuuuagguaucuagcuucaucaggcauauuuuagaaauggacugccuaauaucuauuuaccuaacaacaaaacaacccuuacuuacccaucaguccucuaguccuccaaacuacuguagcagauacuuugccaccuuuuaacuuguuugaagaagcuauauaaaaguuauuuuuuuaaagaagaagaccauuuuacuuaugauguucagaaaucuaugauuuccuacaaccaguaagaucuuacauuuuaaaauugccagaaaaaaaauuaaagcccucuuuuuuucucuuuccuuuuuuugaggggaggagaccuuaucuuuuaaagcugggaaauguauauagagagagaauaagccacuuuuauauuucacuuaaauuugccuuaaauuagcugcacuuuauagagacucagaaaaugucuuuucuuuaaaagauaggccuuuucuguuuguaaauauuuaaaugaaagaaagcauugugcauauuguguggaaaguaggaagaaugguuuugaacaggauaugaacaaaugacuuauuaaaaauugcugaucugguguagguggcagcugaaacuacauccaugucuccauaagguaucccucaaaggcccaggcgcugccaggggguuuguccugguagcuggaggaaccgauuucagggaguagacacuggagacaauacugacuccaggcauggcucauggaaguaggauucugguucuuuguuccuauucccucagcuaaucccaaccugggaaucagagaagucuuggggauuuuucucauuuuuaguacuauuucaggguuuaugagcauaaaaaguuauccauuggggagcuccauuuucccugcugagugagcuagauugccuuccccacccacccacuuaagucugucuuaaagccguagcuggcucccaccaccaguaccaucuccauuugaauggcagggcuaaauucccccagccauuaucucacacugaccacccagagcuuuagaagagagcugugcuucuaauuuugacccagaaaaccauaccccuugagauuuuaccuagaggcuaaccaagagccuaauauguuucucugggggaugacuaaagccaaaaaggcugugagaugaaacaugugaaauaauauucaguuuccuuaccauuaccagcucagaaguagcuagaggcuuucuacccaaaggaugccaaaguauagcagggcaggccuggagcuagggccuucacauggugguagcaaguuuuucaaaucuaauacaaucaaguacaauacuuccuuuaaaugcuucuguggaccuggcaugaaagaucccuagauugaaaggaauaauaccuccaugucuccuguauguugagucuagaauugcuguguuguucuuagaagcagucuuugggcaacaacuugaaaggggaaaaaaaaacuacaaaaacuuaacuuugguauaggccaagucagggagaaaguagagaaagcugucaugccacagacuucuuuaguggagaucauuuccuuuuuaacuuuguucagguugcccuucaccauggauacaguccgguacccuuaaacauuuaagggcuguuuuuuuuuucuuuacaugauguucagcuugguauuaaccaaacuuaaauuuuuuuuccagaaguauuaaaauuuaguuaaagcaagaugaagucuuuucccaugaauguguccccuuaucucauuauagcuuaugcucaguuucacuuucuuggaaagguuaaaacaaauuagccuggcacuuuagguaacuugaaaauaacucucacccuucugacugccuuccauccacucucaccccacaccuuuuuuuaauauauauacacccuuacagauuuucuaacaaccaaauaaaauucuagcaauaaauugaauuauacugcuauauuuguauauacuguaccauaaauaguaugucuguaccuggaagguauuuuuuugagaacugauuuauaugaaauauacuugaggguaauguagcuuguccuuuuuaguuucaaauucuuauucauaggcagauacuuugaagacaccuuaacucuuuguuguguguauuuucccuugcaucagauaacuauacauggagaaauccauuuuguuuuuugguuuaucuucuguucuuccuaccuugugcuugucugacuaguaucaccccugagccaguauacaguaccauccucucccccuaccaaguuuggcagagguguuuauacugcauucucagaucuaugaauauuuuugucauccugccugagaaaguacaucuuccaggcaaaaguaggguaucuugaacuccuuucuucugaguugagcagacucacuggcuuaagcaucccauaagccuauuauuuagugugaauuugggacuuuuauuuguauguugucuuaacuuacuaagccugugacuuguauuuagcuguagucaagccucaccagccauaucucaucucugagaggaagacuggauagugaguuugguuuugguuuugguuuuaaacccuuuuaccuuuucagucuggcagcuccuacugcugcuuuccuaaguuacucaaagcacugcuucuugguccuuguuuucuuuugccuuguacuaucuuguauaauguuuacuaaaagagccuccccauaaaucagagaggcaaaaagguagcauauaaaaagaagaaccaaaagaagagaaaaccugacuucuagaugacuguggugucaucuaaaaggcagaggugccugacccucaggaauguguaugaugcaacagagcugaagaauggguucccuucaccuacugcuggccauugucccuucuguuggagauuccuuucuuuaugguugcuguucauaaccccuucaacacccccccuugcugguccugccggucacaguugaggauuuuggcugugaugggcucauacucauaauggccuguugaguuguuuuuagugacagguuuuguuugcugcacaccucauuggcuugcuuaccaacaccagcuagaaguggucccucuuucauauccaaaccagaacacauuuggguauuccugagacuuuauagagcguguauuguuuguuauacgaaccuaaccuaccuuguuguuuucucauauuaagaaauuuaaaucuacuuuguuuuagugaagcuauuuugguaauguauaagcaauuuugguucuguuuagggagaauucaggguuuccaugacuugauuugagcuuugcauauuucaaauaaguaacacagccauuuuaauuuagcuaaauaaaaaaauuucuuuuuucucucaaugugucugacuaaagccucucucacuccccugcgauuuuuaagggaaaaaaaaaaucugcuuugauuucuau

SEQ ID NO: 14059 - RNA, 42847 nt, Homo sapiens
uugggcagccucccuggaggaggcgggccguggcauacacagggcggcgagagcgcgcagugccggggccagagcggcgcgcccccuccuccccgccccgccucgccgcuaucccgcgcccggaaccuugggcgcgcggaaccucggugccggagcgcgggcgcggcgcacucggagcgggauggagcgggcgcgcgggccgcgggccgaggccgacgcgccugaggaggaggaggaggcgggggcggccauggcugcuguggugguggcggcugcggguggcgcgggaccggcgguccugcagguggccggucucuaccggggccugugcgcggugcgcagccgcgcccugggccuggggcucgugucacccgcgcagcugcgcgucuucccagugcgccccggcucgggccggcccgaggggggcgccgacagcagcggggucggggccgaggccgagcuccaggccaacccuuucuacgaccgcuaccgcgacaagauccagcugcugcgcaggugcgggccuggguuggcuggaggcgggcaggaggcgggaggaggggcggcccgggcugcugggccuuaggacagcccugugaggugggcacuaguacugucccagcucuucagaugauguagccaggcuccgcgaggcuaggucacuugcccaagaucacacagcuaauuggugucagagcugggagucucugcaaagcccuggcucguuccacguuugucugcuuugguucuccaaacgcuaagguggacucuuaugacagcccugaggcaggcagcucagagacaccuguccucauuauagaaaugggaaaacgccuucuagagaagggacuugacuugcucaaggucacauauuaagauagcugaggccuggcucagagcuggaguucccaggcuggugguagcuuagggccuugacugcaaggaaaggcgacuggggaugggaggagggcaucaaagacuaauagugucacagucggaucacccauugaacccucuuaaggagacugaggaucagcgagaguaagagacuugccaaaggucacacagcuguuugggauuugucugacucugaguccagggucccuaacaccaccucuuagcuuccagagggaaggaucuggagcuuagaggggcuuaaggugcauaugaggggcuauaggagcaucugaagaguucaagugggaagagcuaaaggagaucagaggugaaaauuaaaggggcuugggagagaauuuagcaggguaagaagguaguugucuuaugaaaggaaaccaaagacuuaguacuguaaauuugaguucugucucaucucuacuuccacugccuuaaucuacuccaucaucgucaccugggcuguugccauuauccucuaacuagaguucccuacuuccauuccuggacuacuuuaccccaguuccucucacugcuacuguagugaucuuucuugccauuugaaacaguuaugcaguaaaugaaugaguauuuuugcucuccuuccagcagcauugagauagucucaaguauuugucaucuuaaaagccuuucuuugauguacauuccccuccaggcuucucucguugaucuguauuugaucuguuuuacacacaagcaucucugaagaguugucuacuuguacuuugaauacuuuaucagcauccauuuauucuuacccacucaugaacaaauaaauaacugguuuuaccguccuuccccacuggaucauucccaucaacauuuacacauacuguuauccccccacugaccucuaaauaacauccaaacuccuuaauguuucacacaaguuccucauacccuagucccugccagucucucucuaguuuuaucuguuagcaaacuuccuuugaaaaagaauggagaggaggggauguuccagguaaggggagcagcaacauaaacaaagguacagaggcaugaaaccaccuuaaccauuuggggauguuugagcaaauuuucaucauaauaccuguuguacuuucauuuguuuacuuuuaugccugucucucccacuggauagugagcuccuugagguagggagucugacuuauuuauuucuauauccucagaucccagcaacagcuucacugcccaggcugucccuugcccucucuaccccuucacuauggcaggcccaguugcagcuguagccacuagcaggguugacccugguccugguacagcccccagggcugcuugcagcucuggccaggcaggugccaugcccgacuaagcagaaaccccuggugaggcucuuuauugaggaggagccggcccacuacagagagaagaaaaacaucccaucuacaugacagugaagggagugguguuuuaugucaccuccagaaaggaauuuuauggaagaaggggcccccuauaaugcauugaccaggaaaguccaccagagggauagccaagaugucccuggguccuccagaccucacccaugaaacucugggucucauggccaaagagcuggaaucccuggaugauaucuucaccaaaguguacaaaaccaaauaucccaugguuagcuacacagucugaagaauucuuaauagggacagcaccccagccuggacuucaaaccugaagaccaaccccauuuugacauaaacaauguguucuguuguuucaucuccaagagcagcuucuuuggaggguagguuagggagauacucagaugcuaaaucuucugcaaaauaggcuaccuaaagccucugaaucaccaggaucugaauaaagcagauguuuaaccugguuggggggacauauuuucaagaacuggauguauucaaguaaaagcuugacaccuaguaaggaggcuauaggauucuugucugaagaggugauccagcaagaugaccucaaaauucuaaguacccugaauguaaguaccugagagacuaagcccuguguaaaccuagggaacagccugcaaaagaaaaauguuacacaggccccuugaggauuaacaacaguugaauaacaggauuucuuuuuccaguuucuuuauuucuaggccugugcccaguucuuacuaacugaaggcaaauuuuucaaccucucugaauggcaguguccuuucucuguagagguggaaagugaugcuuuguuauuuuagaauucaaaaaggcccaguugguuuacccuuugguuuaccucugaucaggucagacccagcugcuuuugagucccgccuggagaaacgcagugaauuucggaagcagccaguggggcauuccaggcaaggugauuuuaucaaauguguggaacagaagguaagaccuucccccauuugugguguuugcuuaccagcacuccuucacccuccuuacccucacccuuauccuuaaaguugguuuauugaugggucagcugggugaacugaacauagucucucccaacuccauuuccauccauaaauguuuauccugcucuuucuaggcaaaguacuguggucaugguggagauauagaaguaugagagggguacuuccugcucccaagaggagcagucugguggucaaggcaaggcacacaugguaguaggcuagagguaucagagaaaauuucccaugggagauggaaccugaccuaggcuaggaacguugugggggauuuaaauuaaguagagaggaaggaaugggacuuugauguagagcaggggucaucaaauuuuuucuguaaagaacuagauguuaaauauuuuaggcauugugggccguauggucuucuuugugacuacucagcucugccaucauagugcaaaagcaggccuagaccguacguaaaugaauagguaugguucugucccaguaaaacuuaaucuacaaaaauauuuggcagacuagauuuaguuuccugacaaccagccaacccugccaacccacccccauccauucccauguugaggaauuagcuuaaacagaggaagagcuuugaaaguaaaagggguuucaggagacagcaagguacuaugcccaguuaaaauggagagggaaguguuaaggcuaaagaaauaaguuaggcauuaaacucuuugggcuuaaggaguacaggcaggauaauuuagcugcuaagaggaugggcucuggggccagaugccaaggacugaauccuaacccuuccacuuacuagcugggugacucugagcaaauuguuacuucuccaugccucaguuugcuuaucuguaaaacaggaauaauaacaguaccuacuucacagaguugugcugaagagauaauaccauuuaaaacucuuuagcgccgucucuggcauaaguacuuaauauauauuagccauuauuauccuuaaauaggaaucaaagcugaggaaaagcauguugaaaacugugucugggaagauuauucuaaugcaguguuuuucaaacuuuuugaccaugaccacaauaagaaauauauuuuacauugcaauucaguacacauguagguauaugauuguaacugaaaaaaaaauguauaaaauaaugcuaacuuuuacaacaugcaguccauucuuauuacuuuuuauucucuuucaucuuuuaaaaaacucugaucacaauccacuaaauguauuucacaaccuauuauuugaaaaauucuaaccuaggauggugcacagaacaaacugguguaggagaggccagcgccagggagaauauggaguaauccaggugugggcugcagaagccugaauuaagguaguuacaguagaaaauugggauucuacauuguguuuuaaagucaaauuagagguguuuauuuuacuuggaaaauacuuuuuuugccuuggguauccugaauuuuaagugaaucugcugagucuuaaugacuacuacucaucugacaaagggcuaauauccagaaucuacagugaacucaaacaaauuuacaagaaaaaaaaaaccccaucaaaaaguggacaaaggauacgaacagacacuucucaaaagaagacauuuaugcagccaaaagacacaugaaaaaaugcucaucaucacuggccauuggagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaacauuguggaagucaguguggcgauuccuuagggaucuagaacuagaaauaccauuugacccagccaucccauuacuggguauauacccaaaggauuacaaaucaugcugcuauaaagacacaugcacauguauguuuauugcggcacuauucacaauagcaaagacuuggaaccaacccaaauguccaacaaugauagacugaaucaagaaaauguggcacauauacaccauggaauacuaugcagccauaaaaaaugaugaguucauguccuuuguagggacauggaugaagcuggaaaccaucguucucagcaaacuaucgcaaggacaaaaaaccaaacacugcauguucucacucaugggugggaaucgaacaaugagaacacauggacacaggaaggggaacaucacacacuggggccuguuguggggucgggggaguggggagggauagcauuaggagauauaccuaauguuaaaugacgaguuaaugggugcagcacaccaacaugguacauguauagauauguaacaaaccugcacguuguguacauguacccuaaaacuuaaaguauaauaaaaauagaaaaaaauaaaauaaaaugacuaauugaguuaauuagaacaggauuaauaguaaauggguugccaggcgcaguggcucacgccuauaaucccagcacuuugggagguugaggugggcagaucacuuaaggucaggaguuugagaccagccuggccaacagggugaaacccuguaucuacuaaaaauacaaaacuuagcugggugugguagcaggcgccuguaaucccagcuacuugggaggcugaggcaggagaaucgcuugaaccugggaggcggagguuacagugagcugaggucauggcacugcauuccagccugggcaaaaaaaaaaaaaauaacagauggguuaauuauaauaagguuggggagcaaauucaacuccuaugacaaauagaguuuacaacuuuaugugagcaaacaauucuuuacuacaaauauuuuaacaauugucauuuccuauaauaaacacuuauaguaguaagguuacaagucaauagcucuuggaaauauuacuauauuauaaacuuuaaauauuagauaggaauguucuuugccccuuuuugguaaacagacuuagaaauuuggcuuuaugaggccgggcgugguggcucacgccuguaaugccagcacuuugggaggccaaggcgggcagaucacgaggucaggagauugagaccauccuggcuaacacggugaaaccccuucucuacuaaaaauacaaaaaauuagccgggcguuguggcaggcgccuguagucccagcuacucgggaggcugaggcaggagaauggcguggagccaggaggcggagccugcagugagcggagaucacaccacugcacuccagccuggacgacagagugagacuccaucuuaaaaaaaaaaaaaaagaaagaaauuuagcuuuaugauaaaauguagaauauguaaagauuuaauuuaaauuguggcagcucuuagguaaauauucacuugcuaucuucuguaucuagcuagauagaggaaggcuaacggcuaacacauauuuuccauucccacagucuugucuuuacuacuuugaguuauugguuccccaccacaugggacucaacaucccccuuuuauaauacauuuuuuaaaaauucucccuuuucuacccugaaauaaaacaauagguauguaaaaauauaaccuaccuguauguauaaccucaggugggaaaaucaauauaaugcccuaaccauaauauaaagaaaaguauuuuuuaacaaaauacauauuuuagcauguaaauauuagggcacgacuacacugugagaccuaauguagucaugaggugcuuccacccauuucugaaauaaccuugaacauguaagcagcaaauacugacuggcaaauggguguuauguugauaauuauaaaaacucuaaaaccaccgggugcaguggcucacacauguaauccuaguacuuugggaggccaagguggcagaucacuugaggucaggaguucgagaccagccugggcaacacggugaaaccccgucucuacuaaaaugcaaaagaaaaauuagccaggcaugguggcgcaugccuguaaucccagcuacucaggaggcugaggcaggagaauugcuugaacccgggaggcggagguugcagugagcggagauugugccacugcacuccagcgugggcgacagagugagacucugucuccaaaaaaaaaaaaaccuccaaaaccaugagcaguguuguuaucagugaccuaugauuccacaauguggaaucuuucaaguuauauaguaguugcauuucuggaaauuuuaguauuaaagcaguguuuaaaaaaaaaagguucuaggcccaaguaauuauaaauauugaaauauuauagguauuuucagcugcaagaaugucuagcuagacauugaaaaguuguacaggaugagggaaauuuuuuuuauuauguagaacucacccauuugacaccccucccauaauguagauaucaauauccaauaaacuauuaugauaaccauaaaauuaucugcacagauuuccaaagcauccauaguagggaaguaaaauacccauuuaaaguucuuauuaaaugcuucugauuuuugacauguaguuucaacugcuuuaauuaccuuauuucaucaaaucuaaagcucacucuuauuuuucucauuuuaacaucacuaaaauugucuuauaauugauaugacaggaaaauauugugcuauuuaauuggcaucauuuucugaugcauaaaauaauggugcaucuuaagauaugaugucuuagauuugauaaaaugcaauacgcuuauacuuagggcuuaaauuuuuuauuucuauaagugaaaauggauacaaauaauagauuggagagacauuguguaaaaaccgauacaugaggcuucaugacugaaaggugaaagcagcugugcaaguggagguuuuguuuuguuuuuguuucguuuucaugguacaccugagaaugagugguaugaaaaugaaauucucaucaggcacaguggcucaugccuguaaucccaacacuuugggaggccgaagcgggcagaucacuugaggccagaagucaagaccagccuggccaacauggugaaaccccaucucuacuaaaaauacaaaaaauuagccaggcaugguggcacaagccuguagacccagcuacucgggagacugaggugggagaaucacuugaaccugggaggcagagguugcagugagccgacauugugccacugcacuccagccuaggcaacagagcuagacccugucucaaaaaaaaaaaaaaagaaagaaagaaaaugaaauuaacuccuuuuuagaugguuuacauaugaaggaacggcuacacugggauguugucaguguauaggugcgugaccaaaaagacuaaaggguguucaacaggcuuuucucuaauuuguggguacagguucuaugaccaucauuuaugaaaaguguggauuaauuaaagcacaaagugacuaaaggcaagguuuuaugcagaaaguguuuuucagccucagaaucccaggugucgaauguacuucugagaagcacagccuugaguggaagacucagaacaacccaucccuacuaccagaaacuacucaaaacaggauuuacuagcuaugaccuuuaugagagauaauggcuacgagacaaaauaaucacuuucaguuguugguggccuuuuuuuaagggugucuaauuugauagaggaaacauuaagauugaacacucaaaaugacucuagucugcugaggaugccuaccaucaaaguguugucagagauaagcaguauccuuggauaacacaucuuuccauuucuuaccucucccauggcucaguguggaauaggucaggacagagcacaguaaucccaagcaggccuaauucugggaagaaaucccucauauccacaguggcagguggagaauggacucucaguacuaguagaugauaguuuacugagagagaaaucuuaucucugaaucucagaaucuuagaagaaaguuguuuucuuauaaacaauaauuuuuauuuuuauuucuuuuuauuuauuuauuuuauuuuaugagacagagucucacucuguugcccgggcuagagugcaguggcgugaucucggcucacugcauccuccgccuccuggguucaagcgguucuccugccucagccucccaaguaucugggaucacaggcacccgccacuaugcccagcuaauuuuuuguauuuuuaguagagacgggguuucaccauguuggccaggcuggucucgaacuccugaccuuaugauucucucgccucggcuucccaaagugcugggauuacaggugugagccacugcgcccagccaacaauaauuuuuaaaauaguguuaaaauuuuagaacaauuauuauaaaaaguggagagaagugaguucucacaugcaaaauuauuuaaugagauuggguacuucaccuagcuuaguuaccuuuuuucuuaugaguaaaguguagauuaauaucuugucuuauauauuucagacagaugccuuggggaaacagucugugaacagaggauucacuaaggacaagguagguuucuaauuaaauauaggaaaaaaagcuugaagucauaugggacaucuagaacaagaggcugcaaauuugaacauaaguacuguggcucagugauuuuguguaaggugauuuuccagcuguagaagugagaaauauuucuaugaacuuuguguccuugaccaugaccccuagcauagcaguuuaauuaaaaauaacaaccaaacuuucuccucuuaccagcugcaaagugccgcaggacucauugguaagggugaagccuuugggaaguacauggcaaccuaagagagacuccucaggaacagaacuaugaaaaccugucuaggcuugggggcucacuuucucugagcauguggguuuucuuauacuuguuuucuacuuuuggaaaucuguuucauuguccugacauguuugccacaggcuuagagauagaguuaagcuguuuuuuuuuuuuuuuaauuauguguuaauugcuuuuuauugucucuuucaagacucucaguucaaucuuuaacauugagaugguaaaagaaaaaacugcagaagaaauaaaacagguaaugaauggaaaugggcuggccuacucuaugaaaaugugaauucugugaaccaaaucugaaaguacauuuucugacaccucuuucuagccacaaugaaagguaauaauaaaaggcaaaagugaugaauuacuugaagaacaaugucauaagaaaacuugucuucuuugucacucuuauaugucuaaucaacuuguaugucuaguuucuuuuucauucccauaauccacaucucguguaacccucaucaguacucuguaccuggauuacugcacuaccuuuccaaauagguuucccuucuccuuuuuuuuccacuccacccauaauauucucaucaacugaguccucugaaacuucuccuuucauuauggagaaguauaguguauugguuuaaaaacacagacucuagaaccaagcugccgguuuuaaguccuagcucugccacuaucuauaggacuuggacaaguuaaucaacuugucugggcuuuaguuucccuauuuaaaguggagcaaauaauagcacuuaccucauagaguuauuuggauaauuaaaugaguuaacauuuauuaucacuuagaacagucccuggcauagaguaagugcuauauuuauguuuuuuaaaaaaugggaaaaaaauguauuaggaaccuggucacaaauguucagugacuuccuguauuccuuuucugggcauucauagcucuccauuaucacaggaccuucuucaggaagcuuccugaacacuuuccuucaaagcacucaugagcuauccugccuguuuggucauuuauauuuuuauaccugugauucuuuucucucuaauaagcuauuuuucuggcauucuuuauaguuccaugaauuauacauuagguagauugagaggaucaaaauaauaauaaaagcagcauacucuguaucagguacaaugccuaaugcuucauaugcauuauuucauuaaauucucuuaaccaccccgugaagugggugccauuauucccaguuuacaguugaggaaacugugacuuaaagagauuauguaacuuagucagugguagagcugggacucaaacccaugucuauuugacucugcaucauauucccacaacuggaaguugugccaguugccauggguuuccuuuguaugcuguaucauuuauuuuagcacacauuuaaugcauaccaauuaaaugucagacucugugccagauacagagauaaaugagagaauccucauccccaaggaguuuuagccuccgcaaaacggaucagaucagcacaggguucuuucuauuaauagaggcauaugcaaagugucagggagaacucuggcugugccuuugggaagaaguaccaaaggaacauggacacaaaacaugucauuuaggggaaaaagaagccaggcccaggaggccugaucauaugacaaguaucauugagaccuauaguuuuagguauaaauuuguguuuguugaaaugaguagcuaaauucaacuauauaaggaaacauauaucagucucaugaauuucaguuuugauucauaaacugucugcuaauaucauaaauuaaauaaaaauaaucagaauaugcuguccuuaaaaugagaagacaauguuuugacaugcaaaaaaagaaaagguaaagcaaccuuaugccacauugagaguaguuuccauagguccuaggaguuaauaguccuuuugugcucuguguugauuagauggaucacacuuugauuaguaucuucaauuggggccccauauuuuaacagaaauguugacaaaacagaccaacucuaaaggaaguugacccauucuucaacacuagcucacucuggugucaccuugguuaugauacccuccucuacuucuaugccuuuguuaguguugucauucucugcuucaaaugugucucuuaucuccuucuccugcccuaccuguuaucuucccagccuccuuauuucccuacucuaacuccuaaucauucuucaggauacaguuccaagugucccuuccucuggcacucuucccuacccuggguuaagugccucuuuuagauuacauguuucuuauuauuucacaaucaucuaucauucaaccagcauuucugaguacuuuuuggguugcaaggcauuggugacaacacagcagauaccugccuacagggggcuugcaaacuagugagggaaauagauccauaugcaaaugaucuuauuaugaaguagcauauccuaggcaucuuaagagagauauaaaauaugaaagcaagggggaggaaauaaauaaaauagaaaagcagcucauaggaaaacuucugacuguaauaucaagggaaacugcauggaagaagaagcauauaggcucagcuucagaguacaggaagaauuugggaggucagagguaggagagagaggcuuucuagucagagccaauaacauguaaaaaggcaugggaaggcaaaaaaaagguaguaaaaaauaagaacacagagcauccauaugauauuaaugguaaauaaugaaaagacacaauauugcauauaugcuacaucuauguauacuauaaaagacaugcuagaaagaaauaaaguaacaguggucuuuguuagggugguaggacuaugggcauuuuuuccuuuucccuguuuucuaauuuucaaauuuuauuauauaauuuuuuuauuccccaccuuuugguauuugcaucaugaaggucaacuguagcuuccuuguucguuagugucaagcagagguaggacuucugauugguauauaccauagucagauccaacagaccuuaucucuuccacauguagaagacuuucuggaagcaggauuuuaagagcugccuauaacaugccaauaauaucuaauaugguuuugcuguguccccacccaaaucucaucuugaauuguaguucccauaauccccacacaucaugggagggacacaaugggagguaauugaaucauaggggcaguuaccuccaugcuguucccaugauaaugaguucucacgagaucugaugguuuuauagggggcuuuucccccuuuugcucauucuucuuccugucaccaugugaagaaggauguguuugcuuccccuuccaccaugauuguaagauucuuaacgccuucccagcccuguggaacugugagucacuuaaaccucuuuccauuauaaauuacccagucucuggauuaagaaaauauggcacauuuacaccauggaauacuaugcagccauaaaaaagcaugaguucauguccuuugcagggacauggaugaagcuggaaaccaucauucucagcaaacuaucacaaggacagaaaaccaaacaccgcauguucucacucauaagugagaguugaacaaugagaacacauggacacagaguggggaacaccacacacuggggccugucaggggguggagggcugggggagggauaucauuaggagaaauacuuaaaguaaaugacaaguugaugggugcagcaaaccaacauggcacacguauaccuauguaaccugcauguuguacacauguacccuagaacuuaaaguacaauaauaauaauaauaauaauaauaauaauaaauaaauaaauaaauugcccagucucagguauaucuuuauuagcagugugagaauggacuaauacaauaucuaacaaaagcuaacauuauuuguaguguuuauucugugacaagugcugagcuaagcacagaccuacauuauuucagcuagucaugacaauucugugagguuauuauugcuauuuuauugauguuuuuuagggaguuuucaguaauuugcccaagguaguauagcuaguaaaugacuggagcugagauucgcauccaggucugccugacugugaacccugagcucuaguccugacucucugggaaggcucaguuggcuggggagguguggguuuggggaggaaauaaaaaugugaaaaaaaagaaguugucuaucacacacaaggcacauauuaagaggaaugacuuuuaaagucagagaaucaguuucucugucaggaauuuguuauuaagaguuacaguuuaaucaucuagaagaguggauuguauuaaaucuuuuuugugaugugcuaguaaugaaagcguuauacuggguuuuuccucucuguuaucaaauagcauauuccucugagcaaugaaaacugucaccauuucuuggcacauguugaaaagauuacccacaugucacagacaccccucucuuuuuuguacagauuuggcagcaauauuuugcagcaaaagauacagucuacgcaguuauuccuguaaguaguuuggagggcaaagugaaaguguuacaacaugaaagucaguucucuaaccuuagcaggcaguugccuuuacuuuuccuauguuuauugccucuugagaagcugcauuuuacagcccugagaguuuuuauuaugcccugagcaccagagauuggaagcuccauaugguauauuuauggcucuuguuuuccuccuuucuacuuuagaaaugucucugagucaagucucugacaagggagcgugguauaaguucauguugcugaguaauuuccagaugucuuuuuuuucuuacugauguuuuccaaccaagcuguuggaauuuaagacagggccucuagcacagcuuuuuucccuucuugccuguaagugaccuauaccugagcugacuuggagccucuuccuagucuaucucuggugaauauuccccuuagcaaguggcauuuucuuggucuuucccuucuugaaauuauucuuagagauggucaccaucuacugcuugaccauuaaggucugugacagagaagggaugcugcuggcuucucugguuuaauguuuugcuggccuucacuauaauaaagcaucugaaguacuggauuaucagcuaguucuuuguuuuucccugaaggaggggugggagcuuagguuaaguuucuaucaagcacacaaauauauauugagauuacaugaguaaguguaagauuaaggaggaaaacauauagauggaaggauaaagccaggccuuuuggugguuaugaugguaucgcuaucuuuuuuuuuaaucucucauauauauauacccuuauccuacaugaauucaacagccagaagaagagucugcgcuuuuugugauguuuuagaucucugauacugacucauuguuuaaacaggccuucuuaccucucccucaaacugacuuggugacuugaugucucugacaauuguuaaaguucccuggagcauuggugcaccuagucuuuacacauaauucugacaauaaacagcaaaacagacaucugguuuuuccugucuuucugucauaagagugauuugaaaaugaugaaacuuaaaugacuguuuuaguuguauuauaauucuagaauucagucuuggugaauuacaugugauaguggccuuuuguguuuuacuauguguagguuaacuuuauucuuuuccaaccuacaggcagaaaaguuugauuugaucuggaaccgggcucaguccuguccaacaguaaguuucuggugaucacguaaggguugcuuaucaauguugccaaacaaguauuuuccagcccaucacgucauauuccauacugucucacauguuauagugcucuguuuacuuaauaaagaugcucacauguugauuguacuaauaaguuauagugcucuguuuacuuaauaaagaugcucacacguugauuguacuaauaagugacauuuucagccuuaugaaaucauguggguuugacccaguaagccucuggcuuuuuagcucccuaccacaucagcccuuucugauguagaucuuaaucuaucgguacaagugcguuuuggaagacaucugagaccuuaaucuuuucaacuucuuuuuuuuuuuuuuuuugcuuuuauuauuauuuuuaauugacacauaauuauacauauuuaugggguacagugugauaguucaauacaugugugcaguguguaaugaucaaaucagaauaauuagcacaucuaucaccucaaacauuuaucauuucauuguauugguaacauucagaauccauucuucuagcuacuugaaaauauacaauaauugccauucuaacuggugugagaugguaucucauugugguuuugauuugcauuucucugauggccagugauggugagcauuuuuucuuguguuuuuuggcugcauaaaugucuucuuuugagaagugucuguucauuuccuuugcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguguauacccaaaggacuauaaaucaugcugcuauaaagacacaugcacacguaugcuuauugcagcuuuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuauggcaagaacaaaaaaccaaacaccgcauguucucacucauaggugggaaucgaacaaugagaacacauggacacaggaaggagaacaucacacucuggggacuguugugggguggggggaguggggagggauagcacugggagauauaccuaaugcuagaugacgaguuagugggugcagcgcacuagcauggcacauguauacauauguaacuaaccugcacauugugcacauguacccuaaaacuuaaaguauaauaauaauaaauaaauaaauaaaaagaaaauauacaauaaauuauuguuaauuauaguacuccauagugccguagaacacuagaacauauuucucccaucuagcuguacuuuuguaucccuuaaccaaacuuuggcuauucguuccucuaguaaccacucuccuacucucuccuucuaugagaucagguuuuuuuuuuuuuuuagcuuccaacaugugagaacaugugguauuugucucucugugcguggcuuauuucacuuaacauaauguucuccaagcucauccauguugucacaaaugacagaacuuguucuuuuuuguggcuaaauaguauuccauuguguauagauaccacauuuucuuuauccauucauuuguugauggacacuuagguugauuccauaucuucgcuauugugaauagugcuguagcaaacaugggagugcagauaucucuucaacauacuaauuuccuuuccuuuggauauauauccaguagugggacugcuggaucaugugguaguucucuuuuuaguuuuuugaggaaacuucauaauguuuuccauaauggcuauacuaauuuacguuccaccaauauuauacaaaaguuccucuuucuccacaucuucaccagcauuuuuuuuuuuuucauuuagagaugaggucuuacuguguugcccaggaugggcuucaaauccuggccucaaaugacccucccaccucagacucccgaagugcugggauuacagguugucuuuuuuuuuuucguaauagcuguucaaacugggcugagaugccuguuuuauuggcaguuuucuucacaguuuuggcuaugcuauccugguaauaugugccuaaaggaauuaagaggucguagcugaaauacugagcugccagaaggccuaagggaaaaggaauaggugggguggaccagcuaacuugguaucaguaaugauuucucggguuuucaaaacauuuuuggaaacauugcugaaaacagagaauaccuaaauaaauggaaaugauauauaccauguucauggauuggauggcucaguuuguuacauuuuguuuuguuuuguuuuuugagacaggaucuuacaguguugcccaggcuggagugcaguggugugaucauagcuuacugcagccucaaucucuucagcugaagcaauacccccaccucagccuucuaaguagcugggauuacaaacaugcacccccaugcucagcuaauuuuuuguauguuuaguagagacaagaucucacuuacguugcccaggcuggucucaaauuccuugguucaagcaauccuccugccucagccucccaaagugcugggauuacaggugugagccacugugccuaggcuuuguuauuguuaagguaucaguucucuccuaauuggucucuagaugaaauacaauacuaaucaaaaccccacuaggcauuuaagaaauugaugagcugguuuuaaaauuuuacuuggauauuuaaaggacugagauagcuaaaacaauuuugaaaaagaacaaagcuugaggacuuacauuuccugauuucaagacuuauuacaaagauacaguaauuaaaacaguaugguauuggcacaaagauagacauguagauuaauggaacagaguagaguccugaaauagacaaacauauaugugguuaguuguuuuucaacaaaggugucuauaaauuagagaaaggauaaucuuuucaacaaaugcugcuaaaacaauugaauaucaugcacaaaaaaaaggaaccucuacuuuuaccucacaguguauacaaaaauuaaaguagaucauaaaaguaaauguaacuuuuuuuuuuuuuuuuuuuugagacggagcuugcuuugucacccagggugcaauguaguaugaucucagcucacugcaaccuccaccuccuggguuuaagcuauucuccugccucagccucccaaguagcugggauuacaggugccugccaccacacugggcuaauuuuuguauuuuuagcagagaccauuuuuuuuuugagucagagucuuguacuguugcccaggcuguagugcaguggcaugaucucugcucacugcaaucucugccucccagguucaagcgauucuugagccucagccucgugaguagcugaaguuacaugagcccaccaccacacccagcuaauuuuuauguuuuuaguagagacaggguuucaccauguuagccagucuagucucaaaacuccugaccucaagugauccacuugccucagccucccaaagugcuaagauuacaggcaugagccaccgcaccuggcccauaaauguaacuuguaaaggaaaauaaaagaagaaaucuaaauuaccuuggguuuggcaaagaugucauaaguacauuacaaaaagcacaaacuauaaaagaaaaaaaucaccuugggcaauauagugagaccuugucucuauaaaaaaaauuuuucaagcaccuguugucccagcuacucaagaggcugaggugggaggaucacuugagcccuggagguggagguuauagugagcccagaccggacaacagagcgagacccugucucaaaacaauaaaaauagggugggugugguggcucacgcauguaaccccagcacuuugggaggccaagguggguggaucacuugagguccgaaguucaagaccagccuggccaauauggcgaaaacccaucucuacuaaaaauacaaaaauuagcuaggcgugguggugugugccuguaaucucagcuacuccggaagcugaggcaugagaaucgcuugaaccugggaggcagggacugcagugagccgaggucacaccacagcacuccagacuagcugacagagugagauucugucucaaaaaaauaauaauaaauaaauuagauuucaucaaaauuaaaacauucuauuugcauacccaaauagcuucuacauucauagcaacauuagucacaauagccaaaagguguauagcucaaguuauaucagaaauucuuauaacucaauaauaaagaggauagacaaauggacaaaggauuugaacauuuuaucaaagaauagcagauaagcaccugaaaauaugcuugacagcauuagucauaaugggaauccaaauuacuacagugagauaccauuagaaugacuaaaaugucaaaaacugaucauaccaaguauugguaagaaugugaagcaccuggaacucuccuauacugccggucauauugcaaaaugguacaaccacuuuagaaaauaguucggcuguuucuuuaaaaauuaagcauauaccugccauacuaacuagccauuccauuucuagauauuuucccaagagaacucaaagaauauguccauagaaugacuugugcgcaaauauucaagcagcuuuauuuguaacaaccaaugcuggaaacaaugcaaaugucugucacuagugcacaggaauuguggaaagagagaaugugcauguguguguguguguguguguauguguguauacauacacaauggaauaauauucagcaguaaaaggaaugaacuauugauacaugcaacaacaugguguucugugaaagggccauaugugcaaaacgacccccaaauggugaaggagcugaaaaaccaaagaaggaggcagacaaauccaauuuguggguaugggaugauuuauugggggaacuuacagacgggaaugucguauuggguggcugcaauacagguagaucuccacaccacaaccagacagacccaauaugucuuauaucuuggggaaaguauacaugcucuggaaggaauguguagguggauacagucaucacugccuaugauuucugcaacaacaucaaggauuguuuuggaagaauagauguuucuacauaaagaguaauacaucaacuagacauuugggaggcauuccuggacuugggguuagucagaagucacacgguggacuagcauuuaaaauaaagucacucuuguuccuacacauggauagaucaugaaacaguuaugcugacugaaaguaaccaaaccaaaaaaguacucauuuugugguuccguuuuuacaaaauucuacaaaggcacacuaaccuauaguggcagaaagcaaaucagugguugcuuagggacaguaagggacagggaaguaugaacuucaaagggcaaagaaaacuuggaagugauaaccauguucauuuuguugauuuugguuaugguuucacaguacacauaugucacacucaucaaauuguauacuuuaaauaugugcacuuuguuguauuucaaguauaccucaauaaagcuguaaaaaaaauauuuucccuagcaagggaucaucugucaaguaggcacuaaguuuaucucaucuaauaauaauaaauuggagccugagugguugacaauaagaagauaauuugugacuaauguguauugggcugcuuuauacuuuuguuuuguucuggcaccauucuuuucucuacuacucauccccauucuaaacaucuugagcauaaaacuuauuuuuugguguuuagucuggagccaugcuccaauaucagccuuaucugauagaaugugaaguaauuacagcaauuggaacgagcuaauucagcagcauuagaaaguuuagaaauugaaacauccaucaagagaaggauaaauagugauaaacuucuacaauagaauuccauacaacagugagauauuuaugaauucagaguuauagauaucaacauggauaaaucucagaagcauacuaugaaguaaaaaaguuacaaaaggauacacacacuuugauaagauuuaaguuuuuaaacauauaaacuacuacuuuaaaaaaaauuuuucuaaagacagggucucacuauguugcccaggcuggucucaaacuccugggcucaaucaguccuccugccucagcccccgaguagcuaggacaacaggcacaugccaccacaccuggcuauuuuuuuuauuuuuuuguagugacggggucucacuguauuguccagguuggccucaaacuccugagcucaagugauccuccgaccuuggccuuccaaagugcuggaauuacaggugugagccaccaugcccagccuguaaacuacuacuucuuaacuuacaguuauacgcauauacauuaaaguauuaaaauaugaaaaaggaggauagacaccaaaugcuggauagauguuaacucugggaugggauuagaagggaaugcagagggaaccucaauuguauuucugaugcuuucuuagguggauugauaaguacaugaguauuuauugccacauaugaauuucuuaauuuuaaaaaaauguuuuaggcugggagcaguggcucaugccuauaaucccaucacuuugggaggcugagggaggcagauugcuugagcccgggaguucaagaccagccugggcaacauggcaaaaccccaucucuaccaaaaaaaaaaaaaaaguagccaggcuuaguggugcacaccugcaguuccagcuacuugggaggcugagugggaagaucaccugagcccagcagaucaagacugcggugagcugugaucaugccugcacugcagccuggacaacagagcgagaaccugucucaaaaaaauaaaaaaauauuuuaaaaaccaaauauggaggaaauggaaugaauguuacaggugguuggauauagagcaaauaauuucauuuauucaucugucuccuuguauaucuguuuuucacaguuucuaugugcucugccaagaagggaagguuaugaguuuuuuguaggacaauggacagguacugaacuccacuucacugcacuuauaaauauucagguagguggcuugugcccuuccucuagaggaaagaggacuaccccuugguaggacuagaaacccuugcugaggcucaaggacacagaauagcugcuuacucccagcauuuauuauuguggcgcagaugaauugucauacuuuuuguguuggacuaguuuucuaggcccuccucaauaccuagaaauuggaaaagacuccaaaacaccuucucugacuacuucugguucucuuuugucucuuccccagaccucuaguuguauauacugcaugugccucacuuaacaaacaugccugaguuaugauggcuaucuuuuuaacccaagcuagaagccccuugaggaaagcuccaagucuuaaauguguuuuauuaccuaagucaacaccuuccaacaugcuaagugaauaguuucuguuuaauguuauuuuguuugcuuucuuccuuuauuucuuuauuuccaauaaaacaauauuaacuuuuaaauauuauauuuaaaaguuagauucaaaacauuuaaaacuuuuaaaauaaaagucaauauuuuaaaucauaacuaggauuggcauucuauauuuggaggucaaauguggcaaaaaacaagcacgaauuauauuggcuuugaaguugggguaaagaaugcaaaauagaaugaaggaacagcuuuuuacuuugcuauuuuguaauaugucuaacaacccuuuauugaguacauacuuuaauaaccaacaauuugauguacuuacuaugugccacauguuuuauauauauuaugucauuuaauccucauaauacgccauauuuacuguuauuauuucuaauuacauagaagaaaguggccucagauguuaguuacauugucuaauaagugauagagccaggauugagcccagguuaucugacuucaaagucugugaacuuaaucauuaugggauuguguuaggaacugugcuaagacuuggagaucugugagacaaggucccugccuucauggagcuaauauucagcuuuaggagaaagauccagaaacauaauuacaauaaaagugauuaguauaauauuagaaugaugaccaaaaugaucaguguaacauuagaaguauguucaagaaaaaugagaugcugaacuauuacaaguacccuagugauaguuggauauuuauaauuaaaaagacucgcugaaauuuuagagauaaagucuaggaaucuucuuuugaauguaguuguuuccaccugugcuauguaggggcuuuagcuuugaacccauccucucuaccuagucuagacuugagauuuaguaaccacugcccugaucauucuucauaaaaucaugguguuuccauccuucuucuccccuucaccccccaccaacccagauuauauuuuagagcugcacauuacaaaucuggcucaugugcaaacucugcagcuccugcuacagcuuaaaagagcucagucuucagagccagccaaggggaguagauuucaacugugaaaugcacuaguccaugaaaguggcaauuacacaggcacauugcuuucuuuagaacuugauuugguagcugcuugugccauuuuguuuuuaaauguauggucacaaugauggauucacugccuacuguaaacauuuucugggaaaaaagccaaaccuuuuccaguugaagacacaaauaacacugugcaaacugucaguuucacugugccuuugcaggccugaccuuaccaccacauaccaguccuccaacucacuagccacccaaggggcuguuaagagccagaauuuccucuagacugucuauugcuuugaaauugcaguuuguugugaugguaccuuauugagccuugauaaguguuccaccuugcagacccgaggggaagcugcagccagccagcugauuuuauaucacuauccugaacuuaaggaagaaaagggcauagugcugaugacugcagaaauggauuccacauuucugguaagaauuaacuugcaaaacucuuuggauuuaccucauggcacugaagguauuacucuucugccaaagcucaugagagagaaaauuucaaagagcuacauauaccuuguuucuuacuuauuuuaaaguugacagugaaguugucuugcucaagaucuuccaauuugaaguuaguacagauccucaaucauuuauucacaauucugaaacccaugggcucugagaacaaaauguuuuuguucucauuuggucacaaaaccuuauguaaacuugaacucauuugguaacuaaaucuuuaaacugaugugaaacuauuuauauaacuaaucccacuugguguggaguauuaugcauuuuacuagggaaauauuaauguguuugaguauggggagucacauaauauaguuauauaguaucuauaccuauuaucuuucuaaaauucaauaauucugaaucuaagacacaucaggcccuaaggguuucagauaagagauuguagacaaguaaauggcuucuuaauuauagggaagaguuguauugaagccuaggauagcucucaauauuuuaucuuccuucauacuguucauuuauacaacauucaucauuuauaguguuuuucuuuccuccuuuucccacuccuagaugagaaucacugagauagagcauugaccauaugcucauaguuaaugaugcccacuguguucucucugcacauccaggugccaggagcaguguugugauuacuguacacugucugucuaguccuugcucauuucagucacauauccuuuuaucuggcagagguuaaguucagaauguccccaaacaguggacacuucccccuaacagucuucauuacagcacccacuuauuuuuucucuuucucuuaccagcugcauagggagaaagaagugauaucacucagcugauaucucacaguagcaguaacccacaaaccuaggacacagugaggauucuacuucccuauucuugaagcuauucaguaccaucucucccauucuuccuuccacauuaacccuuccauucaucacauucaacugaaagccaaaauucuauccaagaauauggaauugccauuaacugagauaggcaagauugcaggaggaauaggccuaacaggaaaaucaggagcucacuuuucgauguauuaaaucugagaugccuauuagauauccaaguaguaggcaauuagauauaugagccuggacuucaugggagaaguccaggcuggagauauaaauaugggaguugucagcauacagauuguacuuaaaaccauaggacugaaugaagucaccaaggaaguaaguaaaaauagagaagagacgagaucuaagaacugagcgaggggucuccaucccuggagagaugaagaagcaucagcaaagauuaagaaggaauggccaugagguaaaaggaaaauuaagaugguagaaugcccuggaagcuaaaauugaauguuucaaggaauagggacugcucaacucaccaaaucucccuuguuuauuagggcaaaugagauuagaacugagaauuuacugauuucacaaacauggaagucacugggggccuuauaagagcaguuucauaaaagugugauuggaguagacuuaagagaggaugggaagagaaacuccgaagaaucagcauagaaacucuuucaaggggcauuucuauaaagggaaggagagaaugggguauuagcuggagguggagaagugcgcccaaggguaucuuuuguuucaaauaugagaaagaaaacauauuuguaugcugaugggaaagguccaguugaggcugggacaguggcucaugcuuguaaucccagcauuuugggaggacaagguggguggauugcuugagcucaggaguuugagaccagccuggccaaugugaugaaacccugugucuacaaaaaauacaaaaauuagccaggcgugguggcaugcaccuuguaaucucagcugcucggaaggcugagguaggaggaucacuuaagccccagcagcaaagguugcagugagcugagauugcaccauugcacuccagccugagcgacagacccagacucugucuaaaaaaauaauaauaauaaaauaaaauaaauaaagauccaguggagagggaaauguugaugauacaggagaaagcgggaagugauauuuuugagugggcaagucugguaaugagggguugaucuuuaccaggaauaugacagcaggagagaagccagaguauaaggacacugauaaaauuagauggauagagguagugguauaaguuuccuacagauugcucagugaaaagaaagaaaaguucucaucagcugaaagcaagguuggaaaaauguuggacauuugagucaaaaagaggaaguacaaaauuguugucuaggacaagcgucagcaaacuacagccuaugggccaaguccagcccacugcuuguuauaacgcccacgaguuaagaauguuuucuaccucuuuaaaugauuagggggaaaaacucuuuuuuuguuuguuuguuuguuuguuuguuuuugagacagagucucgcuguguuggccaggcuggagugcaguggcacaaucucagcucacugcaacauccaccucccaggcucaagcaguucuccugccucagccucaagcaguucuccugccucagccuccugaguagcugagauuacaggcaugugccaccacaccuggcuaauuuuuguauuuuuaguagagacgagguuucaccauguuggccaggcuggucucgaacuccugaccucagguaaucgacccaccucggccuuccagagugcugggauuacaggcaugagccaccacgcugggccaaaaacucuuuauucuuaaagaaauacagaaauuauuuaauaacaaaaacuauuauuaaagaaaaauaguauuucaaguuuuauuagaacacagccauauucauuuauuuacauauuaucuauggccugaaggaaguuaaaggugaaugcaaaggaaugauuauugaccauggaauggaagcuggguaaugaggaaagugaaaauauaagggagguuagagacaguaagaauuaugaguccuaauggguugugggaguuggaagugagcugaaaagauaggaaauaauuugaucaugcaagugagugacaauauagagauuguacuauauuuucuggucuucggcaaagcacagcaucuaaucauauuaaaaguggauccuaaaggucagaggaggcccauucugcuguuugccauuuuuaccaccucacucugguggucucaaacugcugugcaguucucaucauuguuaaaauuugcuuccuggccuuuuaacauuugacagcauacaagacaauacauauuugccuuguauaaaucaacuugacugugagguuccgauguaguguagaacuagacauguuagaacuuguuguacaugacuuagagaagagaaacuuagaaguauaagaugaauauaugauccccuguauacucaugcaugaauugugcacuuuaggcauaguauuuccaacuaugguaaagcauuaaugucaaaugaauagaaauacauggaaacuagagauuucuucugaacuaacuuuaaugcuaaaaacuaauggaauauuuaaaaaccuagcuuuauuuggcuccacaucuaugucaauagaugauuucauugaaaugcaguaagugcuaggauagacaugcagaagguucuagggauagagaguggggugauaucccuggcccaaagggaguaauauuuccuggagaugacacccagacugaaccuucaaacagcaggaguuagccuaauaaagaaggggagaaauguuuccgacagagggaauagcauaaguaaaugcugagagacauaaaaugacuuggaguauuguaaagaguuugguaucacuuguguguguguguguguauguguguauauguaagguuuggugguuuuuguuuagagauuuggcuuuacccugagggcaugaaaagagucauuaaaggguuugaacagagaagaacccauaaagagauggauuuuaagaccuagccuauuaauuauuaacuuuaauuauuugcuuccuaaacauuguguaguucaagucuagucaguaugauaauuuagaagucaguugcaauagucugcacaagaaguggugaaaacuugaacuacagcagugguauagagauggaggaaagagaaugaccccaggaauauguagggaauaaaauagucaggacuuggugcguugauuguagauuugaaaauugaaagagagggaggaaucaaacuuguuaaaauaccucuuuauugagcagcacagggaauuaguauguuuaucuuauugggucuuggaaaaggaggagacuguugcuucauguugaaagccaagagaauaaaaggcagggggagaauaagggcugguggggguugccuuucuauaacccuccaugagagguagacaucucucucugugucuuaccuuccuauccuacucacuguacuaguggucuucaaaaacuuuuuuuuuuuuuuuuggagacagucuugcucuuuucaccaaggcuggagugcaguggcuggaucucggcucacugcaagcucugccucccggguucacgccauucuccugccucagccucccgaguagcugggacuacaagcgcccaccaccacgcccagcuaauuuuguuuuuguauuuguaguagagacgggguuucaccguguuagccaggauggucucgaucuccugaccucaugauccgcccaccucggccucccaaagugcugggauuauaggcgugagccaccacgccuggcccaaacuucuuuuuaaaguaguaggaggaccccuuuauccaaacaaaaucuuacuauguaaaaccccaggauaugacagcuaaaacaggugaagggaccugaggcaccuccacagagcaccuaggacucuacagaauaguuugaacagcaguguuguagugugaacacagcugaacuuacuccuaccuucccaccccaagcuucagauaaaaguugaugucagaggcccuguagccaggggcugagagaguggugguauccucagauuauagcagugcacuugcuucagaaaugauuugcucuugaggcaugugugaauuuaagaaagguaaaauggaugaaguaguuauuggccuucaucaaucuuaauuaucuugcccuaccagaaacagaaggaugaauuggggggaauaccagccagggagucuagaggucuaguccuggcugugaccuuggcuggccacuugaccuugagcccaucccugaaccucaucugccuugguuuccuagccuauuaaaugagaacugggugaucucugaggucccuucuagcucuaaaauucuauuaauuugaaguagccagcuuuuugggaaaagguuuuugauugaagaugcagucucagagauuagugccugcucaugagaaauguccugaaagucccacagagggaauagagauggagcacagcccauguuauuuauaaacccgucuucaucauucucuagcuagacauagcacacuuuuggcaguaaguuuuuagugggaauuuuccaugaccuuuugggguuuaauuuuggcuauaugaacauggugauaauggacaaguaccucugaccgacuagaacugcagaauguauagcaaaaguaagaguugucugaggugacucuuuugcaaaguuugagaguguagcccguguucuaacccccaucucugucauuuuuuaauuuuuauuuuuagagauagagucuuccucuguuacccaggcuggagugugcuggcaugaccauagcucagugcagccucaaacuccuggucucaagcaauccuccugucucagccucccgaguagcuaggacuacaggcucaugccaccacaucuggcuaauuucucugccucugucauguaggguggccugcucaccauuucucugcuauugcucaccauuucucugcuacugcccuucucuucccugggccuuugcugauguauuaguuauaaauggcugcauaacaaauuauacaaaaucuaguggcuuaaaacaacaaacauuuauuaccucgcaguuucuguaguagcagcuuagcugagugguucuggcucagggucucacaagguugcugucaagauguuaucuagggguauagucauccgaagguugauugggcuugagcgucugcauccagccccacucacauggcucuuggcagaggccucaugucuuugucguguuucuccauagggcugcaugaauguccucacuacauggcaacugacuuuucccagagcaagaaaauuagcaagagaaaaguuacaaccuuuauggcuugauagcagaacucauucuccaucauuuuucauuuuuucauagucuuuuuuuuuuuuuaaggggcucacuacauuacccagacaggcucaagcaauccuccuaccucagccuccugaguagcugggacuacaggcucacaccaaugcccccaaccauuuugucauagucuacuuguuagaaggaagucacugaguauagccauuacccaaggaaagggaaauuaggcuccaucaaagggaggaauaucuuaaaauuugugggcaaauuuuaaaaccaucacagcuggcucugggaguacuuuucugaccaagguaguaucauaacagguuuuauucaaguguauaucugguuagucaagaacuuaguucucacucacaaacugguucuuagagcuggguaacuguugcugucuuauuccccccuugaaauauauuuaacaguuauuagggaacuggaugaagaggaauaaugugaacauguacauuaauuuauucaguaaacauucaccagaugucacucugcagagauauaaaacaaaccacggucuaugucuuugaggaauuuguacuagggaaaauagacaaaaaaagaaaaggaaaaauacaauacagugugauaaauacuaugacagugguaagcacaggaugauuugguacacagagaaggggcaccuaaccaagacuagggacuucaagaaguuaaggaaacuuucuggaaguggugacuccugggcgagggcccccacccaccacacaauucagacaagagcuuuguggcccugugcaagaaaggaccucauuauucuuuuuaccuuacagaauguugcugaggcacagugcaucgccaaccaaguucagcucuucuacgcuacugaucggaaagagaccuacggguuaguggagaccuuuaaccucagaccaaaugaguucaaauauaugucugucaucgcugaauuggagcaaagcggacuuggagcagaacugaaaugugcccagaaccaaaauaagacuuagaacuguacagguuggcccuucaccuaguugacucagcccucgauagucuagagcccacccccuccucaggaacucaagagcucagcauuuauaaugagcaguugguaaugaguugcccuaugugcuugucgcaagcagucacagagaugagcccuauuacuugauauucaggaacaaagguaccugaacauucugauaauuaucucagcauacuugagguuuccuuuuuuaaguguucgagguuauaacaagagacagccaaggaccuacaagacaguugacuugauuuugcacaguguaacagcgcaguugcauucuggccacuuugaccuuauagcucccaaaugaugaguuugucaucuuuaugaacucaugacaggauaauaagcuugaagaccugcuguaguuagauaugggcuuuaauccuucccaggcaccagucagcugaacaaaagcauaagccaaacauccuguuuaaacuguagaauaaccagauauucccaucagguuaaagacuucaucuagaugaugccccccagagaugccuuuaguguaaguagcuggcuugggguaucagcaaauuucagguauaguuagauaaacagguacagggccugcauacuauuaaaccauaguuuguggcacccgcuuuucuaacuccaccuguuagaagcuauguguuugaaggaaugaaucagugcaguauaaauaaaauucuuuuguaaggagaagauuaauccugguuugcaugauuuuuuuaaaaacaacucuaaacaugauacgaaaaaguggaugaaagcaaauguucccagauuggauguggggaaaauauagcaauaauuuuuuuuuuaagucuggcuuacaauguuuguuauacaaaauaaugaaaucugaguuauguacuguccauugugucagggcuaugggcugauuuuaucaaaacucaucuugggacugaaaaauuguuuggaaugccagaaauaagaaaguuguucuccagagcuggaaacccaucuuucguuuguagugucacuguuguggcuccaagcucagugauaggaaaggacggugguuacacaccagccuucugaacccaaggcccccaguauuguugucagcugccuuuaccauggcauuucuuucucuuucuuuuuuuccugagaugaagucuugcucugucuugcccaggcuggaguacaguagcgugaucucagcucgcugcaaccucuaccucccugguucaagugauucugcugcgucagccuccugaggagcuaggauuacaggcgcaugccaccauaccuggcuuauuuuuguauuguuguagagacaggguuucacuuuguuggccaggcuggcuggucucgaacuccuggccucaagugauccaccaccuuggccucccaaagugcugggauuacaggugugagccaccgugccuggccugacauuucuuuauugaucuaacaugcuccacucugcugcuccugccuaagaucugguuauaugacacugaauguggugagugggaauuuaagcaguauucgcaguuuguguguguguguuuucuuccuuccagaagaauuuuuauagguugggccugucccuaagcucuuuaaauaggguggacaucccacuauucucugagccgugucuauuuuguugcaccuuugagucuauguauugagagagacagauaguauuuuuuuaaacuggggaagcugcuauccuuucacuauuucucuaaagguugagcuguuaacuaauguaaauucuggaccugcuucugguccuggcaguuuaucuuuugagaaacuugagucuuaucugcccugccauuuucauuaaaugccuucugaccuucugaauguuuugggucccaagaauuuuugacaucagaugggguuguuuuuauugguauccaguuauguuugcuugucuuuccagaugggcccaguuauuagccauacauaguacauugauacaccuccaccagcgggugaggaaaugauggaaaaaggaguaagaaguggccauucguuuuaaucauuccuccuggauuuguccucaguccccaacugccaaguaggauguguccauggauaaauguguggggcaugacuaaaguaccacguagcuguucuuuauauuuauuuaccuagaaagaucuggcaaagaacucaaagaaaauuguaccauuuaaucaguaaauuuguccccuggugcuagcaugguguuauagaaaguggacaggcuuuagaguuaagugaaucuggguucauauguuaguguugcuauucauuagcucuauacuguugaacaaauugcuuaaacuaucuaauuuugggguuuuuuuuccaucuaaaauagggauaauaauaucuaccucauaggauuauugugagaauuaaauuaacuucacuauaguagaaaauaucaacuaccauccuuuucucuacuucccuugccccucauuaaagacuaauacaaguuagcauuucagauguguagaucauucuuuauuccaguuaaaagaacaaacuuuaucucaucaguucugaaacuuuaagaugcaguagcaucaccuaaagugcuuuuaaaaugcagauucucaggccucaaccguacaccacccccccacacacguacuaaaucaagaauaugugcagaagguacugggaaucuacuuguuaauaugugcuccaaaugauucugauguagguaauuagccagccacacuuugagaaccacugccuuaucuauucuuuacaaaaauguacauugccaggucuuucuuuccuguggaugcuaacuauaggauauuuagguuccucuguucuuugucucccauaguggcccccuuugcaaacuccaaauacauuauauuuauuuauucuugugucuuuuuucccccacuagacugugagcuccuugagggccaggacuuaucucuguucgcagugccaaggacauggccuggaccauagaagauacucaguuuuuuguugaauaaauagguaauauggauuucaaccaaaacauugucuuguguauguaccugcauguaaauacucuagauuuaaaagaaucucuuaauacacauagaucgagaauuuguugaguagaaauauuugcaaaccaagauaccaaguuauacacaguucucuguaccucaccuaauccacuggcauuaccuugguggaccauuacacaguacaacuuaacagcugcucacagagcaucuauucugcagccacuauguuaagugcuggacacagaaagaugaguagaguaugauuccugcucgcaggcucuguuuuagccacugccuguuucucucuugccucugauucagugccucacaccuacaccugauuauaguuugcuuugucuaguucuuggauguucauacugguacuucuuucuucuccaaccaguuuggaagcuggagccacauguuuugcuuugcacucuccauacugaccuuuuguucagucuuggagaagagguacuaaugcccacuuccuagucauuugauuuggcauugagucagcauucauucacacuuauugagcaccuuuuugccaagcacuguuauaaaaaacuggauaauauagcaaugaacauggcaaauaaggcuccuguucucauguaguuuauauucuuguaaagaagacaaguaaaucaauaaaauuauuuuacauacugguagugcuaugaaaauuuaaaaauaauauuuuagacuauggaguggaggcaauaacuuaauggucaggagaggcaucucugcagcaguggcagcugauacaugagcuggggaaagagaaccagguaaagagaacagcaaguguuaacgccccggagcagagccaagcuaggaaugcuuguuucuggacaaauauaaagauucaguaucuacccuuuaggagccuacaguucagcggcaugaccugacaugaaugauuacaauacaagacaaacugaucaaugccgucucagaaggggcaaagagaguuaaggaacuccccccgcaugcuauggaggaugcaaagcuugccaggcucugguacccacccaugaagcacuuauggcuuaauggggaauaacagguagacaguguuaaagucucaaaggcuauauguuucuugcaauagacaagagguacuguggguucagugcuggccucccaagcuacagucacguacuacauaacaauguuuuggucacguuagauugcauaugcaacuguggucccauaagauuauaauggagcugaaaaauuccuauugccuagugacaucauagcugugguaauguuauagcacaaugcauuauguguuuguggugaugcugguguaaaucuacuacaccagcauaguguauagggguauaggguauaaaaguauaguguacaggggccggguacgguggcucacgccuguaaucccagcacuuuggaaggccgaggcagguggaucccuugaguuuagaaguucaaaaccagccuggacagcauagcgagaccuugucucuacaaaaaaaauuuaaaaauuaacugagcgugguggugcacgccuguagucccagcuacucaggaggcuaaggugggaggaucacuugagcccgggagguugaggcuacagugagcugggaucacacugcugcacuccggccugggccacagagcaagacccuaucucaaaaaauaaaaagguauagugcauaaaacuauguacaguacauaaugcuugauaguaaaugacuauuacugguuuauguauuuacuguauuauuuagagugugcuccuucuacguauaaaaaauacuaagucaauuguaaaacagccucaggcaggucucucaggaguuguuccagaagagggcauuguucuuauaggagaggacagcuccauguguguuauugccccugaagaccuuccagugggacaagaugugcagguggaagucaguaauguugaugauccugacccuguguaggccuaggcuaauguacauguuugugucuuagcuuuuaaccaaaacauuuaaaaaguaaaaaauaaaauuuuuuaaagaaaaaagcuuacagaauaaagauagaaaauauuuuauacagcuauacaguguguuuuaagcuaagugcaauuauaaaauagucaaaaguuuuaaaaauuaaaaaguuuauaaaguuaaaaaguuauaguaagcuaagguuauugaaaaaagaaaaauauuuuuauaaauuuaguguacaguguuuauaaagccuacuguaguguacaguaauguccuccucagucuucauauucacucagaacucacucacugacucauccagaacaacuuccaguccugcaggcuccauucauuguaaguguccuauacagcaauaucauuuuuuaucuuauacuguauuuuuacuguaccuuuucuauguuuagauacgauagauaaguauuuacccuuauauuacaguguccacaguauucagcacaguaacaugcuguacagguuugcagccuaggagcaauaggcuauaugccaucuagguuuguauaaauacauccuaugauguuugcacaacaaccaaaucaccuaaugauacauuucucaauguagucuccauuguuaagcaacacuugacuauauacacauuaacaauaaccacuaacauuuacuaagggcuaaccauauaccaggcacugugcuaagcccuuacauggauuaucucaauccuaccaacccuaugagguuggcaggaaccugcuggucagugacaugugcugcucucuccuuguacccucaugccccaacuccagcucagaaaagagagcaaccagccaggcacaguggcucaugccuguaaucccaacacuuugggaggccaaggugggccgaucgcuugagaccaggaguuagagaccagccugcucaacauaacgaaacccccucucuacuaaaaauacaaaaauuagcuggaugugguggcacacaccuguaaucccagcuacucaggcugagguacgagaaucacuugaaccugggagguggagguugcugugagcccagauugugccacugcacuccagccugggugacagaaugagacccugucucaaaaaaaaaaaaaaaaaaaaguaagucaugguuggcucuggaaccagcccugagaaacaugucucccaauuuucuugcugguaacuaaagaacaaaaugcaugcauuauauaccucugauuccuccagacaauuuugcaagacaucauguucuaacuagggaagacuuccuucggagaacuuuggucuugucaauucuucugaugugacagguugauaacaacaucuuuauccuuguucugcuaaaagggagaguaggagcacagaaagggaagagaugacuucaagguugcugucugcaucaggagccaacccaggaauaauaauaaguguguccaugcuccacacuuaauaggaucauuuguaauguccacugagcaggcucauucuucacauucacuugaacagggcuacuucuacgcucuucaggcuuuaggaacuggaauaucuacaagaaaaauugguucaaaccacuuaagaaucauuacagguucccuagggcuuucuggacaaaguccuuuuagaucagcucacaggagcuucaggauccagugcauggugucuuuuccaggcucauuuugugccucuccuaccuacuccuuuggcuccagccauucuggauaacuugcaguucccuaaacacauugugcucuuccuaccucuguucugcucuuuucuaauacauuugccugcuucaaaugcccauuccuccuuaaguuaauucaaagcuucacuguaguaucccuaugagaagccuucccugagaccuauuccccuccacauggccccccugcaaggcuggcuuccccaccagaaugaauagcccuuggagacugggaucauaucuuacuggacauuauauuccaaguguccagcacgaaacccggcagagggauaagauacucuguggaugcugaacaaacuccguuugagugaccacuaaacucagaccaccugagccuacaaacaucgcuugcacagugagauccagcucuggcaaacacauugugguuaugucccagcccaagacaguggucauuuugcuugcucuuauugcagaggcugcauauggaaaaccaagccaagggaccaacagagaaggcagucagguccaggguuuguaagcagaaagaacugagagaugaugaugugaacaaacuuuuggagcaaaacaauuauuuuaaguaccaggcuggcacuuucaaguucuugucuugccuugccaaaccuuaacauuaaaaaagaccugguuggguugguggcuuacgccuguaaucccagcacuuugggaggccgaggcaggcagaucacgaggucaggagaucaagaccauccuggcuaacauggugaaaccccgucucuacuaaaaauacaaaaaaauuagccaggugugguggcaggcaccuguagucccagcuacucgggaggcugaggcaggagaauggcgugaacccaggagguggagcuugcagugagcggagauugcaccacugcacuccaaccugggggauaaagcgagacucgucuccaaaaaaaaaaaaaagaccuuacaggcugggcgcgguggcucaugccuguaauucuagcacaaggcgggcagaucaccugaagucaggaguucgagaccagcguggccaacauggugaaaccccaucucuacuaaaaauacaaaaauuagccaggcauggugacaggggccuguaaucccagcuacucaggaggcugaggcaggagaacugcuugaacccgggaggcagagguugcagugagccaagaucgcgccacugcacuccagccugggcgacagagugagacucggucucaaaaaaaaaaaaaggguggggggugggcggccgagagcaguggcucacagcuguaaucccagcacuuugggaggccaaggugggcaaaucacaaggucaggcgaucaagaccauccuggccaacauggugaaacccugucucuacuaaaaauacaaaaauuagcugggcaugguggcacaugccuauaaucccagcuacucgagaggcugaggcaggagacuagcuugagccagggagucggagguugcagugagccgaagccuggcgacagagcaagacuccaucucaaaaaaaaaaagaaaaggccuuacagacuauccagucaccaguuuucaaacugugcuucaagaaauccccaaaguccagagauggggaccuugggauucugacccccaacucaaccagagaaucuguguuuuauuuacugggcuucucauaagcugucaucugaaaaaacaguuuucaagaaagacugaaaaaaaaaaaccuggucuagucuaauucucccgcccaccauuguaggccucccuacagcaccacuaagccauuggacaacuguuuaaaaucuuccuggggacugggaacucucuaccugcuaacugaccugcaccaugcugaggcagcucugggugagccaguucuuccccaccccuagccaaaaucuggccucuucucacuacccucaccuccuucugccugcuguagauggaaacucccaggagagucuucacuuuucuaccuaaccaccucuccugcugauaagcaaagauaacucucaaguugcuuuggcaucucuucagcagaaccgucugucuuuaguuauauuacccaaaaccccagccccucacccucuggcucaccugcaucuggacagacuagccagugucaccagugucugccucacaguuggggccuggaguugagcccaagaugcccuugugggguaaucagaguggauucuggguggccaucccuugggaguuggcauggcccaccuggaagucauuuccccccauagccacuuacuaaagucaucucacugacuccaccuuuccuggcccucguccuuacucccaccuugcuaucuucccauaaucuguugucaaacauugcuuuuccugccuagaacuuuaguccuuuggaccgccacacauagccccauuucaucuggcugguuucaguccagugcucccaucacaucuggacuugaaucuucacuguauugcccagaacccaugucccuccuaacagaugugauauucacguuaccuugguccccuucuacaucugccauggcaguaaccauagcuuagugguauccucucaagaucuucauuuacccaaaaaauauuugccaugguuugaaacaaucacuacuggguccugcuugauaugugguccacugugaccccacaucauguuuguuacugcuauuguucccacacucacaauaugguauggauccccaucuugcacucucauuucuucaacccacauucaaucucccauuuugaccuugccucuggucagguaagaaguagcagacauaucuuacauuuuggcacuaauuuugcaggggaagagagggagcagagagguauuuugcugaaucucacuuguugugugacccccagaagacucccugagaugccuaaguuucuuucauuugaucuuugaacaauaccuuaaaaaguaauauuauuccuuuuuuucuuuuucuuucucuuuuuuuuuuuuuggacagagucucacucuuguugcccaagcuggagugcaguggcgcgaucucagcucacugcaaccuccgccuccugguucaagggauucuccugccucggccuccagaguagcugggacuacagaugugugccaccacgcccagcuaacuuuuuguauuuuuaguagagaugggguuucgccauguuggccaggcuggucucgaacuccugaccucuggugaucagcccgccccggccucccaaagugcugggauuacaggcaugagccaccacaccuggccaauauuauuccuguuuuacagaugaggacacuggggaaacaccaucauagaugugaagagucaagacuaaauuagaaucccaguucugcc

SEQ ID NO: 14060 - RNA, 3778 nt, Homo sapiens
cugagccuuuguguucucaucuguaaauaaaauaauaauggcccuaucucaaaauauaagaaaggauuaaaugauguagcaaacacagagugcuuagcacuauaaugaaagugcaaaacaguagcugguuaaguaccuuuucaagaugcacaucuauacagaggaggaggaauuucuguuucuggaacauaaaucuucuccuagaacauagaccuuucauuucuagaacauguuucuuuuguacuauuuuucuacaccauguuuuguuuucagaaaaucucuuccgggaauuuagagaggcuugagcagugguaaucauaccagaccaggggacaggcaucaggaaucugggaggugggcaggugagcaggcagacccaaagccuggcagcuaacaucuaggucggaaaccagguaacgucuggaguuuugggccaaggugcaggccugccugauuauucguagauggcuuaucugagacaaaguuauuccugguuacagaugucuauguauuuaguuccuuggcaacucauuaaacauaacuguuuauaguuuaaagagaccaaauccauguaaccuugucauuuuccuacccgacugggcaucagaaacaccugaugcacuugucagagcuguccauucuugagcuucaccauugagauauagauucuguuggccugggguggggccugagaaaauauuaggcuggugcaaaaguaauuacaguuuuugccauuuaugucaaaaaugcaauuacuuuuccaccaacuuaauauuuuucuuuucuuuaacucuccagguaauucugaaacucagccugauuugggagccccugcaauaaguuuuuacuuuuacuuugcaccugaggaaaaaggcuccaacccaggugaagugacuuccccaaggucacacaggguaucaguagcagcauuccuucuaucucuuuguuccaaauuuucuuugcacuucaguccaaggcaacccaacugaaaaauaucugaaaaagacaaggauuuuuauuauugucugccucuaguaaagauuccuuggaugagacuagcuguucccagcaugccauuagauaagaccucuauggggcaagagaggaaagccuucccagaugccuggacuucagauguuuuccuuguuugauguugaaagcugagaauuucccuggcucaugaccccuggaaacaaaugcuggauuaucuguugcgcuggauuaucugugccuggccccugcagcugcauagagaauuguguguugccugcacagacugaagcucuccauccauccugcgugcauuuuguacucgccuguggugagugagcagagggggaugauauauggaaagccaggcaggcagcaguggcaggggagggggguugaggggaaugagggauugaugggaacucaacuacagagcucaguugggaaacucacaccccauuggagcugggauugauugcuggaacuuucucacccuucucaguuugucucagagccagcagcuugcacuguguccucugggcaccccuguggagagggaauuguucucaaggucagggaagcuugggucucucagugauggucuaccucaugcccucuucccagaggcaggcaacucugcacucuagaagccgagugaccuucagacagccuucuguuuccuaaaccccuuucuucugucuguacuuggccuccuucuuaucucuuuuucaacucucagcucacacuaaaugacuuccucccuugggugcuaucuguagaauguguggaauaugaccugccccagcagauuuugcaaggguaucaaaagagugagugagaagucuaagguggugucaagguuacugaggauggucaauguacuuaaugcugccaauugcuuuaacauggauccaggcacagaugucuucauuaucaucuacuuucccaggagagcauuuuuuagaaagugucuagccccaauucaaacugacuuguucuuugccuaacuuacuaacaguauauuugcuaagugcucaggcagugucaggcagaaggauagacccugugacuggagcugggagaccuguuuuugagucucagcucugcuugcuugcuugcuugcuugcuugcuugcuugcuugcuugcuugcuugcuuuuuaaagacaaaagucuuguucugucaccuaggcuagagugcuuuggaacagucuuggcucacugcaaccuccgccucccaggcucaaacaauccuccugccucagccuccugaauagcugagaccaugggcaugcaccaccgcaccuggcuaauuuuuguauuuucuuaguagagaugggguuucgccauguugcccaggcuggucucuaacuccugagcucaagcaaucugccaccucagccucccaaagugcuaggauuacaggcaugagccaccccacccggcccugcucugccauuucaagcugugcuucuuggccaagucauuucaccuuuuggagccaauacucacauuccaagguuguuacagggcucaaaaaugaccagaguaggccgggcacgguggcucacgcauguaaucccagcacuuugggaggcugaggcggaaagaucaccugaggucaggaguucaagaccagccuggccaacaauggcgaaacccugucucuacaaaaauuagcugggcgugauggugugugccuguaaucccagcuacucaggaggcugaggaaggagaaucacuugaaccugggaggcggagguugcaguaagccgagaucacgccauuguacuccagccuaggugacagagcgagacuccaucucaaaaaaaaaaagaguaguaaaagcacuuuguaaaccagaacauuccuuacaacugucaguugcugcuacaagguaacaugggaggaggcaaaauaaauaaaaacccaauucuaagggcuuauaguccaaaagggaagacacaaccuccaugggcuuaaccaaggagugcaucugcaaaccacugagaacuuuuugugucaagggcuccccccugaggaggguugguuccaggcagcugguguaauuuaggaaaacuuccugggaaagccaagagcauacccuuagucugcuuagccuuaggcaaagcggagcuccuacagcuacuucuugaaaaggccccaaaugcaauuugaugacauucugcaggaagucacaagcuguacuuguguggaauccagacucuacggggugcagcaugagucuccaauaagaaguggacuccacccacugaauugcugcuucccgcugcagcagacacagcucucccaucuccuggacaugaagccaagaugggacccaaagagagcugcaguguagaguuuggaacgucaucuaaacacggccaaucccuucucucuacuuaguggaacuuucuuuccagccccuccgucccucucugaagggaagaacaacuuaaaagcucuagaaagauaaaccucccucucucccaggguugcugagaagaagaaaugagaauaugccucucagggagaggcauacguaagguucacugaaugguuuuuauugucaugauucaucauugggcugaucucuuccucucccuaugucucaguuuuccacauacuucgaggagauuagacuaaaugauauccaagaaccuuucccuuuuacaagccacuccucccugaccuguuguucaauaauauuccuuuguagccagugggacucgugggcccaguggaaguuccuuagaagaccgaggccuuugucaccacccacaaagc

SEQ ID NO: 14061 - RNA, 9138 nt, Homo sapiens
gcugcuuuaguuugccuuuuauuuuaccaaaaauaacaacaauaaagucuucccucuguuucauaaaaauaaauuuuccaacccucccccuaucccagaaaucagcccuugccacagccuagaauccaucaugcaagucacagcacucugggaaaagcuccuacuacccucgcuccacagccucuggcaaagcugccaggccacucuggaggcggcagaggcagaagucccaggcccagcuggcugggcccaagagcuccaucuguuuccccaaaguacaggcagcuucuaggccauugaguggggcaugauauuggaugcuuggcucaggaaacaaccccagccaacccaaggggcagugggacauguuggccucagguuagaaauuauugcucaaagcagaaacaguuguguccuagagagggucuguuaaacccucuuuccauguguaucucuauguagcaauugaugggcccugcggucaggaucccugguuucuccagcuccaugaaugccucccugugaggcccuggacaguuucucccucuucuucuccuggcuucaguuuccccguauguacauugagacaguaagacuggaugauucucagguucccucuggcuuuccauucuggcaucccagaguggaggcucugggagggcagaacccuguuccugccucaguuuccccaccugugggucugcguauagggcuggguauggagguacugaguaauggagugcugcgugaacaucccagucucccuguggauagcugugcugugagauccaacuggcuggaaugugucagggauggcugggaaggaggcagguacuuuuaggauggaggaucuccaugccuggaagaguccauucaccaacuacauccucaaugugcugggaugggagacaagacuccaaaguucccaauucaaguuccacaagcuccuuggacggggagauuauuuugugcugggcuucagauccgaggagccaggucuguagauucugggagcuagaguggaguauaugauucccagaugaagggccaggggaccuuuguguacuugagggaucaucuccaacccccaggaggacacguauaauacaggccuucuuggaggcagagggaugaguaaaaugucagcucaugggcaucucuggguaagagaaucagagccugugucugcagugggucgguuuaggaacucaaggcaaggcuccucuuccuacguucccccagcucuccaggacucaugcugauggaagaguguagccuggaagguuugaauguagagcaacaucuacaaccacauuuuugugcacuuacacacauggucagauacacugaguggggacgcugagcugucaucacuccuacaguggucauggucugauggucccauggucugauggucccaaucuauuuauccauccauccaacauuuauggaaggccuacuaugugccaaggagggguaaggcagcuagcucucacagacacaccccacagugaaaaucacacacacacacacacaccccggcaucugugcucacucacaggcagacugcucacuuucuugcaccuuucuugccaucaccucggccacacccacauuccuccaauaggcuugggaaccagcauggaagggucaagugucauagaagaaacccccuagccuacccuacucccagacuucaugccagagguuuaacuccacuucccuucuguuugccugccuagaugcucuccccuucuccauccacaagcggucagggcgacagguaggcagacuccugagaaccagaaguccagaggcuuuggguguguggagugauuccagugccuucagauuccuucaggcuccuggggguccccucugccagccacccuauguucagaucguccaucugauggccaaaaaaguccagaccugggcucaguggcagauccgcucugucaucucccucuguagagacacaagguagggaggggucaauuagagcucagccuacuaggcaaucccuucccaaaccauagggccuagcugcucuucugucugagccuggccuucccccagcaaccccaacucuuaggcugcagaucuggguuuguaaaccaacacuugaaugaauucucuauugaaguacagaauucacuguuaaaugaauugccuuccccuaauucaucuacuugggcguuggaguuacuuaaagcaggcagcuuuuggacgugaaaacucagaggcuagccuugguaggggagggugguagggcuuggccucaccaguggcuccagcucccgcugguccaccagacugaacucgcggaugaaguaguagaagugcuuguagcagguguugacgugcgccucugcccccaugcugaggaugcuaucgaagugguggauguagacauggacaaagacucggaagaggcgggucaggaucuuggugcagaccugcuggaaguucuuagggaagggaacuccuagagggcaggggagggcagaaggggaucaguauccuggugccaaagcucugcucaacuuuucccucccacacacaggcaaccaggauggcuuuuuccccagcacacuuuuuaguacacuucccuuuggaaaacagagagugguuugacuuucucccauacuuuucuuucuuucuuccuuucuuuuuuucuuuccuuuuugagacggaguuucacucuugcccaggcaagugcaauggcaugaucucggcucacugcaaccuccaccucccagguucaagguauucuccugccucagccucccaaguagcugggauuacagacaugugccaucaugcccagcuaauuuuguauuuuuaguagagacaggguuucuccauguuggucaggcuggucuugaacuccugaccucaggugauccaccugccucguccuccuaaaugcugggauuacaggcaugagccacugugccuggccauacuuuucuuucuaaugaagcacaaaucugacuguggcucuccccugcuggaauauacaucaucuuccacauuuucccauuaccuaaagcagggcuuugcaaacuugugggggucacugaccaacccuuuuuagacuaugauaaaaguuacgaccuaaacucuccccagaaauaugugcaauugcagagaugcucacaucacacucuuguauacaacuccaaggagaguucaacaacuggguccauuuaaaaaaucccugggccuucaggauuaaguccuaacuuuccagcaggacgcugcucaaggccuuucaugaucuuauccugaccucccucucuagccccaccccaugucccuccucuuuucaacauucacacagaaguccucagacccccaauccuggaaauuaugaauucugcaagaguuaguucagacagcccucauuccuucaaauauucaacaacacgaagaaccuuccauuuaugagcaaggccuugugcugggcccuucacaccuuuugccucuaauccuuagaacaauucgccugaugugucugauugucacuuuagauaugauaaaacagaagugcuuauaaaggugaagcugcuagcccaaggccacauaaguauuaaucagugcagaauggagacuggauucagacccucuuugcagugcacugcagcgacccucacagauauugggacccaugaaaaaggccccgcuucugcauagucccccaugcucaaggcagagaucuugguggcuuaugcccucuucucuguguggcagucacccaggguuuuaggcaucgauaccuggagucccacaggcccagggagguauggccagcagggacuaugaaucuacauucagguccacagcuggcccacccggcucuguagacccccuccucuuccucaccauucccagguggggucgagccuucccucccucugagccccuccagcccagcccagauuccucagacauauccugcccauguagacuugggguccugggcucccacagaucugagccccaguucggaauuccucccaguucagugcacuuucccucaguagccucaaguuuccuccuauguaaaaugaaggugcuccuugucgggcaugacagugcaagaaacagcaggccacuggcuggggaggagccgugggcauugaauugugacucagugcccagcuuccuucagcauucagacuucuccccucagggcuugaccacccugccccacccaccgcugauccacacagccucugcagagaugagcuccaggccaggugggggcugggcccagcuacaggugcggcuggugugaugaacacagugucaugccugcucagcuccuggaccaacaacccccuccugcugcccucggguggguaagcagugccugggugacaucacucaucuccccucccuacccucacccgcccaggcugcccagcugagauaagaaaaggccccacagccugugccuggcaagggaaaauucuguccucagagccccaaucugaggugaugauaccaccagggcccacccaaccaccaacucccuccuuuuccugaggccaggagucagagggaaccccgggaggcuggaggucaaaucagcuaugaacaccucggggcaacuguucuggaagguucugagaaucacagcaucuguggucuugccagagugguccuuggugggaccacuuaugcuuuagaaaagaaaagcccucugagguggguggaucaccugaggucagguguucgagaucagccuggccaauguggugaaacccugucucuacuaaaaauacaaaaauuagccaggcgugguggugggugccuauaaucccagcuacucagaaggcugaggcaggagaaucgcuugaacccggggggcagagguugcaguaagcugagaucucaccacugggugaaagaccgaaacucugucucagaaaagaaaaaaaaaaaaaaagaaagaaagaaagaaaaagaaaagaaagaaaagccccaaauugggagucaggaaguccuagcaaaugcuugaccuugagcaaggcacuuaaccuguuucaaccucgcuuuccucuuccacaaaauggggaugaaaaucaacccccaacccugcagagugucuauaucaaacuaaauccucaucuguggaaugggcucccaguggcucccuccccgccaggugacacucaccaacacgcgugggaaagaccucuucgucguugaugaggccuucgauccaguccaugagcaaugccauauagcgcggcgcagagagcuuggcgggccgccgguacuggcgcucguccugccagcgguacucguagcggggcccgccggccaugaccgggcagcuggucucacugcagcgcuccgccauagugccguagaugagguugaugcgguugaagaaguccaccacgugcacggcgauccagucgucgauguucuccccgggugguagccucaccacacugcgcagguccaggcccgacuugagagaggccugugccuucuuguacagcucaaagcgcugugugcccggcucaaagcgcuuccgcggccggaacgucuuguccuuggcgaacaccugcuucaggcacagggccauggccagcugggccuggggcugcuguccaggggcucggaccugaggauacccugccagggacaagggcauaggggagcuggcggucaaggccuuaucaucugggcucugacuucccaauucaucauuucccugucaccucucagccuuugcucaaccucugcauccucugccuggaaucuaaguccucagccccuagguccagugccccgcccucuuuccaggcuauguuagucccccuugcuaagcccccacaguccucccaucuugcuuugucucuuuucugcuuucauugcagagcugggccugggcucuaaacaggugccccucagacuugcuguuggucacgagagaggucgcagaggcucccugcaggcccaccagcagacaggggcuuggacgagaugaccucugggagcccccuuggccagcuggugcaacgugggagagccucgcagcauugugcugggggcaggguggaggggggucggggguggcuuucggcuuccucugggauaucccguaguccauccggccaccggggauucccagggagcagcagggaacuuuucuaccaaaaauguccuuuccuuuuuuuucacccugaaagaggaaagggcccucccgcugccagcugggcggcuucugaguguggcugcaagcacuggaggagggggagggcggcaggccaaugagggcgucgcuuccucugacaacagcuggagauccuuccccucaagccagccuccuccagccccaaaucugaacaagccacuggcuccucccguugcaccugacacucaguagacauuccucuagcaacuacuaugugccuggcacugggagguagaagaguauagucagaugcacccaggagggcccaucuagagcucaggcaaauuuacuuugccuccuagaauuuaaggaucccagauucagaacaaauuuugggagacagugaucagggcccuaggcucagaggcaggaguccuggguucuagucccagcucuaccacuggcuuacugggugaccccuguaucaccauggauuuagcccauccagguccugggucacucugcuauagcuagguuucuaagaccugagucaucucaucucaacugugagugugugagcuacugggaaaugcagacccauguaccuaccaaaacuagaauuuagccacccacuaagcacacugccccugccccuagacugagcacuaaggcugaguauaagcuaagaauugcauucugguuccuggcugaccucugaccugggcucuggcaagugugagcccugacucuagccuuuagcccuacccugaggcuugcuuauggccaaagccugggcuugaccucugacgcuggagcacuguccuuucucacaucucugguaacccugggacaggauuggggaagggagggugggaaccaggugacaccuggguaaaagcaaagggauggcacauauuucggggagggguauuacuucuggcaagaagucaaacuagcuggggagcuguuugagacaaagguccuuccuugaacccacaaaggcaggccaggaugggggcagucugguaaaaugagagcagcuuggagaguagaaacaggccauucagcaggaacuuguucucuugaaaaaaacucacagaugugaaaggucaucucauccaucccgacucuucgacuucucacccaaagaaguccccagggugggaccccaguuuccagagcaaagagauuucugcgcuucauuugccaucuccauuuuaaacucugcuuggggcaagugcuuccaaaaucccucacacugcaauuaggcggggcuccugggcuccccacauugcauggcccccuuuaugacaguuagaaauaggcccccacccuggcauucagcaccuuguccuaccuuuccugccccacuucccaccuccccacaccaaccacccugggcuucuuccugauuccugaacacgcccccacucuuuugccucugcauguuuucuuaucccuccaccugccugaccacacauccucagauuggcugcuaccuccucccacagccuccucuccugaacucagaucuccuucuccuuggguagaggcugcuuuuggucauugcagucuccacuccauccccaacccacccccagcuuaggacaaggccuggcacaaagucaguguucaggcuuuaaggaaagcuuagacuagaaucuuagaguuaaaauagcccugauagaucagcuggcccaacucacuuguacagauggggaaacugaggcccagaugaggaaacugaggccuaaaaagaggacuugaggagccuguguccacauagcaaguuacaagcagaacugggaacugggauaagguggggcucagcucaugaccaagaguaaaagaccauuuuccugcacuggcucaucaauggucugguggagacagagaagaggaggggaguggagggacaguggaagcaucuucuccaccaaacagcccaaccugcuuccuguccccaacacacugacuccgcacagcaacugggguguccugaccagugagcuagaguuccaccuuacuccuguggaacuucaaggccugggucucuuuccaggaaaauguaagcucagggggugggugcagggcaggugcucuucuagccacaggguuaacucccuucacuccccacccccaugcccucacugaguuucuaucugucacagaaccucugucucucccugaaccacugccguuccccguccuagcccccauuucccagugauggcuauccuuucacuccuggaguggcagugccuugcucguucccugggugcggaucugggcuucucaaaugaagacagcaggcugacccuaccuguuucugauauuuagcccccugcuaggcuacaucuaccacuccuugggccuggcccaggaucugggccagaggauggccccaguuugaacccagaauccauccugggacucucucuaggacagaggucgaagagaaaaaguagaggcgaagacuccacgcucuccucgcggcgcgcagccacccacgcccacccccggcuucccugcaaccucaaaccagcucccagggccaggaaggucguaggacccagaggagcccgccugacauuuccgcuccccgaaaacacgccccccaaccccuccccucugccccguacucccccaccccgacaaucccccccgcaacuuucgaagcucugagccucggacgccagccucaggacagcggccagccugccuucgggcgggacucuccuccggacugugccacgccaggacggccgaagaaaugaaaguggaagccaggcgggcggggugcgcggcgaggccgcaggggcacggcgcacacucacggguccucuucuggccguggggucacauucccagccacaggaucgccuuucuccugcaggucccgcagugccuguucucucuccugucagccuguccgucugccuguccugccggccgcggcugcccuccugccccgggcgacg

SEQ ID NO: 14062 - RNA, 9764 nt, Homo sapiens
ggccaggccggggcggggccgcaagcggcauggaggaggcggaggccgcggcgagccgggccgagcagugagggcccuagcggggcccgagcggggcccggggccccuaagccgugagugccuccgcguggguguccggaacggguagcgcugccggugcaggucuccugagcccucgggcggcuccgggcccugggaggaggagagaagcuggggcagauaggaugggacgaggguugaagacuggggcaggagaggucgcucuuugcucaccacaggcuugggaaggccuggaacuugguccuuguaggggcuaacgaacuuugagccgauuauuuggccuccacccuuggacagccuugauucagagaguuacuccagucucagggaauuuccaggugauccaaccccacugaaggguuuccugccagcccagagaaguugagccacuuuccccaugucacacaguaugggugcuugcagggaagaguugcugggagguccucccucaucuccccagaaggcaucagacuuugggaggagcaucuuaccccauguggcccucuggucccuucagauuccugaagucaugggcuggccaggacauuggugacccgccaauccgguauggacgacuggaagcccagcccccucaucaagcccuuuggggcucggaagaagcggagcugguaccuuaccuggaaguauaaacugacaaaccagcgggcccugcggagauucugucagguauagagaugucccaaacccuccccaccgagcgcucccucccagcuuccuccccaccuaaaucaggcacugggaccccuguuggccagccccagugggaaaggggcagcagguuccuagaggggagaccucuaugugucaugucccuauagguaaugauuugaacccaaaguucuggaaucggaacccaaguacaacuucuaagcuucugacggaagccugaagucugaucaggcuggcuuugcagagaggcacaccccugugaggcaguuagggccaggacccaggucugaucccccgcuugggucccugggccuggcuccaucucuagaaaccaacaauggaggggaccaaggaaaucaaggucucaaauagaagaauacaggagcacuggguagggagggcccuaauggagggggaagugucaggggagguucccuggggaaaguggcugugaaacuaggcccuggucaggggaguagagcuaggcagacagaggaagggacaggacccaguuucucuggaugucuucacugcagccagggcccuccuuucagaaagacccucuaggaucugaaggaggugcuccucuuaaucaucccuaccccuccccucagacaggggccgugcuuuuccugcuggugacugucauugucaauaucaaguugauccuggacacucggcgagccaucagugaagccaaugaagacccagagccagagcaagacuaugguagggcuaggcuaaggaugggguagggggccuuggaucucacagcuggaguggcaggcagacccuaagcggugagacucugcugaggagacuaucuccaugaccuguuguaccccacagaugaggcccuaggccgccuggagcccccacggcgcagaggcagugguccccggcggguccuggacguagagguguauucaagucgcagcaaaguauauguggcaguggauggcaccacggucagugggccagggucugguguacagucacucuauucugcucagggcaugguccacuggcagcagggucuacugccuaagugggaacugcaacucugccaguuucuagcugugugacuuuggaguccucgauuccuuaucuauagacugggacuaaugauuucuacuugucaggauucaaugaaaaguuugugaagugucuuguauguagugggaucucaaaaguaaucauucauaauaguaggcagucaauucauugauuuauuuuauaaccauccccugguccuuucuuuggccucagccuugugcugggcacuggggaccugaaaguaaucagaccuggcccuaccuugagggguucagugugguggaggauugugauacuuccaggaugaagcagagacagcagaggcucuaagagccaugaaagucauggaggggaggguuguagaaagacgugaucucuucugaugggagugcuauagaggcuuucuggaagagguggccuucgagcugaguuggaaaagaacugugugaacagaaacauaggcaggaggugauguuucaagcagcugguguuuuaaguaccccuaagacagagacaccuugaaugccagagugaaaagcuggacuuugucucugccacuguguaggugcuggaggaugaggcccgggagcagggccggggcauccaugucauuguccucaaccaggccacggugaguuucuaggggugggugacccagagggcuggagcugggcucuugcugaugacaccaacucaccagaaguauauccccugccagggccacgugauggcaaaacguguguuugacacguacucaccucaugaggaugaggccauggugcuauuccucaacaugguagcgcccggccgagugcucaucugcacugucaaggucaguuauucuguccugacccugaccccuacucccuagcuccaacccugcuucuagccccggcuucucugccccucauauaacauagugggaagauucucugaaggaagguuacucagguuccaaucucagccuuaacauuuguauuaauucagcaaauaguuauugagcaacagcuguaugccagguacuucucugggugcugaagauacaaugggaaacaagacagaguccccacccucauggagcuuauauuccagcagugggaggucaacagaaacagccaaguaaauguggauaaugcuaguaaaugauaacuuguauaaagaagaaaauaaagcaggggauaaugaaugauagaggggaggggacauuuuagaaagagaaggccccugcaaggagaugauaugugagcagaaagcugaggaauugaggagugagccaggugaguaucuggaggaagagcauuccagguggaaagaauggcaagugcaaagccccuauagugggaagguacacggcauauuugaggaacagcaaagaugcuagucgagguggagcagaauaagggaggagaguaggagagugguuggaaaagaaggcagagaguggcgggagagagaggugcagaucguguggguuuguggaaaggacuuauuagcuggaugaccuuagaaucucuaagccuucaguuauuauuuuaucugugaaagagaguaaccauagaggguuauugcaauaauguaaugagcuauuuuaaguaaaagguugcuacauaguucgugcucugugaggccaggucuccuggaaccaugccagucaggcuaacugccuucucuggucccccaggaugagggcuccuuccaccucaaggacacagccaaggcucugcugaggagccugggcagccaggcuggcccugcccugggcuggagggacacaugggccuucgugggacgaaaaggaggugccggcaucagaggccauccacucuguaguaucaagagccugggaggagcagaacccuaggagauggggugggguggggaacaaauaggagccaguggcaguggguuggaugaaaguaggcagggagaugggaaaaagcccccaaacuggugucugggcccccauggcccucauuccugccuccugccagguccugucuucggggagaaacauucuaaaucaccugcccucucuuccuggggggacccaguccugcugaagacagaugugccauugagcucagcagaagguggaguuaguggagcauggauggggcagggccugggcugggggugggcauuuagaucucucuguggagcuuuauuccuuugauugugugccuggggcucuucaaaccuugcuggccccaugccuccaugacaaccgcauccuucccucagaggcagagugccacugggcagacacagagcugaaccgucgccgccggcgcuucugcagcaaaguugagggcuauggaaguguaugcagcugcaaggaccccacacccaucgaguucagcccugacccagugaguggggccuuaagacagugagguuuggacuccuucccagcucagcaggggggccccaggaaugaucuagguugggcuuucccuaccugagccugggagagaaccaggggcaggauuuacacugcgcucugaaagacagggcuggggugaaggggcaggccaugugaguaaagcucagcgcuagaguugggcugaguguguggagagcccagaacagggaagauccucuaucccuucccugucuacuccagucugcaccuacccucaccugagaagucuucccuagguggggaucccaguuugaagggggaauaaggcaagagcuaaacgcuauuucucccacagcucccagacaacaagguccucaaugugccuguggcugucauugcagggaaccgacccaauuaccuguacagguaagccugggaaugggcuauacccagcacugaacaggagggugcuuaggucaucuaccuccaggaggaacucuugaggugggcagaaaggcaauagauucuagacgcauucaccucuguggguaagcauagggacucugggcccagcuguaaacacaggggaaccugaguugaggggugaugaagugacccuaaccuaucccugggcuccccaggaugcugcgcucucugcuuucagcccagggggugucuccucagaugauaacaguuuucauugacggcuacuaugaggugagcaggacuuggggggugccucggguggaguacaacauggagcagcagugauugccagggacgggcaagggagaccgcccaggcaagggcugugaaaugugaaggccuuggauugcagaggugggcagagggaaagugaccucacauggugagcaguggccaugucccccaggaacccauggaugugguggcacuguuuggucugaggggcauccagcauacucccaucagcaucaagaaugcccgcgugucucagguacugcauaggcaaguggggauggggcagacaccuggcucugccuucuacccuaaagcucaugugcccuauucccaccccacucccagcacuacaaggccagccucacugccacuuucaaccuguuuccggugaguacuaaggauacaacucuugggccugggaggggggaaacaugggcauaaggucugggccuguuacguggcaagcucuuccccucacugggccucauccuucacaucuggaaaauggggguaaugcugccugcaagaagaggguugggggcaaaggagaucacaggauggagagaccccuuugggaccaugaugucccauuccccuucuaggaggccaaguuugcugugguucuggaagaggaccuggacauugcuguggauuuuuucaggugaggggagucucuagguuucaguugaggucccucagucugcagggaaagagucagugagguguccuagagagcuuucuggaggacaugagcucacaagugggggcgaagccugggcaaagguaggauggcagguguuggggcugcuguugaagguacaguggaugaauggagacaguggggauuugggggaaggagguacuccaggaaggaggugcuccugagacccagcuccagcaauucuagcaucucugugugacuagauuuauccuugucccucccugaacucuuugacccugccucucucaguuuccugagccaauccauccaccuacuggaggaggaugacagccuguacugcaucucugccuggaaugaccagguaggcuggaaugaccaggguuuagcaggcgaguuuaugaggccucagcuaauaccucccacuauggcacccuguccccagggguaugaacacacggcugaggacccagcacuacuguaccguguggagaccaugccugggcugggcugggugcucaggagguccuuguacaaggaggagcuugagcccaaguggccuacaccggaaaagguaacugucaggguagggugagggggcuggaguccccuaccaacucgaaacaucuuaaccuucaucgugguccaugucugccagcucugggauugggacauguggaugcggaugccugaacaacgccggggccgagagugcaucaucccugacguuucccgauccuaccacuuuggcaucgucggccucaacaugaauggcuacuuucacgugagugggaggcagggagcagggcacaguguggcaugacagucaagaacaagaacauggacucugaagcaaucuuagcucugcuacuugcuagccauguaaccuuggggaaagagcuauccuauuuuugccucaguuucuuuaucugaaaaaugaggauaaagggcugggcgcgguggcucacgccuguaaucccagcacuuugggaggccgaugcggguggaucacaaggucaggagaucgagaccauccuggcuaacauggugaaaccccaucucuacuaaaaauacaaaaaauuagccgggccuggugaugggcgccuguagucccagcuacuugggaggcugaggcaggagaauggcgugaacccaggaggcgaagcuugcugugagccaagaucacgccacugcacuccagccuaggugacagagcgagacuccaucucaaaaaaaaagaggauaaaauacuacuaccucacuggguuacgauauuuugagguuuaaaugagucaauauauguaaagugcuuugaauuauaaacauauauaagggucagcugguauuguuuuuauuuuuacuauuuuuagcacuagacugugggugucuggggagaguauuucugccucuaaguacugguccagcccugcaaucucugcccuuuccuguuuuggcaagugcuggagccuaugcuucagccugaggagaacagggaaguccuuagguaccgccaacccaccuggcugcauucagaggaccauuccccaguuacagcaagggaggccuugagccagcccagcccaaaggaaugaauagcguccagcuuggaaccuccuagaagccagaggucccucagaggcugacuaauacgcgagccccauuccucucccagagaggggcaggcgcuucccucaggucacucucaguaccagagucaaaguaguuuuuuccuucccagcccagcccgucccuuugcccaccaccuccugcagggccuguuucugacaucuguggcucuagaacagcaggcccagggagaacuacaagaggcagggacugcuaguucaugggucuguggugcaguagugugagcugccgugacagcaugagcucuccagcaaugguggaggccaaauuaaagcuaguaagagcuugcugaggaugcugcaaagaggauggagaagacggugggaaauuagagggcucuuuacaggucuaggacuucauuugugugucuuauagaugucuggcuggucagcaagugggugugggccagacaaugugaggugcugauuuucacucucauacccacuccaggaggccuacuucaagaagcacaaguucaacacgguuccagguguccagcucaggaauguggacagguuggggcuggcagcagggcaagggguggauaucuaggagauuuggaggccagucccugaaagucccuuccaaugcugggccuguguguuuacuccagcccugcggcuacagauucccaugugaccccuugcccugcucagugcuacccaugggaccugagggccugcccacuccccugacccauuucucccuccucuucagucugaagaaagaagcuuaugaaguggaaguucacaggcugcucagguauggccuaggacaauugggguguagcagggagcaaagagucaaauacuggggaucuuggccccauaauuuacaggguccugugcaaaaugaaaaucagggcccucaucucaaacauuaggaacuucaggccgggcgcgguggcucacgccuguaaucccagcacuuugggaggccgagguggguggaucaugaggucaggagaucgagaccauccuggcuaacacggugaaacccugucucuacuaaaaauacaaaaaauuagccgggcgugguggcaggcgccuguagucccagcuacuugggaggcugaggcaggagacuccagccugggcgacagagcaagacuccaucucaaaaaaaaaaaaaaaaaaagaacuucaagguggcaacagcagagcauucaaccaaguacaggguccugugggacacacccaugaagugggcccugucuuggcuauauucucccacccucuacugcagugaggcugagguucuggaccacagcaagaacccuugugaagacucuuuccugccagacacagagggccacaccuacguggccuuuauucgaauggagaaagaugaugacuucaccaccuggacccagcuugccaaggugcuccaauaccaugcccacccuggagaaccccucccccucacacacauacugccccaagauccagggagccuuugcucuggaaucuucaaccucagaaccuccucuuuauacucuuagaacaccucuuccaaccuccuuguccaaauucauauucuaaaagaugcuaucucuuacaaauugaggugguuucugaggaggggugggggcugggccaaagggucgucagugaccccucccuacagcucucugacccaugucucugucuccaucccacccucacuagugccuccauaucugggaccuggaugugcguggcaaccaucggggccuguggagauuguuucggaagaagaaccacuuccugauggugggggucccggcuucccccuacucgugagugacccuuuucugcccugggaaacaggaggccuagugagauccagggauauagcuaauggcuucuucucuauacauucuuguauuauuuucccagagugaagaagccacccucagucaccccaauuuuccuggagccacccccaaaggaggagggagccccaggagccccagaacagacaugagaccuccuccaggacccugcggggcuggguacuguguacccccaggcuggcuagcccuucccuccauccuguaggauuuuguagaugcugguaggggcuggggcuaccuuguuuuuaacaugagacuuaauuacuaacuccaaggggaggguuccccugcuccaacaccccguuccugaguuaaaagucuauuuauuuacuuccuuguuggagaagggcaggagaguaccugggaaucauuacgaucccuagcagcucauccugcccuuugaauacccucacuuuccaggccuggcucagaaucuaaccuauuuauugacuguccugagggccuugaaaacaggccgaaccuggagggccuggauuucuuuuugggcuggaaugcugcccugaggguggggcuggcucuuacucaggaaacugcugugcccaacccauggacaggcccagcuggggcccacaugcugacacagacucacucagagacccuuagacacuggaccaggccuccucucagccuucucuuuguccagauuuccaaagcuggauaaguuggucauugauuaaaaaaggagaagcccucug

SEQ ID NO: 14063 - RNA, 1129 nt, Homo sapiens
aggcaguuugagcagaaugacuguauuuguuguucaccacccacacggccccuaggagaugcagguccagggcaaaccaagcuucugggcuagcuucugggcacuucuagaggaucagaaaaaucccagguugccugagaugucugagaacugaggagaggaaggagagggaagaguuugaggaaggaagcaguucuggaaguucccugccucuuggauucagccccuccccaaacccucugcuuccagccaauccauccuccauuaaggcugucagcacuuuggggugccugccaucaggagucccccauauauguaggggugcuauuucacagagaucauccuuuggcgugccuaaacagaaccagguagggaaaucuucacuggcucugguuuuuuuuuuuuuuucuugagacagagucuagcucugucacccaggcuggagugcaguggcgcgaucuuggcucacugcaaccucugccucccggguucaagcaauucuccugccucagccucccaaguagcugggacuaaaggcgugugccaccacgcccggcuaauuuuuuuuuguauuuuuaguagagaugggauuucaccguguuagccaggauggucucgaucuccugaccuugugaucugcccgccuuggccucccaaagugccgggauuacaggcaugagccaccgcacccagccuaguggcucuguuuuuuaaaaccccacccuggcucacaggcccccuggcuaaccuugaggugggaagauccacacuaugguggugucaguguggguguuguugauacccauggcccugguggcaggauugauggcugcacugcuggcaguucgaccucggagacccuguugauaucuucugcggcuacacuugaacauccugggaaaucggggccugggccagcccauaccuggccugcgguagggggaacgcaugcccuggggccgagggccacggacaagccgagauggccccaugggcacagggagcuucugcagugugccuggggggugcuguuggccaggguagcugaggccucuaugacauacaaagucugcauaagggcagggcccuuuauuacaagucgugggcccuggccccuccucauggguca

SEQ ID NO: 14064 - RNA, 604 nt, Homo sapiens
uuuuuuuuuuuuguaucaaagaaaauauuuuauucaaguucccaaaacaaacuucaggaguuaugcuggguuugaauugaagaaaaaaggccaaguuaaaauaggaaaacaaaugguuuucauuugguggcagcugaaaucaaaguauacauguauauacauucuaauccaucaucuaucccauguggcauuuuccaagguuuuaagagucuaccacgccaaacccuuugccacuuucacugcuuuugcuuugcuuuuccccuuucuuuucucucgcuuugccgucagccuuuuucuuugccuuugguucauccauauuggguacuguccaugcuggucuagaagagucuuuuuguuucucuuaguaucagucucccuuuucaugucaucuuuuucaucuuuuaccucacauugcauuuucucuuggcaauguuuggguaccaccacaguugcuaucucuugaacaucuuucauuaaaacaucaccgucuaguuugagaauacuuuuaagccugcuggccuccuuuggggcauucuuuuuucucuuuucagcacgcaucuuucuuuuccacuuacuccguaagcuuuuagccauguuucaccug

SEQ ID NO: 14065 - RNA, 1308 nt, Homo sapiens
caaggccccgcccaccccgaccccucagguccagccuccuuccucgugcaagguuuuuuuucccuuuuggcgccaaaucuucguugguuauauucccggguuauccagggguucuaccagaggcacacgcuggggacagaaggggcgugaaggccaacccgcgcgccagggccccgccucccggccaaccgccccgggcugggggaggaaggagaggggcaggcgaaggauacagccgccgcugcccccggcaagauggcggccgcgaaaagcggggcagggggcgccagccgaccgccguuaccgcugcugcgcgaggcucucagcaaaagaaggacugcuccagugaccaggccuucccgaacagcgacagcugcucuugggaaggcaaguacucccgcccaccggucugccccuucuccggagcccccguccauuagcccuccccgcggacuggccagugccuuaagcuuuccacagucccgcuuacuugucggcagaaaccagcuccgcggcgacggcggcaguggcuguggacuccauggccaucguuccccugagguggcgaaccagcgaacggaauagagccugcgagaaaaacaggcaauuugggacgccagagacucacucagggacagaaaauggcagauuagagaccccgcgcggccggggcccuuuuauauacgaggacccuucgccccgcccauccacuuccggauccucccccucggguuuaaagggccaggacucaccacccauacccuccgucccccgccggccuaccacuaucuagacaccuccugcccucuccauauggcuccgcgggauuguuucccucccuagcccgacuucuccaauaaacagcaacuuccugcuucuccagcaagucgcauaagaagaacuggaaucuugacacuacaacuccugacaggacgccccugcggcauccagagacagggaagccagugcugcucugcauguucagggcgaguagcugagagucuccuuccggccuggauacugaggaaggugacuuagacuuucucuccguccucugagucguaacggacggacacgcaagggccgaggacggguacaagcagcagcgacuagaacugaucugggugagaucuaggccucagcaacaacugacgcaaaaagauuuuguucuaggauuggcuacagcugaaacuaccgcgcuugauucaaagcucggggcuugcagcgggaggcagcuggcuccucccucugaacccgcccccuuuggcuggcccaauccgcugaucccauccucuuaggcccugccca

SEQ ID NO: 14066 - RNA, 1308 nt, Homo sapiens
ugggcagggccuaagaggaugggaucagcggauugggccagccaaagggggcggguucagagggaggagccagcugccucccgcugcaagccccgagcuuugaaucaagcgcgguaguuucagcuguagccaauccuagaacaaaaucuuuuugcgucaguuguugcugaggccuagaucucacccagaucaguucuagucgcugcugcuuguacccguccucggcccuugcguguccguccguuacgacucagaggacggagagaaagucuaagucaccuuccucaguauccaggccggaaggagacucucagcuacucgcccugaacaugcagagcagcacuggcuucccugucucuggaugccgcaggggcguccugucaggaguuguagugucaagauuccaguucuucuuaugcgacuugcuggagaagcaggaaguugcuguuuauuggagaagucgggcuagggagggaaacaaucccgcggagccauauggagagggcaggaggugucuagauagugguaggccggcgggggacggaggguauggguggugaguccuggcccuuuaaacccgagggggaggauccggaaguggaugggcggggcgaaggguccucguauauaaaagggccccggccgcgcggggucucuaaucugccauuuucugucccugagugagucucuggcgucccaaauugccuguuuuucucgcaggcucuauuccguucgcugguucgccaccucaggggaacgauggccauggaguccacagccacugccgccgucgccgcggagcugguuucugccgacaaguaagcgggacuguggaaagcuuaaggcacuggccaguccgcggggagggcuaauggacgggggcuccggagaaggggcagaccggugggcgggaguacuugccuucccaagagcagcugucgcuguucgggaaggccuggucacuggagcaguccuucuuuugcugagagccucgcgcagcagcgguaacggcggucggcuggcgcccccugccccgcuuuucgcggccgccaucuugccgggggcagcggcggcuguauccuucgccugccccucuccuuccucccccagcccggggcgguuggccgggaggcggggcccuggcgcgcggguuggccuucacgccccuucuguccccagcgugugccucugguagaaccccuggauaacccgggaauauaaccaacgaagauuuggcgccaaaagggaaaaaaaaccuugcacgaggaaggaggcuggaccugaggggucggggugggcggggccuug

SEQ ID NO: 14067 - RNA, 1064 nt, Homo sapiens
aaggcugcgaacuuaagaaauauuuggauagacaguucucauggcuuggugugguuagacgugguccuccgugggcagcagcuaagacgcuuacuccaguuugggcauugagggcacagugcguagugguccuggaaguaaagagaauccugguuuuccgcagagaucuaggauuaaccuaagcguucggguucgggagcggccacaagggcgccucacuccaaccucagccauccgcaacagggugggguauuaguauuuuuccgcacccgccccaacgagggaaagcgccgagucauuccggcggggcgcgccgggcggggcucgggccacaucccccuccucucucuccuccuccggcacccccguccguuccgacucucgcgagaucccuacuggcuauaaaggcagcgccccggagagcucuugcgcgucuuguucuugccuggugucggugguuaguuucugcgacuuguguugggacuggugagugugggcagugcggccccugcggagugaggcgcggcgcgcccuucuugccuguugccucuuccuccuccuguccggggcccgcccgcgcucgggugggggugcugugaugcgugaggcagccgggggaggcccggaguccgagacugcuugagcgcugcgcacaccccucucgugggccccccacguaggugcgggaaccugguugaaccccaaggcaagcguggacucgagucgagucuucccccggcaacucgagcacguggcgcggcgucugggcgggcugguggugggggucuccgagacuagccuccugccggacgggguggguucgggaagcuucuggaauggaccuguauccagacucguggcuguagaagacagccucuauguauuuggcuguuccggguccugagccuugacuagcugcggagcuucggguacccuuuccccgucuuuauuuuccuguacguggaauggaguuagcgaugagcccaaauguccccgcugaagcacucucucugcuggugcuuucuccagugcuggggagggacagggggcaccugaaguggggu

SEQ ID NO: 14068 - RNA, 9978 nt, Homo sapiens
ucaaaacguaacggcccaauuguccuugagacuucauuccccagcaagcucagcguguaacgugcgcuauggagccgaaagucgcagagcugaagcagaagaucgaggacacgcuauguccuuuuggcuucgagguuuaccccuuccagguuaguuuaucccuccugcuguucuagggcgaaauauaugauuggcuucguugcaacuggcgugaggccucgggagccucugauccuccuggguuccugcagcccaguguccaugugacaacagggacagaguuucagugggggcuuggguuaaaaagguaguggucgaggccgggcaugguggcucacgccuguaaucccagcacuuugggaggccgaggcgggcggaucaccugaggugaggaguucgagaccagccuggccaacauggugaaaccccaucucuacuaaaaauauaaaauuagccgggcgugguggugcaugccuguaaucccagcuacucgggaggcugaggcaggacaauugcuugaacccaugagacggagguugcagugagccgagauugcgccauugcaguccagccugagcaacaaagagcgaaacuccgugucaaaaaaaaaaaaaaaaaaaaaaguugucgcauguuuaaccuuuugccaccauauaaugccggauucguuaacgggagacaccauaugaccuguagcguguguggcucagauugucaccuauauaauuuacaagaagaaagggaccugugaggcaaagucaccuuggaacuuccuaaaggauuuaggagagggcaaagccuagaagguuugcauagcuaucauuuaggucagcugaggaaggaagggcauuccuggugaugaacaggcaaacaauuggcugguuuguucccucuaccaacagaaggauaauucaugauauuuccagucaucagugcugggcuggguaaugaaacuuuguacacuugccuggcacagcagucucagcaccgcaccccgacccccauuuacacgguuacauuuccccacaucagugcccugugcacugagcaguuaaguuacaaagcuaaaucagcucagcuugagcccuuugccugaugcuuaagagacuacccacuucccauuccuucugcugaguggcucacagcaguccugggagaggauauagagggagaaguagguugggucuagcuugagacuggucuugccagaaaaaauggaauugagcuauauaugaaaagauagauuggaaggaaggaggguuauguacaucccaaauaucagaaaaagcuugaguaaagguguggagauaguggugugguguuaccaaguaaaagggcuugaugccugaugugcuggaagcuaauauuaugacacuggguuuuugagaaaacaaaagcuauuuguugcagaucgaccuuuaacucuuugagacaccguuucaguggauggcaggugugugggagagugagaaugccuaucuggcaaguugaguagaccuggguauuaggagcuuuuguacugaacaaagccaacugcagcccugccagucacccuaggcuccuaccucucaccucccuacccccacauccaaucagccaccaagaccuauaagacugucuacugaaucucccaaauccauucccuuguauuccacccaucuaugcugugguccaggccaccauuucucacuuggauuacuguaauaaccuccuugcuguaauuuuaccuccagucccuccuccacacugcagccagugugaucuaaaaaugaucaugcuaguuuacuccuuaaaucuucaguggcucuucacugucaccaaauuaaauccauauuccuuaaauugguauucaaagccaaucaaaaucucacuccuauugaucucuccagccuucucucccucugauucccucuacagacccuucacuuccaccaaacuagacaauucucaaauauacccaggaauuuucugccaguguguuugcuuaugcugugacuuguuuauuuuauucuuuauuuauuuagagacaaagucucacucuguccucccggccggagugcaguggugcaaucauagcucacugcagccucaaacuccugggcucaagugauccucccacuuuagucucccaaguagcugacuccaggcaugcaccaacacucagggucucacuuuguugcccuggcuggucuugaacuccuggccucaagugauccuccugcuucggccagccacccaaagcacugggauuacaggcaugagucaccgcacucagucugugaccucuuuuuaaaauacacaccagugaguuuauguguuuuuuggugaaauauaaauaauaaauaaaugcacaccagauucuccucccuacaucaaccugacaguugaccaguugacuuucuagccuucaagacuuagcauccaaggaagccuuuucuuuucuuuuuuuuuuuuuuugagauggaguuucgcucuuguugcccaggcuggagugcaauggugcgaucucagcucaccacaaccucugccucccggguucaagugauucuccugccucagccuccagaguagguaggauuacaggcaugugccaacauacccggcuaauuuuguauuuuuuuuaguagagacaguuucuccauguuggucaggcuggucuugaacucccgaccucaggugaucugccugcguuggccucccaaagugcuggaauuacaggcaugagccaccaugcccggccacaaggaagccuuuucuaauuucagaggacccuuaucugacccugucauugcacuagcuauaguacagucauuucuauuguucuuagugguucugccuauuagaacuuucugcagccaggcguggugguucucaccuauaucccagcacuuugggaggccaagguggguaaauuacuggaggucagggguucaagaccagccuggcuaacauggugaaaucccgucucuacuaaaaauacaaaauuaggugggcgugguggugugcaccuguaaucccggcuacucgggaggcugaagcaggagaaucgcuugagcccaggagguggagguuguggugagucgagaucgcgccauugcagucuagccugggcaagaagaagagcgaaacuccaucucaaaaauaauaauaacucucuaacucucugcuuuuuuuuuuuuuuuuuuuuuugagauggagucucacucuguugccccggcuggagugcaauggcaccaucuuggcucacugcaaccucuggcucccagguucaagcgauucucccgccucagccuccugaguagcugagauuucugccucucuauucuaaguucccugccauauaauacaugaaccuauaauagacaugagggggaacagaccuaaccacaacagucacauuauuaguugagcaccgacacagacuucacuuaucuguuacagcaguaaaaccagcuacaaucaaacaaguaauggucaucccacucugucccauuaaugcacaaccccagguagccuguguagaccugugucaaguguucugcacuaugagucagaaauccccaguaagugaugccgguauauacauagcacuuugugugaacagcagaaaccuccacaacuacgugauuuagcaaguucauugcagguuauguuaugggucuucgguuugggcuucuugugacaucucuucuccauguucagugugugaauguggguguagacgguguuacaggugaauccaauuucuuggauguccaggccaaguggacaaaagcaaauauuguguguccuaaaacugaaaauaaaguuugcauuaaucacauauuugcuuugcugauuggucaaccucaaaaacacaggcuugcuggccgggcacggagacucaagccuguaaucccagcacuuuagggaggcggaggcggguggaucaucugaggucaggaguucaagaccagccucgccaacaugaugaaaccccaucucaacuaaaaauacagaaaaugagccagguuugcuggcaggcaccuguaaucccagcuccucgggaggcugaggcaggagaaucacuugaacccaggaggcagagguugcagugagccaagaucgcgccacaaacuccagccuggggaacaagagcaaaauuccaucucaaaaaaaagaaaccaaacacaagauuccuguuagggguuuguagacuaauaugguguugaccgugguaacaagaaagucugucaaaagcaggaaaaucccauccugggcaacauagggagacccugucucuacaacaaauuauuuuuuuguuuuaauuagccagccaggugugguggcucacaccuguggucccagccacucgggaagcugaggagggaugauugcuugagggagggagguugaggcugcagugagcugugaucaccucacugcacucuagccuaggugacaaagcaagacuaucucaaaaaaaagaagcagaaaaaccccugaugggcucaagucagagguuaaguacguuucuagccucuuugguagcaucaguucaucauuaacugauaaaaaugguuuuuuuggccuggcacggaagcucacgccuguaauccuagcacuuugggaggccaaggugggcagaucaguugaggccagguguucgagaccagccuggccaacauggcaaaaccccaucucuacuaaaaauacaaaaaauuagcuaggccugguagcacacgccuguuaaucccugcuacuugggggacugaggcacaagaaucacuuggacccaggaggcagagguugcagugagccaacaucaugccacuguacccuagccccugggcgacagugagacuguauacauuuaaaaaaaaaaaaaaaaaaagggccguuuuguuuuuaaagacagguucucgccuggcgcggugacucacgccuguaaucccaacacuuugggaggccgaugcagguggaucaugaggucaagagaucgagaccauccuggccaacauggugaaacuccgucucuacuaaaaaauacaaaaauuagcugggcguagugaugcacgccuguagucccagcaacuugggaggcugagacaggaaaaucacuugaacccgggagguggagauugcaauaagccgaggcugcgccauugcacuccagccuggcgacagagugagaauccgucucaaaaaauaaaauaaaauaaaauaaaaaaacaaagacagguucucacucuguuacccaggcuggucuaaaacucuuggccccaagcaguccuccuaccucagccucccaaagugcugggauugcaggcaugagccaccgcgccgagccuaaaaacaguauuuuaagaaacugccugggcugggcccgguggcucacgccuguaaucucagcacuuugggaggccaagucagguggaucacgaggucaggagaucgagaccacccuggccaacauggugaaaccucaucucuacuaaaaauacaaaaauuagccgggcgugguggcacgugccuguagucccagcuacucaggaggcugaggcaggggaaucacuugaacccgggaggcggagguugcggugagccuagaucacgccacugcacucuaaccugggcaacagagugagacuccgucucaaaaaaaaaaaaaaacaaaacugccuguucucuccaaauucaucucuagaguuaggguuauauagccuggaacuaugaucucgucuuuugaucugucuguauggagaugcucuggauauaguaaaauuuuaaucuauuauaaccccuugaucuucagugaagacauagcuugcugccacugauaguuuccccugaugacauaucaaaaggauaaagaagugcugguugggaagagacugguggaaccacaucguuuugugucauuugaggaugaguuggacuguggcaugaacggcauugaggguucagguggcuuucucccucucaggcuuggcugcagcaacaugcuucuccagauuaacaauauuuuucugaacaacugucauggcaucauauguugauucugcuuugagaaaucuccgaucuuguuuuugucuuaaaaugccuucaagguguuggacuuggagggcaagugcguugacagccacuuugacuguuccuaugcccucaugcaccucagucaguuguggauuuaggaacucugcucuguggguccucguuccuggguuuuuaauuuucuuuuauuauuauuauuauuuuuugaggcgggggucucacucuguugcccaggcuggagugcaguggcacgaucuugucucauugcaaccucugccuaccggguucaagcgauucuccugccucagccuccugaguagcugcgauuacaggcgagugccaccaugcuugucuaauuuuuguauuucuaguacaggcaggguuucaccauguuggccaggcuggucucaaacuccagaccuuaggugauccaccugccucggccucccaaagugcugggauuauagcugugagucaccacaccuggcgggguuuuucauuuucauugguucauuuguaguuggaugaggccugaaauuauuugcugucagucaguccuucaauaaauaaaauaauucccugggccaggcucgguggcucacgccuauauaaucccagcacuuuggaaggccgaggcagguggguccuagcugaggccaggaguucggagaccagccuggccaacauggcgaaacccugucucuacuaaaaauacaaaaacuagccaggcgugguagugcacaucguaaucccagcugcucgggaggcugaggcaugagaaucacuugaaucugggaggccaaaguugcagugggccaagaucaugccacugcacuccagccugggugacagagcaagacucugucucaaaaaauaaugaauucccugucaaauucaguugaguugcuuauaaaaaugcaucacauagcgucagugaaaauucacugaaugagugagauggaggcuggggcaaaagugugaggccugaagguuaaggugugggccaggcugaggccuagacuggcccucuccagccuggccugaacuuucuguuucagguggcaugguacaaugaacucuugccuccagccuuccaccuaccgcugccaggaccuacccuggccuuccugguacucagcacgccugccauguuugaccgggcccucaagcccuucuugcagagcugccaccuccgaaugcugacugacccaguggaccaguguguggccuaccaucugggccguguuagagaggugaggaaggcucaguuuucccccagcucccaaaccuacagcugccuccaguuccuccacacucaaugcaggaucuagaccuagggcuaggagccacuucaaaggugaaaugauacccuaaagccaggcuugacauucugugaucuuuccucauucugccuucucacacacccagguuccaccacccucaucuagcagucccccagugugaaauagucucacucacccuacacugaugggcaacuauaugaaccucagaccagguuuuccuuggccuccaaguggaauaggaaugaguccaacauuccccaggcauugcuuuguccuagaccugcaagcuuuaugcuguccuuuugaggacagaacaauauucucccaacacacacucacauauacacauaacuauguacauacccacuggaucuccccaaagcugaccaugccuuccuucacaccagguguuauguauuucccuucaaacaugugcccuucuggaaauaacuauaacuauguccacacuggagccucccaaguuaaggucauguuuucccuucugaggacaggaccauguucacacacacaaaacaaacuagggcucccucggacaaggucauaacuccccucaugcugacaguacccucuauuuuguccacuguuccagagccucccagagcugcagauagaaaucauugcugacuacgaggugcaccccaaccgacgccccaagauccuggcccagacagcagcccauguagcuggggcugcuuacuacuaccaacgacaagauguggaggcugacccaugggggaaccaggugagagggaaaauguaaauagaggcugagauagacugguaaaggccucucccuaccaggucccacauuccucagccuucccuggauggaugugacacaacccagaacaaauuagcuuuguucuggaugggaggcaguccugucacaugcgguugucuaacuggguacucgugagaucagaaaacuuagucugcagaacugucuuaggauacagggggcacagcaguguuaagacuaguggugagacuaggaagcccagcccuucccugugcucagaauaguuuaugaaaggguuugccaagaaaaggacagagguuuauguagucaguguacacugagugggaagugaacaggccuagcuugcaaugauggcaguugacuuggugccaaggggaccuccaugaccuugcuuuucuucacccucuccccagcgcauaucaggugugugcauacacccccgauuugggggcugguuugccauccgagggguagugcugcugccagggauagaggugccagaucugccacccagaaaaccucaugacuguguaccuacaagagcugaccguaucgcccuacucgaaggcuucaauuuccacuggcgugauuggacuuaccgggaugcugugacaccccaggagcgcuacucagaagagcagaaggccuacuucuccacuccaccugcccaacgauuggcccuauugggcuuggcucagcccucagagaagccuaguucucccuccccggaccuucccuuuaccacacccgcccccaagaagccugggaaucccagcagagcccggagcuggcucagccccagggucucaccaccugcauccccuggcccuugauuuucucccauguggacccugauuuauggugguacuugcuaggacuuaauuggcuuuggcaaagcaaaagguuuugaguacaagauuacuauuuuugauaauauaguagagaucuuccaugaagauaacaaggcucaaggaaguuagguuuggccaagauaaaggccagggaaccagaauucccaucugccuucaaaugaguuuuuuuuuuuuuuuuagacagagucuuacucugucaccuaggcuggagugcaguggcacagucucuacucacugcaaccucugccuccuggguucaagcaauuaucugccucagccuccugaguagcugggaugacaggugccugccacuacaccuggcuaauuuuuuguauuuuuaguagagaugggguuucaucauauuggccaggcuggucuuuaacuccugaccucgugauccacccaucuuggccucccaaaguccugggauuacaggaaugagccaccgcacccagccaagacucuaucuguucccauuucuaagcaguuccccaagauguuguuacagggccuaaggggcaaauauccucuaaagaguaccuaccagcagggugugguggcucccgccuguaaucccagcacucugggaggccgaggcagguggaucaugaggucgaguuugagaccagccuggccaauacagugaaaccccgucucuacuaaaaaugcaaaguuagccgggcaugguagcgcaggccuguagucccagcuacucaggaggcugaggcaguagaaucauuugaaccagggaggcagagauugcagugagccgagauugcauggcugcacucuagccugggugacagugugagacucugucucaaaaaaaaaaaaaaaaguaccuaccucagguagggacugaauaaacacguguaaggcacuuuggaaaaauaccuggcauauauaguaagcaguauguuggccauuaccaaaggcccugggaauucuguacugcugcucauggguguagucgguucuagaggggugg

SEQ ID NO: 14069 - RNA, 12261 nt, Homo sapiens
ugcuuuuccuuauggggaauggguauucccagugucaacugacuugagacaagaaacuaggaacauaggagaaauaacucccuauauuucugggcuguacuuucuuggguccggacuuuaaggagguuuugaggauaauuccagguggugagaacaaaggacguuugcaaacucuagaggaaggcugggaaguacacuauaggggaucucaaguugaagacaaacaagugagucuuaugaaccagacuguccaauuugagauaccgucuguguucauugcccuuuuaucaucucugagaaauaaagcuaaagggacaguagagggcucggagguuuccaaauuaucucuucauaguccaucuugggucugugucuuauuucuuuaaggacaguaucaggcuuucuuauauuuuaauauuauacacuccauaucacuugauuguucuguugugucuguaucucccaccagcaugaguuucucaagugcuucucuuauuuacuuuuguuuucuuaccaccuagcacagagccuaugagaguauaaagucuuccugggccuauuucagggaagggcgaagggcuugauagcaaagaggccaaaacgccugcuccagagcugagauucuggguuccaggcccaguuuuguccccaucucugaacgacuucagugaccuuggaaccuccgugcucccagucuguaaaacagaugcuguccuugacuuugcaggagcgaucaguccacacugcucagaccagagcuaacaagagggauuuaaaguagagguaacauguuccaaguggguaaaccaggacagagagaagaagaugccuuuuuccaaaugauccuaagccugugguuagaagcaaaaagaucccuaguuuccuaucaacgugccuccugaaaguaguauuaccuuuauaggacucauguccgcagcuacugcaauaaugcucuaagaguaaaaugucugucagauauagccauucagucuaauuuuguaauuacuucuaagaaacagccugaaacagacuuuugcaguggcaaggccaagaacuuacuuggaaggaagugggaggcaguguggcuuuaaaaauauucaguuugugagcacuaugaagaagugccaauagccacacacaggcuuuuaucaguagcucuagaaguaaccaguacacacauacccgagccuuggcucuugggggcagcugagaaaguaguuugcuucugcuuaauaccauuacugcccaacugaucuucugugauuacuguugggaaugaguaugaauuaugaauugcaccuuuaguucuuaguucuuuucuguuguuauuguugacugcauagaagccacuuaggugauuucacuggaaugaaaagccuauucaguuauggucuuaggcuaugccacacaaugaggaauagaaaaugccaauuuucagagugaagagaacaugaauuaggaacaacguugaaugcuggagggauguagagaaugacuguuaguguacccuaaaguuaauuuuuauaauuaaaaccaucagcagcuucugggaacuauuuaugcugugcuauuagagggcacaauauuggggaauccaaucucuaccuuccaugggcucuacucuaguuguggagauauuuaagucagcaggccauuacacaagagcuaugguaaagguaugagaucacaugguaggauugagggcaagggaugggacacaucacaccaaaacagauaauccucuaagagacuugaaauauaacagucccugaggcauuuaggaguccggcaguucggucacugaucucccugugcuaugaaaagaaccucuuaacuguucagucuuucaguagaaucuuagucuuuuccugccugauccuaacuggguuuagggagucaguuuguugcgggugaggggaaagaggugaagccacauagaaaguguuuuguuguuuuuguugcagaaacagcuuuagagugaacaugaguuaauagacuuggcauuucuucacucagguggcuuuauucaguguuaauacugacugugcagcuguuccaggacaccucaggcacuuucaggugucugaucuggcccaguucugaagaauuuguguagguuuccaggaaaugcauccauggccacccuuuugagucucuugucagcucaguccucacuauggagaguggaauguaugauuauuguauacguuugacacacgcuuuuuuuaauuuuaauuuuugagacagagucucacugucacccaggcuggagugcaguggugugaucuuggcucacugcaaccucugccucccggauucaagugauucuccugccucagccuccugaguagcugggauuacaggugccugccacugcaccuggcuaauuuuuguauuuuuaguagagacaggguuucaccauguuggccaagcuggucucgaacuccugaccucaggugauccacgugccuuggccuuccaaagugcuggaauuacaggcaugagccaucacacccagcuugacacaugcuuuuaaaagaagcccaguugcuucagucaucagacuaaacuuucauuuaacacacuuuugccaagcuccuucuggguaccugugcuagguuacagauacagaggcaaaugaaaucauuccuugccagugaagaggcaaacauguaagucacuguugcagugugauauaauaggugugaggaaaugaagaaugggaaccaggcagcaacagugccugggcuguuuucugaaacugaaaaggucaccucuugccucagggaaaucugacugguccucucuuacugcuuaguguaggcagggcuaccucacucaaaagucuucuaggagggaagagacauaggugacauaucugagcugccacugccucacaggcuggugcccuauagcuggggcuuuggcuaauaggcaggcuggccuagggcccaucuucucacagacagucaaagucagggagcugcgagugcugagccagcaggacugauuagagagccaaagccaggacaagcacaagaacuguccuuccuggaagccagagaugaggcaugucuaccugugauccaggguagaagugaugaaaucacggcuccuuccagcuuggggaagggaaauaguguaaucaugucaaggccagaguaagggauugauuuguaccugacaggaguaagcaggaggugacuuggcaugucuuagcaacuagauaccaaggcuggcaaggaagagggagggcugguuugggucagauggggccuugcuggcuccagaaguguuucugugagccaaggaucccugcucucugcuauucugaaggaagcggguggggugaggugccucuugagccagagcaguguagggcuauuuugaaagcagcuauuuggggagagcugguugccgcuuuuuguuuauuuacaggucacuuggguugaccugaagacagcauuuuuucagugagcauguucucagccugucucaugaauugaaagcugugaggaaggaaggcaaaccagaacuugcuccugagggguucauagcuuuucugcuagacuguaagaggaguggcauagaggaggagcuaagaguugagaugagagggagaaagaugaggucauggcuaaaaagguagcuugccuuaaaauacaaaauuuucuuaggugaaaaggauaauugggagaauauuucaaaugaaagggaacaauguaagcaaaggcaaaggcuugaaggaccuguucagguuugguaagucaagcuugucugugacaaguuuggaugaggauaugugcauaggggcaccaggaacagggggacagcggcuaggccaguuggauaaagccagaucauagacuuuuaaugccagagaagagguugguugugaucuuguggacagugaagguuagugaaggcuuagacacuugucuugugcuuauaucaaguuggcaaggucaggccugggcuuugggucuguguuucugaggaaggaggaagggaggccaggggccugauagucuguuguucuccccuauauugcaagcuccaagaggacaaggguuuugguuguuuucaucuagcuauuucuagcacuuaaaauuaugccuagcacuuagaaagcaaagaugaguaauuguguuuggaaugugaaguguauccuaggacagccacccaagacccaggacuaacucaucucaccuggcugucuuagagccccugaccugaccaguggggucagcuugagugcgguucaccaaggagcagaggacaaggugcccugugauaggaaggggggaaugggugguaacucuauggcugauccccgcuucugagccacauuauuuucucuuccuuccugggaacccuagaacugccugauaaagagggaugagaaugguuacucugcagugguagcugacuuuggccuggcugagaagauccccgaugucagguguguagcccuacuggaugcugggguccaagggacagggggcugaagcuaagggaaaauucuagccuccuccccagaggccaggacuuggucacagcucaaccucagcucccuaaauuuguuuaguccucgucuguacccauccuugagguggaggaauggucaaaagauuccauugcaccagccauuggcaagcucauuuucuguauaaucucaccccacagcauggggagugagaagcuggccgugguggguuccccauucuggauggcaccugagguucuccgagaugagcccuauaaugaaaagguaaguuuggaggaucucaaggccugauucuccuuuuuucuuuuucuuuuuuuugagauggucucacuauguugcucaggcuggaaugcaguggcacgaucucggcuuacugccucccgaguucaagcuauucuccugccucagcuucccaaguagcuggaauuacaggcaugcaccaccacgcccagcuaauuuuuuuauuuuuaguagagacaggguuucaccauauuggccaggcuggucucagacuccugaccugaagugaucugcccaccucggccucuugaagugcugggauuacaggcaugagccaucgcgcucggcugauucucccuagaauccacucuuagcagaguguccaagauguuccuaccaagagcaguggugguaccuggcagcugcccagugacugacugggaugaaguaugggcaauauggcccaggccugggcuguuagaugguggggugcaggggaggcaggggcaggggcagauacccuaccccucaacccauuaagagggaaaccaaaguccgacuacccaccaggcagauguguucucuuaugguaucauccucugcgagaucaucgcccgcauccaggccgauccggacuaucuuccccgcacagaggugagcugcaagcauggggaucauugccacugauggggcuaguuugaagcaauggaacuguucugucccugggauggacuugcuggaacucucuguugcugguugucaggggcagcucccaaccacuucuacugagcaggcuaggauggguggggggauuaaugaacugucuaccuaugcuuuccauacccauccacagaauuucgggcuggacuaugaugcuuuccagcacauggugggagacugucccccagauuuucugcaacuuacuuucaacugcuguaacgugagugucuuucucccucugccuuucaucaggggcuggcugaacccuuuucaccugguuaggacuguacagagaggcugcuaauuagcuucaugagggaccucauuuucacuguagugacagcaaccacaccuccuccuccucccucuggcagcuaaccuauucagagcucuggacaaaggaaagaaagaaguuguuuuguauuaucugguccucaaccuguaggguagacccaucacuccuugcguuagguguugauggaacucugguccgguuuuauuguuggacuguggauccaacugguccugaggcauaugagaaaggcucuucuuggccuucauguauguagcucuggggcuggaccuuaccuguuaggaucaagggguaggugggcuuuguucagauaccucccagaaacacauuaggagcagaacucaagaacagaauaaacuaauaugagcauacuuuuggaagguucugugacaaggugauaagacaaacacuaagacagggaggguaguagacaguaguguuuucccugaccugaacuguagggaucaccuucauugucuggggccuuuagaaaaggucucucagcugcacaucugaaucuucaaagaugccagaaauagacucaaaugccaucuuuggggugggagauggagggcagagcucauggcuguuguggauaccuacagauggaucccaaacugcgcccaucuuuuguggagauugggaagacccuggaggaaauucugagccgccuacaggaagaagagcaggagagggauaggaagcugcagcccacagccagggguaagagauuagaccagggagcccaaccuaacccuaagggaggaaauucggauguggggccuucuccucuuaggguugugauugccaggaucccagguccagaaacaaaugggaggggaaggagaugaugcagaaaguacuggccuuuuuaagagcuguggcuuggcauacugcuuccccucucugagucuguuucuucauugguaaaacagggccaugguaucagcuuugcuuucaugagugaaaacauucugugguaaaaugcugcuuguauuuguuaugacuagugagaguaacccagacuugauuauucuucaggacucuuggagaaagcaccuggggugaagcgacuaagcucacuggaugacaagaucccccacaagucaccaugcccaagacguaccaucuggcugucucgaagccagucagauaucuuuucccguaagcccccacguacagugagugucuuggacccauacuaccggccacgagauggugcugcccgcacccccaaagucaacccuuuuagugcucgccaggaccucauggggggcaagaucaaguuuuuugaccugcccagcaagucugucaucucucugguauuugaccuggaugcaccagggcccggaacuaugccccuggcugacuggcaggagccccuggccccaccuauucgccgguggcguuccuugccugguucgccugaguucuugcaucaagaggcuuguccauuugugggccgggaagaaucgcuaucugaugggcccccaccacgccuaaguagucucaaguacagaguuaaagagaucccaccauuccgggcaucugcccuaccagcugcucaagcccaugaggcuauggacugcuccauucuccaggaagaaaaugguuuuggguccaggccccaggggaccaguccaugcccugcgggugcuucugaggagauggagguagaagaaaggccagcaggcucaacuccagccaccuucuccaccucaggcauaggccugcaaacccagggaaagcaggaugggugaggggguuuagucccugccucaccuuggggauggaccuucagcugaaaccauauggcccccuaggugcacagccuugauucuucccuggagccuacagagcaggcaggcuaggccaagccaggcucaacuucugggcucccagugcccauuggcuguguaugacgggaggcagcagugagaggccuuccuaguuagggccaacagcugauaccaagccucugaaauccagcaaggaggucugccucccaccagacccucuccaguguacuuccccagauaggaccagaggaugucuaguucuaggcugagcuggcaggcagcuauuaccccgguucuuuccccaccccaggucugucucuugccuuuucuuggggcauauaagcuacugaguggaacauggagcugaucaagaggccguaauggucauggcuguuucccagaccugaauauuggggugcuucuugccaguauucuaagacauuugaguaauugcuguuugcacuuacugcauggucagaccacgucacuacauuucuaugcaaggggacagcaaggcagcgugguggucauggcucuuagcuaaccuauucaaagaccuuuuccuguugauuaaucuauuuucauauuuauaaaggagucuuaauguucugccccauaagacuuucaaccuugugguugggaguggggcugguuuuguaggcccuagggccugcuucuauguauuuaucaacaugugauacauucaauugguuaaaugguuuauacagggacugauuugcuucccuuccugccauggcuggagcuuugggaacagucuguccuuacagagcugcaauaagaaauaaccaaagaugaagcuggucaaauauuuucauaacuugcuucuguugauuuuuuuuuuuguaaaacuuucccaagacauuuucagacuuaaaaauaaagucaguguuacaggugcuggucagccuucuuacuuguaccucaaacacugggauaaaggaggcgguccagggcaaugcagugaugucugucaagacauucccccuccccuaaacucaguagcaguugaggaugacauuucaggcuagagagacccaaaauaccucuguuccaccugagagcaagguggaaguugcaucagcuacugccccaagugagcuucaucuucugauugugggcuuuggaggaacgagagaacuggcucuuggccacugugagggguacagcuuugccacucaaauauaccuuauuguggcauucagggagccaggguccagagcugcagggcugcggucccuggcucacuuccacauaggccaucacauaaccugucauaaaggcaucaaaaccagcccggugcaauccauccccaggcacuggguuaggacuggcuuggcucccuggcacuucugagguagcucuaucagcuauuucaggccuugcugccuuaauccccaucucuaagucauuuuuguugccuugcuuggagugaggcagguuccuaguuucaucggcagccaccuccugcucgguuucuucaggcuugaugcuauccccacagaccugcuucuugggaggaccauccuuagcuuccccagaggucuguguccccgguagguucaauaaagcccucuuccguuuuucccuacgucgucgccgucgccgcuuguccucugccgcagccucaucagugucaaugauaaggucaauaucgugagacugaggacacuguggucccagggggcaccagccauaagccuaggggugggaaagaggcuuagaaagaggcuccaggcaucagaaccuucccucccaagaaacaggugggugcucucaccgagaaguugucacagaugcuggugggaugaggacgguggguugcugggggcaggcagcagcgguaaucaauauggucccucaugcuggaaggauaguugcagaacuccaggguaaggugugggcugccagcugcccgcugcuucccauuuucccguucacugcaacagcgcaagaggguaaugguccacuagcauauaagcuccauaagagcaggguuuuguggucuguuuuguucacugcugaauccucagcaccuaaaacacugccugggcacaugguaggagcucaauaaauaucuuaagugaaugaaauaaacucguaucaggccccaccccuuucccucaaccauuuccucaccauuuccggaaggcauauucuaaguaggaggccacgaaacgggcaugaaacucagcagcauauuuggugucauaaaugccugcugggaacaucucacacaggucagcggugaagguucccagacucucagggaggugugcauagaaguucugguacaggaacaccaagucuauaaggccauuguguagcaccaggggccggcgggcucggauuagcuccaggaauaggguccguacugacuggcucuggcucucaucacccuagaugaaaguaaaggggucaaugaggaggacagagucccccagggagccucuucugcugggcacuuaucccagacuuccccacuuggaacgcucucucucuaccuuacccaaugcugcccacccuccucauaccagucuuguuucccaagcccugucacuagugauuccccauacucccuaagaagcagauucuccccagacauccagccuaggguaggaagaaauaaagucacagaaagggcagacucaaggcuagggaggcuagaggccuaccuugucauugcccuuaugguaggggaugccuugggcauacugcugguugaaguugaagccaugcuguaucaggaacugcacagacuuugguucuaugacauacuccuccaugcacagcagagugagauugaacacuugagccagauaggaauguucacccugggagaaagagaagucugcuauaucaagauuucagagagccaagcuaggaggaugcaaaagcuuaagaaugauacaauggacucuggggacucaggggggaaaggauggaggcaggugagggauaaaagacuacgcauugggcacaguguacacugggugauaggugcaccaaaaucucagaaauugccacuaaagaacuuacucauuuaaccaaacaccaccuguuccccauaaaccuauucaaauaaaaaaaaaaaaacuaucaagucaaaaaaaaagauuugggagagaaaugcuuccuaucugauguucccuagaaucucucuacccuccaccccacagccacaccuaggauuggggugagaucagcucauaccuugucuggcugccgcuugaagcaggcgaggcccagggaaaggauagaacggguccuggcagcaugacacacggccuuguaacguuccucaaugcaccuugggguuggguauggggguugcuguggcuaggaguuagccuuaugaaggacccaaaccacccaggucugugacccccccacuccacaguugagggcuggcacuaaagagaaaagggcuuauacuuacugguucagcaaacucuuccuguccccaagcccacucagcuccuguggguagguaaagggagaguugugacaggccucuagcaccagccccuucacaaccaccugcccuccuuguuucccaacucucaccguguccacagccacgaaauuagcugucuuuauggcuagcaggagggauggccacaucuccuugaaguuguugcuuugcacauccacuacgggaaccuggacuacuagcuccuccccagauguugugcuuuugcugacaccaccuggggguuaggagggugauggauguucaugcuuaaggaaagagcccaggggaacagacaccaagcuaggccacggugauggugguaagggggguaguuuccauugguagcuuuucccacaagccuuuguaacccacguguucuacacacaggccuuggaguggagaaugcccugaauuuggggagaggaagccugagucuucuacuggcuuguaugagccuggguaaauuacuucccaccucgcuuucacaaucuguagaggagaaaguuggacuagacgaccuuugauucuuuuuucccauguccugcaggaaacauuuuguagggcuugaggaucucagcucccuuaauaucccacagggauccauacuacuguucucauggugccccagcgccacaagcaacagcucccaguaagccccagagccuggcagugccccacaccagagcucccaauacguccuaccuuccuuuggaucacaacgcucaauccacuccacugaacugaaucacaacuauuacuacuaaccguuaugagcuccagacuacaucucccgccaugccuccaucagccccaugcucccaacgcuccaggcuuuugcagccggagccgcgguguacaacggaacuuguagucuccucguggcuaguucaggcggaaggagcaguccucugaagcuugaggagccucuagaacuaugagcccgaggccuuccccucucccagagcgcagaggcuuugaaggcuaccucugggaagccgcucaccgucggaagcugcgggagcugaaacugcgccaucgucacugucggcggccaugacaccgcucgucucccgccugagucgucuguggguacgcuggacuugcgguccgucuccuggcgcgguucaggcagucggggauggggcggggucucgccgucgggucgccgaugggucgaacuuccguucag

SEQ ID NO: 14070 - RNA, 1858 nt, Homo sapiens
guauugguuauguucuauuuccuaguguguaauucuuuuauuguucuuuguaucuuacauauuuauuauagacuguauauaagaaauguuuuaguuuuaaaaaaucccaccucuuuggagcccaaugagagacacagcuucuggcaggcacugaugaaauggaagucacaccugccccccggaggcaaagccuuucacuaguugggccuccugcagauguuccucaguucugugcuggucuccccagagcugcaggacagcuggcugcacccagcccugggcauccuuaggcuuccuggcuccuggcagauugcuccuguacggacugccacagagcucugauguugcccugaccaaagccaguggcccccugccucugaaucagcuccaggaagaaaguguccucaguaaaaagggacuuggugaagaccugaagcagaaacuugccuuuaucaccaucuagcaggauccccugucgagcaagcagaugaggcucgugcccugcagcucggaucugccucuccuuuccuggcugcugguaguaugccccagggggagccaggaacuggccuccagcaguugccacccccucaguggccuccacaauguuaggcguauacagccccacgugcugcaggccuggccccuugugccgggccaggaacugcuccaccugguccugucgugucgucgcccccggaagggacucagccagaacaagaguggggacaaugcugcccggcugggccugcagggcuguaagccucagucccccaagcccaaacccugcugucauuucgaggcccagcucgggauccucaccugggcucagcggcaaguggcaaaagcccaggcagucguggaaccagcgcaaaagugugggggagcugccgggggugcaggccaaggucaggugguccacgcggcugacccacccggggccaggcgcagaggacacgggccugaagccggguaggaaggguccgcgguagccagcgcgcuccagcaaggucaggcugaggaugccggcaggcgagcugaccacggcguaaguggcggcacccugcgcgucccgcacgcgaacgggagggacaggcacgcugcagcccagcgcugccagcucccggguugcagcgccggcguccgccacgucgaagcacagguuuguggcgcugggcacggcgugacgcggauccaggccguacagcggcucuccagacccugcgcccucguucaccaaaaagaccgcgucgccgcugcgcagggcuagcugccgccagccguccaccucccgcgaagccaggggcuggaagccgaagaggcgcugcagguuccgggcuaggggcugcccggcgggcacguggaaggcgauguggcacaaacgaagggcgggcgcggccauggcgcucuggacggcgaccuagacuuguccuucuggggccgcuuacuugugguuggggacuucggggcucucaguccugggcugaucguccggaguuggggaguccggcucaccccgcagagcgcguuccucgcuuucuuccggaaagaagucacccgccgaccccugagagcucgcgguucucccugcagcgccaccccagccaggagcagcgucuggaccaccgggucucagugagccgagcugcugguugugagaaccacgcggugccugugcucgcgccaagcaggagaaagagggcggagcccgugacuccgccuuugacuccccacccccucccccacacccugucgccucggauacugcggggucgccgcgcugcucuuuccccgggccucacgccuggucacauccuugggcacugagccucccuuccccagcccaggaacucacaau

SEQ ID NO: 14071 - RNA, 3483 nt, Homo sapiens
ugugaagaggauauagagaggguucccagggaaggagcagaggcuaagaagaacugaggauaugggcacaaucuuucacaaacaaaacuacacaauaguucaacuccgaaacuuuuauuguccuggaaacgaucaaucaucuguguuagugguacuugaggguaaagguauacacucaguucugucgaagcagacgugaguguuuaugcacagcauccacaaaggcgcccacauguucuggguccaugucaggauaaagcccauggcccagguuggcaauguagcgaugugguccaaagucauccagcaucugcuucaccaacugcccgaucuccuccugggggaccaacagggcacuggcuacaggaggaccagcaagccuuuguccucccuauauauacuagugacaaacgcauauguaggcaugcuucuacucaguguuauucagucauucaauaaaauuuaucagaucccuaguauggacccaggcaugaagcauaaacacaaaugaacaacagcaacaaaaaguccggucuuucuagggcuuauguuguacagaguagaagaaaaggacagacagacauuaaaaacaagugcacacagaauaauacagccacagccacaggagugcacaguaacagacacacagaggggcccuggcuguuaccucagaugcauacaaggcacagggguccagguugcccugcaaugucaccgucuuccccacacacucccuggaagcaaagccagcgccacguucugguaacugcauacauggcagcucccccagccaacacccccaccucaaccucaaggccucacccuuccauggcuuaccgggcuuucuuuggggccacuguccagucaagcccaaccaccucauagccagcuugggccagcuccuccagggcaaaaugcccauccuuagcaaagaugaucuagaaaaaagcagaucucaggcuacagagggccuugcuacaaccacuaaucuuucuugacuguacuucugcugcccuccaguggucacuccaguccaugcaggacuuagccugaaagcuccacaggaccaccuucacucaacccaucccaauccucaccaugggcacuggugccaggccugccucccgcaaccuggccuucacuugcuuggccacaucacggauguaaggcagugcaaacuuguugaagagcugugggccaagaugcccugcaugggacucaaacagcugcaaugccuaguuaggguauggugaagaaaaauauguaacacacaaagaggaaguuucccccacauacaaaauccaccucaauuuuccccaaaugacuucaaucccugauacugccugacccuaaaaacccaguaauuaaaaaaaaaaaaauuuacuuuccucagaucccagcacuaacuuuggugucugaauacuuagagcauuaagccccacugucagugucaggaugggcuuggcugcuccgcuagaucacuggaggccaagguucuuucaucccuggcauuaagaccccugcccucucagguuuaggacacucuugcuucugguccuuacagaccaaaucccagccuauuucucucucucucaggacucaccugggcaccagccaccacuuguccuaccagauaugggaccagagcaucagugaggaugcgaagcagcuggugacuagccugaggucucugauagagccagcgcuuggccugagccauggugcuugagccaccacccucaaccauguaugucaucaggguccacuagagaaggauagaaagauggugucacagaagccagacugacccuuccuuuugucuaccccagaccuuccagagugaucuccccgcgccccgagucccugcccugucccacauuacuggggcaccagcaaagccaaucagcggcacacguccagccagucguugucggguaagggugauggcuuggaacacauagccuagcucagaggcuaccacuucuggaucccguaggcguucuagguccugcucuucucuuaauggcucugggaagcuggguccuuugccagguaccauggucaccuccaugcccagugccuggagggggagaaaacaucuggguucccaaaauggaauccaggaggaaagguucuguucagcucauuccaggaggaaggaaaaggagaauaaaacucugccaaacuccauuucuuucaaccuuaguuuuucccucgauccaguuaggauaagugcuuauuguaaaccuugacuggacugauagaaggauuuucaaggcguccuuggauuauauucuaggaucagguuugaguggguaccugggguacaacaaggaugucggagaaaaugauggcagcauccagagggaagcgacgcaguggcuguaggaaacaggagacagguugcuagguggcagacugaaggcauaaaucuuucccucuuuuguggaccccucaccugcagagucaguucacagcaggccucaggagagcgacacgugcugaaaaaguccugggcagcccggguuucccuaaacucugcauacagagggaagacagggcucagccuugaggcccuccagagcccuccccugccccucgaaaacuuuucucccuccggaguuuuaucuagauuuccagacccugacucuuaccugguaaguaacggccugccuggcgcaugcaccaaacgggaguguagucuguuuccucuccccaggcugcucgcaggaaugugucauucuucagcuccggaaaacccugaggucuggcgaucagguggggguggggguaggugucaguaugcuacgcuggaggcuggggaaagcgcggguucauaaggccgauucaguccaggaccgcuaucuaccuccuccaggccagcucccaaacccuggcuuuccgcccguuccgccuccucucugccuaucagguggugcacaaacuccagaagggcccgcccuggggccucuucccuccacuuagucucuacucuuccaagcucgaagcaaccagagggacuggggggagggaaugaaggcccacuaaggauaguuugggggucuucgaacuagugagccucagaaacgggaaugucacugggcugguucaggggcugagaaauacccaggcugggggauaaagagggaucagaguugauggucccagaauagagauccugguuggaaauccugaggcaucccuugaauuaaggcccugggaugaacaucucaaaaauccaugguuuuaggauucaggaucccagcuaacggaguucagguugggaggucuccaggguggggaaaggggaguagagggauagaguccugaguuggaagacucaaauuagaagcccggcuagccacaccgcgugcucuggagaacucaccccaacccauucgcuuccauggucagcugucuguaacugcgagcucaauccacaauuuaaccugaaucugagccugccccccaguccaggcuccg

SEQ ID NO: 14072 - RNA, 9145 nt, Homo sapiens
caaaggcuggccaaaggcggggaagggcguggugggaagcucuguccgcggucgcgccagcuguuccccgggcagggucgccucuaggugcucaccuccgccacuucgccauggcggguccuggcccgggcgcggugcuggaguccccccggcagcugcugggccgcgugcgcuucuuggcagaggcagcgcggagccuccgcgccgggcggccgcugccagcagcgcuggcuuucgugccgcgagaggugcucuacaagcuuuacaaggacccagcgggaccgucgcgcgugcuucugccggugugggaggcagagggccuggggcugcgugugggcgccgcaggcccagcccccgguaccggcuccgggccccuccgcgccgcccgcgacagcauugagcuccggcgcggcgccugcgugcgcaccacgggcgaggagcugugcaauggccacgggcucugggugaagcugacaaaggugcgcucuucccugcccaggacccgguaaaagaccccuggggccagagaaaccucuggcuguuugccuuuucuccccuguauugaguuggcauugcguucggcgcccuuugcccugggcugggcacgacaggcggcugggcaguucccugacggcuguccccauccuacgcgucccggcaggagcagcuggcagagcaccugggcgacugcgggcugcaggaaggcuggcugcuggugugccgcccggcggagggcggagcccgccugguacccaucgacacucccaaccaccuccagcggcagcagcagcucuuuggcguggauuaucggccggugcucagguacugcacuugaaggagcggggcuggcugucagaaggccgggccaggagggcuugggaacacuucagccacagccuggggugggugggauacuggagcggaggcaggguuaagagcagaaaggggcgggacgugaagggggcucggagggagacugggagauagagcccugaagaaggcuacacggcauggagguagugucuugcugaccgcugaugucuccccaucccacucccuacucugugcccacaggugggaacaggugguggaccugacauacucacaucgccugggaucgagaccucagccggcagaggcauacgcagaagcuguacaaaggcuacugugagugagcuggaaugggguggggaggaaggagcucugcgucugggcccagucuaauuaggggcuugggguugcuuagcuauguacccccgacauggaccuacgagugcgacgaggaccugauccacuucuuguaugaccaccugggcaaggaggaugagaaccuggguagcgugaagcaguauguggagagcauagacguuuccuccuacacggugggugcuggggcuccucccaccccaggcaagauauagucacaccccucaaggcuagauccagaaagaacccccaccugcaggccaggacuaaaacaggguccccacaggccacacucaguucagcuccccaucuuggacgucuauaggaccccuuacauacccagcggcccccuaucccauaccaguugccuguuagcccaacuucacuaugcuuucucucuggugcuccuggcccagagcacaagcccagugcagggagggaggguaacugcugacuucacgucucugccccuccccaggaggaguucaacguguccugccugacagacagcaaugccgauaccuacugggagagcgaugggucccagugccaacacuggguacggcuuacuaugaagaagggcaccauugucaaguaaguaggcucugggcaggacagggugggugggcuaugucccuguggguucacaaagacucauauucacacucugacccuucaggaagcugcuacucacaguggauaccacagaugacaacuuuaugccaaagcgggugguggucuaugggggugaaggggacaaccugaagaagcugagugacgugagcauugacgagugagcacgcuggccuggggagggaaguagggcauguuccaagccuagcccagcuugaaagccuaaguuugagugagacuccagcagucucugaaggccugaggcaggagguaucugaagugcuucacacucaucuccucaggacccucaucggggaugucuguguccuggaggacaugaccguccaccucccgaucaucgagauccgcaucguggagugccgaggugagguuuaaggcuauaaggagggaaagagagcccggcguggagaugggggcaaacagagaguguguguggagagaagaggaugggcuuggaguuggggugaaggcgaugcugaacuaacuccaggauuuggagcuuuggggccugagccagcugggacaugccagguauaggccugccuuaaagccauacaggugguugggcucaccuggaagaggaacugaguugggacccucaggcaucccagcauucuaguggaagacagaggaaucagcaggaauagaucaaucagaaucaggugauagaaggugaucccgaaggucccgaguuucuaggggcuaacggugacacaaggcugagcguucaaggagccggucccaggucugagggccaaggaggcagcaggugcuguaaaugaccuuacucugaccccuucccccagaugaugggauugauguucgucuccgaggggucaagaucaagucaucuagacagcgggaacuaggguugaaugcagaccuguuccagccaacuagucuggugcgauauccacgccuagaaggcaccgacccugaaguacuguaccgcagagcuguccuccugcagagguggcugugguccuggaccuaugggcccuucccuucccccaacauugagccuugugugucugcauggaggagguucccaaggucucauaguauaagcuguucaagggucagagaagcccccagguccugccuuuuccugucccuuuauguuggggaguuggggguguuacagguaugcuaaacucuuuagcugcagucuaucuacccaugccagauucaucaagauccucgauaguguccugcaccaccugguaccugccugggaccacacacugggcaccuucagugagauuaaggugagccgacccagccagugcuggucuuggcauuuccccuuccugcucacguaguuguucauuccuuagcagaguuccuaaaaucuacucuagggcaagaccuuugcugggucugggaacauaggaagaaagccagaacaaaugguccaaauuuaguguuugggaggcuguuccccagccuccuugguauuccagaguguguggaauacccaagggcuauugacagcacaggcagggcaguuugcgugaaagguacauacagggaguuaccagcagcucaagaugucuugagaaaagugugccaguaggugugaguaugacagagggaugaggguggaaggaugugggcaggagacagguccugguugcagagggcccugugggccaggcugugaagcaaggacuuugucccaggguaguggagcuguuggaaagguaaggaagguaaugacaguauuagauuuuuuuguuuuagaaagcucucccugguggcugaacuaaggaggggacuggagacaaagacagggauggacuagacuugaacugaaacgguggaauuggauacaggcagaggggaaaguuccagggccuggacggaggcugacugcccacucauuccugcucuggccaccucuccucacuagcaagugaagcaguuccuacugcugucccgccagcggccaggccugguggcucagugccugcgugacucugagagcagcaagcccagcuucaugccacgccuauacaucaaccgccgucuugccauggaacaccgugccugccccucucgagacccugccugcaagaaugcagucuucacccaggucugcaccaccuaggguccgacugagauaggaucagucaagggccaagggggcuaggccaagagggaccugaacaaguucuuggggcaaguauagggccaggucuugcuuuccuaugacuccuuuccuccuugccuccagguauaugaaggccucaagcccucugacaaauaugaaaagccccuggacuacagguauggcaugagagugagggacuuacucgggacaccuguuugugcacacaaacacacacaaacacacacacacacacacacacacacacacaacugcucgaggcaccccucgccaugacugcuuuucccagguggucucugagcugaugaauugugcugcaccuggccccacauaaugacaaaucugcccacguuuuuugcagguggcccaugcgcuaugaccaguggugggaguguaaauuuauugcagaaggcaucauugaccaaggugaggcccugagggaggaucucaaggguccugcuugcugcccuaucaaagugguagaggcuuuucaccagcuaaugaugaugggggaccuauucauuaccccauuaugggagcugggcucuugagugcccagcugagggcaucugucauuucagggggugguuuccgggacagccuggcagauaugucagaagagcugugcccuagcucagcggauacccccgugccccugcccuucuuuguacgcacagccaaccagguaaucuccguuuccaucucugcaaaccucccaggugccagauugagcuagaaagggggcagaggagggggccagauugagcuagaaagggggcaggcacaguggcucacgccuguaaucccagcacuuugggaagccgaggcgggcagaucacgaggucaggaguucaagaccagccuggccaaugaagugaagccccaucucuauaaaaauaaaaaauuagccgggcgugguggcacgcgccuguagucccagcuacaugggaggcugaagcaggcgacucgcuugaacccaggagacggagguugcagugagccgagaucacgccacugcacuccagccugggugacacagugagacucugucucaaaaaaaaaaaaaaauagaaauagggcagaggagggacugaguugcucagggcaaccucugggcagacagggagaggaggagccacugugcauuugaagggaucauuuaguggaaaauguucccaguggaaaauguucagggaagucuuugggccaggaaaauaggguguaucucaugccacacucacagcucugucucuggggcagggcaauggcacuggugaggcucgggacauguauguacccaaccccuccugccgagacuuugccaaguaugaauggaucggacagcugaugggggcugcccuucgggguaaggaguuccuggugaguagccuuauccacacccccguccgaucagcccuggcccuuggaaggaaaggccagccaaaccugggcagcucagggugagaagacaguggggaguguuugucacacagguccuggcccugccugguuuuguguggaagcagcuuucuggugaggaggugagcuggagcaaggacuucccagcuguggacucugugcuggugaguaggaccuggaaccaguguuuccucugcccagccccuaaagguugguccucccuaaggcuguucuguaccuuguucuuucaccacacacaagaucccucuccaauccauccacucccauggcuucaacuacugucuguagacucgugaccccuaaaauccugaccucuagccccagccucuccuaagccuggggccauauauguaucuguacccucgacguuugccccaagauggcaucucaggcucaguguguucuuuaucuucuccgaagacuacuccccucuagggcuccugccucagaagggcaccaugucccacuccuccccaucccaaagcccacagggccauccuucaccccuucuucucccucgccaccauauucuuaagucuuccucuguaaucuguuugcuuuuccugucucacuacugucucccugccugguugaggacaccuuuccuccuuagcuaaucacuuacuaaaaagcuggugucccugucuccguucuuacccguuuggucuccaugcagccacaguaauucauuucacucuccuuauuuaaacucauugauggcucggcccugggcuuaggauagaaugcagaaucuguaaaggccuuacgugaacccugugucuccagccacuugguucacauucaggcuccagccacacaguuuccuuaggccuuuugcucuuuccagcuuucuccaagauguucucucuccuaacuucccuuaugucccagccaucauuugggucucagcugagacaccauuuuccacaggaugccuccucuggccuccaaggcugguuagguguugucuugaugcuuuuacagcucuuguacugacacccucauucccugcugccuccauggggacugccuugccuggcugucucugcuucccugugagcaucuuguggaaagacagggacuaucuccacagugaaaagguuaccucccugccucucuccaaccccuaggugaagcuccuggaagugauggaaggaauggacaaggagacguuugaguucaaguuugggaaggaacuaacauucaccacuguacugagugaccaacaggugguggagcugaucccugggggugcaggcaucgucgugggauauggggaccguucucguuucauccaacugguccagaaggcacggcuagaggagagcaaggagcagguaguacccagaggcuaguagagcagagagcuuuggccccuccugagccccagcuccugggacccagaacacagccuguaagccaccaguacuccaagaacucuggcccccaccauuccucagugccaccuuucugcugcuaaaaggccacagugaugccccccagugugaggcgggaggugugcccucuuccccagccaagccuuuuuacccacuccccagguggcagcuaugcaggcaggucugcugaaggugguaccacaggcugugcuggacuugcugaccuggcaagaguuggagaagaaaguguguggggauccagaggucacuguggaugcucugcgcaagcucagugaguuccccaaggcagggcagggcagggcagcacagcacagcacagggguuggggcucaaggacugggcaagaugagacccaagaaugaaugcuggccuugucuccaccagcccgguuugaggacuucgagccaucugacucgcgggugcaguauuucugggaggcacugaacaacuucaccaacggucaguggaggagggcagggugacaccuggguuuggacucugcugcugaguugcagaggcaggguagaaguuguagacccucccucaccauccaugcaggcacugauuuccuucucccuccagaggaccggagccgcuuccugcgcuuugucacgggccgcagucgccugccagcacggaucuacaucuacccagacaagcuggggugagugcuggagggaggccugaaggugccauggccgccuucuguccucccuccccacacacguacaugugccccaacacaucuuccugaccuauggucccucaaugcccccagcuacgagaccacagacgcgcugcccgagucuuccacuugcuccagcacccucuuccugccacacuaugccagguggguuuuuuccuaggcucgauuuggggcccaggggaccccaucaccccugguagcgauguagggaccugaccaaguccccauucccacagugccaagguaugcgaggagaagcuccgcuaugcggccuacaacugcguggccaucgacacugacaugagcccuugggaggagugaggcgugccgccggcugugggaccagcaagacugcacgugucccucuuggccuugcccagggcgaagacaccuucccugcccugguuuggcugacgugcucagcaaaaccccaugugcccugcuccugugugcaguugggguaggggcagcuggcauggucagguaacacuaguggcccagccccgcagacccacaagcccuacccgugcuggggcuugcuucccgagguauuucaccucuuaagagggaaucuuccacaagcccagcacaagcugccaggccugagcuacuugaagggggccaucuagguccccaacccauggacuuugccuccauuuucagcuccgccuuuuuucuccuauuuucucucuggcuuucuucagccaugacucacaacuaaaaacauaaaacacuggagguuaguggaggccccuccccaagcagggagccugggaugggcagggagugauagccaaacuccuuggucaccugcuccaagaaggaagcaguagcugagcaccugcccucacauucugcucuuuuccccucucccuccauaccagagauguggugagcucuguucuucuaccaacccagucucaacacacaaagugccaccaccuucccugacucagaacccacauccacucaaugugaacucuacuaccacgaccuccccauauuccucacuucuccaucaccuccagccugacucccugucugcccuuucacccccaagauuuugcacagguuaaggccaguuauggccuuuuugaaaucuguaauagcuccccuuuccccaacucuaaagccuagaccuuaaaccuguuccuagagcuaugcacaccccugccccaguuuaccguuccucccucagggccuccgugacacuccaugaaaagaaguucuugcauaccggaaaguugaauaaauggaugaauucauuccuucagaauguguuuauugggcccugggcuuaggcacagggucacaaggagaaauugacuuuaguguccuacucggagccaagaagauggaugugaaaugcaaguagagguuucucagugacagacuuugcacaguuacauaucuggggcugagcagagacguaagggccccacugcgcagaaaagggaaaacaagcaaacaggcuggccuggcauuuucuggcauggauauggugauuuggaggaugggaguccacuucuggagccaagugggcagaagaauuugacaucauagaagacagagacgggagggcugacaaac

SEQ ID NO: 14073 - RNA, 21525 nt, Homo sapiens
cagccgccucccggggacugcaguugccaccucgagcccugcugugcgucucgggccagcaauuccgccugcgcgcgggacccauuccuccuccagccgccgcggcccacggcccacggagcgggugaaucccggcgccgcgccccggacccgcagcucccugcacuccucccucccagccgcuuuaacacccacaccccacagucucucccacgcccgcgccuuggcggccccacugaaucccuacgcggggcccagcgguaccgggagaccgggcuagccuaugggagcgcccagauaacgcggguugggggcgcccgcgccccccauccccgccagcaugacucgaucgccgccccucagagagcugcccccgaguuacacacccccagcucgaaccgcagcaccccaggugaguagagggggagcuggaagaaggaagagagcggagccaggucugucacucgggccucugcaagguuugugaugucuugaagugccgagugucauuagaugucugaaggcaagugagagccagcaccgcaagcaaguugugcgugugugucggugugucugugccggugucuccucaucgucuggccagugagaaugaaugucuguggguucaccucuguguccacccgacgacagguguguguacauauguauccugcucucagaaaaugggccuaugccggccgggcgcggugacucacgccuguaaucccaacacugggaggcugaggcaggcagauuaccugaggucaggaguucgagaccagccaggccaacauggggaaacucugucucuacuaaaaauaaaaaauuagcagggcgugguggcgggcgccuguagucccaacuacucgggaggcugaggcaggagaaucucuugaaccugggaggcggagguugcagucagccgagaucacaccacugcacuccagccagggcaacagagcgagacugcgucucaaaaaaaaaaaaaaaaaaaaaaaggagagaaaacaaaaagaaaagaaaggaaaauaggccuaugccuuccucaggugugugcuggggaugguggguguuacaucuuccaagucugggccugugucuguguuggugcucccugucccacauccagaaaucaagaagcgagggcugggcagcagauauacagggugagaagggaaggauuucaugcauuguugcagugaugccuggcugacccuucucuuuccaucccagauccuagcugggagccugaaggcuccacucuggcuucgugcuuacuuccagggccugcucuucucucugggaugcgggauccagagacauuguggcaaagugcucuuucugggacuguuggccuuuggggcccuggcauuaggucuccgcauggccauuauugagacaaacuuggaacagcucuggguagaagguaaguuguggacacuggccauagcugcucagguauggugagcccaagacaagaacggggugaggagcuggcuacugagcucuagcaggccuggcccuggggcuggagggucaccugcuggccagaguccuacaccugggcaucuaggaacaccguucccucccacaaccauaaauggacaucugcagauguuagaccuugugaauuggguguauagaauauuugucugugauuuuguacguuagcauuuauugcuaacuuucuaugugugucuuugacaaugcaucaggguuuuacaaaggcagcuaaaacaagauucaucuuucaguagcaaagaaaguaaaauaugugcuggaauaacuaaaauacaauacagagcauccugugauuaugugguauaagauaggguagggagaaaucacuucugaccagcagaaucagaaaaguuagaacuagaaggcuggggaaacugaguaaauaaucuggccaagccugcagggagaggacucaggcacccaggcccauuuaauggaaaagcaauacagaauccacacuuugaggcaauagccagggucagauggaaucaaauccucacuuucuuaaggaagcauaaaagaagaaugauuuucuugggguuuuuuuuugggggggguuguuuuuuuguuuguuuguuuguuugagacagagucuuucucugucacccaggcuggagugcaguggugcgauccuggaucacuacaaccucacuucccggguucaagugauucucgugccucagccuccaaguagcugggaucacaggugcccaccaacacacccggcuaauuuuuguauuuuuaguagagacagccuagaccuccagggcucagguccucccaccucagccucccaaguagcugggauuacaggcgugcgccaccacacccagcuaauuuuuguuuuguuuuguuuuggagacagaaucucacucugucacccaggcuggagugcaguggugugaucucagcucagugcaaccuccaccucccagggucaagugauucuugugccucagccaccuaaguagcugggacuacaggcauaagccaccacacccugauaauuuuuggguuuuugguuuuuuguuuuuuuuuugagacagagucucacucugucucauccaagcuggaguuuaguggcuugauaucgucucacugcaaccucugccucccagguucaaacgauucuccugccucagccuccaaaguagcugagauuacaggugggcgacaccaugccuggcuaauuuuuguauuauuaguagagaccagguuucaccauguuggccaggcuggucucgaacuccuggcuucaaguaauccgcucaccucagccucccaaagugcugggauuacaggugugagccaccgugccuggccagaaugauuucucauuaauaauuucagcaggccaggcacgguggcucacgccuguaaucccagcacuuugggaggccggggcgggcggaucaaaggucaggaguucaagaccaaccuggccaacauaauaaaaccccaucucuacuaaaaauacaaaaauuagccaggcgugguggcgggcgccuguagucccagcuacuugggaagcggagacaggagaauugcuugaaccugggaggcggagguugcagugagccaagaucgccgcacugcacuccagccugggcagcagagggagauuccaucucaaaaaaaaaaaaaaaaaaauuucagcaugacucucuucuuuccugagggcugguuucauauggcagcccuuugauaggagucaaacuccagucuguuuuucccugggaaauuugcauuuuguagacucccucagcccuggcccauacccaaaggcagaacccagguuggagucucacacccucgaguuauuucaaauacuggcaaguccuaggauccacagcagauguuucucagagcuugccugccuguugagcucccacacgccauccccacccuaccuacccccagcccugcagacucucacauccauauacacucuaggccagcccugggguccagagcagaugucucgcucugccugccugcccccagccccaggacacagaugugcauacacgcacauacacauauccccacccacaccacugcugccuggguggucccagaugacucuuggauuuccugccccaacagaggcagucucccuucccuuccucccucuccauuccccacauucuccccaucuaaacacugcuugagccuccauguuuccucauccucucuccuauacuccagcauaggauaggcuagaccccagcaguuuuuugcuguuguuugggggaggguuuuauaagaggaugguagccaauuccuaggcuuuuuuccuuuauuucagaauaucacucuuguccuauauuggcugggggugagguaaaaaucuuuuuuuuucuuucuguuuuuuuuuuuuuuuuuuuuuugagaguaagucuugcucuguugcccaggcuguagugcagugacgcaaucucggcucacugcaaccuccgccucccggguucaagcgauucuccagaguagcugacacuauaggcaugcgccaccaugcccggcuaauuuuuuuguauuuuuaguagaaacagggugucaccauguuggccaugcuggccucgaucuccugaccuugugauccgcccgccuuggccucccaaagugcugggauuacaggccugagccagacgcuaggccaaucuuuuuuuucauagagauggagucucacugugagacccagucucaaagaaaaaguguaagaaggcagggugcaguggcucacgccuguaaucccagcacuucgggaggccgaaguagguggaucuccugaggucaggaguucaacaccagccuggcuagccuggcuaacuuggugaaacuccaucucuacuaaaaauacaaaaauuagccaagugcggugguucgcgccuguagucccagcuacuccagaggcugaggcaggagaaucgcuugagcccaggaggcagagguugcagugggccaagaucgugccacugcacucuagccuggcgacagagcgagacucaaaaaaaaaaaaaaagaaaagaaaaagaaagauuaagccgaggaagaaaccgaacauuggcuaucacaguguuccagaccagaguucaggguccuccuuaacuuugccucagugagacuuggaauuugacuuguuugucuuuccuggccaacuguaaagucaagcguucagaggcagauuguucucuaaaaugaaaauuacaaaggccuggcacgguggcucacgccuguaauccuagcacuuugggaggccgaagcggguggaucacuugaggucaagaguuugagaccagccugaccaacauggugaaacacugucucuacuccaaauacaaaauuagccaggcgugguggugcaugccuguaaucccagcuacuggggaggcuguggcaggagaaucgcuugaacccgggaggcagaguuugcagugagccgagaucgcgucuuuguacuccagccugcgcaacaagagcugccauuccauguagaagacagaggauggccuuauaucaguugguagaaucaccauccacuuaaauaccuaaagcuaaaaccuuaggagucagccucaguucuuguucacccaauuguuuacuaaacuauuaaauccuugcuucuuaaccucucucauaacaaacccauccuuucuuuuuuuuuuuuuuugagacggagucuugauguguugcccacacuggagugcagaggugcgaucuuagcucacugcaagcuccaucucccggguucacgccauucuccugccucagccuucugaguagcugggacuacaggcacccgccaccaugcccagcuaauuuuuuuguauuuuuuuuaguagagacaggguuccaccauguuagccaggauggugucgaucuccugaccucgugauccgcccgccucggccucccaaagugcugggauuacaggcuugagccaccgggcccggcacaaacccauccuuucuaccuuguggucacugcucuaguugaggccuuguucuaucucuggcaauacacuucugauuguaucauuuagaaugcuuuuaggccaggcgugguggcucaugcuuguaauccuagcauuuugggaggccaaggugggaggcuugacugagcccaggaauucaagaccagccugggcaacauggcaaaaacccaucucuauuucuaaaaaauuaaaaaauaaaauaaggccaggcacaguggcucacaccuguaaucccagcauuuugggaguccagggugggguggaucaccugaggucaggaguucgagaccagccuggccaacauggcaaaaccuugucucuacuaaaaauacaaaauuuggccacacaugauggcauguaccuguaaucgcagcuacuccggaggcugaggcaggagaucacuugaacccaggaggcggagguugcagugagcugagaucgugccauugcacuccagccuggguaacagcaagacucugucucaaaaaaauauauaaauaaauaaauuaaauuaaauaauagaaugcuuuuagccacaugaaaagagaagaaaaggaaaggaagaagggaagaaggaagaaagaagauugauuuauuauucucuguaacaggaagccugguuaauucaguuaauucggcagcccaaggacauuagcaaggacccaguuucuuucuaucuuucuccucugccaucuucaacauucuggacuuuuguccucagacuuaucucaaaguggcugcugcagugucaggaaaaagaaaucauucuugucuugcauuucuuuuuguuuuuguuuuguuuuauagagacagggucucacucuuucacccaggcuggagugcagugacacaaucacagcucacugcagccuggaacuccuaggcucacacaguacuccugccucuuucucuguaguaucugggacuacaggcacaugccaccaugcacagcuaauuuuuuuguuuguuuguuuguuuguuuguagagacgcagucccacuauguugcccaggcugaucuuuuuuccuuuuuucuuuuucuuuuccaucccccgagacagagucuugcucucuagcccaggcuggagugcaguggauugaccucagcucacugcaaccuccgccuccuggguucaagcgauucuucugccucagccuccucaguagcugggauuacaggugcgcaccacgccuggcuaauuuuuguauuuuuaguaaagacaggguuucaccacguuggccaagcuagucucaaccucuugacuucgugauccgcccaccucggccucccaaagugcugggauugcagguaugagccaucgcgccuggccggcccccaggcuggucuugaacuccuggucucaagcgauccuccugccuuggccuccugaagugcugggguuacaggcaugagccaccaugccugaucuugcaucucuuuuaaaaagugaggaaaaauguauuaguagccucccagccaacuucucauuugcucucuuuggcaagaacuauguagcauccuaugccgaaauccuucacuuggcaaaggcaauggaauuacugauuggcuucuuaaacuaaucaaguuucaccuccugaugcuggggaggagcccagcugucccuaaucacugggccuuuccgaugacggccacggaaaucagggucuguuagaaaggaggaaggugcugacagccucaccuucaaaucugccuccacagcaccacccuguggccaaucuccaucuggccaagucaguccccuucuuagugcccuuccaccgauuuccaccagauucuguaaaaucaaauauaaacuccauagcacacacucuaggcccuccauaauuggacuugauugcuucuccagcauugccgcuggcuccucccuggcucacucuuagcaguaccgaaacacggagucuuugacaguucccugcgcacaccugguccaggacacguuuccugacuucuucucgugggcaccucaucauucacaacucacaauaguguauucacaaaaauacauuguuaggugaugaaaacgucagauccccucugcccaaaaucuaccaugacucccauuucaccuagagaaagcuuaagucccuacaauaguauauaggccuuuacacgugaaacuucuggaccaaagauuauggagcauauauauugcaauguugcuuucccccgaagaguguaccauauuacacucucaugguggguuagaguguacucuuguaaaccagcaacgagugccaucaauuuuaaaauuuuugcuaaauuguuagauaguaacuuauugauguuuguauuugcauuuacauuauuauuuauaagguagagucuuuuuccauauugguuaaccaguuauauuuucccguugguaaagacauaaaaguuuggccgagcacagugacucaugccuguaaucccagcacuuucagaggcugaggugggaggaucacuugagcccaggaguucgagaccagccugggcaacauagggagacccugucucuacaaaaaauacaaacauuaacugggcaugguggcacacaccuguaguuccagcuacuugagaggauugcuugagccgggaggucaaggcugcggugagcugugauugcaccacugcacuccagccugggugacaaagcgagacccugucucaaaaaaaagagacaaguuguuuuuucauguaucaaucuugauauucucccuccucuguccuauuuccuccccugucaccugcagucuuuccuucaguuccuucucauuuuucugucacuucauuucucuaccagcaacuauugaaaaauaacuccacaucuguaccuacugugugccaugcaauuuccuaaguacuuugccugcauuuauucuaauucuaccaagguagucacuguuucuguuugacagaugaggagcuggagacccagagagaauaacuaaugagcccaaggcacagacuaagcauuaucgacucuuccuuucugcaccacaaugcaucccaguucaccuguccauaucuaucuuugucaacuaagguuuaucuuuuucucugccccauuuucuccccugaggagucuuuauucucuuugaugcuccauuuuaaauuauccguguuucuuucucuugcuuucuuaucagaucucucuggguuccuuccuccucccaugccuccuuccucucagcaaacccacuuacuauggagagcuuaucucuguccucuucuucccuuccaugcggcagccuucggccuaaucuuggugaaauaaacacugcaguacaggccuggcaaaagaguggggaguaggggagagucggagaaggagaggcugggcacgguggcucacaccuguaaucccagcacuuugugaggccgaggcuggcagaucaccugaggucagcaguucaagaucagccuggcgaacagggugaaaccccaucucuacuacuaauaauauaaaaauuagccaggcguaguggcaggcaccuguaaucccaacuacucgggaggcugaggcaggagaaucgcuugaacccgggaggcagagguugcagugagccgagauugcaccauugcacuccagccugggcaauaagagcgaaacucagucucaaaaaaaaaaaaaagggaaggaacuggcaguguggggagcaggacaggaagacuguuuucaugaggugaaggccaggaaugugacuuuuggggcacgaggggacaugugagcauauggguaaguauguguugggggcuaccaaggauuuggggcuuuugugagugagaagauuacauggguuugaaaaagagauuggagggccaggugcagugacucacaccuguaaucccagcacuuuaggaggcuggggugggaggaucgcuugagcccaggaauuuaagaccaacuuggggccgggugcgguggcucacuccuguaaucccagcacuuugggaggccgugaaaccccaccuguacuaaaaaugcaaaaaauuagcuggccaugguggcaggugcuuguaaucccagcuacucggaaggcugaggcacgagaaucgcuugaaccugggagacagacguugcagugagccacaaaaaagaccagcuugggcaacauagugaugagaccucgucucuacaaaaaauuuaaaaauuagccaggccugguggcgggugccuguggucccagccacuugggaggcugaggugggaggaucaccugagcccaggaagucgaagcuauagugagcuaugaucaggccacugcacuccagccugggcaauagagcaagacucugucucaaaaaaaaaaaaaaaaggaaaagagauugggaaacaugacgaucucagauggggcuugagucucagagaagcaguacguuugggucccagcaggcagcaaagacuaacaggaggagacccccagacagguggaaacagcgcagggucugagaucagaccaaauccgcaaagccuccagagguagauuuggcccucacucuuccccacaucauaguuaggugauagccccucacaauguccccaccucccccaggucccaguuacagagcaggagccuguggccagcauaacgcaggacuggaggggcgcuaagauccaggacacuauggcaggccuggcgccgggaaucccuguggucuggacagugagggcggugaaaaggaucuggacaccucccuccccuuggcccacuuugauuucaccccugccaggguucgugagcugauuccaugcacuuucugccugagugggagcagcacacugaaugacugucccauccucccucucccccacaccaacacagggcccauuauuaucacccauuauuaucagacacuccuaucccugcccucuccuuaggacacuuugcagaaagguguguggauauaaaucacugcccagagcaaccugaacuaagaaccagcccuagcccuacaccuguucuuuuaggaaacccuccuagcagcagccucccuauuggccccuauuggcccuccuuguccuccccaccagaacagagagggacugagcgaggguucccuuaccaagaugccccuacaacccccacagcccacggccagcucaugcugauugucauuuuuaaguuuacacccaaaacccagccaaccugguucaugcuuaagcccuagaccacacaagaaauccgcagagccacacaaccgaggcuucuccacuucccuggcagagcuccaggacccagaagccuggggagucggccugggccaugaccaggcccucagggauaaggcagggacuccucucugccgcaccucucccacuugucuggggaggccucagaguuagaagcccccuucccaaguucugacccgccuaggcccuuucccccccagcuuucucuguuugcucuggcagugggcagccgggugagccaggagcugcauuacaccaaggagaagcugggggaggaggcugcauacaccucucagaugcugauacagaccgcacgccaggagggagagaacauccucacacccgaagcacuuggccuccaccuccaggcagcccucacugccaguaaaguccaaguaucacucuaugggaagugagucuggcugagccccugagcagcugggggcgaggcgugcuguggggguucuggagugggaauccccuucuucugcugaucuccuaugccccuggcuauugcagguccugggauuugaacaaaaucugcuacaagucaggaguuccccuuauugaaaauggaaugauugagcggguaaguguccugagagggaguagaggcagaacuuuuucuguagcgugggaggacucagagaccgagcaagccccacagccugcaaucugcccccuuaaaacuaaggagggggauugcagagggcauccuacaaagguuguggggcaggacugacguggcccgggguaucccuggcagaugauugagaagcuguuuccgugcgugauccucaccccccucgacugcuucugggagggagccaaacuccaagggggcuccgccuaccugccgugagugccacuccuggggcccugcuucaucucccgcuggggacucucccagcagaaaggaggggucuggggaaugaggaugaucaaaaccuuaccaagguccuaauuaccucccaggccaggaacagagagcaugggcuuccccaaggcucucuccacauccuccuucucuuucccucucaaggaaggaagaccugacuuauuuacacaaaacuaaacacaaagaucuguaagaucugagcaaaggagaaaaagauccccacaaagaggcuuugcugggggaaauuaccuagguguuugcuaagccauugcccaggccagaaagaaaaccugcuacaggcaugugccugcugguuguauauuagaaccaagcacacagcuugguaaggaacucaguggggccuuucugggcccuuucuauguauuagguaacccugcccugauauucgucucagccccuuguacucuucuacagcucacuguagcacccuggugggcccaugcagccuggcaguucugagaagcugaggcuugcacacccuccauauggaaggacaaaucggcagauaagaggagggugggguacagcauggcgccccagcagcaguuuggagccuggguuuucgucccugacccucaccaacuauaggcuuuucccucagcggccgcccggauauccaguggaccaaccuggauccagagcagcugcuggaggagcugggucccuuugccucccuugagggcuuccgggagcugcuagacaaggcacaggugggccaggccuacguggggcggcccugucugcacccugaugaccuccacugcccaccuagugcccccaaccaucacagcaggcagguggguuccaaccaggucugccagggaaaggcuguuuuccuucccuuucccuuccucauacuccuguguucugggggagcugacugcucugugcccugaccccccacuuccuggccauuauuacccugcucccacagugccaggcccccaauguuccauucccauucaguuauccuacggagcccucaagugguauauaugaaucccuuuuuccuuuucuaagccuagauaaggcuggacuucuuuuuuuuuuuuuuuuugagucucacucugucacccaggcuggagugcaguaguucgaucuuggcucacugcaaccucggcucaagcaauucuccugccuuagccuccugaguagcugggauuacaggugcccaccaccaugcccggcuaauuuuuauuagccucccaaagugcugggauuacaggcgugagccacugcgccuggccaaggcuggacuuuuuaucaaaauagacuaauacagggaaacuaagaacacagcagguaagcaugaauaucauaccugguuucccagguuucuuuguggcccugcaaaugugguacuuuuuucagaauccgccaguuacaccagcuccucccagaagcccuuccaggccucugcuuccccuuggggcuuccugucugcgggauacuagcuguucacuccugcagagcagucaagaggcucagaauaguuaccuacacuccagcccuacugagcuucauggcagcgugguuccuggagguggaagcccagggacacucaguuauccacggccagggccuugagcauuaaccccuccuguuccccuccaggcucccaauguggcucacgagcugagugggggcugccauggcuucucccacaaauucaugcacuggcaggaggaauugcugcugggaggcauggccagagacccccaaggagagcugcugagguagggucuccucugggaguuggugaggggacucuguucaugagaacccauacuguaaugccaggcagcucuggcaaaaggcccuucacaucccucaccagguguuugggccagcucugaccccugguucucccacacccccaccagggcagaggcccugcagagcaccuucuugcugaugaguccccgccagcuguacgagcauuuccggggugacuaucagacacaugacauuggcuggagugaggagcaggccagcacagugcuacaagccuggcagcggcgcuuugugcaggucgguauggacaaggacaaggggggugcccugaggccauucccuccuccugcccccuccuauccacccuguuucuccagcuggcccaggaggcccugccugagaacgcuucccagcagauccaugccuucuccuccaccacccuggaugacauccugcaugcguucucugaagucagugcugcccguguggugggaggcuaucugcucauggugggucuugcaccuggcaccuugcccccaccccaccuccaaccagugcccacccugggagccccugagacugcccuuuccccccacagcuggccuaugccugugugaccaugcugcggugggacugcgcccagucccaggguuccgugggccuugccgggguacugcugguggcccuggcgguggccucaggccuugggcucugugcccugcucggcaucaccuucaaugcugccacuacccagguacgccaggacugcagggcagacucagugccagucaccaggcuucacggguccucagcugcccgcuccucugccccuccaggugcugcccuucuuggcucugggaaucggcguggaugacguauuccugcuggcgcaugccuucacagaggcucugccuggcaccccucuccagguggggccuugucccccagggcucaucugaggcagcucagcuuacugguuaagagccucuugguucaagugaccuugggcugcuaaugaaccucggugccucuuguccccaucuguaaacaggggaaauaauagugcuguguccuaaggguuauuguuuggaucagugagguaacucaaguugaaugcuuagaacagcccaucauacguacaugguacccaauaaaugcuagccacuguguuaugacugccccaccucugcaccccaaguuccugagccuccccuucacuccacuuugacacggccccucccuugugaccugagggcagguccccacucuguccuggcaggagcgcaugggcgagugucugcagcgcacgggcaccagugucguacucacauccaucaacaacauggccgccuuccucauggcugcccucguucccaucccugcgcugcgagccuucucccuacaggugaggccucucacacggggcagcucaggguggguguggggcugaggccaagcuucauccagccuucauuccccuccuguccgucccccaggcggccauagugguuggcugcaccuuuguagccgugaugcuugucuucccagccauccucagccuggaccuacggcggcgccacugccagcgccuugaugugcucugcugcuucuccagguacugccugcgccccagccccuuccucccgugacccacgccagccuguccccucaccagcauuucaaggcacagaccugucauccacucucuaccucuuccagucccugcucugcucaggugauucagauccugccccaggagcugggggacgggacaguaccagugggcauugcccaccucacugccacaguucaagccuuuacccacugugaagccagcagccagcauguggucaccauccugccuccccaagcccaccuggugcccccaccuucugacccacugggcucugagcucuucagcccuggaggguccacacgggaccuucuaggccaggaggaggagacaaggcagaaggcagccugcaagucccugcccugugcccgcuggaaucuugcccauuucgcccgcuaucaguuugccccguugcugcuccagucacaugcuaagguaagacugggcagagcagggcagagacuuagcaucucugggcccagaagggcagagagggcuuaguccacugccugaggggcugggggcagcccuggggucuccagcuuaguugcuacaucccgcaggccaucgugcuggugcucuuuggugcucuucugggccugagccucuacggagccaccuuggugcaagacggccuggcccugacggauguggugccucggggcaccaaggagcaugccuuccugagcgcccagcucagguacuucucccuguacgagguggcccuggugacccaggguggcuuugacuacgcccacucccaacgcgcccucuuugaucugcaccagcgcuucaguucccucaaggcggugcugcccccaccggccacccaggcaccccgcaccuggcugcacuauuaccgcaacuggcuacagggugagaggcgaggagacgggcagggaggggugcugcagggagaaacgcccuggggccaccagcuaauagaacccuauccuggucucccccaggaauccaggcugccuuugaccaggacugggcuucugggcgcaucacccgccacucguaccgcaauggcucugaggauggggcccuggccuacaagcugcucauccagacuggagacgcccaggagccucuggauuucagccagguugggagagggcuggagggguccacuaguacaggggcugcaggccuccugggcccaggccuucagcccucucugccucugcagcugaccacaaggaagcugguggacagagagggacugauuccacccgagcucuucuacauggggcugaccgugugggugagcagugacccccugggucuggcagccucacaggccaacuucuaccccccaccuccugaauggcugcacgacaaauacgacaccacgggggagaaccuucgcagugagucuuggggggagcucggcaagagccucagccucgcccacacaagcccugagccugaggcccugcccacucugccccgugcucaccgcccugucccucucccucuucucccuuccccuccccuccacagucccgccagcucagcccuuggaguuugcccaguuccccuuccugcugcguggccuccagaagacugcagacuuuguggaggccaucgagggggcccgggcagcaugcgcagaggccggccaggcuggggugcacgccuaccccagcggcucccccuuccucuucugggaacaguaucugggccugcggcgcugcuuccugcuggccgucugcauccugcuggugugcacuuuccucgucugugcucugcugcuccucaaccccuggacggcuggccucauagugagugcuugcaggaguggggacagagacaccccacccuucccugcccagccugucaucccuccugccaggagcccucugugagcccugucucccucaggugcugguccuggcgaugaugacaguggaacucuuugguaucauggguuuccugggcaucaagcugagugccauccccguggugauccuuguggccucuguaggcauuggcguugaguucacaguccacguggcucuggugagcacgggcaccccggggagggaccaaucagcugauucaguauucaacacauauuguucaagccccuacuaugugcuagguacuauuuaagaauuugggcuggguggacgugguagcucauuccuguaaucccagcacuuugggaggccgaggcagguggaucaccugaggucaggaguucgaaaccagccuggccaacauggugaaacccugucuuuacuaaaaauacaaaaaauuagccaggcgugguggcacaugccaguaaucccagcuacuuuggaggcugaggcagaauugcuugaaccugggaggcgaagguugcagugagcugagaucgugccauugcacuccagccugggcaacaagagugaaacucuccgucucaaaaaaaaaaaaaaaaaagaauuugggcugggcacaguggcucaugccuguaauugggaugaugcuggggcauuuugggaggccaaggcaggcggauccccugaagucaggaguucaagaccagccuggccaacauugcaaaaccccgucucuacugaaaauacaaaaauuagcugggcgugguggcucaugccuguaaucccagcuacucaggaggcugaggcaggagaauuacuugaacccaggaggcggagguuacagugagcugagaucacaucacuguacuccagccugggcaaaagagcaagauucaaucucaaaaaagaauuuggaaaauaaaaauaaaaaagaauacgggauauaauagcaauacaguuuuuuaccuccaaggaacuuauauucuagggauagagauagacaauaagggcugggugagguggcuuacgccuguaaucccagcacuuugggaagccgaggugggcacaucacuugaggucaggaguucaagaccagccuggccgacauggugaaaccccaucucuacuaaaaauaugaaaauuagcugggugugggggugcaugccuguaaucccagcuacuuggaaggcugaggcaggagaaucacuugaacccgggaggguggagguugccaugagccgagaccaugccacugcacuccagccugggagaccgagcaaaacuccaucucaaaaaaagaaaaaaaagaagagagagauagacaguaaauaaguagacaaauaaauaagcagccauuucaguagagaggaguagacaagauccugucuggaauguguuaaagacagaauggaagaugagaaaaugggaaucaaugauucuuuugaaugguuuuacugugaaccauugugggaugggccaggcauggugacucacaccuguaaucccagcacuuugggaggcuaaagcugguggauugcuugagccaggaguucaagaccagccugggcaacauggugaaaccccgucucuaauaaaaauacaaaaauuagccaggcguaguggcaggugccuguaaucccagcuacucaggaugcugaggcaggagaauugcuugaaccugggaggcagaggcugcaguaagccaagauugcgccacugcacuccaaccugggcaacagagcaagacuccgucucaaagaaaaaaaauuuuuuuuaaauaauuagcugggcaugguggugcgugccuguagucucagccacucaggagguugaggcgggaggaucacuugaaccucagaguuugaggcugcagugagccaugauuacaccacugcacugcagccugggcaacacaguaagauccugucucaaaaaaaaaaaaaaaugggaugguagcgggauggcaaugugggcuuaauggagggguucuacaaagauaccagagauacagagaugccagaaccaaggagggccucgcccagggcugcauauucucuggcagaggaaaggggggacccacagaccagccagacuccacaaacagcucccuuccuuuccccccaccaaauaucucuauuauuauucugauuauaaaaacaauauaugauccuugaaaacaaacaaagccagcaugcagaaagguacaaaagaagaauuagaaauccucugaaacgcuacucugagaaguaacuguuaucacuuugaugucccucuucuagauggacuagugguuggccaacuucuucuauuuauaggaccaaauaauaacuauuucaggcuugguaggccauagagucucugcugcaacucugccaucaaagcacaaaauugucuagacaauacauuaaccaauggguauggcuguuucaacaaaauuucauuuacaaaacaagugacaggcuguaguuugcccaaccuauguuuguuuguuuguuuguuuguuuguuugaaacagggucucacucugucgcccaggcuggaguguagcagugcaaucucgguucacugcaaccuccaccuccugggccaagcgauccucccaccucagccucccaaguagcugagacuacaggcacacacaaccacacccagcuaauuuuuguauuuguuauagagacaggguuuugccauguuucccaggcuggucuggaacucccaaccucaggugauccacccaccucagccucccaaagugcugggauuacaggcaugagccaccgugcccgggcuuguuuguuuuaagagacagggucucacucugucacccaggcuguacccuauuuucuacgugucucugugucuaagcucaccaaacccauccauacaguguuaccuaaaaggacucacgcaugcucccuguacaguucccaugaacuuaguucacccagccuuuggugggccaagguaucguugagcucugaagacagauacagcucgggacauggcugagcuggccaugacuggcagaggagcagcuccaggaccacucuguuuuccuagggcuuccugaccacccagggcagccggaaccugcgggccgcccaugcccuugagcacacauuugcccccgugaccgauggggccaucuccacauugcugggucugcucaugcuugcugguucccacuuugacuucauuguaagguagggagggcucggggcagggaggcagggcucaggacaggccugggcugacuccccccacacccuaccccuagguacuucuuugcggcgcugacagugcucacgcuccugggccuccuccauggacucgugcugcugccugugcugcuguccauccugggcccgccgccagaggugaccacacccucggcaccaucccucuacucccagcccaagggacgggguagggagaggcaagggaagggacagagcccuguggcccacagacagguaccuccccaacaggugccaccagcugaagguggcagccuccuccuuuccccagacaccauguuccugccccucagcccuccuggcuucuucaugggacccaccuuagacuuuuaggauccagaacaaggugcaggguuugccccaggccucaacauccugucgccugccagcucucauauccugcuggagaccaacaagggccccagcuucccaacagucaugguaauccccagcgagaugcuaaaggggacgggagccccaggggcccgugggcuuacuggggcuggugucuccccacaggugauacagauguacaaggaaagcccagagauccugaguccaccagcuccacagggaggcgggcuuagguggggggcauccuccucccugccccagagcuuugccagagugacuaccuccaugaccguggccauccacccacccccccugccuggugccuacauccauccagccccugaugagcccccuugguccccugcugccacuagcucuggcaaccucaguuccaggggaccagguccagccacugggugaaagagcagcugaagcacagagaccauguguggggcguguggggucacugggaagcacugggucugguguuagacgcaggauggaccccuggagggcccugcugcugcugcauccccucucccgacccagcugucaugggccucccugauauccauacagaacagccaccgauuugcacauccaggccugugugagccuguaucugugucacuugagagugaaagcuggcacuuggggcugcagugcagcccugucccccuucccaccccacaccacugccugcccagcugaccaagccugagggacccuccagcacccuuccgucuggugacuccugggcaggcucuccauaucccugcccaccuccuaccacauccauuauuuauaugaaaaugucuauuuuuguaguauacauacauguuagcuaugaugaaaguuuuauuuuuuaaagaaugaaauauauucuaugugaacuaaucucagaugacuucagugcuuuuuuuuggacagaguggggaguuugcaagugaacauuagcuauuggaaggagcuucucuggugccaggaccugagguauuagcuucucuaguucuggguggaaaagaccccagauucuggauuuuugucauauacuugguaacaucaucuggauuaagugcuuacuaua

SEQ ID NO: 14074 - RNA, 1409 nt, Homo sapiens
cauuugaaggacagguccagaaagcggugaugcucccggggcagggugccucuccggcggcgacacggggcgccccgggccucauccccucuccgcagggcauggcauuuccacgccuccacaaucugcuccaccugcagagcaaggccaguuagugcgcagucccgcgguggccccucgccccgaggaccgugggccgggcugcuccugcccccucccagcgcccuguacccccugcugaguggagcugggccgguuccccgcguccccaccgggaugagugguuccugccgguucugcucuuccagggcgcucagcuccgccggggccagcaaggcuagucucagcucuuucaccaccggggccgccaccucagccaccggccgcuccagcaccgccugcaaacgccagcccugagucgggcaccuguccugccgcccgcucaccagucucguggccagcaccuccuuccgugcccuugcgcucccccagccccacucaccgcgcccacgcgcgcccagcuucgggccgcgcggaccaguucagccucguccacgcagagcuugucgcugcggagcaggggcagcagcgcggccgccgacagcuccaggaagccucggguccggagggccuccugcgagccggcaaaugggucagggaggagcagaaugcggugcguagggugaggaguaugaagggagcaguaccuggcugugggccucuaugaaagccacgcagcgcuccugcagcugccccaggccaaagguuacggccaccugcgagcagaaugagggagaucagguuggagacuggagaggccguagcccagccugcucacugggacccaccacugcaagccugacccuagcccuagcuggggaggcugacagggcccucagcccuccaggaaacuagacccaaugaaagccugcuacacacacacacacacacacacacacacacacacacacacacacacacacacguggacucacucuacaaccugcucuucccuacaggagaccacgccauggccuucaaaccccaccugggaccuaggcuugauuuuuuuugaggcagagucucacucuguugcccaggcuggagugugcaguggcgcaaucucggcucacugcaaccucugccucccggguucaagcgauucuccugccucagccuccagaguagcugggagcaugccaccacaccaggcuaauuuucuguauuuuuaauagagacaggguuucaccguguuagccaggauggucucgaucuccugaccucuugauccgcccgccucggccuccaaaagugcugaaauuacaggugugagccguugugccugacccagcuugacuucuaaagucuacagccacccuuucccuaccccaagucaagcugagaaccau

SEQ ID NO: 14075 - RNA, 6206 nt, Homo sapiens
ggcgccagcgcagcguagcaaauccaggcagcgccacgcgcggccggggccgggcggaaccgagaagccgggaccgcgcugcgacgcgccggccgcauggagccugccgccgguuuccugucuccgcgccccuuccagcgugcggccgccgcgcccgcucccccggccgggcccgggccgccuccgagugccuugcgcggaccugagcuggagaugcuggccgggcuaccgacgucagaccccgggcgccucaucacggacccgcgcagcggccgcaccuaccucaaaggccgcuuguugggcaaggugggccgagggacguccgcgggguggugaugguggaggugggggucccggccggccucuuuucuggcgccgagcagggcgugggcacuugacccccaacgcggggacgcccgcgggccagacucggccccccuggaacaaccagccugaugcccccucuucacaggggggcuucgcccgcugcuacgaggccacugacacagagacuggcagcgccuacgcugucaaagucaucccgcagagccgcgucgccaagccgcaucagcgcgagaagguggguccaggcucagcgggcgaggggugggguggggacgguggcaugggaaccauggaaggaugacgacuccgcgcccucaucgcagauccuaaaugagauugagcugcaccgagaccugcagcaccgccacaucgugcguuuuucgcaccacuuugaggacgcugacaacaucuacauuuucuuggagcucugcagccgaaaggugaaagauggugauucccgcagggaugagagugagggagagaagacagucuuuuuuuuuuuuuuuuuuuuuuuugagauggagucuugcucuguugcccaggcuggagugcaguggcgcgaucucggcucacugcaaucucugccucccggguucaagcaauucuccugccucagccuccugaguagcugggauuacaggcaugcaccaccacgcccggcuaauuuuuguauuuuuaguagagacaggguuucacccuguuggucaggcuggucucaaacuccugaccuugugauacaccugccuuggccucccaaagugcugggauuacaggcgugagccacuacacccagccgagaagacagucuuaagacccaaagcuggggcccuguuucuuccucagggagcacagauggagggggagggggagggagggcucaccaggggcugaggcaguggcucucugcagucccuggcccacaucuggaaggcccggcacacccuguuggagccagaagugcgcuacuaccugcggcagauccuuucuggccucaaguacuugcaccagcgcggcaucuugcaccgggaccucaaguugggugagacuccugagccuggaggaugggagguuggggagggagggagggagggaggaaggaaagaaucugacacaccucucuugccccaucuaggaaauuuuuucaucacugagaacauggaacugaaggugggggauuuugggcuggcagcccgguuggagccuccggagcagaggaagaagugaguuuugaggaaaggggcccugugugugauacagaugacaugcgugauagacagugcauauguaugugggaggcaaggugacugccugaugugugcaugagauaaaugggaagggaugaugggcuguucaugcaugugugaagguggagguggcagccuguguuaccgagaccgguggagagggggaggauccuauagguguaugacacagauaggguaggugacucugagucccugagacagauggggguauacagauucuuggaggcacaugacuuacccuuuguguggaugggggaaggugacaggcagcguguaugugugugugagagacagacugagaguguggaaauggugggauaugacauuguggguguaagaagacccugcuguggccaucauacuuugugugugugacacagauagcguauguggcagaugaguguuuauggggguugugacagcugguguugguguguguguggcacaaaccgugggaggugacagccugaugccugucugacagacaggagugcaggaagggggaagggaucagcuguggacucucuguguugacccuagaggagaggacugggcugggggucaggcccucccccugucaugaagagcagcugagcagcugggccaggcgggugggcggggacucagcugccaucccuggcauccauugucccaggacaagcaggaguucucuggccuuuggugacaggcagcugcuuugucuggacuaacagugggggaaggagucggggggcugcugggcugggucucagccuucucuccuccuccccacccucuuucaggaccaucuguggcacccccaacuauguggcuccagaagugcugcugagacagggccacggcccugaggcggauguauggucacugggcugugucaugugaguugcaggguccagguucagcagcagacaggugguggguguguggguggagcaucuccuccacuuuacuccugaccccuuggcccugcccuauagguacacgcugcucugcgggagcccucccuuugagacggcugaccugaaggagacguaccgcugcaucaagcagguucacuacacgcugccugccagccucucacugccugcccggcagcuccuggccgccauccuucgggccucaccccgagaccgccccucuauugaccagauccugcgccaugacuucuuuaccaaggucuguggcuccccagaccucuaaguccaucuguguauucccagggauugaaagggggcaggugacaggaccccuggagccucucuucucuguucacaugguuccccucccuagggcuacacccccgaucgacucccuaucagcagcugcgugacagucccagaccugacaccccccaacccagcuaggagucuguuugccaaaguuaccaagagccucuuuggcagaaagaagaagagugagucuggggugucaguggguugagggggcagagcaguagagcggcuugucacauuugucuugggugugugagugugggugccuggaaacuccuggggagagcaugugcaguacaggcacuuggggaggccaaucucugugucaucccugucggaaguggaggggcugggcaggauacugaggacgguaucaccuuucacccccagguaagaaucaugcccaggagagggaugaggucuccgguuuggugagcggccucaugcgcacauccguuggccaucaggaugccaggccagaggugaggcgcucagguggacacuguuccccugacucacccccacccuagcagcugagggaagccggggauaaaagaggcugcugaagcauccagccucgugguggccuaauuggcugugugucaccagccuggcggggcugaccuggggugcccugggagccagggcagggccaggccauggacucaaggguuuggauuuuggggccugugucacucccuuucccugcccaacccuccaggcuccagcagcuucuggcccagccccugucagccugguagagacagcaccugaagacagcucaccccgugggacacuggcaagcaguggagauggugaggagccagggaggaugagaggugauagagguugcuggagcugagaucaggggcgagagggaaggagugggcagaggggccuggccuggguccuggggugcuaauuccuaaaucucagugcccugucuccuucaggauuugaagaaggucugacuguggccacaguaguggagucagcccuuugugcucugagaaauuguauagccuucaugcccccagguaaggguggggucugguacaugcugcuguggugggaguucuguggcugggaggccaggagcaggugcugacucccuccucucccaugacagcggaacagaacccggccccccuggcccagccagagccucuggugugggucagcaaguggguugacuacuccaauaaguucggcuuuggguaucaacuguccagccgccguguggcugugcucuucaacgauggcacacauauggcccugucggccaacagaaaguaagugcuguuauggggugccuuguauucaggccacuaauccagcagggccgcacccucgugagugcuccugggcucaggggucuggguuucucagaggaggggcauuggugcagggcucccucugaccucugccuccccauucuaggacugugcacuacaaucccaccagcacaaagcacuucuccuucuccgugggugcugugccccgggcccugcagccucagcuggguauccugcgguacuucgccuccuacauggagcagcaccucaugaaggugugagggcuggggcugugguacauugaaaccuaacccauccuggccgggugcgguggcucacgccuguaaucccagcacuuugggaggccgaggcggguggauuaugaggucaggagaucgagaccauccuggcuaacaaggugaaaccccgucucuacuaaaaauacaacaaauuagccgggcgugguggcgggcgccuguagucccagcuacucgggaggcugaggcaggagaaugggcgaacccaggaggcggagcuugcagugagcagagauggcgcaccauugcacuccagccugggcaacagagcgagacuccaucucaaaaaaaaaaaauaaagaaaagaaaacuaacccauccugaucccucugauucccccuugguggugguugggguugcugaaagcuagaggauaaggcauacacuaauggggagggggcugucucacgcuggaucagugaccugcccugauccugcucccaggguggagaucugcccaguguggaagagguagagguaccugcuccgcccuugcugcugcagugggucaagacggaucaggcucuccucaugcuguuuagugauggcacuguccagguaagagccuauccaggaguugcgggaaggucugggaggcccagggugcuggggaggaagcugggcccggagccuagguccugaccacugucaugcucugugugcaggugaacuucuacggggaccacaccaagcugauucucaguggcugggagccccuccuugugacuuuuguggcccgaaaucguagugcuuguacuuaccucgcuucccaccuucggcagcugggcugcucuccagaccugcggcagcgacuccgcuaugcucugcgccugcuccgggaccgcagcccagccuaggacccaagcccugaggccugaggccugugccugucaggcucuggcccuugccuuuguggccuucccccuuccuuuggugccucacugggggcuuugggccgaaucccccagggaaucagggaccagcuuuacuggaguugggggcggcuugucuucgcuggcuccuaccccaucuccaagauaagccugagccuuagcucccagcuagggggcguuauuuauggaccacuuuuauuuauugucagacacuuauuuauugggaugugagccccaggggggccuccuccuaggauaauaaacaauuuugcagaauuggacucccccucacucgcaguagagcccguggaccguggccaccgcgaagagcgagguguugguguaggagaccgaggccagcccaucgcgcgccacgucccagagcgcacggcugaccacgugaacgcccuggcccgcgcgcggccccagcaccacacugcauaccagcuuguagcguggcgggcugagcucgcgcaggcgaacgugcaccugcucgcagagcucccgcaccagccgcgcggccucgucgcuggaguagcacgcgucgugcagcccugcggccagcgccgccuccagggcacgcugugcacgcgcagccucccagcgcuccccgggcacuggcuccgugcgguaggagggcgccacccaacgggcgggcgccaggggcaacccugagaagcugacccuugagcccagagggggcaccgggcccagggauggccgcugacccccaggacccgcgccuggcccgaccagcgaguugcggcgggagaaggacgcggccaggcccagcauggagccccggcgcgaggccggggcuggaccuggaccugccggucgggccucaucaaugcugggc

SEQ ID NO: 14076 - RNA, 7249 nt, Homo sapiens
ugucggccgcguuccgaaugagcaccgccggaaguuucugccgcggcuuugcggggacgggggagugguagugggggcugcagcugccggacccaggugcggaagugcgagggcccagguggcugaaggggccguuaggaacauccaagcgguggggcacaggcagauccccgaccugaccuggaccacccuucuccucuuggcccgccccuucaacucgccuccgcuuaggucuggauuggccccgcccccugaccugagccugguccuucuucaggcacugacccuugaccuccgguggcucccccaucucucaggcgcgauggcuacgggcgcggauguacgggacauucuagaacucggggguccagaaggggaugcagccucugggaccaucagcaagaaggacauuaucaacccggacaagguagcaggggcaccugaaagcguugacuaggggaggguaggggagugaagauggggaggagugacaacgggcaagggaugggugcuacacuuacagugaguugggcgauaaaaggggugacauaacaggacagggaauaugugucauccuugaugggagggaggagaugggacaucgugggagauggugggaccaagaggguaugacaccucuaagagcugagaggaccaggcaagugugauuuuugcaagauauuguuggggagagaucaagacauuguaacagucugagaguuggugggauggggaggggacugcucugauuugggcguaggaugguguuccugggaguggguuucugugccuuuacagugugucaguuugccugucauugacccuguaggugcugcuuuguucagggauugagcuggacuaaagaauuuucaggaaagggucuagguugugguuccuuucugugguuuccuuccucagaaaaaauccaagaaguccucugagacacugacuuucaagaggcccgagggcaugcaccgggaagucuaugccuugcucuacucugacaagaagcaaguauuggagucccaagucccccagguuuuggccccugauucaccugccaugccccuaacuccuaguuuucucuaacaauuuucuccuccccagcaagggcuccugcuugcuuagcaggaugcaggaggaccugaagucuuuugcuccaggacaugacuuucuugcuauaggguaggguagaucagcucccugggacaaaaagcucuuuaacacaccuucugauucuaaccucgcaucucccuaaaccucccugccagggaugcacccccacugcuacccagugacacuggccagggauaccguacagugaaggccaaguugggcuccaagaaggugcggccuuggaaguggaugccauucaccaacccggcccgcaaggacggagcaauguucuuccacuggcgacgugcagcggaggagggcaaggacuaccccuuugccagguucaauaagguaagcuaccuucauucggacacaggccaagauugcccucccacuuugagccauuugugcgagcucuccagucuccuaggguugguucugggggcacgcuuaugcccaacugugauuacccacucaauccucguggcaaaugcaugcagaguaggacucugugggucuuuucugcccaagggauccuguucuuucccggaccugcucugguuuuucauggcuuuucuuggucuuucaaauguugcuguuccucagagcuguauccuaggugcucuagucuucuuguucucuacuuucuuaguaugaacccuguggcuucaguuacccucucuacaagucaccaauccagagcagugcuuccuucgcauccagucauuuacuaauaucucuuucucaaugccccacagguaccuuacaucagguagguacccugaacagagcucaucaucuucccucugucagucccaaaucuguuccccaucucagugaauggcacuaucuuccacccaguugcccaaaccagaaacuugggggaucguccuugacuuagucuucucccuuaguccucacaguauuuaaaucaacaacagaacaaagaagguaggggaaaacaaacaacaaacauguaaggaaauaaauuggagucuuucaaauaagagccgucaguaacacgaaaccaggauuugaauggauaugaaaugagauaaagagugaacuuguagguguaggggaguccuaccuuagguuggucagggagggucugagaacguggcauuugagcuggaugccagugauacaucuauuuauugaguccuguugauucuuuuuccauaauaaaucacaucucugacuauauucuucaucacuaugccagcccccuaguccaagcugaguuaccuguguagcucagcacagcacggccuucccagacucacccauucagugagaggcagagcuagauugggcuagguuuccuaguccauuacuuaagucauuguacaguguggccucacagcugcugcggccuggaauagccuagacuuagauccuaaaagccucauuuaccucuucucuaaccaaucuuugucccugggcuggagugucacuuguuauacccuauguaucaaacuucccacacgguaccaaaauuguuuuuucagcugcaguaugagcuuugagaggcuaggaucccugccugucauaugcagcacugugucuccagcauagguauugcagccccaugguaaauauuuguugaaugaaugaaaaaaugucuuccucacuugacuaugagcuacuugagaggacuggcugcacaguuccugaggauuuuuuuuuuuuccuucuuugagacagggucucuuucugucugccaggcuggagugcaguggugugaucucagcucauugcauccuccaccucuagggcucaagcgauccucccaccucacccuccugaguagcugggaccaccggcaugcaccaacaugccuggcuaauuuuuguguuuuuuuaagagacuggguuucaccauguuucccaggcuggucucaaacucuuaggcucaagugaucugcccaccucagccucccaaaguauugggauuacaggcgugagccaccgcacauggcccugaguuguugguuuguuuguuuuuuaguuaaauugaauuaaaaugcauaggagaaauauguaaccaaaccugggaaaccagagagacuucccagaggagaugaugccugagagcucgaaagguugagaaaguuaccuagguagaaggaauguggaaguggaaggcauuucaggcaagagcagaggucaagggggaagucugcuauguucuagaaacugcuagucauuuggcugcaguuuaggguucaugagggacaguggcugcaggaggaggccaggucauuuauuuguauguucauuaauugauuugguagacacugauacauacagugugcugaguccuaaaggugcgagaugaacuggacaacccuugcucuucaggaguuugugaauuaucuagaagaugcuuuaucuuagauggagagcuucugaggaguuuaauaagggauaguuggggguaaugauaagauauauauucuagaacacuaggacagugugucucaaaucaucuguggugaaggacauuuuucuauuuuauuucuaaaccaucagagacugauaaagauaauaaaauuauaaagacaaaauacaaguccauguuucuucauauuagauucaacagcauacaauugcuguaaaauuguuacguaaguuuuucaguguguacucucaguuuccauucucaucauagaccagggguaaguguaaacagcacugguuugcagacuauccuuuaaguagcacuguucaaagagaucacgucuuagcugcagauggagaauugauuggaagcggauugaaugugggcagagaucaguagcgaggcuauuucucugauccaggcaugugacaguggguaggccgacggagaaguggcaauggagacagaaauuuuggagguaaaagccacagauuuggugaaggggaggagucaaggggaaagauaggaauuaagaugccucccagguuucuggcuugagcagcuggguugggugauggugauauugacugaaaucuggacuggagaagauaauguuugagagagggccaugaguucaguacugagcuaaguuugagguuccuuggggccuccaguaggagauguccaaaaggcgaccaguuuuggagcugguuguggucuuuaacugagaagagagacuucccugauguagucuagcacugacuccuuccuugggucucugacagacucagcucgugguagugcuauuugucucugggggaggucuguggaagaagggaggaaggggcauuggcagggcugcguauguugguaguaggauucaggcccagcuucuguagagaugccugaccuuggcaaacucugggggaguggcaagucccacugugcccacuggguggcaguagugcuucagaugaguuguauggacuagggguugcugggccuuucuccagguaauuagccaucuguccuacuccagaguugaccuuuggacuccacagaagcacuuacaugugggccccucaccuuaacuaugggggcaggagugugugucccaugacugaggcucuggagcuggagacagugaaguugauccuggaauaaaucagaggcaggcuacagucccaaacccugcuaggaccucuagucaagcagacaaguucuuuccucacuccaugcugcaggggcacaggcccagggucuggcaacaaacaggagcagcuguggucacuggggccuggagccugcuggacaugacaucaugcgggcaugccccuacugugucccucugugcuaguagacugugcaggugccuguguacucggagcaggaguaccagcuuuaucuccacgaugaugcuuggacuaaggcagaaacugaccaccucuuugaccucagccgccgcuuugaccugcguuuuguuguuauccaugaccgguaugaccaccagcaguucaaggugagccauuguguauuugcaugggugcccagcuucugggucuagcaggcccuacuuuuaugccaucucuuccacaugccccugaauguucauuccucuacccugucuugcuccucagaagcguucuguggaagaccugaaggagcgguacuaccacaucugugcuaagcuugccaacgugcgggcugugccaggcacagaccuuaagauaccaguauuugaugcugggcacgaacgacggcggaaggaacagcuugagcgucucuacaaccggaccccagagcagguaagcccaaggccacauaccuguccuccaugccccaaaccccuugcucauugucuccauccuccauccccucaacucccacucccaggucccccugccucccacugauaccuuauuaacugccccaagcccauuccuacuucucaugggccauccccccugcuuuucauagcccuucaccucccucaugauccauuacuucucagauucccucacagacagcccagcacccugucaccuccgugucuacccucacuccuagaagugcccucacacacuucgcaucccucacuuucccagguggcagaggaggaguaccugcuacaggagcugcgcaagauugaggcccggaagaaggagcgggagaaacgcagccaggaccugcagaagcugaucacagcggcagacaccacugcagagcagcggcgcacggaacgcaaggcccccaaaaagaagcuaccccagaaaaaggaggcugagaagccggugcggagguuccgccagccuagcucaggguggaagggucaccuggcacaaggccucaccccgaguggaggguucugagaguacccagugcugauggggugcuaggacuaacccugggcccucucccugugacaccuuggucuccauaaugccuucucccccaggcuguuccugagacugcaggcaucaaguuuccagacuucaagucugcaggugucacgcugcggagccaacggguacgugagucaccuccuuuagcaaguuuggguccugggcucugcucugggcuccaugugucccaaacgcugcaggcagguggggauggagcaguaggagagauugcugcagacagagguggccuuggcaggaucucagugauguggccaggcuaaggucauagcagcuuucacuauauucagcuuccuggcuauuuccuuuucuggcccauaguuaaccuccauguguuaccgucucucuuccaccaucuuucccucugccuuuuguccccuucauccuaagccucuuguggcugggacaggcuuagcuugccagcuuucauugcagaugaagcugccaagcucugugggacagaagaagaucaaggcccuggaacagaugcugcuggagcuuggugugggugaguguggggacugggccccauaggguguacccacccgaggcuguggauauagguugggcagggggaggggaguucacauugcuggcccucuaccacaccugggcucugcccgugcugccugccgccugccugcagagcugagcccgacaccuacggaggagcuggugcacauguucaaugagcugcgaagcgaccuggugcugcucuacgagcucaagcaggccugugccaacugcgaguaugagcugcagaugcugcggcaccgucaugaggcacuggcccgggcuggugugcuagggggcccugccacaccagcaucaggcccaggcccggccucugcugagccggcagugacugaacccggacuugguccugaccccaaggacaccaucauugauguggugggcgcaccccucacgcccaauucgguaagagucuggacaggcugggaggcacgccugggcccugcgagugagcacaugcacauggguguaggggcuccucucccucuagugccugcagcaggaacgaucaucacuucugugcgagucugagacugaggguaggaguggguugaccagugggcguccuugucccugagcgugugaagcacaugcacuaagccugacucaggccuuggggggucacugaccucaaugccuucuguguauccucagagaaagcgacgggagucggccuccagcucaucuuccgugaagaaagccaagaagccgugagaggccccacggggugugggcgacgcuguuauguaaauagagcugcugaguuggaccaggcu

SEQ ID NO: 14077 - RNA, 1397 nt, Homo sapiens
cgccggcccuggccagcucgcgcucccuuccugcguagcccuccgucaguucucucgugaguccauggucuccaguucaguuaucagcccugcuuucccagcuugcgacuugcggacaggcguccugggcacgaagagacuggacucggauucgucgcccgaaucuguccucugagaaguucaagguacuucguacaauuucagccacccaggccaguguccuccagcaaugguucccguccagaagaagcugguaauugucggugacagagucuguggcaagacaugcuugcucauugucuucagcaaggaccaguucccagaggggugagcacccucaggguuucagaacuauguggcccauaucgagguggaugggaaaguguagagcugacuuugugggacacagccaggcaggaagauuaggaucgccugaggccccucuuuuacucggacacugauguuauguguucuccguugacaacccugagaguuuagaaaacaucccagagaaauggagcccagaagucaagcauuucugucccaacgugcccaccagccugguugggaacaagaaggaucuucggaaugaugugcacacaaggugggagcuagccaggaugaagcagaagagggugagacucgaagagggcagagauauggucaagggaauuggcucuuugggguacaugaaguguucagcaaagaccaaagauggagugagagagguuuuugaaguggcugcgaaagcuacucugcaagccagaugugggaagaaaaacucugggugccuugucuugugaaacagugcuuaagaggugaauuuugaagugcuguugguuagucuuaguggaugaacacuggccuuuaucacuuauauacaguuuaccuaagauuacaaauuuaaggcaugccaucuuguuaccaguauuuagaaaccaacccugauucuuaaugaugucaaauccgucaggccuaccaggauccuuuuaccacuacucuuaacaacccuccucuacacuucugccugacgcaccacggcaaauucaaagaauuucuuaacuucuugcuucugucuugaaagagaaacagcugguaacuuugcaaauuaggcugcaacuacuuuauaacuaacguucccugccuaucaucugucaacagcaagguacucuggugagacacaacuucagugcuuuacuccuuaacaggcuucauuggcauagcucugggacaggcaucuggucuuuugaaaauggguucuacaaggaaggcccaaguccaugcagcuguggcacaguuacaguucugugguuucauguuaguuaccuuagaguuacuguguaauuagugccacuuaauguacauuaccaaaauaaauauaucuaccccagacugga

SEQ ID NO: 14078 - RNA, 496 nt, Homo sapiens
cauggucaaccccaccguguucuucgacauugccgucgacggcgagcccuugggccgcgucuccuuugagcuguuugcagacaaggucccaaagacagcagaaaauuuucgugcucugagcacuggagagaaaggauuugguuauaaggguuccugcuuucacagaauuauuccaggguuuaugugucaggguggugacuucacacgccauaauggcacugguggcaaguccaucuauggggagaaauuugaagaugagaacuucauccuaaagcauacagguccuggcaucuuguccauggcaaaugcuggacccaacacaaauggaucccaguuuuucaucugcacugccaagacugagugguuggauggcaagcaugugguguuuggcaaagugaaagaaggcaugaauauuguggaggccauggagcgcuuuggguccaggaauggcaagaccagcaagaagaucaccauugcugacuguggacaacucgaa

SEQ ID NO: 14079 - RNA, 2616 nt, Homo sapiens
gggagcgcgggaggaaaugggucaggcucguccaaagggugggcuuagaggucggaccggcgagcgggugcagaccguggagucccuuagcggggaguggggauugcauuggagcgcgaacuccccaggaaggggaccuggagguugggcggacucaggcugcggggcuagggauuugucaacucuuuaauuggaccaagauucaaggucggccagcagagagggggcaggacccuuaaaggcgugggcuggagguggcuggggcuucugggguaacaggaaacagggucagggaaggagaaaacgagauuggauggggugggaggagcugcccugggcccugggaacaaggaucagaguagagguuucugggaggggcugcugcuagaaggacaggaccaucacuggaggcagagaccacugccuaggcuccaggccucacaaggacggagaugauggugcccgacuguacaaccagguaaguagaugcugucagacaauucgggcaugguggucagucagagcccugagcaaacgggccuagaaggacuacaggcacaaacacacccaggggccccuaucugcacacucccucauccccaaacaagucuguuuggggguuagaguccacccagcacccgugccuccccaccuaggagcaagcucugugcagaucagaagugugcagucagaaagcugacaagggauuggcaugaggcugaggcguacaggccucuuuacccuuccucugugaacggugacgcaagagggcaacagaagcugcacugacccagacaaauaccaaguuuauuucacaaacacuaggaagauggguugaggguggaggugggggacacaggugcgcagcugcacagagucagcagcagcagccugcuccccgcacugaggacucggccuggacugcagugccuccaaaucaacacgcagcaagaggggagugcagggagggcccugaacaccaagccucugaaaggcuaagggacacagcuccagcugucccaggaaaaccagcaauaaauaaaagugaggcacggccccacccacacauaucaucuagucacccaucuucacucuggaggucugcaaaaaaagaacaggagaaaucaggcagggacagaggaauagguaaggcagugacaaaugauagaagaugacaucuagcacaugguuggauggacagaccacaagagauauaugacuaaccaggauggacacacugugacagacaaggcagacagggacagacaaccacagaguuacgcugugggacagacggagagaaguggcauauggauaaagcuagucacuaagaaucaacucagucaagcacccacagucacacucagacccucaggcugauccuuagucacaaacucacacacugucagacagacuagacacacacaauuuagacaaugguguccuacugacaggcaugugagagggagauacacauagcuccgagagacagucaaacacaccaugacagacugauauagacagacaaaauuccauucuagucuagaucacaaauacagacuggagacaugaaaagcauggcagauaaaaugagagaacagaaagagggaggacuaagugcuauacagauacaacgcauuagaaaggggggaaaaagaacagggcuguugucagugacaccaaaucagagacaaaaauagagagccccuguaggagaaaaccagaagauggaaaugaggagguggaagcuguuugggggaaucuauaguuauagguagagaaggagagcacuucagcuucuccagaaggaggguaaggcuagguuggggacaaggacacagaggcuucccaaggggauucaucaccugaagaauugcgacgaugaccccaaagaggccaauggcgcugccaaagaucuccacgaugagaaucuuuacaaagaggcugggguucugagcaucggccagggcagccccacugcccacgaugcccacgcagacuccacagaagagguuagacaggccuacggugaggccagccccaaacauggaguagccugggaggauagagaggggugcagugaggcuaagccaggaaugggggagauaugggcuaauggggccaaucaccauccccacucugcaaagcagaaaaaguaggugagagaauaucaaaaugauggcccaagcugggaugggggagaguggaagcaggcaugaagucccagcauuuugcauucauacgcccauccacccaccugcaugguaguuccgauggccgauggccuuggggucuguggcacugaaaggcugagggaagaagaaaaguaaucagaaaccauccugaugcaccccauccaaucucuaaggaauguguagaacacacuggaauggauucccgccaccacccuggccuuccauaccucagccauguugcuaaugacaauugccaugaugaugccguagauggccacagccucacagaagaugaugcugguagugguagagauuagggguaaggaguggaaaggagaaagaaaugagaaagaaaccguccuuccugcccaguaaguccccagcaaucuuuccccuauaacaucccaucccacaagguggc

SEQ ID NO: 14080 - RNA, 2616 nt, Homo sapiens
gccaccuugugggaugggauguuauaggggaaagauugcuggggacuuacugggcaggaaggacgguuucuuucucauuucuuucuccuuuccacuccuuaccccuaaucucuaccacuaccagcaucaucuucugugaggcuguggccaucuacggcaucaucauggcaauugucauuagcaacauggcugagguauggaaggccagggugguggcgggaauccauuccaguguguucuacacauuccuuagagauuggauggggugcaucaggaugguuucugauuacuuuucuucuucccucagccuuucagugccacagaccccaaggccaucggccaucggaacuaccaugcagguggguggaugggcguaugaaugcaaaaugcugggacuucaugccugcuuccacucucccccaucccagcuugggccaucauuuugauauucucucaccuacuuuuucugcuuugcagaguggggauggugauuggccccauuagcccauaucucccccauuccuggcuuagccucacugcaccccucucuauccucccaggcuacuccauguuuggggcuggccucaccguaggccugucuaaccucuucuguggagucugcgugggcaucgugggcaguggggcugcccuggccgaugcucagaaccccagccucuuuguaaagauucucaucguggagaucuuuggcagcgccauuggccucuuuggggucaucgucgcaauucuucaggugaugaauccccuugggaagccucuguguccuuguccccaaccuagccuuacccuccuucuggagaagcugaagugcucuccuucucuaccuauaacuauagauucccccaaacagcuuccaccuccucauuuccaucuucugguuuucuccuacaggggcucucuauuuuugucucugauuuggugucacugacaacagcccuguucuuuuuccccccuuucuaaugcguuguaucuguauagcacuuaguccucccucuuucuguucucucauuuuaucugccaugcuuuucaugucuccagucuguauuugugaucuagacuagaauggaauuuugucugucuauaucagucugucaugguguguuugacugucucucggagcuauguguaucucccucucacaugccugucaguaggacaccauugucuaaauugugugugucuagucugucugacagugugugaguuugugacuaaggaucagccugagggucugagugugacugugggugcuugacugaguugauucuuagugacuagcuuuauccauaugccacuucucuccgucugucccacagcguaacucugugguugucugucccugucugccuugucugucacaguguguccauccugguuagucauauaucucuuguggucuguccauccaaccaugugcuagaugucaucuucuaucauuugucacugccuuaccuauuccucugucccugccugauuucuccuguucuuuuuuugcagaccuccagagugaagaugggugacuagaugauauguguggguggggccgugccucacuuuuauuuauugcugguuuuccugggacagcuggagcugugucccuuagccuuucagaggcuugguguucagggcccucccugcacuccccucuugcugcguguugauuuggaggcacugcaguccaggccgaguccucagugcggggagcaggcugcugcugcugacucugugcagcugcgcaccugugucccccaccuccacccucaacccaucuuccuaguguuugugaaauaaacuugguauuugucugggucagugcagcuucuguugcccucuugcgucaccguucacagaggaaggguaaagaggccuguacgccucagccucaugccaaucccuugucagcuuucugacugcacacuucugaucugcacagagcuugcuccuagguggggaggcacgggugcuggguggacucuaacccccaaacagacuuguuuggggaugagggagugugcagauaggggccccuggguguguuugugccuguaguccuucuaggcccguuugcucagggcucugacugaccaccaugcccgaauugucugacagcaucuacuuaccugguuguacagucgggcaccaucaucuccguccuugugaggccuggagccuaggcaguggucucugccuccagugaugguccuguccuucuagcagcagccccucccagaaaccucuacucugauccuuguucccagggcccagggcagcuccucccaccccauccaaucucguuuucuccuucccugacccuguuuccuguuaccccagaagccccagccaccuccagcccacgccuuuaaggguccugcccccucucugcuggccgaccuugaaucuugguccaauuaaagaguugacaaaucccuagccccgcagccugaguccgcccaaccuccagguccccuuccuggggaguucgcgcuccaaugcaauccccacuccccgcuaagggacuccacggucugcacccgcucgccgguccgaccucuaagcccacccuuuggacgagccugacccauuuccucccgcgcuccc

SEQ ID NO: 14081 - RNA, 3393 nt, Homo sapiens
acugacccagacaaauaccaaguuuauuucacaaacacuaggaagauggguugaggguggaggugggggacacaggugcgcagcugcacagagucagcagcagcagccugcuccccgcacugaggacucggccuggacugcagugccuccaaaucaacacgcagcaagaggggagugcagggagggcccugaacaccaagccucugaaaggcuaagggacacagcuccagcugucccaggaaaaccagcaauaaauaaaagugaggcacggccccacccacacauaucaucuagucacccaucuucacucuggaggucugcaaaaaaagaacaggagaaaucaggcagggacagaggaauagguaaggcagugacaaaugauagaagaugacaucuagcacaugguuggauggacagaccacaagagauauaugacuaaccaggauggacacacugugacagacaaggcagacagggacagacaaccacagaguuacgcugugggacagacggagagaaguggcauauggauaaagcuagucacuaagaaucaacucagucaagcacccacagucacacucagacccucaggcugauccuuagucacaaacucacacacugucagacagacuagacacacacaauuuagacaaugguguccuacugacaggcaugugagagggagauacacauagcuccgagagacagucaaacacaccaugacagacugauauagacagacaaaauuccauucuagucuagaucacaaauacagacuggagacaugaaaagcauggcagauaaaaugagagaacagaaagagggaggacuaagugcuauacagauacaacgcauuagaaaggggggaaaaagaacagggcuguugucagugacaccaaaucagagacaaaaauagagagccccuguaggagaaaaccagaagauggaaaugaggagguggaagcuguuugggggaaucuauaguuauagguagagaaggagagcacuucagcuucuccagaaggaggguaaggcuagguuggggacaaggacacagaggcuucccaaggggauucaucaccugaagaauugcgacgaugaccccaaagaggccaauggcgcugccaaagaucuccacgaugagaaucuuuacaaagaggcugggguucugagcaucggccagggcagccccacugcccacgaugcccacgcagacuccacagaagagguuagacaggccuacggugaggccagccccaaacauggaguagccugggaggauagagaggggugcagugaggcuaagccaggaaugggggagauaugggcuaauggggccaaucaccauccccacucugcaaagcagaaaaaguaggugagagaauaucaaaaugauggcccaagcugggaugggggagaguggaagcaggcaugaagucccagcauuuugcauucauacgcccauccacccaccugcaugguaguuccgauggccgauggccuuggggucuguggcacugaaaggcugagggaagaagaaaaguaaucagaaaccauccugaugcaccccauccaaucucuaaggaauguguagaacacacuggaauggauucccgccaccacccuggccuuccauaccucagccauguugcuaaugacaauugccaugaugaugccguagauggccacagccucacagaagaugaugcugguagugguagagauuagggguaaggaguggaaaggagaaagaaaugagaaagaaaccguccuuccugcccaguaaguccccagcaaucuuuccccuauaacaucccaucccacaagguggcuugucagaaacaguaugucagaucaaacacacaggcagcgccaacacagcugguucugacaaaaguccaaggacccugacacuuaccugaccagguucuuggucuugauccugggggccuucacuccuccaccaaugauggaggagccgguaauauagaugccccugguggaaggauaaaaaacugaugagcagagcccaagcugucacugcccucagcaugccuaagaccccagugacaccaccugccaugacucagccccugcccccagucccaccaccccaauacucaccaggcugccccaaccacagacagggagauagcuaggccaaugcccagguuggaccacaugaagggcgaagucuccgucaggaaccuguuguggaagcagagaagaaagcaguucagcucuagcagggaagcggagcacaaaaucuuaaccccucaaacccccuucaaccccaccaccaguucuacaggcaacaacugaccgcguauuucccaaagguccaugucccaggcaggcaguggugugggggagggacucagaccagagaaaagaagagaggcugcagggaagaagcuucaaggggaauccucccccugcccucccuuaccaugccacaucaaagcggaagcccaaaucaaaaaugguguagcagacuccugcagcagugagggagaaaaaggggguuacgggcugcucgguagagagaaguucuucaaccuaaaguagcugccgagcugaagggccaccucccugaaggggcguccucaggcugcccccaggugacaguacagcuguguagacagauuccucugcuuaggccuccauuuucugccauucccucgcuaaaaccaccucccagaccaagcaccugcgcaggcagggucgccacccgcaagcccgaauccgaggcgggaccgagggagcaagcgcuccagccagaucccgccggcccaguccguuccgcuguuuacccaacaagcugugggugggggagggcaaagcgacugggaaaagaggaaccggagcagccggcuugugaccgagcgggccggucaggagcaagaaaggggggacagcagugagacgugggagcgaggggagacagcgauaguggcaggacgggggagugcugcccucgcggccccuacccgcccgcaccccuccucaagcagcuggaaauccgggucuccuuugucggagucagaggcccucgcaggcgcaaguccccagagccucgggugcagagcgcgcggggggccaguauuccccgcaggccacuuccccgccgaguuccgacccggccagcucggccgcgaugcugcucccgcccgccaggacccggccucacccacggccagcgcgcaggcccagaaggccacgaagaccccggaguagagcagugcuagccccgucauggcggcgacggcggcgggggucggaacggcggggccggagcuacaaacgcgucccagcguccaccguccgucccgcagucuguccgcccgccccgcagcgucaccuaacucgcccacgugaugcgccgguaccacg

SEQ ID NO: 14082 - RNA, 3393 nt, Homo sapiens
cgugguaccggcgcaucacgugggcgaguuaggugacgcugcggggcgggcggacagacugcgggacggacgguggacgcugggacgcguuuguagcuccggccccgccguuccgacccccgccgccgucgccgccaugacggggcuagcacugcucuacuccggggucuucguggccuucugggccugcgcgcuggccgugggugaggccggguccuggcgggcgggagcagcaucgcggccgagcuggccgggucggaacucggcggggaaguggccugcggggaauacuggccccccgcgcgcucugcacccgaggcucuggggacuugcgccugcgagggccucugacuccgacaaaggagacccggauuuccagcugcuugaggaggggugcgggcggguaggggccgcgagggcagcacucccccguccugccacuaucgcugucuccccucgcucccacgucucacugcuguccccccuuucuugcuccugaccggcccgcucggucacaagccggcugcuccgguuccucuuuucccagucgcuuugcccucccccacccacagcuuguuggguaaacagcggaacggacugggccggcgggaucuggcuggagcgcuugcucccucggucccgccucggauucgggcuugcggguggcgacccugccugcgcaggugcuuggucugggaggugguuuuagcgagggaauggcagaaaauggaggccuaagcagaggaaucugucuacacagcuguacugucaccugggggcagccugaggacgccccuucagggagguggcccuucagcucggcagcuacuuuagguugaagaacuucucucuaccgagcagcccguaacccccuuuuucucccucacugcugcaggagucugcuacaccauuuuugauuugggcuuccgcuuugauguggcaugguaagggagggcagggggaggauuccccuugaagcuucuucccugcagccucucuucuuuucucuggucugagucccucccccacaccacugccugccugggacauggaccuuugggaaauacgcggucaguuguugccuguagaacugguggugggguugaaggggguuugagggguuaagauuuugugcuccgcuucccugcuagagcugaacugcuuucuucucugcuuccacaacagguuccugacggagacuucgcccuucaugugguccaaccugggcauuggccuagcuaucucccugucugugguuggggcagccuggugaguauugggguggugggacugggggcaggggcugagucauggcagguggugucacuggggucuuaggcaugcugagggcagugacagcuugggcucugcucaucaguuuuuuauccuuccaccaggggcaucuauauuaccggcuccuccaucauugguggaggagugaaggcccccaggaucaagaccaagaaccuggucagguaagugucaggguccuuggacuuuugucagaaccagcuguguuggcgcugccuguguguuugaucugacauacuguuucugacaagccaccuugugggaugggauguuauaggggaaagauugcuggggacuuacugggcaggaaggacgguuucuuucucauuucuuucuccuuuccacuccuuaccccuaaucucuaccacuaccagcaucaucuucugugaggcuguggccaucuacggcaucaucauggcaauugucauuagcaacauggcugagguauggaaggccagggugguggcgggaauccauuccaguguguucuacacauuccuuagagauuggauggggugcaucaggaugguuucugauuacuuuucuucuucccucagccuuucagugccacagaccccaaggccaucggccaucggaacuaccaugcagguggguggaugggcguaugaaugcaaaaugcugggacuucaugccugcuuccacucucccccaucccagcuugggccaucauuuugauauucucucaccuacuuuuucugcuuugcagaguggggauggugauuggccccauuagcccauaucucccccauuccuggcuuagccucacugcaccccucucuauccucccaggcuacuccauguuuggggcuggccucaccguaggccugucuaaccucuucuguggagucugcgugggcaucgugggcaguggggcugcccuggccgaugcucagaaccccagccucuuuguaaagauucucaucguggagaucuuuggcagcgccauuggccucuuuggggucaucgucgcaauucuucaggugaugaauccccuugggaagccucuguguccuuguccccaaccuagccuuacccuccuucuggagaagcugaagugcucuccuucucuaccuauaacuauagauucccccaaacagcuuccaccuccucauuuccaucuucugguuuucuccuacaggggcucucuauuuuugucucugauuuggugucacugacaacagcccuguucuuuuuccccccuuucuaaugcguuguaucuguauagcacuuaguccucccucuuucuguucucucauuuuaucugccaugcuuuucaugucuccagucuguauuugugaucuagacuagaauggaauuuugucugucuauaucagucugucaugguguguuugacugucucucggagcuauguguaucucccucucacaugccugucaguaggacaccauugucuaaauugugugugucuagucugucugacagugugugaguuugugacuaaggaucagccugagggucugagugugacugugggugcuugacugaguugauucuuagugacuagcuuuauccauaugccacuucucuccgucugucccacagcguaacucugugguugucugucccugucugccuugucugucacaguguguccauccugguuagucauauaucucuuguggucuguccauccaaccaugugcuagaugucaucuucuaucauuugucacugccuuaccuauuccucugucccugccugauuucuccuguucuuuuuuugcagaccuccagagugaagaugggugacuagaugauauguguggguggggccgugccucacuuuuauuuauugcugguuuuccugggacagcuggagcugugucccuuagccuuucagaggcuugguguucagggcccucccugcacuccccucuugcugcguguugauuuggaggcacugcaguccaggccgaguccucagugcggggagcaggcugcugcugcugacucugugcagcugcgcaccugugucccccaccuccacccucaacccaucuuccuaguguuugugaaauaaacuugguauuugucugggucagu

SEQ ID NO: 14083 - RNA, 55410 nt, Homo sapiens
ugaauugguugacucuguacggcugcgcagaugccgacuuuagaggaggcggaguuucggccuucgccugcuggaaaagcaguaggaucggccaguggcgacagcaggagcugagccuaagcccuggcggggcuuugggcuguaggugagaacuauaggguuuuggaauucucgaggaucauugccgcuguagcagugaccgugaguuuuggugggggaggggcggugggggugggucuuccagcggugagugaucggcauguuucucggccaauaggagaaggagcuuccagaauggguucugagauugguccuuuccaaucuucaaggccaauggaccucgggagaggggggcgggucaucugggccuuauuuucuucuuccugcggccgagcuucacucgccaaggcggcggggccgggaggggccgaaccugugcgcggugagguucggggacgguggggagcagggugcgcugccuuuggagugaugcucgcgggagcggcugcgagggaagggugcgggaguccgaggggguuguuagcaacagcuagcuuuauugaguggguaaguaccgggccuagugcuuagugcuucgcuugcaucaucugagcuaaucacagcgacccugcagggcaggggguugggauccccauuuuacagguggagaaacugagacucaagucagcucacacagccaaggucacauagcuaauaaacggcagagaccggaucuguauucagaguuuugacuucggagccgguguucuugaaucucuaggcuuuguuacugauugggagggaaggugucaugaaacgggagcuuuccccagggaacagauuugggggaagggaauccuaggguugaagaagggaugaacaauugaggugagggugaggaaaucaguuuuucaacaguuaccgauugccuacucugugccaugcauuguucuaggcauacaaagaugaauaggggcagaggcugaugaagcccauuagggccccuuugaaggcccggggaagggccccaacauuguauucacaugauuguauguuuuuauaaaaugugcaaaaguaagauauuuuggauucauuuuucuuuuuaagagggucuucaaaauuaaauaaacuucggguuucuccacacuuggagcugcccuugcagaggacuuaguccagguggagaugaguauguaagcaguauagagcaguggaaggugcacuuaagagugggcugugggcaaauuuccugguauguaaaacagggagaacaguauaccugccaugcaaaguuucugccagguucaugaaaagcgccuguuuagaaacacgccuuauuuuugauaggaagccuaggagauacggguaacuggauuugccuucucuccuaccuuacacaguugugcuccguguucugcucccaggccuguaacuagauuucugguggauuggaggcgcuuuucuccuuucugagcucuccaacucucaaagagagucuuggagcugaaccgccauaccuuugggccccagauaggggguacggaacugcuggacccucagugaggaggguggguaaaggaaaggacauacugguguuccuucuagaauggccuauuuucauugauaugcuuugucuuuuuucaguugagguggucuauugcguuaccgagcuguggggaugcacccacuuagcugaaguucucaucuaaaaacaaaguauuuauuuugcuuucuccaaucaguuaugaaguuuuccguguauugccaguuuaaauuuuguccuuugaguucuggguacagugcaacugaacuugucuguagcuugauuucauuaaguacugcugaaacugcaucuuaguuucaacagaacaguuucacuuuaggguuuuaaaauuauguuacuaauaucaaagggcuuuuaaaucauguuacuaauaucaaaguacuuuugaacccuuaaguuuuguuaucuuguagccacguaacuuuuauuagguaucugguuuagcugugcccuagggaggagccuuggccucccaaagugcugggauuacaaggcguaagccaccgcacccagccauggguggcuuucaaguuguaguguauucuguuuaauacucugaaaagugauuagcaagguguuaauaagggaguagcuugaaaggauaaggguaaaauaugggcauuuuagcuguacuauuaggaccaacaacuaaauaauuaguuuccuuuuuuuagcugaaacaauuuucuuuuuuuuuucuuucaagaacaauccuauugcaguaacaaugucucuguugaaauaagguuugaauccaugcaguuuugauacaucagguucuuuuuaaacagaaccuuuucgaucuguauuucuaguuuauuuaaauaacuuuuuguuguuuauuuaaaaaaaauuuuuuuugagacagggucucacuauguugcccaggcuggucucaaacuccuuaacucaagcgaucugcccaccucagucucccaaagugcugggauuacaggcuugagccaccacacccccacccuaaauuacuuuucuuucuuucuuucuuucuuuuuuuuuuuuuuuuuuugagacggaguuucgcucuuguugcccagucuggagugcgauggcgcaaucuuggcucacugcaaccuuuagccucccggguucaagugauucuccugccucagccucccgaguagcuaggauugcaggugcccgccaccaugcccagcuaauuuuuuguauuuuuaguagagacaggguuucacuguguuggccaggcuggucucaaacuuaugaccucaggcgaugcacccgcuuuggccucccaaagugcugggauuacaggcgugagccaccgugcccggccccuaaauaacuuuucuagagguagauuccaggugugaagucuuaacugugucuuuugaauuucuauauuaucuuuuacuguuuucagaguugauguuuccagcacuuaauuuuaauuuuuauauuauuuuauacucuuaauguguuucuucagauuccugucugacuaaagggaccucaaaaaggagggaaaauggcuucugagucugaaacucugaaucccagugcuaggauaaugaccuuuuauccaacuauggaagaguuccgaaacuucaguagauacauugccuacauugaaucccaaggagcucaucgggcagggcuagccaagguaaggagcugggauuguucaaaugguuuuguuaccuagggcagagcaguaagauuuuuuuccuacauuugggccggaacuguguuuuacugaaaguuggguggggugaugacuuuagugaaugcgguucuauuugcaaguuaauucccguuguuaacaucagaagcaucucugcuuuuagguaggaagagagcuacuuggaaucuucagaaagggggagguaaagagcuagugucuccaggccuggcugcuguugugccucagcccucuugguggagcugggugcugugguguuauugaacugccagugagugcuuaugccaucugacuucucuugcucucauuucagucucauccagcacucuaguagcaauuuggcuucccauguggacuuucuucaaggggagagaaugcacuggccagccaacaugaguauucugguccuuguaauuugaaauugguuucugguuuguacuucuuucuccugugaguuggauucguuauuuuuccugagucaaaucagcuuuucauauauucugucacaaucagguugagugcuggaagcugaaagaacugcauuucuggagagauccucaggaaacugagaggcagggaccucagucuaagccaggaggaaauuuuuuacaccauuuuauguuguuugaauucccuaccauaugugcuuguuacauuuucaauaugaaaagagaaagcaagaacauuggcuacaaagcugaggaccagucuuggacccuggugccuccagagacuugagacgaccacauccucuuucuuaucugcagauacggcuacugcuggguuaauaacagcaggcgggaauagcagggccugcagugcaguuuuucauagcacauugcuuuuuuugguuguacuuuauuagauuuaaaguuaccaaaaaaaugucgguuauuacaaguuaaauauuucaaacgcagauaaagaaaaggcugaucuucauccaccuucuccagugccgucuccuuaagugguauuagcucccuccacaccuuuuucucugcucauacaaacauacacacauauaaaauaguguuauuuguuuuguuuuuaaaagagaauggcaucaugccauauacauuccuguguugguucguucauucuuuuuucuuuuuuuuuuucuuuuuuccuuuuuaacaacauauauuccucccucuaggucaauuauggauucaacucauucuucuuuuuucucaugucgacugucuuguuaauuuauuacuauuggaauggguaauuugauuaugugaguaaaaacagaaugcuauuggaagguagcuaauguagagucuugcucccuuuccguauuuucuuauauguccuuucaguguugccuuaugcagaugcuugugaguguguguguguguguguguguguguguguguguguguuguuuucucccuuguuacauaaaguaaaacaauacucucuaauuaaaaaaaaaaaagcuguauaguauuccauaaagcagaucuaucuuacuuaacuauucaagauuagauuuuuuuuguuuuuuuuugagauggaguuucgcucuuguuaccccagcuggagugcaauggcgcaaucuuggcucacugcaaccucugccuccggguucaagcgauucuccugcaucagccccccaaauagccgggauuauaguugagugccaccacaccaggcuaauuuuuguguuuuuaguagagaugggguuucaccauguuggccaagcugaucucaaacucugaccucaggugauccaccugccucggccucccaaagugcugggauuaccggcaugagccacugugcccggccucaagauuagauuuuuaagaauguuaugcuucuuuguaauuaaacuguaaucuagugugugaaaaaaggaaauucuguacaaguauagaguugaccaaaucaaguaaaguuguguuugugauuuuuuuaaagagagcccugggcuaggagauugagagagaaucaagucuuuaaucuccuuucuugguguccaaauaagauacugaagcugggaacaaguauuacuuaccuuagguugcugcaauuaggcagcugguugguggcaaaaguggaucaggguuagcaugccugugacuuacuguguuuuggugaauguggguaaaucaaaguaacugucuaguaaaauugacuguuagguuggcugguaacuacaugcuuccuggacucugacuggcuugccagguuucucaucugucuuuuuguuucuuguguucccuucagguuguuccuccaaaagaguggaagccacgagcauccuaugaugacauugaugauuuggucauuccugcccccauucaacagcuggugacggggcagucuggccucuuuacucaguacaacauacagaagaaagccaugacuguucgagaguuccgcaagauagccaauagcgauaagugaguggaaacccuuucuuaccugacauagcaccuaggacccuggugucucauccuccuagcaucuccaggacugcugcuguccugaugaacagugucuucagcaggauggcucuguucuagcugucucccuuucugcuuuuuuuauggaagcauucccuccucucaggacugugucccagucuaaaccuguuccuguucuuauaacaacaaaucccauuguuuuuccaucagaaguagaaucauuuucugacucuaaaguugcaaggagaaaguuggauguggugcacaaggagcuuuugcuggguauuaucaaccaccugcucaucaaaagugcuuuaguuccacuuccucucucucgggaugcucuguguuuaauugugcuggaauuucucacugcccauccagccugcuagcucauuucuguuuugacauuaacagugugaguaaaccaccaagcugguugcuauuuucugucacuccuucuuucucuguacauuccugucucuuuuagagauaucuuucuuuguguaggccuguuuucaguucuucucugcuguugguuuuuuuuuuuuuuuuuuuuuuuuuugagauggugucucacuuuauugcccaggcuggagugcaguggagugaucuuggcucacugcaaccucugucucccagguucacgugauucuccugccucagccucccaaguagcugggacuacaggcacgcgccaccaugcuuggcuauuuuuuguauuuucaguagagacaggguuucgccacauuggccaggcuggucuugaacuccugaccucaagugauccuccugccuuggccucccaaagugcugggauuacaggcaagagccaccacuccuggcccuucuccgcuguuuuuaauguuuaguucucauuuuuccugagauucacagagaauaaauuuuguguuuccuuguucagcucugacuacuccaucuuuuuuuuuuuuugagguggagucucgcucguuccccaggcuggagugcaauggugcagucucggcucacugcaaccuccaccucccggguucaagcaauucuccugucucagccucccgaguagcugggauuacauacaggcgccugccaccacgccuggcuaauuuuuguauuuuuaguagagacgggguuucaccgucucuacugucacccaaguuggaguguaguggugcaaucauggcuuacugcagccucgacugcccaggcucaaaaugauccuccuugcucagccucccaaguaacuggagguauagauaggcaugugcuaccgcgcucagcuaauauuuuuuauuauuugcugcccaguuuggucuugaacuccugggcucaagcgauccuccugccucagccucccaaagugcugggauuauaggcaugagccacugcauccggcugacaccuuaacuccuuuuauuuauuuuuuuuuuugagacagaaucucgcucugucgccaggcuagagugcaguggcgugaucucggcucacugcagccuccgccuccuggguucaagcaauucuccugccucagucuccugagcagcugggauuacaggcgcccaccaccacaccuagcuaauuuuuguauuuuuagcagaggcaggguuucaccauguuggccaggauggucucgaucucuugaccucgugauccacccgccuuggccucccaaagggcugggauuacaggugugagccaccgugcccggccaaccuuaacucuuaaaacaucuaccuugcuggccaaccugcugaccgaugagagaauuuacauaaaggcauguugaagaaauguggggcucugcaggugaaaggcuguauccuuccugccauccuuauugucugauuuuugcuacacaugaggagcaaacucaccugccuucuguuucucacauggaauucagccaggggcuucagucuccucagccuuuuuucccuuuuuguuaaggcuuuuucuuuucuuuuuuuuuuuuuuuuuugagauggagugucgcucugucacccaggcuggagugcaguggcacaaucuuggcucauugcagccuccgccucccagguucaagugauuuuccuuccucggccucccgaguagcugggagcccgccaccacgcccggccaauuuuuuuguauuuuuaguagagaugggguuucaccauauuggccaggcuggucucgcuuuuucuucuuuuagcacacuuguuuuccuuuuaaauuaaccagcccuaugucuauuccuuucguccuaauacauagcagauuaccuuuaaaguaaaaacauaacuuuuuuuuuuuuuuuuugagacagagucucgcuguguugcccaggcuggagugcaguggcacaaucucacucacugcaaucucugccucccagguuuaagcgauucuccuaccucagccucccauguagcugggauuacaggugcccaccaccacgccuggcuaauuuuuuuguauuuuuaguagagacgggguuucaccauguuggucaggcuggucucgaacuguuggccucaagugaucagccugccuuggccucccaaaugcugggauuacaggcaugagccaccgugcccaaccuaaaaaccuaaauucaugaaacagauuaguugacaauaggggaguuaauuguauuucagagagaauguuaggucucuaaaauuuauuauucccuagguugacauuaaaguguaaggcaguuacuuagucagauuuuuuuuuuuuuuuuuuugagauggagucuuacucuguggcgcgggcuagagugcaguggugcuauuuaggcucacugcaaucuccgccuccuggguucaagcaauucuccugccucagcuucccaaguagcugggacuauaggcgcccgccacaccacccggcuaauuuuuuguauuuguuguagauacaggguuucaccauguuagacaggauggucuugaucuccugaccuugugauccgccugccugggccucccaagugcugggauuacaggcgugagccauugcugcuggccagcucugcuaauuuuuaaaguuuuuguagaaauaggauuuugccauguugcuggucucaaacucuugggcucaagugauccuccugccucagccucccaaaguguugggauuacaggcaugagccacuguacuuggcuaguuugaaucuaaaagaaguuuuuuuuuuuuuaauuaaauuuucaguauuaagcuaaagaguauagauauuuuuagacugggugcauuggcuaacuucuauaaucccaucacuuugggaggccgagguuggaggaucacuggaggccaggaauuugagaccaaccugggcaacauugcaggacuucauuucuacaaaaaauaaaaacaccagauguggugguguacacuugcaguccuggcuacucgggagguuagggcaggaggauugcuugagcccaggaguucgaggcuacaguaagcuaugaucacaccacugugcuccaggcugggcagcagagcaaggaucuuguauaguuuuuuuuaagguauaguuuucuuuucuuuuuuugagacagaguuuuacucuauggccgaggcuggagugcaguggcguuaguuagcucagcucacugcagacuccuccuccuggguuuaaguaauucuccugccucagcccccacccuaaauagcugggauuacaggcgugugccaccacgccccucuaauuuuuguauuuuuaguagagaccagguuucaccauguuggccaggcuggucuugaacuccugaccucaggugauccgcccccgccaggccucccaaagugcugggauaacaggugugagccacaccccuggccaaaguguagauauuuuuauggcuuuauguagauagguagauauaaauaugcguauaugugaguacguauuuuccuaauuggaauauuggaugugcaaaaaucuauauuuuuagagcuauuuuauauuuuuacuaaaauauuuguuguuuuuaggagugauuacuuggugagugucagccacugcguagggcgcuugggcauauagcagggguacuuacaaaugagcccucuuggagcagcuuccuuuuggcugguucagggaggugaaugcuguuggaaagccuuagcucuucacaugcugcuggguuuugguugucuguggauauguagggaccuugggucuuggucuguaagcccauuuucucccuggguggccaccugaaucuagcaagguguaguuuaaguagagucucuucagagaguugaggauguugugcuuguuaaggaagaccgguuuacaucuguguguacauuaccuuccucaggcuuccucaggcccagugcucauggaagggacguugagggacugacuacguauuagagccuugaaggccaagauuaugccuuguucauuugaaauucuugcugucacuggaauaggggauuaugucuuguaauguucauaaugccuaauaaaccccuguaagugguuuacauguuucuuuuuacuuucaaaaagguacuguaccccacgcuauagugaguuugaagagcucgagcggaaauacuggaaaaaucuuacauucaauccuccaaucuauggugcagaugugaaugguacccucuaugaaaaggugaggcucacuggaaacccucugugcaguguuuuuguaauuuuguaauaccuuuuuuucggcccggcacguaguaggcaccuaaaagcuguuuggugaauggguggaugaacagaugaucuacccccagcugauguugcugugcuggccuaauugugggccauuuugcaugugacugaauuuuauuucuccugcuuuacaugugaauuggaugaugugguguucuuuucaaggguuguuagcauagucggugggugguagcugaugaguucuugaaaggguggguuggcucucagauaaugaaaugaggcagugugguuucugcagaaaaaagaugacugacuaaucuaaugaaagggguauacauuuaagaagagaaauacauuuagauuuuucagaacccucaaacaagauucuguggcaaaagcuauuuuaaccacuuuuauuggcuugaaauccugccuuaaauauggugaaaggggagaauauuugggaauaucuucagaugacugaaaaacaguagggcauucagggauuaucacucauaauuguuuucauauuuuaauuuuuuuuuuuuuugagacggaguuucgcuuuuguugcccgggcuggagugcaauggcgcgaucucagcuuaccgcaaccuccgccucccggguucaagugauucuccugccucagccaccugaguagcugggauuauaggcaugcgccaccaugcccggcuaauuuuguauuuuuuaguagagacgggguuucuccauguugcucaggcugguuuuaaacucccgaccucaggugauccaccugccucagccucccaaagugcuagaauuacaggugugagccacugcgcuuggcccauauuuuaauguuuuuaucaauuauuggaagaguuaaaaaaaugaauuccaggccgggugugguggcucacaucuguaaucccagcacuuugggaggcugagguggauggaucaggaggucaggagauugagaccacucuggcugacauggugaaaccccgucucuacuaaaaauaaaaaaaaaguagccugcaguagcgggcgccuguagucccagcuacucuggaggcugaggcaggagaauggugugaacccggcgggaggcagagcuugcagugagccgagauugcaccacugcacuccagccugggugacagagcaagacucugucucaaaaaaaaaaaaaaaaaaaaaaaaaaaaaaaagaauuccaguuuuguugauagcaguuuuugggggucagggaaagucagucuuguagggaugaauggcaggaagaugcuguaaggaucugggauggagagcuacaaaagucaggcauaauaauaauacaggaccuaguuaugggagaugggcucccagcuggccauuacaacucgggaaaaggauauuccacauuuuuuaugaagacacugccugguggaaaucagggcuaaaaagccacaacauugccauaguuuuuuguucuuuuguuuuugagacagagucucgcccugccacccaggcuagagguuagugguaugaucauagauuacuguaaccucaaacaccggggucaagggauccuccugcuucacccucccaaguagcugagacugcaggcacaugccacuucaccuggcuacuuuuuuuaauuuguaauuuuuuuguagagacugggccuugcuuuguugcccaggauggucuugaacuccugggcucaagcaauccugccuuggccucccaaaguguugagauuacaggcgugagccaccacaccuggcccacugucauaguucccauguuuugcgauuuuuuuuuuuguggucauagaguuuuuuuucuauuuugaccuaaauuucuuuagcaucaguucaaacuuuuccucuugggguuucaaacaggugacucuuggucgggcgcgguggcucaggccuguaaucccagcacuuugggaggccaaggcggguggaucacaaggucaggaguugaagaccagccuggccaagauggugaaaccccggcucuacuaaaaauagaaaaauuaguugggcaugguggugggugccuguaaucccaggugcgcgggaggcugaagcagggaauugcuugagcccgggaggcggagguugcagugagccaagaucaugccacugcacuccagccugagcaacagagcgagacuccgucucaaaaacaaacgaaaaaacaaacaggugacugucaucucuuuauucaucuuuccuacacuaguauucacaaaguaauauuugcccuuugaagguaaauggugucaguuccagugguagccgugaaagucaaugaggaaugcuauggucuucacguccauaguguuuugacauuauucccaauguuugucagagaugacagcuuacuugugaccuacucugauuuguagguucagagccucgguuucuaugcaaauguaacuugcccuggacugucauugccuuugcagcauguugaugaguggaauauuggccggcugagaacaauccuggacuugguggaaaaggagagugggaucaccauugagggugugaacaccccauaccuguacuuuggcauguggaagacauccuuugcuuggcacacugaagacauggaccucuacagcaucaacuaccugcacuuuggagaaccaaaguccugguacagucugccugcagucggcaccgggcuucuaugcuagagcacgggcucauguucauugugcgugggaagcaccucaggauuguguuaaagggcagacccugguucaggcuuggggugacauuccauguuuuaaacacacuuucaagugcuaagaugcuugcuguuggagcucuggugcucggaccaccuuuugaguagggaggcuuuagagagcagggugcuggcaguuacccaaagacacgggggcucuuccaggcuaucccacugcuuucuaauuuuuuuucugaacaggccugaggcauuucuuagcagcagacuuccaagacuagagucacucucucagaugacagaaagcuuucuuuucgucauggaaaaaauacuaauacuuggggagcagcagugugugcuuaacacauaagggauugcgaggcuauucagcaugcuuccuguucuccagaguguuauucuuguuggugagacaaacauugguucucucuccucucucugugcugacccaucuuugagucucagcauuuuuuuuuuucuauuuugagacagggucucacucugucacccaggcuggagugcaguggcaccauuauggcucacugcagccuugaccuccugggcucaagugauccuucuacuucagccucccagguagcuggguuuacaggcgugcaccacuaugcccagcuaauuuuuuuccuucuuuuuuuuuaggguagagauggggucucacuauguugcacaggcuggucucaaacuccugggcucaagcaguccuccuacuucagccuugcaaagugcuaggauuacaggcaugagccacuguacccggcccaucucagcauuuuagugaaggugcugcagauaacagcagugaauaagauggaugagauaccuacccucacacagauaggagacuggucaggagguagaaagugugagagaaugcucauacgguguggggacagcucugaaggggaagaagugggugcuaagguccacauaagaaggauagaugggauuaaagaaggcuucuuucaaagaggugacaagugagaccuaaaacaugagaaggacauaaccggguggagugguggugggcuuagcagcugggagauugagggaaguguauccaggcaguuggaaccacagacgcagagcuccuggauuaagacagcacaugagggccaggcgugguggcucacaccuguaaucccagcacuuugggaagccgagguggguggaucaccugaagucaggaguuggagaccagccuggccaacauggugaaacccgucucuacuaaaaacacaaaauuagccaggcgugguguguuuagggagcuagggggagucugcuguaguuugggugcuguguaaaacgaugagaagugagugaugaggccggaggggacaucauggggcacauuauggggagucaugaaaaccauauccacuuucaggucuuuuuucagcaucuucagccauguucuuucucagggguuuuccuuucuucuuucaagugcucuccaguuucuaaucuugggggaaagaaccuuuugagccuaugauuaucuccuaacuacuguccuguuuuuccuuccucagaaggcuagacuuguaggauguguaaauguagcuuuugugucuucaccauuguuuacuccaaaauucacugcuccuggauuuuugaauucucuuauaaaagaagguuuuccaguuauuauauacauucuuagguccucugaagugggaccuccagagccuucuguauaggguugccugauggaucccagaguccuuuaggugacauuuuugucaacucuucuucucuguuuuguuuuauaaugaagcuguuugcagugggaggauuuguuguuacuguggaauaaucuucagaagagauuaaaaagguuaaaacagaguuacugugaguuucagaauauaaaguuuaacaauuuugcaaaaguuuaauaguccuagguguucuuuuuuacuuuucauuuuuuaggaagagcaguuucuaugguguuuagacacccuacuggguagagagguaauugauuguuggguaaucaguauauguagcuguuggggagauaaagggaaaguggguucaucagcagauacggggcuaggucucuuaagugucagauccaucuuucacuuuguuuuccaucuuccucuugccugcccccaguuaggccuuucaagcauuuaaaaauacugagcauuuuuaaauacugagguuauauagugacauccuucuuuuuuuuucuuuuaaaaaauguuauuauaugaacaacauuauaaaggagaguaauauuauguaccguaaauccuggcucauggugaacacuuaauaaacaucuuauuaagugaaugaauauagaagaaauaaauucacucaccuucuuuaugggcuccuuacuccugugcccaaacagucuaauauuucauuuuuucagauuccuuucuacugcuugggaaguuaaaaaaaaaaucugcuauuucaagguguuuugagagugggaauaagucccuuagcuucuguaccugcccuccacccagccucugaugcucucaugugauugcagguacucuguuccaccugagcauggaaagcgguuggaacgccucgccaaagguacugugucucuucuguuugcuggauuggacccuccuaugagcugugcuccuugcucugcacuaaaaugugcguuccccauggucagauacuugcagguccuguugcaggccugcagacgggggugagccacacugguuaccuuaagagggcagugacggagccuuuucuuccuuuguccugacugucugugccucaguuuuaaugagcagggguguuucuuugaccagcgauaaugaaccagacccaguaugacugguguuuccacuaaagacccaaauguuaaagaaaaaauugaacuuuaugcuuuguuucuuuuaaguggacuuagauuuguaugucuggagaacauaggaaagccuggguagaugauacuacagcugcauuacugaaaaaagaucagggauacaagugacuggagaaaagguccuaaauaguuucaaagcucuauaagaacagaggcagcuugggugaccuugguuucccaaacaggauuucauuacccacguaaugcccuacaugggagugagccuagaggcucauugcagaaucuuagaauuggugcggagcuauaaggauccucagaggucacauuggugaugcauccucuuuaucauuccgaugagaagcacaggugugaagugacuccaggauugcggagcuaguguggagcacuguguuaaccuguacccuuucaauuaaauaggcuuuuucccaggaagugcucaaagcugugaggcauuucuccgccacaagaugacccugauuuccccguuaaugcugaagaaauauggaauucccuuugacaaggugagcugauguuacaugccaaaguucucaggcaccacccuuucuggccuuuguuuuacaguuuuauucuaguucaucacuauaccaagagggggccaaagcuuaaauaaacuauguaacaacacuuugaucuaagagcauuaaagguggggccacuguagcuuccuggugccagaggagagucagauccccuagaacaguguucauuuggaggaaugguuaauuauagucaugucaucugauaugucugggcuuugcauuuuauagaagacagcaaggaccccagggguuuuaugacuuacccuuuguuacucagcuaaguugugguggagcucagaauuccaguucuguggacuucugccauuugaagcagcugcuucaagucugcucuuguucaggugacucaagaggcuggagaguuuaugaucacuuucccuuaugguuaccaugccggcuuuaaccaugguuuuaacugugcggagucuaccaauuuugcuacccgucgguggauugaguacggcaagcaagcugugcugguaagucugcuugauuucuuucuauaacaccaugacaaaaaugagcaaauucugguuagauacguuggcuggugauuagaguauuucuuugagcugcuggaauucagaaacaagcagcuagcaaugugucagaguacuaacauuuuguguucauaaggaauuuuuaaaaauguguucagaauugggaaguauaaaaugagguucuuaaguccauuaggcauuaaaaccacauccacacacguuaauacucuuguuuauccauuccgagauuucucuguugaaauuuuuagggguuuccuuuacucuagggaagcagcagggucgggccuuugacugauaguaguagacuugcuuguguguuccuggcuuggacagggaacaagggcagguggcucaccguccugggggccuaagugcagagccuaaccacccucugugaccccgaguuagugcccagguagauuugccccaguagcaugugcucucugccuuuuuuucccugcuucccuucauguuugaagguccugcaaggauaacaugcccucagccugugaaccaaaacaaucugguuauaaaccaucuugcacuuguuuccauguggagggaggagcuaggacgugggggugaguuggaagcagcaagguaugcucaccuggugcucuucugguuccugcugacagugcuccuguagaaaggacauggugaagaucuccauggauguguuugugagaaaguuccagccagaaagguacaaacuuuggaaagcugggaaggacaacacaguuauugaccauacucugcccacgccagaagcagcugaguuucuuaaggagagugaacugccuccaagagcuggcaacgaggaggagugcccagaggaggacauggaagggguggaggauggagaggaaggagaccugaagacaagguaacccagcagcccuuuuguccuggcugcgugagggagggaugucuggguagguccuguaaucuguggagaggcuguuucuuguuuuuuuuguuuuguuuuguuuuuguuuuuguuuuuguuuuugauggagucucgcucugucgcccaggcuggagugcaguggugcgaucucggcucacugcaagccccgccucccggguucaggccauucuucugccucagccucccgaguagcugggacuacaggcaccuacagccacgccuggcuaauuuuuuguauuuuuaguagagacaggguuucacuguguuagccaggacggucucgaucuccugaccucgugauccgcccaccucggccucccaaagugcugggauuacaggugugagccaccgcgcccggccgaggcuguuucuaagaugccguuugugccuuggcuaagggaguguucuugguaaaggcuccagaaaccugagagccagagcauucaggcacuuucugaaugagagaccuguagugggcguguagucugcuggagcaaggcgucaguuauaugagggucgggggcauuuaugugcgaaggucgggcucccucugagccagaaaagucauguuuucucaucauaucagagagucuuuuaaaaagaaguguagugaggaugagacucaagggcauugguaaugucgugauuuaagucugcagugcuauugguggcugagccaggggaucugugcucugaggagaauuuauccugggccauaugggaaagaaaggaggaaccguuccuugguaccugcuauaugccaggcacuuugccagcuacucugcauaccuuuucuuaauccucacaacaaaucuguuaggugggugguaauaccuguauuuuccagaugauugaacaaggucagagaggugaagucccuugucucaagucacaaauaagaggugucccugaguuuugagccaggccugacaggcucuggccauucacuuuggguuguguguggauguguaugaauguguuugaguaaguggauguauaugugggcucuuaaaagauuugcccucucccuugcagccuggccaagcaccgaauagggacaaagaggcaccgaguuugucuugaaauaccacaggaggugagucagagugagcucuuccccaaggaggaucugaguucugagcaguaugagaugacggagugcccggcagcccucgccccugugaggcccacccauagcucugugcggcaaguugaggauggucuuaccuucccagguuaguugacuaugguguauuuuccacaacccuaacucauauaugugucccguguuagaugccauauugagugcugggucagaaauaaaaaaggcagagugacagguccgugagcagauagcauacuuggagugugagaagugcuuuggguagggauguacagggaggacuggacacguagggaaaagcuccucccucugccuggucaggggucagggaaacacuggagguuuuggugaaggugacucuuacaagguaaguaggaccuucccaggcggacagagagagaggagggauguagaaagggagucccagaugggaggagcagggcacaggcauggagaugggaauuuuuuuuuuuuuuuuugaaauggagucuugcucugucaugcaggcuggagugcaggggcgcaaucuuggcucacugcaacuucugccuccuggguucaagcgauucuccugccucagccuuccaacuagcuaggacuacaggugccugccaccaugccuggcuaauuuuuuuuuguauuuuuaguagcgaugggguuucaccguguuggccaggcugaucuugaacuccugaccucaggugauccgccugccucggccucccaaaaugccaagugggauuacaggcgugagccacuguucccagcagagaugggaaauauuaauagcaugguccacuugggggaacugguggggaguuucccucaauugaauauuaggguggaaggcagcugugugaccagaaggugacgcuggagaaauaggagaugauguagggcugucugccauuuucauuugcucacuuggaagcuuaagaagccauuuauauuuuaagagagggaguggugugaucagugcuguuuagcagucacuuggaaggucauugaggcuagauuuguuagagaaaggcuuguaucugucuugggucagguaugacccaaagauguggucugccgacagccaggcagcacuguggacugacacccugggcugggcuggcuucucuucagcagauuuucuuucccuuuuuucucuucaaauuuauuuauuuauauugacagauaaaaucgugcauauuugucuuguacaacauaauuuuuuuguuuguuuuagaaacggggucuuacuguguugcccaagccuuugugaacacagcucacugcagccucaacuuucugggcucaagcaauccucuugccucagccucucaaguaggugggacuacaggcauacaccacgccuggcuaauuuuuuuuuuuuuuuuuuuuuuuuugagacggagucucacucugucucccaggcuggagugcaaaggcaugaucuuggcucacugcaaccuccgccucccggguucaagugauucuccuaccucagccucccaaguagcugggacuacagaugcuugcuaccacgcuggcugauuuuuguauuuuuaguagagacgggguuucacucuguuagccaggauggucucgaucuccugacaucgugauccgcccaccucagccucccaaagugcugggauuacagcagugagccaccaugccuggcccaugccuggcuaauuuuuaaauucuguagagacagagucugacuuuguugcccaggcuggucuugaacuccugggcuccagcaauccucccaucuuggccucccaaagugcugggauuacaguuuugaacuacugcuccugguccaacaugauuugugaaguauauauaaguuguggaauggguaaaucuagcuguuuaaaauacauauucacauaguggucauuuuugcagugagaacauuuaacauccacccucuuaauauuuuucaagaucuuuagauuuucuagcaugggcuagguagccaggucucugcugagcucagacuugcauuaccugcaggagacuuuggaggaaauggcagcugccccuuacugagugucugcugagugccaggcggugcucaggagucuuauuuaugagcccuguagaucuguaguagcaucuucucauuacagaggaagaagcuggaggccaggaggcugagcaaauagcccuggcucacagugccccucagugacagagccaggauuggaagccaggucccauuccccgcccauguuccuugugcuuugcccucugccuuucaucagguucacaugugcaggaggaacuuggcucugucuaauguguauguguguuucagauuauucugacuccacugaagucaaauuugaagagcuuaaaaaugucaaacuagaagaggaggaugaggaggaagaacaagcagcagcugccuuggaucuuucugugaauccugcgucuguagggggacgccuugucuucucaggcuccaaaaagaaaucaucuucuagccugggcucuggcucuucacgggauucuaucucuucugauucagaaacuagugagccucucuccugccgagcccaagggcaaacgggaguucucacugugcacaguuaugccaaaggggauggcagggucacugugggagagccaugcacgaggaagaaaggaagcgccgcuagaaguuucagugagcgggagcuggcagagguaugggcuccaggcaguggugugggguggggagcugcccuggaggacacccugucgggaggggaucugugugggggagggagguggaucugugugauggaggugcugcaggagggcaggagagacccucagucagugccucuagccagcagugguugugucaaacaaaagccugggguggcauucacucucccagcuuguucuuugcugggaguugcuuuucuguuaucccuguggcuacugauuccaagaauugcaucaaugcagccugagucacagcagcagauccuccucagcccacuuggaucacaaugccuuuuuuuuuuuucuugagauagagucucugcucuguugccuagcuagagugcaguggcaugaucuuggcucacugcaaccucugccuuccagguucaagcaguucuccugccucagccucucgaguagcugguauuacaggugugugccaccacacccagcuaauuuuuguauuuuuaguagagacaggguuucaccauguuggccaggcuggucuggaacuccugaccucgugaucugcccaccucagccucccaaaguggugggauuacaggcgugagccacuguggcuggccuuuuguuuuuuuuucuuuuuuuuuuugagacggggucucgcucuguugcccaggcuggagugcaguggcacgaucuuggcucacugcaagcuccgccuccuggguucacaccauucuccugccucagccucccgaguagcugggacuacaggcgcccaccaccacgcccagcuaauuuuuuguauuuuuaguagagacuggguuucaccguguuagccaggauggucucgauuuccugaccuugugauccgccugccuuggccucccaaaguacugggauuacaggcgugaaccaccguggcuggccuuuucaacugggguaggcaggaacucuuccucugauccucauugccuuagcggcaccaggguuagaauggcugcuguuggagcccacguguuuggagguuugggaucagaugagaugaccuuucuuaccuugaaauucaaggguuuuuuucuuacaccucuugacugcccuguagacucccaguaugacauugauagagcauccuuuuggagaccaagaugcauucccaaagcuauaaacacgaacauguguguucaggcuuccuccuuaaauacauguugucaccaaaagcugauuccugcuuuugugcaaaauggcucuuggugggucugccacucugagugaucagucaugucagaugccacuggacccccacuacccaagugacuuucccugacuccccagccuuggagcuuaugugggucaagcugcagucuuuggugaggggugggagauagaagaagccagugcagaagguccucuuuauucccuauucccuuaccuuuaguuuuuaaaaauguaucuuaaaaaucuucacuauggaaaauuucugacguacguacaaaauaccaucacgagcccccgcguguacucaucauauauaugauuaacauuuggcacauuugcuuucuguuuucuuuggcugcaguacuugacacucagucauauucacauuucccuaguguugccaauagucccuuuuuaugguagguuugucuccuuguuguugauacucauaacuuuucucggugccuucucugaaucucaggguacgguuuugguagacuucuuuuuaccuugugaauguuccucuuuccaucccacugugguugcaggcuaaugagcuaauaacuacuguguuuccuucucauugccucugauugcaguucucugugccuucuuauggcagcuuccauaaaggagggcuuuuucagccuggaaaccagagucucuuuaacucccaguugccaccuagcaauucuuccuucgcagaggccccgggccauuucauccauccuacuguugacuacuguucacuacaguucaugcuguccucuugcugagucuuccugacauucuuguuucuaguugcaaucacaaucacaaaaagcagcuaagaaguagcaagagcucacuguauauuaaauacuuuguuuaucuuuuuugagacagggucuugcucuguugcccaggguagagugcaguggcacagucuuggcucacugcaacuucugccuucuggguucaacccauccuccccaccucagccucccaaguagcugggacuacaggugcacaccaccacucuuggccaauuuuuguauuuuucguagagaugggguuucaacauguugcccagacuggucucgaaauccuggguucaagugauccuccucccuugaucucccaaagugccgugauuucaggugugagccacugugugccccaccgccccccagcuguuaaauacuuuauaugcauuguucagucuuuguauuacugcuuaauuaaucuuauuacagagucaaguuuuugugggaauuuuuuggggugggaggugcaggaagccaauaaauaacaccuguccuuuuuccucucaauucggaacuauuuaauugaugauacaagagucaggcauauggagcucagaaugucgcuuuauuuacaaguuaaaaugauugaagaaagugacuuuuaaccugugacuaaauggcccugcuacuuuuuuuuuuuuuguggggggacugagucucgcucuguugcccaggcuggagugcagugguguaaucuuggcucacugcaaccuccaccuccuggguucaagugauucucgugccccagccucccgaguagcugggauuacaggcaugcaccaccacuccugguuaauuuuuguauuuuuuuuaguagagaugggguuucaccauguuggccaggcuggucuguaacuccugagugcccgccucagccucccaaagugcugagauuacaggugugagccaucgcgccuggccuacucauuuacucuugaugucuccaggccccucuagaggcaaagcauuuccauggaagcacucagcuuccaugugguguggauguaggccagaaugcacucccucuccaaaagacagauccuagugaagugaagcacagcuuucaaggggguggggagaagaaaagccaggacuccuuccguguggaagugugcuaggggaaggggucuucucucugacaugucucucuuuuucaguccucugcucaaaaacccuugagugucuucuugguuccuuuuuauuucgguauguacuuuucaggccgagccugaugauaauacccuaauaaauaacccucucugcuccaucgccaaccaucccuccaccuccaacaugugcuggcuuguuuguuugaacuacuuaaaagucucuaaaacugucuuggcugcccugccacuucccucuacuuucuaaucauuuauggcaugccuacucuaggccaggacugugccuucaaggagcucacagucuaggauagauagguaagagcaaaucauuccaguacuuaaugauacguguugugguacaagugggagaguuagcagcucagccugggguugcaguguagaguucuggacugccugagagaaggaaacaguuuaggccugagguuagaagaaugccagguggacagaaugaaaucgaagagaaucugggagaggaggguguucuaaaugcucaugauaacucaugccagggucaaagcacuuggggaucugcagugguuuaguuugucucaggcauauaggacuggagagggccucagguggugcuguugggggaugucaagagccagaaccuggagggucugccuuguugcucugugaagcaguuugaccuaguugugguguagggagcagcagaaggguccccaccauaugcaccauauggauuuggaaauugaaaacuuucauaauucauucuuuuaaacgcacacacaaagggccgggugccguggugcaugccuguaauccuagcaguuugggaggcugaggcggguggaucaccugaggucaggaguuugagaccagcuuguccaacauggcgaaaccccaucucuacuaaaaauagaaaaauuagcugggugugguggcgggcgccuauaaucccagcugcuugggaggcugaggcaggaaagcgcuuaaacccuggggugguggggggcggagguugcagugagcugagaucacaccacugcacuccagucugggcaaaagagugaaacuuuaccucaaaaagauaaaaaaaaaaaaaaaaaagcaagaaagaaaugcacacacaaagauucagagggaggccacgcagggugccauacaccuguggucccagcacuuugggaggcugaggugcgagaauugcuugagccugagagguugaggcugcaaugagccgugacuguaccauugcacuacagccugggugacagaaugacacaguaucuuagaaagaugcagagcgaauaauacagugaacccacaaauaauuuuuuuuugagacggagucuugcucugucgcccaggcuggagugcaguggcaugaucucggcucacugcaaccuccaccuccuggcuuuaagcaauucuuugccucagccuccugaguagcugggauuacaggcgccugccaccaugcccggcuaauuuuuguauuuuuaguagagacaggguuucaccaucuuggccaggcuggucuugaaccccugcccucgugauccaccugccucggccucccaaagugaugggauugcaggugugagccaccauucucggccaaacccacaaauauucuaacaggugucaggaucuuuccauauuugcuuuguuuguccuguuuucaauuugcugaaguauuuauauuaaaauuauauuaucuucauuaguauauaauguacauauuuuugggguacauguugauacuuuaauacauuaauuuguaaagauuaaaucaguguaauugguaaaugcaucaccuuaaauauuugucuugucuuuaugcuagaaacauucaaauuauucuauuuugaaauguacaauagauuauuguaaacuauagucacccuacugauuugucaaacacuaggucuuauuucuucuaucagacuauauauuugugcccauuaaucugccucucugcugaaguauuugaaagcacaucccagauaccuugucauuucuucccuacuucaguguguaucucugaauaauauggucauuuuuggcugggcgcaguggcucacaccuguaaucccagcacucugggaggccgaggggguggaucaucugaggucaggagugcgagaccagccuggccaacauggugaaaccuugucuuuacuaaaaauacaaaaauuagccaggcguguuggcgggugccuguaaucccagcuacucaggaggcugaggcaggagaauugcucgaaucugagaggcggagguugcgcugagcugggaucuugccauugcacuccagccugggcaacagagugagacuccaucucaaaaaaaaaaaaaaaaaaaggaaaauauggucacuuucuuagaugauaacuaugccauuauuauaccuaagaaaacuacaaaaauucuuuagcauaauuuacuauccaguccauaaucaaauuuccucauuguccaaucuguuuuacaguugauugguuuguaucaggauuaaaucaaggcccacaccuuugauuugccgaugauguucugaagucuuccuuaauguaggccagcgccucucccccuuuuuuccucaccauugacuuaaucaagaagcugucauugauuguccaguaaaggguuuuuuaaguacugcacugauguuuuggaagauuguucuggaggcaguauaaagauuuugagggggaggaagaaggaggcaaaauuagaaauuguuuaacagagguucucuugaagguggaauuauggaugauuucacuuccuacauuuaugcaucauuugaauauuuuuaugauuaacaugugauuuuuauaacuaaauacuucuacuucaggaaaggaggaaaaaagauuugaaacagggaaaccaauuaggaaccuguuucuuuagucugagagagagguagugaggaccuguaggugguggugauagggauggggagcagaaaauggacuugagagcuacuuggaagguaggcacauaggacugggugacuggaugggggugagucagaggguagcauggggcuugacucggguuuccagcuuugaguucuugggauaggugguggugucauccauauaggauaaugguuauaagaaaacuaaaggguuuuuagugugggccaggaaaugaguugaguuuggguacgucuagagggggacuuuugugagguaggcuauggagacacauagacauagccuugaagcuggggugggaggguuggucugugggugugggagucaccaggagggcacuggugggcauggaagaauguguguagagugaagaacaguuucacaguguggggugacaggagagggcccagguaggagaaugugagggagcagccagaggucaggagaacuaggaaagaacaguguauccagugccagggcaggagaagaguucaagacagugggagauauggccaagugugccuuguauuaaagggcaggguccugccaagugggggaaguugaagagguagugauuggauucuggggaucuaaggaagugggagugcagguggagggacaggaggggauggcugcagauagguuuuuuuuuuuuuuuuuugagaaaaggucuugcuguguugcccaggcuggagugcaguggugcgaucucagcucaccacagccucgaccucccaggcuuaacugauucucccaccucagccucucaaguaguugggacuauaggcaugugccaucaugcccagcuaaguuuuuuauuuuuguagugaugggguauccuuauguugccuaggcuggucucaaacuccugggcucaagugauccuccugucuuggccucccaaagugcugggauauaggcaugagccaccacacccagccuguguuuuuaaauugugguaauauauacacgguaugagauuuaccuguuuuaacaguuuuuuuaguaaacaguucaguggcaguaaguacauucacuuuguugggccacugucaccagaaugcagaugguuuugaggugggaggagauggggaauuuaucucugagggucgccuagaguagucagauaacuaccucugcuuagugcaacccagcccuuuucaaaagccacuacucuuagaaacacuucauugcuuuccaucuaguucccuuucuucuuugaagcccuagaguacuaguuucuuaaugcccuugccauaggcuggugaagaauauaaccuucuagaagcugggcccugugccacauucauccucauuucuugaguuaccagcacgguccagagggcuuggccuaugaaacccucuguaaugaggauggaaugaguaaauggaaggucagguuuguuuuaguaagaagccaccaucagaauuaauugacugggaggaauaagggacagauagucaagguuugggggcagaagcugagcaacuuuguccaucccuggagaggucuuauagcacuggaucuauauuuguagacaacuggguuccuuagagcacccuuauguucccccacccccacuuuaagcauccccaagcuguaaucugggcugccugcuguucaguuuccaugccaccaucuaugucaagggccuuuuuuaggucagucugguaaacugcaguuuuugguaaaagcacccuggcuggcugacacugccgaaacuguagaguuuucauuaccuacugacugagccacagccauaugucugcugcagaaguucuuguuaguucaagcuacuuugaaaagugaguucccaaaacaaggugggagaacaauugguucuucucuguacagaauaaacccuaucaggaacacuaaccuugacccuggugccagauguuggaugagggaggaaagaacucaggagccuugaguuccagcuuucuucaggcagggcccugggagucugccugcuaucccgcccugucugcaaaaagagcccucuggggaaggguuuauuacuaccguuuuacugguggggcugcuacucauccaggcucacacagcugcuaguuggucgaacccugaccuuucuguuauauacugagggaauuuagaaacuggagcaaucccagggaaggcagcaccaugagaagggugcggaugccaugguagcaggaggaguacuguccaggagaugaggaaaugugaaaagauauucaaaucuuugaauggaccugacuacuuuggucagaggcagcaugacgguaguggaaagggcucagacuucggacuuggacaccaggucucccucccugagguuagagaucacgucuuguuuuucucugcauugccaaaacaaguauucccaccguauacuggguauauaagaggugcugugaauauacugaucauggaaaagguguccucuucccuucccaagcugcauucugguguucuugaccuucacccuuccaccuccuuuggaacuuggaucuuagguaccuccuacccuguauuuguuuccuauugcugcuauaacaagguaccacaaacacagaggcugaaacacuuguucucuuaugguucuucaguucagaagucugaaauggguuucacugagcuaaagugaaggcaucagcagggcuguguaccuuccuggaggcucucaggggaggacccauuuccuugcccuuuccagccucccugggcugcccacauuccuuggcuccuggaccucuagguccauugucaaaggcagcggcauccagccaagugucucuggcaucacaucacucggacagacucuucugcuuccuucuucuguuguaagccccauugggauuacauugggcccaccuggaugauccaggguacgcucccuauuuuaaacacuaucugauuagcaaucuuaauucuccuuuaccauguuagaauaacauauucacagggauugggaugugggcauauuggggaaccauuauucucucuaccaaauauccuacuaucucccuuucacaagcugcugcuuugccuauaaagccaagcucaugaagccccuaucauagcuaaaauacaauucuagaggaaauuuccuucucaaacuaugaucucauuuuucccuugaucuucucaaaaauacuccacgacguauucacuccuuaguuucuuauucuuuguccaccggaacuuaucucaaaaaacaguccucauagcuccccguugcugagugagucccuuggccacuucccugcucagcucuucuauguucuuugaccuguggaucucccccucccugaagccguccccuucuucucuuucugguauuccucuuaccugucugcuucugagucuccuuuucucccuucucuucuuccuccugucccuggaaggcuuagucaauucaucauccaagacaaucucaucuucucccaccauuguaauucugaaccuggugcugcggauucccagaucuugcucugacuucuuuucugaacccccagucugaauuucuuauugccuccccuggguauuuccaaaugaaaagacccuuggguacauguuguguacccuacacagcuuguuuaaccugguuuguuauuagcccccacuuccuccacaugagcccucuuaaagccugucaccuuggugguccaggcuagaaauccccaccguuucuggcuucuuuauucccauccuuuuuuucccuagucugccacagcccacagguuuaggccuauuguccaggugcccccaaagugauggcgggggcaggucggggggaaacaagaauauuauugggguauaggaauaaagcaaaaugaacuuuguuuuuaucuuaaccuuuuauagucuguuuuugcuuuaaaauaugcauaugugcauuaauauuaguauauguaauugauuaguaaguaauauauagguuggggguacaugcuccuaaauuuucuauuuacaugguuaagacugucgggcaaguauggguuuuccaguuuguuuuagccaaagaacccuuuuacuuacuuacuuauugauuggagacaaagucucacuucugucacccaggcuggagugcaguggugcagucucagcucacugcagccuugaccuuccgggcucagguaauccucccaucucagccucuugaguagcugggacuacaggugcaugccaccacaccugaauuuuuuuguguguggagacgggguguugccauguuaucugggcucaagggauccgccuaccucagccucccaaagugcugggauuauaggcgugagccacugugccuggccagaacccuuucuuuaagugaaaucuuaauuaaaacauaaaucaaaagcagagccauucugguuggaaagaagauggggccucuagcccuuuuuguucacuguaauggaggcuccugaggugcuuuccggauguacguuuugaaaaccauggguuuagacaguugauauaguuccggucugauuaagucuauggucauguaagucuucauggacaucaguaggaaaaggucccugauauccucacuccaccauauuccuccauacugcugcagcauccuuacucacguaagcacagaucacaucuucuuugcuucucuacaccuucuucuuuuccugggcaggccuuugcacacaguaggugcccagugaauauuuguugaaugaauggcaaauggauggcaaaacuuguuggcaaaauguauguuuggaagagcagguucuguuuuuccuggacauggccuguucagaaguuguuuucucuuggcauuccaacugugguccuuaacuccuggggcucuguguaguugcacauggagucuguaggcccaggguguguucucugaaguagcacugcagcauuuauggcauugguuuuugucacaguugcaaaguggcccucuuucaggccucauuuccuugcuuaauggauuuugcuaacccugcaucuccugaugucaguauaaccaaguuuuaaauacguugauuagaaagaaacccuucuguaguguuucugagucaauccuguacauuuaaaucuaauuacauuugcucugacauuauguaaaugcagucuuaaaucaaccuuucccuuugcaagccaggccagaguuucagaugcacuuucuguccuggcugauguucuccccuggagaagcagcagcuaacugaggaaugaacaguaucugcuagcgcgaagucuuggcaguguauaaggagaagguggccuauuuuacuuuuaauaggucagcugcugcucaccccuuuggguguccccuagacacuccuggguggcccagcugccuggcacauuguaacagguacuguugaccuacugggccaaggaaaggggcaccuaggcuccuugggggcucucucacuugggccaccuugguagucucauagcagugagcuuaagggaccgggcaagccucucucagagcuggagcaggcuuguuuuugguacacugguuucaggcugcuccuaagaaggccaagaacuacacuuggguuuugcccuaaauuuacauaauccugguucagacuaguuugguacgugguauugucauuuggcuuuuucuaagauagguauuuucuguuugguauuauaugucuuuuuguuucucugugccccucucuuuccuuugguuuucauuguaagggugacuugugcugugucucaaguggagacaagaccaauuuaauuucuugugguuugcccagguugcagaugaauacauguuuucccuagaagagaauaagaaguccaagggacgccgucagccuuuaagcaagcucccccgccaucacccacuugugcugcaggagugugucagugaugaugguaaguguuguuuuuucuucaccaggaggaaagcagcucaccacauuagacuugacaggacaggacaucagaaggccaagcugagggauaagggugggccuguggcuuagcugcucuuccagauauuccauaaagagaggaccggauuuccuuauaucuaauugacuaaccagauuccauuauaaguuugaguaucuugcaguguaccuuaauaggggauaauugcaggcagguuuuuuccuuucuuuuccugggagguacaaggcugauuuuucaggacagaaaauccugucagugaugcaaagcccugugguguauauguggcugcaaagauaacuaagauauguccgugcccucaagacacucacagggugguggggaaacuggacagguaaacagaucucaagaaagaagagguggccgggugugguggcucaugccuguaaucccagcacuuuggaaagccaaggugggcggaucaugaggucaggagaucgagaccauccuggcuaacacgugaaaccccaucucuacuaaaacuacaaaaaaguagccgggugucauggcacgcgccuguagucccagcuacucaggaggcugaagcaggagaauugcucgaacccaggaggcagagguugcagugagccgagauggugccacugcacuccagccugggcgacagagcgagaugccaucucaaaaaaaaacagaagagguguuacucuggggcagaaggacagcaugcuauggagaagaggagcaggaggcuguagucagaggaacuacagucagcucaguguggcuggagcuggagggcaaggccagggagugauagguggaguaggaggagggggaccagauccuggauagcguuaucauggaggccagagugaggacuuugucuuacuggcauucaggagccagugacauguuuuaagcagaggaaugacagagucauuuagauuccuuuagaaaagaucgcuccuagugcuggcaucuugaggauggcuuugagaggaccacauaggcuuccguaauggucugccugcaauaugaaggucugaaguaggaugguggugguagggaauauauuuggaagauaaaaucaacuggauuuggugacuggcugugaagcuaugaggaugguaguugaggaggaugaguugagugccuccccgguuuguagcuuugguuggggaaaccugaguucagugucuauggaggauguagacuuaggaguuggcacugaggugacauuggauacaauuguuggaauaaugaggccgaucuuggggaggggaccaaggggggugagcagacgcuggggcuagguggacagaggagggaggggagccugugaaggaggcagagaagcaggguaagcagccauguguaaggaaaaccaggaaauguggcacugaagcucaggguguguugacaucaguggagcauggucuccuuggcugccugaagcccagagauccaggaugaucaucacugccgagccucagcuccagcuugguuggugacugggcccugucaccuucagggagagcagagucaaucguacauguuacucuugacuaacaucaggcccuguccuaccugguccucuccuuccugaucugaugucagugccccaucucugcuguuuuuuuuuuucaguagaaagaucaugguauagccgggcgugguggcucacaccuguaaucucagcacuuugggaggccgaggcggguggaucacaaggucaggagaucgagaccauccuggcuaacauggugaaacaccaucucuacuaaaaauacaaaaaauuagcugggcaugguggugagcgccuguagucccagcuacucgggaggcugaggcaggagaauggcaugaacccaggaggcagaauuugcagugagcugagaccaugccacugcacuccagccugggcgacagcgagucucugucucaacaacaacaacaacaaaaaagaucaugauaaacaggguggggaauaucccuucuguccuccagucagaaguguggcaggacccugagucagguccuaggaaguucucuguguucuuauuccagcucagacaggagcuucagguucucuggguagcaccugccuaucucccugauugguuuaaagcaauauagacuucaggaaacuggaaaaguuaccaagaggaauacaaaauuacccuuaaaagaugaccauuuugaauauauuaacauauuaucuuccuggcuuuucucuagucagauauuagaguauguccauguauaucuuuuuaaaauaaugcaguugagauaauacacaaccucucccccuacuuuuuuuuguuucuuguuuuuuuuuuuuuuuuuuuuugagaaggagucucacuuacucuguugcccaggcuggagugcaguggugugaucuuggcuuacugcaaccucugccuccuggucucgaacuccugaccuugugauccacccaccucggccucccaaagugcugggauuacaggcgugagccaccacgcccagccuuuuuuuuuuuuuuugagacggagucuuacucacucuguugcccaggcuggagugcaguggcaugaucuuggcucacugcaaccucugccuccuggguucaagugauucuccugccucagccucccgaguagcuaggauuacaggugugugcuacgacgcccagcuaauuuuuguaucuuuaguagagacgggguuucaccauguuggccaggcuugucucgaacuccugaccucaagugaucugcccgcuucagccucccaaagugcugggauuacaggcgugagccaccgcacccagccccacaauauccuuuaaucuucaguccaugcccaucuuucccugcaugucccaagaauguguuuuauaguuauuucuuuugaacucuaauauaaaucaaacuaaggucacauacuguauuuggaaguuauguuucuuuacuguuguaugccccucccccuacuuuuaaaaaaauuucaauucaagcauaacaauucagugauaugcacacauuuuaacuguacagcucaaugaaauuuuacauauguaaacuguauaauuuugcuuccugcaauuuucacuuaacguagugaacauuuucccucaucauucaguauucacaaauggaaugaucuggggccacuuuuggcuuuguaaauggaacagaugucaguguguuaauuuuuuaguugugagugugagccugccugucuguuucuguuucuuccauucuaucuuggucacuccuguuuggccaggauaaagaaaaaaaucugugcuuggguucugggcaccauggcuccugauuacaacugaacgauggggcauauagggguugauuuuaauugucugcguugguguccuuaggguacacugaggcggcgcacaauggcagcugccagaugccuucagauuaaacaugacuaugagggcagcguagaauacuaucugcacugagcuggaguugccagaaaugaagaaacaggcaccuaauggaaguacagaccagagcuuuccuuggcugcuuggaacagguuucaggggccuuugggaaagcaccucuguuugggaagaaggagggucauagcuggggacugaugaugccauucaaagcgagaugcauggauccccugggaugccccgugugauggggcuggcagagagccagucuccugucaggggccgcauacuugggccuugcuuggucacacuugccaaagaaaggcauagcaacucuagcuucauaccucccucacaugguagagcaucuggagaaacauuuuggacaucuaccaaagacugcgcucauuuacuuauaccuucagaauuauggcguuuccuuuacuucccuguuucuguuuccuuguuucugcugggagcuuguggacuaugccccuguuucacugauuuaggaagaacugggaagugugcaccuuuaucacuuacaugaguuuugugagcaaacuuuuuuuguuuuccacucagcaguauguccccuuucuuguaggaagaugcacccagaggggauuuuuccuucccaggccuuagugaagucugaugaguuguaugcccugcugucuagcauaccuaggagacaccaucugucaugaccagggauauauaaagggccaggaagucaguauuuuaggcuuuacagucuucauuggucucugugguugucacuguuuuuuuuuuuuaagccccaaugcugaaaauguaaaaacaaagcugggugcaguggcucaugccuguaguccaagcuacuugggcagcugugaugggaggaucacuugagcccaggaguuugaggcuguggugagcuaugaucgcacauguaaauagccacuguacuccagccugggcaacauagcaagaccccaucauaaaaauguaaaaacaauucuuagcuuccucagugggcuggauucagccugcaggauauuguuugccagcgucaggcaucacaucuuguggcugggaagaggauucaucuuggacauguagcucugcucuaggagggguuggggagccuuguccagaauagguacauacugcugaccuuuccagaggaagcugguaaguccuggccaaggaccaugauauuacaacuuuuaagcuuugccaauucccuguuauuuuccuuccuuguuuaguugcacuaaagggaaaacucuaaaagguaaaggacuuaacaggcugacguuuuggaggcagcaaauaagaugguuuuuggcaagauggugcuucauucugcuguccuugggcagaagggcugaauguggcagcuguuaagggagaguagagcaagcugagcucguggggcaggaggaagaauggaggccaugagucagucuggccagagaaugggguacuggcaggacucccuacacaucaucaagauacugaaggagucuauugacaguugcuuccacccuuugccuuuaucauccuuaggaauucaggagucacccuugguccaaaccuaggaucaggaguccuaguggaacucaucuguucuccaggcagagccacagaugugcaggguuagugcugacucacacuucuguuuccuccucuagagacaucugaacagcugaccccugaggaagaggcugaggagacagaggccugggccaagccucugagccaacuguggcagaaccgaccuccaaacuuugaggcugagaaggaauucaaugagaccauggcccaacaggccccucacugcgcugucuguaugaucuuccagacuuaucaucagguaacccagcuccaugcacucuguuuacccaggaccagcaaucauagggaagcuagauuuaauugugaguauauagcuugucacugguugucuugggaaaggccaccuccacccccagcauucucugccccaucuguguauuggucagucuucuccaggcagauaacccagcaacguggguuucaauugagaaugcuuuggagaugagcugagggugggcuuaggcuccccuuugcacaugcagucaucacagacaucaguuugcagagcaaucugcauuucuguuauucuaguccgugguuauuccugccaagugguuuauaguccuggccaggguggagaacugugauuuccuuaccacagucugaaccucagcugaaaagccagauccucuaauguuguuuuuccuuucccauugccacaaugcguguugccaguagcagaaggaacuugggagggguggaagcaagggccugauaugugaggaggggcugggaagcaagauugcugagcucagcugugugccuccugcucuggggcaucuguggcuucauugguggaucucuuuggguccagcucuaggaugccaggaaggcauucacagcagcaggugccaagggaccagcucagucucagcugggaccugcacagcauagcagguagguaagugguccuuaccugcuguggugguuaaaguggcauggcugccgcugagccuggcagggccccagauucaugcuugcugaaaauggaaccucagaccaacacacuuuggauuaggaacucacuaaaccuuuccauugacaaaaagcaaaaccaaagccuuugccuaugaggggagugaauggcuggguucuuacuauaagcagaucuacuaaguaggaguuucacaaauggcauaggcucugggguugacaucuuucugggccucauccuuggaauggagaugcaggugccauccagcagauauuugcaaucaguauaguuugccaagggaaguauguggauuuaaguucuuccuggagggacccugagccaggaaucacacagguggggcuccagccaugugacagugcugcaguucaggugaccugcugacaggcacaagaggcaauuagugcuggccuacuaggagcaucugcucuggguacacuccugagguggggucaccgcacaguguagcacguaagggagcccacaguagcagccuagcugcuaacaucuccgugcauuuuuuuuuuuuuuagacggagucucagucuguugcccaggcuggagugcagcugggacuacaggcacacaccaucacacccagcuaauuuuuggauucuuaguacagacgggguuucaccauguuggcuaggcuggucuuggacuccugaccucuggugauccacccgccucggccucccgaagugcuggaauuacaggcgugagccaccucaccuggccucucagugcauuuuauuaaccacuuucuuugggaagauugaaaucccaguugccucuuaccuugcucccuuuucucaguuguccccuaggggccuuuguaugaugcugcugugagaaacugaauuugagucauuacagguaacuucaauuagcagcuccgggauaauggcugugcacccgggagcuguagccauagucagaucgguaagagagccagcuuucugcugauagagcagguggaaagcuaagagcauaggcacgugcucacugagguguacacuuguucuuuccccuuagguugaauuuggaggcuuuaaucagaacuguggaaaugcuucagauuuagccccccagaagcagaggaccaagccauugauuccagaaaugugcuucacuucgacuggcugcagcacggacaucaaccuuucuacuccuuaucuugaggaggauggcaccagcauacucguuuccugcaagaagugcagcguccggguccaugccagugagugcugcucaccuuucucuguguccugucccaggaguaugggccugcucacuggaaguucuugccaccuccuggccucccagccccaaaaagauuguugauguuuuauuggggagucuguugcuagcugauuuuucacugucuccagggguccauacuggcacuagucaucucuuugccauccucuugguugcagauagcagaaagggauuagucccugccacuuacuagguguuuguaccagugaaucuacaguuuuugacuuuuugagacuuugagccauacuguaugccugagcccuggggacucagacuaaagaaaacuaagggguuucugugagauuugguuguagcuuugggaggugguauauggaaaggaauugcaaaucuaccuuuugacucugaccacuggguuuaauuugcucaucuuggugucccuguuagguugcuaugggguccccccugcaaaggcuucugaagacuggauguguucucgguguucagccaaugcccuagaggaggugagugaucccacacuguuacugucuucaccaugagucuuggugcauauucagggccagacgauuucauguuggacucaguauucccagcagucugcauagggucugguacgcggugaugucagagagcgaguauugugagaguaaauccuaugaccgugagaaugguugcugcccacuuacggagucuggaugcuguguuugcuccauuguggaaagaccaacuaguggucuuccuguggaggaacaauaacucccuuaaaagaauuuagccauuuugaauuggagccucagaaaggggcucagaugauucauugugcuguuuucucuucacuguacccccuggaaccuggcuguaccuagcccauauaagaagcagucagagcccugucaugccucuaguuugagcaaaguaucuuuugugacuuugcuaagaguuguuauuagcagcaacaaugaagaggauuaugugaagucacgugacuacuuggcacacuuuagcccugaguggccucuccuucugacagggcguccuggugcaggggcugccugggugaagccccacaugcuauuaugcuucuuucuuauguggaggaguugcccaaagcagguccaggggagagcagauugaauguuaaugacuugguauuaaccacuuuuuccucccucuccuuucuuggcaggacugcuguuuaugcucauuacgaggaggggcccugcagagagcaaaugaugacagguaaguuuccugagcagugccuuggaaugcacaggcucaguuccgaagcacacagugucuuugugaggguacuagcuguucuucugaaugacugaugaggauuugggaagcacaucguguggagcaggaauagcaucuccaagacucauuuuaaaaauggaaugcuaagggagccaagcagucccagacuuuccaacuccagcugcuccucugcagcagagaugucagugacauccuccuuuggagaagcuaagaauggacucaugagaauaugaagacgaagaugaugcgcagggacugugugggcuggagugaggacauucaccuugucacagcuggggcugguaugcagaggcggccacaggcuagcaagcacuucuccacauggcaaacucccuggcucagaccugcuguuuggaaugaggcgagugugcucaaggaggacacugaggagagcucagacaggcccacccacuauggaaccgaaucugcugaauuuucugggcuucucagcuguugggcagcucguuuucauggagugaaucuuugugcuuaggcuuguguuugguugcucugagguggaaacguaagaugaaugagguuucugaccuggaagagcuagcugucuagggcauggugcgugcaggucagugcugaguauccugcuuccaaguagaaucccguggcaacuugcagcauauguucaguccagccgccugcccucaagagucccaguuaugcugucccugagagauagcuacucugccugcugcuucugcuccuucaaaggcacuugcugccauuauuugaggucacuggguuccucacagucacaggauagugcugggaacauucuuucuuauuuggaguggaaauggcugugcuugaaucucucaccuuuaccucugaaugccuguucugcccuccagggccacacagaacaaaucuguucccacucuaaaaagacagccccacuagaacugcagagagcuuccauggagccccaguguugucugguguagguuuucacguagcaugguuuuaagaguugucaccauuuucguucuucuccucuugaugcaugcugguuucccaaaauguccaaaacuuacuuuaauucuuaaggauguccguugaauagaccucucagaguaaguggggcuugggucagaccuuaaagauuaaagagugagucagcuauggaaaaagggagcagaagggagaggucauuucagccugggggagagguuugggcagaggccgagagagagcugugauuacuggcagauuagggcacagccggggacguuuucaggaagcacuuggguccuaugguaaagaggucugcauagagcuuuccaguuuauucucacucccugagaccugccacacaccauuagccugcagcucuguucauuuuucaacagagugguguaagaagcaugauccggugcuaaccuagggcagugggcaguggccuaggugggcaguggggguggcacugcuuccacauacucagaggagagacgguucugguucucaccuuccugggucccaggcaugugcugguggaagucaguggucacccaggugagggaggaagcgcugucagcaggcccaaaagagaaggccacagagccuugggcccagaggugacugagggagccuuugccuuuuggcagguggguccacguuucaugugcuguggcaauucuggaagcaagguuugucaacauugcagaaagaaguccgguggaugugagcaaaaucccccugccccgcuucaaacugguaagggcuuguagacucuacauaauuucccgacuuacaaguuucuggguagaagagaacagggaccuccuguaccccuugguuuugguuagaguuugugauucucacucugugguuagauuccuuaguggaggccaggugugguggcucacaccuguaaucccagcccuuuguggggccgaggugggugaaccacuugaggucaggaguucaagaccagccugggcaacauggugaaaccccgacucuacuaaaaauauaaaauuagcugggagugguggugcgcaccuauaaucccagcuccucgggaaucugaggcaggagaaucacuugaacccgggaggcggagguugcagugagccgauauugugucacugcacuccagccugggugacagagcaagacuccgucucaaaaaaaaaaaaaaaaaaauuuccuuggcagauaaaguuguaaccagaccuggauuagagcaggcugguguguccuuguauuuugggaaggggcuggcucuugcuugcuuggcuuugcauuugggaggggaacaacagaggaagcugcagugccaguuccugcaaucacugguuuucuuccccugugcuacagaaauguaucuucuguaagaagcggaggaaaagaacugcuggcugcugugugcaguguucucacggccgcugcccaacugccuuccaugugagcugcgcccaggcugccggugugaugaugcagccugacgacuggccuuuuguggucuucauuaccugcuuucggcacaagauuccuaauuuggaggugagagagggugucauucuagaauccucuugacaguuuucauggucauuuucucugcauguuuuccauuuguuguaucagcaacuauuuccucaagcauucugcauuaugaagagugcuaaugaguuaagagauugagagguggccccuguccaucuccacucccugccuuguacuccauaagccagugacaccaaacugcuuguaguugauucguuuugauuaucucuuuacuugucugccucuccaucagaauaaacuccuugaggguccauaucuuauuaauguggucauccuuauuacuuaaccuaguguccgggacaugcagaaccucugaaaauguugagaacaaauggggagagcucccaagaguuaaccaugaauugccagacaguagagauuucugcaguucucuuaaugguaaagcuuagagaaaaagugacauguaauguuagcuagaggagcucugaagaggauuggguagacgguggcauuugaagugggucuuaaacaauaagaaggaauuguaugcagagacuguugugugcagagcuugagaaacagaaugaacaggucgcagaagaaggaucaugaaagacugguuaugggagugugacggugugugggagugugaugcuugagaggcggacaacggcagaggaugaaggcccugcacugccacucucaggacucugaccugucuucacuggaugagaacuuguugaauauuuugauucugcauuauaguuuuugauaaucacucaggugguuguuugaagagaggauucagaguaagaauuugaggcuggaaaaccaguuaguccaggagagagugaggucugaaaugggaacacauaggcagggcuuugggguacauuuaacuuugagauccuccaacagguagaacugauaggguuuauugacccucguggguugaggagagaaggggagaggaggaggaaagggggagugaauauugaagaugacucagguuacucccuugagagaugggaaggaugcuaauaugauguuaguaacugcaaucaggaacugagaugaagcaguguugcucugcaagggagagaaggagggaugagaaagaggaaaguaaaugcugaggucacuggagcauucuggagaguaacugugaggguaaagauuuggcuauuagcauuuaacagcauaguuaaaucuaguucccauuagaaacugggcucuggagauucccagugggagaagcagguagcagagcaugaaccagugaaagcaguugagaaagugaagcaagccagugggaggaaggagggucauauccaacagagaaggcagggcuggugugguggucacuaaguaccacaaacuggagugucccuguggaguagucaggucagaagccagaccguaguuggggaaggcucugccaugagugaguuacaaucuaauagaagaggcgaucauacaaguuugacaacagugugguaaauacauaaucaaaggaagaacgugauagauggccagcccagaaggaugaacuuuucacucugccauuugggguugcagaaaaguccugguuggcugacugcauucuuuuucauaaagauguugaacgugacagguggucagggguaugauaggaaggaccuuaggaagaugggaacauauuguaugugagaaugagacuccggagugucucaagggcccugcccuagccaucccuggugcccucaccaugcccuucucauucugaacuugcccuuaaugcaaguaaaaacuugagguaguacugagucacagcuaugauagggaagaguuuuuucauacacagaauaguuauuuugugauaaucauuaauacuccacaugcuuaagcuggcagcuguagacugcuggugcuaugaggaaauuggggggacugaugaguuaguaguuuuuucacugauuuauucuucaaauguuuauugagcauuuacuauaugccaggcacaguuuuaggugccaggacuauaccauugaacaagacaaaaaaguccuugcccuucuggugcauacaguauaguugaaggacacauagaagcaaguaaauacacaguauagcagauggugagaagugcagggauaaaaauuaagucagauaaggggaauggaagaugaaguaguaaggaaugacaucaauaaguugacacugggaugggagucagugugcaaguaacuggggaauggcaucucagguagaagaaccagcagugucgaagcccuggguggcagcacauauggcacacucauucagggaacagcaaggggggccagcauggcuggggcagagugccugggcaggcuagcaggcgugcuuggaaaugaggccgucacauacuuugugauccuguuugcaucaagggcaaguucagaaugagaagggcaugguugagggcaccagagauggcaauggcagggcccuuggaaugggggacaguuuguuguguguagcuggagacaucugggaaaccuaagucuuugugcccuagcccugaggguaaugcugcaggugcuaagauguggugcagcuuugccuggcggcccaggccucagggcaccuauugagucucuccuucgauacuuugaugucaguucuuggcaagaucagagguccauguuguuguucagagaguucuggguaagauaauaugguauaagggccaguuguggacuagcuaaauuuaugggaagagcuaaauuuauggaggaaaugugguacuggucucuuccaauguccuggcugggaugguggguaucuggaaaggcuuguuuuagcucccaucucuucucuccuuuuuacuuuuacuuucccaugcuuaucuuucccugauaaggaggaacuaauugaucuucaucuccauaugccaggccugcaaacuccacgugugaguaaccaaagccucuguuuuuuuccagcgugccaagggggccuugcaaagcaucacugcaggccagaaagucauuagcaagcauaagaacgggcgcuucuaccagugugaaguggucaggcucaccaccgagaccuucuaugaagucaacuuugaugauggcuccuucagcgacaaucuuuauccugaggacauagugguaauaucugcaaggagcuucucaggcaguuuggaauggggggauguuucuaaggucuggcuggcagacuguguguguaugccugcuucuucuagccaggucccuggucccaucaccauguccucaaacagaaagaaucaucuguaccagucuuucuuugcaaagaaaacugcgugcugcuaggguacccuauuuucccuagaaguaccugggaaucaguauuuucugcaauuccuugaaaccugcaucuguugccgucuaaauuauccuugagggcauucuagugcaauaggagagcccaggcuuuggaaucaaauaugccaauaccagcuucauugccuaguagcugugugauuuuaggggaauuauccaacucucuuuucuaucaggcccucuuaguagauguauagaaucugcuuuugucucuucacagugggcuuuagggcuaaguagaaacugccuggagacacccuuggccuguuuauguuaucaacaccugagacacaguggccccacauggacccaguccuaggucuggcuugguagugaggacuuaguucagguuuccccuacccccaccuugccuuuucaguugguagacugaccaccaaaguagagaggaaugaaaccauuuuuuccuuuaacaaaucagguauugucccauguuuauaccacauuagccacucaguugcuaaaagcacauucauuaguuauaagguagacuuauagaaaaggcgacauuaguaguacucauagcaguagcauagcuaucauuuauuuauauuuuauuugugagacaggguuucacucugacgcccaggcuggagugcaguggcacaaucucagcucacugcagccucaacuuccuggauugaggugaucaucccaccucagccucccugguagcugggacuacaggaacgcaccaccacagccggcuaauuuuuuaauuuuuuguagagacgggcuuuugccauguugcccaggcuggucucaaacuccugggcucaagugaucugccuaccuuggccucccaaaguggugggauuacaggcgugagccacugugccuggccuuauuuuuuuuuuuuuuuuuuugagagagaccaggucucacucugucacuuaggcuggagugcaguggcuguaucauagcuccugcaaucucaaacuccugaacucaagugauccuccugcuucagcuucccagguagcugggacuacaggcacaugcagucacaccuggcuaauuuuuaaauuuuuuguaguaacaacggucuugcuuuguugcucaggcugguuucgaucucgcagcuugaagcgauccucacaucuugggcccccaaaccacugggauuacaagaguuugagccaccauaccuggcccuugcuguaauuuauuaagcugguacaguaugccaggcacuaugcuaagugguuauuucaaguaucucuuuaucuucucauacccacugugagaaggaugugguauuaucucuaacuuacagugguuucaggacuccauuuucuacaaguuagagaccccaaagagccuguguuucucuggguuacaucuaaacguauuuauucuuauuagaaauuaaagcagauugauuuaaaauaaucaauuuuuuuagauuaaaaauaacuuuucuaaaacaaaaacaaaagauugccauuucccugcaauuuugcaaaucucuuuaaugucuuuuuuuuuuuuuuuugagauggagucuugcucuguugcccaggcuggaguacgggaguacgguggcaugaucuuggcucacugcaggcuucaccucccagguucacgccauucuccugccucagccucccgaguagcugggacuacaggcgcccgccaccaugcccggcuaauuuuuuguauuuuuaguagacaugggguuucaccauguuagccaggauggucuugaucuccugaucucgugauccgcccgccucggccucccaaaguggugggauuacaggcgugagccaccgcgcuggccuuaaugucacuucuugauucaaucuauugugauacacuguuuagguucaaguauaggaagaaaauucagccuugcguagauauguaauuggaaaaaggaguuuguuuuuguuuuuuuaaaauaggguuucacuccagucacccacguuggagugcagugcagugaucucaacucacugcaaccuccacauaccaggcucaagugauucugcugccucagccucccaaguagcugggacuacaggcccuugucacuggcgcccagcuaauuuuuuaauuuuuuguagagauggaguuuugccuuguugcccaggcuggucucaaaacugggcucaagcaauccgccuaccucggccucccaaagugcugggauuacaucugugagccaccacucccagccaagggagguauuuuaauagucuuucagguaauuguguuuauuauucucugauauccaccaaaacucaauggaaguaacaacuuuuuuuguuuguuuguuuguuuuaagagaugaugucuugcuuuguugaccaagcaccucccgaguagcugggacuacaggcaugcauggcuauuuguagaaauggggucuugccaucuugcccagguagucucaaacuccugggcucaagcgauuucuuuugccucaaccucccaaagugcugggauuacaggugugagccacugcuccuggcagguucuuaaaaguuaguugcaguguggaaucugaaaggucagugaacguuucauacuguuaacacuaaaacccauuggucucuucugaauggaucuuucacccaugcauccuuuuauaacaucauacuuuggucauuuagaaaauauuggugcacuggccuaucgacagccuccaaauguuguuaaauauuauuauaaauuuaauuuuuuuuuuuuuuugagacagagucucgcucugucgccaggcuggagugcaguggugcguucuuggcucacugcaaccuccaccuaccggguucaagcgauucuccugccucagcaucccaaguagcugcgacuacaggugcacgccaccacgcccaacuaauuuuuguauuuuuaguagagaggguuuccccauguuguccaggauggacucaaucucuugaccucgugaucugcccgccuuggccucccaaagugcugggauuacaggcaugagccaccacgcccggccauaaauauuuuaaaaauuacauuuguuaguaucacuaauaaucaaaaaacuuggaauuuugggaaguuucaagcucacaguugugaaugccgcuucucugaaaugcuaauauuuguuugaaagccugaauuuuacuauuggcaacagauacugacuuuuguuuuccuugacaugacaggcguucacuucaugcauuuucaagaagaugucugccagauaccuaagucugaaaagccauaguuugucagucacuuuuuucuuuuuuuaaauuuucauagaguuuuuuaaagacaggguccugcucuguugcgcagcaccacugcuggagugcaguggcauggucauggcucacugcagccucauccucccggccucaagcaguccucagccuuccgaguaacugggacuauaggcgugugccaucacaccuggauaauuuuuuauguuuuguagagauggggucuccccuguguugcccaggcuggucuugaacuccugggcugaugcgauccuccuaccucugccucccaaagugagggauuacaggcaugagccaccaugccuggccuaguaauuuuuuucaaauaaaacugguauuccaugaacaaagcagcuaguguaauucacaacucaaacaacacagauagauuucuuugagacaaccaaaagugucuuaugaggacuuaacacauguacucaaugauuaagauuuaacaacauuaauaauuuuuuacugcuucaucaagggauauuguuacaugcaaucuagaguuuuugcucuuuucuccuaaauuaugaguguacaguggugaaaaaugcaauaacaacuaguagagcuuagggucagugccuugaucugugcucaggugccagcaguuguaccuauccuagguaaaugacaacacagugacaaaggcuaauaguuuaauauuauaaaaauagccaugucucacuugcucccugacagugucucaggaaccccucagagguucacagaccacauuuucagaagugcuguuauaggagguggaacugaauugcagagaacuuaaacaauuuaucaaauaucaaacauuugaguaguuaaaucuuagaacaccucagauauuggguguaggaggcuguaguuuaugccuaauuguuagauugauacaaaauguauuuacugauuaccuauucaguaaaugaauugucaauaaguagggaacuguuuccacucaauaaaugaacuguagcaugauuguaagagcagaugugagcauccacauccuuuuagacucacugcccugccccucucucauuuuuuaagccaugucccuaaggaccuucucccagguauaccuaucagaccuuucauucagccaauaugcugaaugaaauauccccccguauaccaagcccuaugcugggaauacgaugaggacuugggguacuuaccugcuucuggaaggaauaaaaguucugaaguacuuugccaggucccaugguaggugacucuuuuucaucuuuccuguuaagaacauauuucuugguugggcacaguggcucaugccuguaaucccaccacuuuggcaagccgaggcaggcagaucaccugagguaaggaguucgagaccagacuggccaacauggugaaaccccgucucuacuaaaaauacaaagauuagcugggcaugguggcacgugccuguugucccagcuacucgggaggcugaggcaggaggauugcuagaacccaggaggcugagguugcaaugagccaagaucaggccacuguauuccagcgugaucucagcucucugcaagcuccgccuccuggguucacaccauucuccugccucagacucccgaguagcugggacuacaggcgccugccaccacaccuggcuaauuuuuugcauuuuuaguagagaugggguuucaccauguuagccaggauggucuugaucuccugaccuggugaucugccugccucagccucccaaagugcugcgauuacaggcaugagccaccgugccuggccaaaaaaaacacaugucuuauaguugaguaugguucuaguauuucuucauggcagagcccuggagaacccgcaggggaacaguugagggaauguaagaaggacucuugauucuggcacuuaacuccuguguuuacuaaguuuguuauagcuggauuuuuuuuuuuuuuuuggucaccuagaagcaggagagggcagagauaggggcagacuuugacuuagcaaggucuuuaacuguuaacauuuuucagcccagagagcugccuugcucucuaaaacaguuacuuuguccugguucacucuucccugaguagaggacaguuaccuuugugugcagguggacguuccuuucacccuccuuccuuccuguuuccucagagccaggacugucuccaguuugguccuccugcugaaggggaagugguccaagugagauggacagacggccaagucuauggagccaaguuuguggccucccacccuauccaaauguaccagguauccaaaguucuaccuuucuagggaguggggggugcuugauuaauucugugcuuccuguugggccagaggcgagucuuugcucuuaggagaacuaauagguugguaacccuuucagagcuaggggucugcccuguuuccagucugccaaaugugaaguaagguaguuguuauuuuaguguucuaacuccuuccuuugacuguaggggacugccacugugcaugguggaccagggaaagagucagggauauccuagccaaaaggccuuuguuuccuugguagguggaguuugaggauggcucacaacuugugguuaagagagaugauguauacacacuggaugaagagcuucccaagagagucaaaucuagacuggugaguauuuucuguguccccccaguuccugucuuggagggagggaacaagucaaggaugcaucccuuuguauuguuccugggguagcugacacuuggcuugcuuauucuucuauagucaguagccucagacaugcgcuucaaugagauuuucacagagaaagagguuaagcaagaaaagaaacggcaacgaguuaucaacucaagauaccgggaagauuauauugagccugcacuauaccgggccaucauggaguaggugcuuccaggguccaagggauucucagccauccaggcaagagcacucuggguuccacagcacagcagacauggaacgcugaagucucugaaagugaaguuguaaaaagaaaaggaaugaaauaaccgacccaucaucuucucacccacccucauugcauuccgcuguagugaaaggacgagccauuucugggcacguggcagcagucgcugaucucccagcugaggggcugagcacuggaaugcuguggcugcacuggccccaguccauagaggggucaacuaugcuggcuggacuggcugccuuguuccuggccuaggacuuagcuucauaacuaucaccugcaccgacuaggcugaggugcugguacuugccccaaccccuacuuuuguauuuauaugugugugugugugugcgugcgugcgugcgugcguguauguuuggucuggaccagcuucugccagccccuggccuuuacuuucuuccuugccuaugcagggcaaacaaaaugugaaauucugcccucagcugagcugaguaagggcuccuggggguuggcuggagauggguguggcaucuguccaggccuggaaccgucucaagacagugcuggcaaagcugcaguauugagaugcuaaggagcugaugccaccucuuugucuuccccuaaaggagaacauggggauaacaugggugugugcccacaacacucuaggugcagagccccuguggcaaaguauuacaggguguggguggggauuacccugaaucggggauuuuaaugauggaagcaggcagagccuggugggugauucugucaacagaaaauugcaaucaugcaggggcugggaggguuaggaugaaaaaacuggggccauuggaggcccacuguaggugggagggagcugauuuugggguggggggugggacuagagggcaauacugaagggguuaaacagguuuuugcuccucaagaauuuguuugccugggcccaggauuggagggcuucacaccaauacccuguguauacaagaaucagauuuauaauacuuccccuuuuuuguuacguaugaacacuauaaaccaaauuauuuugaaaacuggugcaucaccuuguccuuagcaauaaaauguguugagcagagg

SEQ ID NO: 14084 - RNA, 5979 nt, Homo sapiens
ugcugacuggaaaaccggaagugaaaucguggcagccgccucggccgccgcaaugcaggugagaguugcguugggcguacuagcggcuggcaagcuucggguacagggaccgagagugggcuggcuaaggagaaugaagaguugggacugagaagagagggcagaacccacggcugauaagggaaugugggcuggggggcgaggcuaauuggagcgggagcggcggcgauuagagguggggguggagcuugccugacaggagacagucgggcuaaauccggagggaggaggcagcaccuguuugcuuggcgugggaaaggauuagguuguaauacggggaggcugagaugcaguccaaggaagacggcucaagaaggugguggguuggcucaggcccuguccuaagcugcuggauggaggcuguugguugccgauauagcaggggaucuaauuggaaagaagcccaagcagugagggaauugugggccgcgauggcugaaagcuaagcagcuuauaaucagaggccaugguggaacccgggaucaaguuucugucaggcagguuugcaagacaguuuugcaucccucuucccagccugugcccuauaguuguuaagggugaagaaauggaguaaaacaggagaccaccgaugggaaggaaaugcuuugcagacccccagcauuuuaauuuguuuguccagugcuuagaagcaugugugguuuuuguuuuucauuugucacuuaguuucuugcagcugguagucucaauaaauguuaauggguugacugagcuugugaaagaggcacgggaauauugacacagagauagaugauugcauauuaauucagcaaggagaagguugaaacaaaaugaugagagcagauggaaagcuggagucguugguugggggagggaaaggggagagcaggacugguguucagagaagucuucaugaguaggcagauuucccagagacugacaagacagccaggcucacagaugcuaggauggaggaagcuggagugcaugugcuacagaggugcacaugagagaaugaucuccuggcauuaggucugucgaaaaugucucagugagggaguguaggguguaccuaacacagagaaaaaccaggcauagauuaggaggugauggggaaaaggaaucaguugguggaaggacuuggggucaggcaaacagguuggaaggucucaggguugaugcugucuauaacccaaauaccaaagauagaaaacaaccuggcuauccuaugccaaugagauccuguguuaccugacugguguugcacaccaucuccuuggcuuuccagcccuccuuucuaugugucauacucguuuaucugggugaccaaccuguuccuauuggugcagagagaggagaagcagcuugaggcaucauuagaugcacugcugagucaaguggcugaucugaagaacucucuggggaguuucauuugcaaguuggagaacgaguauggccggcugaccugguaagaguuaccagggcaagcuaggaagggcuuaugggugggggggccuagccuccugaugaauaggacauuucuaaugauguaaccauuuaucaguuugcaaacaucuuuugauuuggaaagagcuggguuuccuaacauuuagcaaguggauuccauggcaaggaaguagagaaaugcucaguuuccuaacccaaguucuuucuagcuuucaauucuuacccuuugacuucucuggugaggagguccucccacuacagcucuauucgugcuggaucucuugccacagauguggcugagucuuuuagagccaaccuacucugaaguguggaucuuauuuccaggcuggaaaggaggcuuuuacccgguuucugaaguuuuaguuauaacaguguagcccugguuccuauuuugccacuguuccucaccccauucaaacaaugaacuggguuuuuucuacgucuguuucauaaacugaaacuaugucccucuuucauagcccugucaucccuguuagucuguucccacuuaggcuagucauagggcuaugagacuuuuggaggugaauccaaguguuccuagccugaaggaacuaggacuauuuuacuaagaaccacccagggaagggguacaacauucuuacaccuuguuaccaccaccaggccaucuguccuggacagcuuugccuugcuuucuggacagcugaacacucugaacaaggucuugaagcaugaaaaaacaccgcuguuccguaaccaggucaucauuccucugguguugucuccagaccgagaugaagaucucaugguaagaggagaaaaagaauacaacuugggaaauuaagggguuuuuuaggcuucuuuaguauuuagggaaauuaaguuauuagcugagagccuagaaauaauuuuggaggccuugcuuuuuguucuucugaaggcgggagagccacucccaaauagugcuguaauaaccugagggguaugucaccaaggcugauaccuuucuucuccaacaucugucucaagccacaaaguuugcccuuuugugacuuugucuauuccagucuuugaagcguggcagacagugauaguuuaauuugccccuaggucugguagagauagggaugugagaagacacaaaaaaugaaggauggaguaaaggagaguguguccuagcaaacuagauauuaugucucagguuguauuuuccuugaaaaugcacuguuugccuguggaugggacuuuaugucaggccagauagaaucuucuuggaguacagaguaggaucaauaaaaucuguguguuacagcggcagacugaaggacgggugccuguuuucagccaugagguagucccugaccaucugagaaccaagccugacccugaaguggaagaacaggagaagcaacugacgacagaugcugcccgcauuggugcagaugcagcccagguuggacugagucacugccuugcugccccauccccaucccaucaugagaagcuaggcauuaccauuccugucuaguagggauacauaguugguugcgccuaaguugcuucuggcagaacccaaggaauaaauuucuccauaucguuuccuaguuacccuaaucucugcacaaauuuguguguuacagaagcagauccagagcuugaauaaaauguguucaaaccuucuggagaaaaucagcaaagaggagcgagaaucagagaguggagguaugaugggacugguggcuaaacagagaaggagagguauauaagaucacuggaaugggaaugguuguuuuggaaguagugaaguuaggacacaagggugaacugcuuugggguuuguauccauucuguuagccuuuuguauuuaaggccagcacugaagcaguggaggaaaugggcaaaguaagaagagagaauucugagauaggcuuggggguccucuggcucuuuuucugggcugugagggagucuagauguugcugaauucagaacuccaaacccuggcacucauacuggucuuccagcugccacguucaguccugcaucagaagcauacuucaggauccccauuacuuuuucuucaggucuccggccgaacaagcagaccuuuaacccuacagacacuaaugccuugguggcagcuguugccuuugggaaaggacuaucuaauuggagaccuucaggcagcagugguccuggccaggcaggccagccaggagcugggacgauccuugcaggaaccucaggauuacagcaggugcagauggcaggagcuccaagccagcagcagccaaugcucagugggguacaaauggcucaggcaggucaaccagguaagguggcagggguugaaaugaagcugacuuugagcaggagugggagggaauaagcuagauuaucugggccuccagcaucucuagaccuagagguuuucucuauuucuccuuuucacugugacccaggaaauaauuuucagaaguaaaaaaaucucaucugagacucugcaacaggcaccagagagugaggaagaacuuugaguaacagaaacugcuccaauuucucauccgcaucucacaucucugugucaacuauccuucuaucccauuuauucugguauuagauauguugucagugucucuuguuagguagagaaaucagcagucagaucuuaagaccauuugguaggugcaucaggaauugacacgcaggccaguuuuccaguccuacauguauucuuuucucuguauccugccucucuugcucuuggcuuccugccuucucuccuacucauuuuuagaacagucuagaugcaggcagcuagaagaguuauuuccuccaagcugucuaggaaaagggacaauuaaagagagauucugcacuuauuaugauauaaaaaaagaaaaacaaugagagaacauaguacucuuuuaccugugacguuaaaugggagucacacagguuuagcuaucuguucuaggaguggaugaacagacuauucucccaugucacuucuuuccuccuggacaccuucagggagacagcugggugaagaaucauacuucugaccucugucaaacagggucagaugccgcagagguucugagaugauaaaggaagugacagagggaaccugagguaccacauuucugauuugucaugaaagucuuaccuugcuuaagaugacuuuuuuaauguuccuuucagggaaaaugccaaguggaauaaaaaccaacaucaagucggcuuccaugcaucccuaccagcggugaguguggcuggcaaccucgacucccuggugcucuuugcagaguugggcagugaaauuaccuuuugcucaaggcucaccuagauggguacaauaaaaagaacaugggcuuucagcagcagacaaaucccacuuccaccacugacuagcugugugaccuuggacaagugaccuaauuuuucugagccuguuucucauuuguaaauggugauaauaccuaccucauaggguuguugugaggauuaaaaugaggaaaugaauguaaagcacuuaguacaguauaugaaauaauggguauucaauaaaugauaguuucuacagauccuucuccccaccacccuccacaguccuugauccagaacuuacccuaaucugauacugccucacgucaauggugagcugauggacacaagaucaaauaaggcuaugcuuauuuugugcugccagaaacuguagcaaccucuguguucuuagaggcacacuguuuuugcaggcccuccugccuggguuucauucuggcuaucccucuaaggcgcaaggugaagaagcuucugggccaggaaggaaaaaaaaaugcccaccugcagcucuggugaagcuugggccugcucuccuuuccauccucuaaggagccaacuuggcuuuuaccugucaaauagucauaaaguccccuauccuuuaccccaccuuauacacacgaggcuuucucaggaaguggcucugccaggcaggacuaugugggaaaggguuuuuccuuagcacacgaaaaagccccuuccccuggauucauguuucuuauuuuggagggagaagggaauugcacuucacacugccaucaggguuuaguugaccucauaauggugcccacuuucucgacuuuggccaggauuuccuucaaagaaaacgacuuuccuucauuucccuaagccuguggcccaaaugguggaccagaaugauggugggagggggcaacccccaguagcuuugccugcuuuuauaaaguugaacaaauugaauuuagacauucaggcuaaccugccuuucuuaguacuccuuuguuggcaugggcagggguugagucagcagaaguggaccaaaggauuccucugaauaaaguuauuuaaauugauguucacuggcucaggguugucugacaguaauuuaugagagcacuacauagggaucagaggggcaguuucaagagugcu

SEQ ID NO: 14085 - RNA, 5623 nt, Homo sapiens
ucccccucuggugacagaaagucggcccagcagaugaggaaguggcaggcaggcaggcuggccccggggacuucucucuggcccugcucccuccgagcgcuccgccguugcccgccuggccccuacgggugagucuggaccuuccacggacucuccacgugccggcgcccccugccuggccagcccggcccagcccggcccagcccugcccugcccugcccaggcugugggcgaggguguucccggggccagugggugggaggucccagcucccuggggccgggccucgccagcacccucccucccccacacccccgucucuggcccccauuugccuacacccgggccuuccuccaccaccccugcauuuaccucucucccuccuccucuccccucccuccccccgcuacccuaacuuugccaggcaccuuuucccuuccauccaucuuaaaggaaggaagggacgggcugaguuccccgacgagagacacacccagauuuuccugcagcuuggggagagguccucccaggagccuuggucccuccuggccugccggguguguggguugauauugggggcuggugguugagagauaacaggcuggcuggcucccaugugucagggaggaaccuguguuggcgcccucgccccggccugggcccugccggcgaugggcggccagcaagcccgauggugggggagcaaguaaggaggggauccgagcguggccaggcagcgcgcacacgugugugaguggccccgcgggugagcccgugcgugugccugggcgguggccgagcugcgugagggccgggagccaugcgugucagcccacggagguguugcguggugugucaggcaggagacgugugugccagcccucggcguggcaccuucgcuguuggggguggagagcuaggugagagguggguguggaccgcaggcuuggggccugaccacggugggccuaaagaagccgggccuccuggaggugaggggugugcggggcagggaggugucagaggugcgccucuucacuuggcaucugcagaggugcuucucuggaagcagggagucuggggcaccugcugcccugggcccugcucuguuccaagaaugccuugucccucagggacugucaguaccaugcucuccugggucuggccagaggcuuuugugucccugggagccuucccccgacauuccuucaggcccugagggggagggggccuagcccaacggggccccucccugagggaggggaagauuccugcgaccucccccacuccccaaccccuucacaugccacuggcuucccugcccuucccaggaagggaagagugauuguacccauucugaaguaggacaaacugagcaguuauggccggcuuaggagaggaugcuggguguggauuuucagcagugcuuugggccagggcuggggcuggggcuggggucagaggagguuucuggcucagaaucuaggaccuuagcucaucaggcuggucccacguggguggguggguggcgagucuggggcuuuacuuggcuuucccaauccugguggguccugcucccccaggcacugaccuguggcccggacccacccuccacccccugcacaguacagcaggggcgggcagagggcggggcugcugccagaucuagucagacagguggagccgccggggcaggagucucaaagagccaggcuccaggagaggaagggcucugcgagaggagagaggagagcgcuggagaggagaggcuggaggugagagucccaggaaaggcagaggagaaucguagggacauaagugucccagcacaggcaaggaggaauccgaggauaagguucuggagggacagaagggcccagagaggugagaguccuggcagggacaggagggacccuggggagaagagaguucaggaaggguccagagggaugggaagaggagagggcaggagaggagagauugaaggggagaaucccuggagagaagaaagacccagagcuggggaggugagggacucgggugaggaagggagacggaguucaagagcucccuguuggugagaagguaagauucuccaguaagagaccuggaauugagaguuaucuuguggaggaagaggggaagggaggccaggaaguaaaacuguggagaggagaggagaguaagguguggagaggaaggguggaacagcucuucccaggcaagcaggauguguggggagcagaugccucaaccaaacugccuccucccccuaguucccaguaauuccuuccuuucacuguucuguccuuucugcaaugaggcauugcaggugucuugucugguucugugucuuaucucugugggaugggggugugcagugggaucugucugacauccgcccucuguaccuccccagaguccuuagccaggauggaggcuguugugaacuuguaccaagaggugaugaagcacgcagguaagacgcuauccaccagcccuuuccuuccuucuuucccgggaucccuggaucuacggcugucuucuaauggagaguuccuaugaaacccuugauccugugaccugaccucaugucuguagacccuucaaaugaagacccuucgaacccugugacucuuccugauuccuuugacccuuauucauagauccccggauccagggcuacccucugauggggucccccuugcuaaugaccuccauucuccugaccuacguguacuucguucucucacuugggccucgcaucauggcuaaucggaagcccuuccagcuccguggcuucaugauugucuacaacuucucacugguggcacucucccucuacauugucuaugaggugggccccugggaugccgggcuuuaauuucugucagcaggauaaggagcaggccauagagccagagcauggcauuucuccuuuccagagagguucagauccauguccucagcuagcgaaggggagggauggcugggaagggagaacucugguggucuaauccacaucccuucccaguuccugaugucgggcuggcugagcaccuauaccuggcgcugugacccuguggacuauuccaacagcccugaggcacuuaggguaaguaggggcuggggcuaggucauaagcaaccugguagauaugaccaguuuggggccugugcucaaggcccaguuuagggaggcucuuagaauaguguaugagguccuaaggcuaucccaacuucuugcagaugguucggguggccuggcucuuccucuucuccaaguucauugagcugauggacacagugaguaguuauaugagaugugagaacuugaggggagaaugagguggagaagcccagguucugaauccccuucccucacucuucucucaggugaucuuuauucuccgaaagaaagacgggcaggugaccuuccuacaugucuuccaucacucugugcuucccuggagcugguggugggggguaaagauugccccgggugaguggugaaggccacuaugggaaagggugggcaccagaggcuggacucugcugacccugucuuauuguccacucacaggaggaaugggcucuuuccaugccaugauaaacucuuccgugcaugucauaauguaccuguacuacggauuaucugccuuuggcccuguggcacaacccuaccuuugguggaaaaagcacaugacagccauucagcuggugaggggcuuggccugacuuaccuauaaccauccccccacauuccuagccuggauccugccuuuauccagucugucucaccuuugaccccaucucucccuacucaacguuugucucuuucucuacccccucuuccccucuaguccucucacuauucccucugacccuggucuuucucuauccuagauccaguuuguccuggucucacugcacaucucccaguacuacuuuauguccagcuguaacuaccaguacccagucauuauucaccucaucuggauguauggcaccaucuucuucaugcuguucuccaacuucugguaucacucuuauaccaagggcaagcggcugccccgugcacuucagcaaaauggagcuccagguauugccaaggucaaggccaacugagaagcauggccuagauaggcgcccaccuaagugccucaggacugcaccuuagggcaguguccgucagugcccucuccaccuacaccugugaccaaggcuuauguggucaggacugagcaggggacuggcccuccccuccccacagcugcucuacagggaccacggcuuugguuccucacccacuucccccgggcagcuccagggauguggccucauugcugucugccacuccagagcugggggcuaaaagggcuguacaguuauuucccccucccugccuuaaaacuugggagaggagcacucagggcuggccccacaaagggucucguggccuuuuuccucacacagaagaggucagcaauaaugucacuguggacccagucucacuccuccaccccacacacugaagcaguagcuucugggccaaaggucagggugggcgggggccugggaauacagccuguggaggcugcuuacucaacuugugucuuaauuaaaagugacagaggaaaccacggaggcuguguguauacguaugugaacagaggaggugggggaacacaacacgcuuagcccuguccacaaacaagagggauggaugguccaggcucccacaggacauaucuagcucucugaucccaguagaguagagccccuaggaaggcugcugggacauaggucaugaaagaagaaaggcauuagcugaaacagauuuaaaaaaaaaacaugaagggagacaugacuuuauuagaaaaauaaaaaacaacugaggugauggguuggucuucagcggaugccuugguggaugaggcugcuuuuggcugcacuggccuucucccgcucccgccgccgcgcaggguccaacucaaaacagcgccauagccucagggucucaucugcugcugcggaugccacuguggccccaucugggcucauggucagacucaggacccgggaugugugaccuggagcaaaugagaacaguacauacgaaugcugaugcagccauagccauaaaggaggcacugggccacccaccuaccuuuuuguuuuuuuugagacuugcucugucacccaggcuggagugcaguggcgcaaucuuggcucacugcaagcuccgccuccuggguucaugccauuuuccugccucagccucccgaguagcugggacuacaggugcuugccaccacgccuggcuaauuuuuuguguuuuuuaguagagacagggcuucaccauguuagccaggauugucucuaucuccugaccucaugaucugcccgccucagccucccaaagugcugggauuacaggcgugagccaccgugccuggccuccucccuuuuuuuucaaugguguuacugagauauaauucacacaccauaaaaugcauccuuuuaaaguguacaguuuagugauuuuuaguauauucacaaaauuguacaacuguuaaaacuaauucuaagacauuuucaacauuucccauuacccucucuca

SEQ ID NO: 14086 - RNA, 5623 nt, Homo sapiens
ugagagaggguaaugggaaauguugaaaaugucuuagaauuaguuuuaacaguuguacaauuuugugaauauacuaaaaaucacuaaacuguacacuuuaaaaggaugcauuuuauggugugugaauuauaucucaguaacaccauugaaaaaaaagggaggaggccaggcacgguggcucacgccuguaaucccagcacuuugggaggcugaggcgggcagaucaugaggucaggagauagagacaauccuggcuaacauggugaagcccugucucuacuaaaaaacacaaaaaauuagccaggcgugguggcaagcaccuguagucccagcuacucgggaggcugaggcaggaaaauggcaugaacccaggaggcggagcuugcagugagccaagauugcgccacugcacuccagccugggugacagagcaagucucaaaaaaaacaaaaagguagguggguggcccagugccuccuuuauggcuauggcugcaucagcauucguauguacuguucucauuugcuccaggucacacaucccggguccugagucugaccaugagcccagauggggccacaguggcauccgcagcagcagaugagacccugaggcuauggcgcuguuuugaguuggacccugcgcggcggcgggagcgggagaaggccagugcagccaaaagcagccucauccaccaaggcauccgcugaagaccaacccaucaccucaguuguuuuuuauuuuucuaauaaagucaugucucccuucauguuuuuuuuuuaaaucuguuucagcuaaugccuuucuucuuucaugaccuaugucccagcagccuuccuaggggcucuacucuacugggaucagagagcuagauauguccugugggagccuggaccauccaucccucuuguuuguggacagggcuaagcguguuguguucccccaccuccucuguucacauacguauacacacagccuccgugguuuccucugucacuuuuaauuaagacacaaguugaguaagcagccuccacaggcuguauucccaggcccccgcccacccugaccuuuggcccagaagcuacugcuucagugugugggguggaggagugagacuggguccacagugacauuauugcugaccucuucugugugaggaaaaaggccacgagacccuuuguggggccagcccugagugcuccucucccaaguuuuaaggcagggagggggaaauaacuguacagcccuuuuagcccccagcucuggaguggcagacagcaaugaggccacaucccuggagcugcccgggggaagugggugaggaaccaaagccguggucccuguagagcagcuguggggaggggagggccaguccccugcucaguccugaccacauaagccuuggucacagguguagguggagagggcacugacggacacugcccuaaggugcaguccugaggcacuuaggugggcgccuaucuaggccaugcuucucaguuggccuugaccuuggcaauaccuggagcuccauuuugcugaagugcacggggcagccgcuugcccuugguauaagagugauaccagaaguuggagaacagcaugaagaagauggugccauacauccagaugaggugaauaaugacuggguacugguaguuacagcuggacauaaaguaguacugggagaugugcagugagaccaggacaaacuggaucuaggauagagaaagaccagggucagagggaauagugagaggacuagaggggaagaggggguagagaaagagacaaacguugaguagggagagauggggucaaaggugagacagacuggauaaaggcaggauccaggcuaggaauguggggggaugguuauagguaagucaggccaagccccucaccagcugaauggcugucaugugcuuuuuccaccaaagguaggguugugccacagggccaaaggcagauaauccguaguacagguacauuaugacaugcacggaagaguuuaucauggcauggaaagagcccauuccuccugugaguggacaauaagacagggucagcagaguccagccucuggugcccacccuuucccauaguggccuucaccacucacccggggcaaucuuuaccccccaccaccagcuccagggaagcacagagugauggaagacauguaggaaggucaccugcccgucuuucuuucggagaauaaagaucaccugagagaagagugagggaaggggauucagaaccugggcuucuccaccucauucuccccucaaguucucacaucucauauaacuacucacuguguccaucagcucaaugaacuuggagaagaggaagagccaggccacccgaaccaucugcaagaaguugggauagccuuaggaccucauacacuauucuaagagccucccuaaacugggccuugagcacaggccccaaacuggucauaucuaccagguugcuuaugaccuagccccagccccuacuuacccuaagugccucagggcuguuggaauaguccacagggucacagcgccagguauaggugcucagccagcccgacaucaggaacugggaagggauguggauuagaccaccagaguucucccuucccagccaucccuccccuucgcuagcugaggacauggaucugaaccucucuggaaaggagaaaugccaugcucuggcucuauggccugcuccuuauccugcugacagaaauuaaagcccggcaucccaggggcccaccucauagacaauguagagggagagugccaccagugagaaguuguagacaaucaugaagccacggagcuggaagggcuuccgauuagccaugaugcgaggcccaagugagagaacgaaguacacguaggucaggagaauggaggucauuagcaagggggaccccaucagaggguagcccuggauccggggaucuaugaauaagggucaaaggaaucaggaagagucacaggguucgaagggucuucauuugaagggucuacagacaugaggucaggucacaggaucaaggguuucauaggaacucuccauuagaagacagccguagauccagggaucccgggaaagaaggaaggaaagggcugguggauagcgucuuaccugcgugcuucaucaccucuugguacaaguucacaacagccuccauccuggcuaaggacucuggggagguacagagggcggaugucagacagaucccacugcacacccccaucccacagagauaagacacagaaccagacaagacaccugcaaugccucauugcagaaaggacagaacagugaaaggaaggaauuacugggaacuagggggaggaggcaguuugguugaggcaucugcuccccacacauccugcuugccugggaagagcuguuccacccuuccucuccacaccuuacucuccucuccucuccacaguuuuacuuccuggccucccuuccccucuuccuccacaagauaacucucaauuccaggucucuuacuggagaaucuuaccuucucaccaacagggagcucuugaacuccgucucccuuccucacccgagucccucaccuccccagcucugggucuuucuucucuccagggauucuccccuucaaucucuccucuccugcccucuccucuucccaucccucuggacccuuccugaacucucuucuccccagggucccuccugucccugccaggacucucaccucucugggcccuucugucccuccagaaccuuauccucggauuccuccuugccugugcugggacacuuaugucccuacgauucuccucugccuuuccugggacucucaccuccagccucuccucuccagcgcucuccucucuccucucgcagagcccuuccucuccuggagccuggcucuuugagacuccugccccggcggcuccaccugucugacuagaucuggcagcagccccgcccucugcccgccccugcuguacugugcaggggguggaggguggguccgggccacaggucagugccugggggagcaggacccaccaggauugggaaagccaaguaaagccccagacucgccacccacccacccacgugggaccagccugaugagcuaagguccuagauucugagccagaaaccuccucugaccccagccccagccccagcccuggcccaaagcacugcugaaaauccacacccagcauccucuccuaagccggccauaacugcucaguuuguccuacuucagaauggguacaaucacucuucccuuccugggaagggcagggaagccaguggcaugugaagggguuggggagugggggaggucgcaggaaucuuccccucccucagggaggggccccguugggcuaggcccccucccccucagggccugaaggaaugucgggggaaggcucccagggacacaaaagccucuggccagacccaggagagcaugguacugacagucccugagggacaaggcauucuuggaacagagcagggcccagggcagcaggugccccagacucccugcuuccagagaagcaccucugcagaugccaagugaagaggcgcaccucugacaccucccugccccgcacaccccucaccuccaggaggcccggcuucuuuaggcccaccguggucaggccccaagccugcgguccacacccaccucucaccuagcucuccacccccaacagcgaaggugccacgccgagggcuggcacacacgucuccugccugacacaccacgcaacaccuccgugggcugacacgcauggcucccggcccucacgcagcucggccaccgcccaggcacacgcacgggcucacccgcggggccacucacacacgugugcgcgcugccuggccacgcucggauccccuccuuacuugcucccccaccaucgggcuugcuggccgcccaucgccggcagggcccaggccggggcgagggcgccaacacagguuccucccugacacaugggagccagccagccuguuaucucucaaccaccagcccccaauaucaacccacacacccggcaggccaggagggaccaaggcuccugggaggaccucuccccaagcugcaggaaaaucugggugugucucucgucggggaacucagcccgucccuuccuuccuuuaagauggauggaagggaaaaggugccuggcaaaguuaggguagcggggggagggaggggagaggaggagggagagagguaaaugcaggggugguggaggaaggcccggguguaggcaaaugggggccagagacgggggugugggggagggagggugcuggcgaggcccggccccagggagcugggaccucccacccacuggccccgggaacacccucgcccacagccugggcagggcagggcagggcugggccgggcugggccgggcuggccaggcagggggcgccggcacguggagaguccguggaagguccagacucacccguaggggccaggcgggcaacggcggagcgcucggagggagcagggccagagagaaguccccggggccagccugccugccugccacuuccucaucugcugggccgacuuucugucaccagaggggga

SEQ ID NO: 14087 - RNA, 4285 nt, Homo sapiens
gguuggauuuugaaggagccaauaggcgcucggagcggagaguuuaagaggcguaagccaggcguguuaaagccggucggaacugcuccggagggcacggugagaggugguggggcugagccgagguggggccguggccagggggagggggugcuaggccggaaggggcugcagccgaggguggcccugauuuuguggccggccaggagcgaaggggucccuuucuguccccugagcaccgucgccuccuuuccuccagggcuccguaggcaccaacugcaaggaccccucccccugcgggcgcucccauggcacaguucgcguucgagagugaccugcacucgcugcuucagcuggaugcacccauccccaaugcacccccugcgcgcuggcagcgcaaagccaaggaagccgcaggcccggcccccucacccaugcgggccgccaaccgaucccacagcgccggcaggacuccgggccgaacuccuggucagugaggugccaaaggaacugagugagagcagccuucauacuuucucccuggggagccuggucagacugucuucucuuucuccgccccaggcaaauccaguuccaagguucagaccacuccuagcaaaccuggcggugaccgcuauaucccccaucgcagugcugcccagauggagguggccagcuuccuccugagcaaggagaaccagccugaaaacagccagacgcccaccaagaagguaugugucccagaggggcuuaaggcacgggaccugacuguucuuuggauaauaccaucuugcuccuucacuacccuuuaugccaggaacaucagaaagccugggcuuugaaccugaacgguuuugauguagaggaagccaagauccuucggcucaguggaaaaccacaaaaugcgccagaggguaagacccgaaguuccugguuccuggagggaggugucaguucaucuccagggcugagcacagauaucugucuccucuuccuaucuaagauugagggcaagggagguguugauuuucccagcgucuagacucacuccguugccacagguuaucagaacagacugaaaguacucuacagccaaaaggccacuccuggcuccagccggaagaccugccguuacauuccuucccugccagaccguauccuggaugcgccugaaauccgaaaugacuauuguaagugcauccuuauccucgccucaugcauggagaaagagggccugggaccacacaaacaaggaagcucaugcucuucucuccaccucugacagaccugaaccuuguggauuggaguucugggaauguacuggccguggcacuggacaacaguguguaccuguggagugcaagcucuggugacauccugcagcuuuugcaaauggagcagccuggggaauauauauccucuguggccuggaucaaagagggcaacuacuuggcugugggcaccagcagugcugaggugcaggugagacguguccagugcugucauucucaccagucccaaugggcuugcacagcuggaggauauuaaugccaagucccaaucucugauccuagugggcuucucucucuagcuaugggaugugcagcagcagaaacggcuucgaaauaugaccagucacucugcccgagugggcucccuaagcuggaacagcuauauccuguccaggucagugguuuuuguuggucuaugguagucugauauuugcccacccuccccuugacuguacaccccugaacugaaccagcucuggcuugcuugcauuuggugcugccacagaaccugauucccuucuuuccuccuccagugguucacguucuggccacauccaccaccaugauguucggguagcagaacaccauguggccacacugaguggccacagccaggaagugugugggcugcgcugggccccagauggacgacauuuggccaguggugguaaugauaacuuggucaauguguggccuagugcuccuggagaggguggcuggguuccucugcagacauucacccagcaucaaggggcugucaaggugaguaggguugggcugaagccucugcagacccucaccuauaaucuggggacuguuaaggggagaagggaugguaggauuggacuggguuaaucugugaccccuagagcuccuugucuggcucuaguaccugcugaccccaccuuuauuccaucuaggccguagcauggugucccuggcaguccaauguccuggcaacaggagggggcaccagugaucgacacauucgcaucuggaaugugugcucuggggccugucugagugccguggaugcccauucccagguaaucuuuugccuguuccugccucucccacaugcauucuuaccgggcaacuacauucacuccaauggcuucaccaacucuaugcccuggugauucccaaacuucuaacucagcucucacucaugagcuucauuuccaacagucuguggcuaucuccaauccuauguccuauaggcaccaccaccuugaucugucccaaauuaaccuugucacuuccccuugccucccugaaauguguuccuuccugucucacauugcuuuggaauggcagaaccugcucagaaaucugagaaaccuccuagaauuuuucauccuccucaccaggaucuaucaguuuuaccucaaaauaucauugacaucuguccccuccccucagccucauccuuccaaguggaggcccacuacaauggcuuccucacuggugucaagcauucuuuguuaucuccugcaaugcauccuccaugcuguggucuguuauacuguacuguccuuaaaccugugauggcuucccaucacuuauggcauauaauccaaauccauuagaaagauacuugaggcucucuccuuccacuccccccacauucagccuucacuguagauauggacucuagagccagauggcccaaguuaaaauucuggcucugucaucuacuaaacuugaaugugaccuuuggcaaccuauugaacuuccuucugauugauuccucaucuauccaauggauaauacagaugcucccugauuuaagucccaguaaacccacuguaaagguaaaaaaugguuacaucagcgagugucuauaauuugccucucaaggaacuuuuguauggacuaugaucauucaacucugagucuggagcauguggcagggugccuaacacuagaaugggcucaguucugauuuaaguagccuuggcuauaugucaugcccacaccagcuccucuccacaggugugcuccauccucuggucuccccauuacaaggagcucaucucaggccauggcuuugcacagaaccagcuaguuauuuggaaguacccaaccauggccaagguggcugaacucaaagguaaguggcuaggugaaaagccggacauaaaaggccacauaauguaugacugaaauguccagaauaagcaaauccagagaaaaaacacauuaaugguugccaggggcugagagaggguaaugggaaauguugaaaaugucuuagaauuaguuuuaacaguuguacaauuuugugaauauacuaaaaaucacuaaacuguacacuuuaaaaggaugcauuuuauggugugugaauuauaucucaguaacaccauugaaaaaaaagggaggaggccaggcacgguggcucacgccuguaaucccagcacuuugggaggcugaggcgggcagaucaugaggucaggagauagagacaauccuggcuaacauggugaagcccugucucuacuaaaaaacacaaaaaauuagccaggcgugguggcaagcaccuguagucccagcuacucgggaggcugaggcaggaaaauggcaugaacccaggaggcggagcuugcagugagccaagauugcgccacugcacuccagccugggugacagagcaagucucaaaaaaaacaaaaagguagguggguggcccagugccuccuuuauggcuauggcugcaucagcauucguauguacuguucucauuugcuccaggucacacaucccggguccugagucugaccaugagcccagauggggccacaguggcauccgcagcagcagaugagacccugaggcuauggcgcuguuuugaguuggacccugcgcggcggcgggagcgggagaaggccagugcagccaaaagcagccucauccaccaaggcauccgcugaagaccaacccaucaccucaguuguuuuuuauuuuucuaauaaagucaugucucccuucauguu

SEQ ID NO: 14088 - RNA, 807 nt, Homo sapiens
uccucuacaucaaaaccguucagguucaaagcccaggcuuucugauguuccuggcauaaaggguagugaaggagcaagaugguauuauccaaagaacagucaggucccgugccuuaagccccucugggacacauaccuucuuggugggcgucuggcuguuuucaggcugguucuccuugcucaggaggaagcuggccaccuccaucugggcagcacugcgaugggggauauagcggucaccgccagguuugcuaggaguggucugaaccuuggaacuggauuugccuggggcggagaaagagaagacagucugaccaggcuccccagggagaaaguaugaaggcugcucucacucaguuccuuuggcaccucacugaccaggaguucggcccggaguccugccggcgcugugggaucgguuggcggcccgcaugggugagggggccgggccugcggcuuccuuggcuuugcgcugccagcgcgcagggggugcauuggggaugggugcauccagcugaagcagcgagugcaggucacucucgaacgcgaacugugccaugggagcgcccgcagggggagggguccuugcaguuggugccuacggagcccuggaggaaaggaggcgacggugcucaggggacagaaagggaccccuucgcuccuggccggccacaaaaucagggccacccucggcugcagccccuuccggccuagcacccccucccccuggccacggccccaccucggcucagccccaccaccucucaccgugcccuccggagcaguuccgaccggcuuuaacacgcc

SEQ ID NO: 14089 - RNA, 807 nt, Homo sapiens
ggcguguuaaagccggucggaacugcuccggagggcacggugagaggugguggggcugagccgagguggggccguggccagggggagggggugcuaggccggaaggggcugcagccgaggguggcccugauuuuguggccggccaggagcgaaggggucccuuucuguccccugagcaccgucgccuccuuuccuccagggcuccguaggcaccaacugcaaggaccccucccccugcgggcgcucccauggcacaguucgcguucgagagugaccugcacucgcugcuucagcuggaugcacccauccccaaugcacccccugcgcgcuggcagcgcaaagccaaggaagccgcaggcccggcccccucacccaugcgggccgccaaccgaucccacagcgccggcaggacuccgggccgaacuccuggucagugaggugccaaaggaacugagugagagcagccuucauacuuucucccuggggagccuggucagacugucuucucuuucuccgccccaggcaaauccaguuccaagguucagaccacuccuagcaaaccuggcggugaccgcuauaucccccaucgcagugcugcccagauggagguggccagcuuccuccugagcaaggagaaccagccugaaaacagccagacgcccaccaagaagguaugugucccagaggggcuuaaggcacgggaccugacuguucuuuggauaauaccaucuugcuccuucacuacccuuuaugccaggaacaucagaaagccugggcuuugaaccugaacgguuuugauguagagga

SEQ ID NO: 14090 - RNA, 3991 nt, Homo sapiens
gcucaccugagugcagguuaggcaggugaagugucuccccggaaaccaagcuagagugccccaccugcucggcccugccuucucggaucggauccagcacauccaggcuucucgugaguucccccauugucccccaacgccccaccgcccccauguucucccacucgcuucuccccugagaaccuccaccccgcccccagccugacacccguugucucagcacaccugugcaagcauuuucagaccaacgaagucacagcccaggggaaugcugggacugacuccacggccacgcccaccucccccacuuccuugagagcaucggcaccagcccccgcccaccucggggguaggggucagccucugcagaggagucuccgggaggacagauaccucgucaggauguaaccugugcacggccacauaguaauauucccagaaugacccaggaccuacgucuucugcccuguccugccuuggagggguaacaucguuuucauguauucaaaaagcacgcuuugagcaucuaugcaggcucuaggccccacuggaauucugaaacgaagaugucaggugacucauccccaccccucaagauaaauguuauugucuucacuuuucagacaaggagacugaggcucuaagagacgaaccauucaggcuuccuggccccucccccagaccccucuccugggcucugcagggcucugggcugacuaacccacacccacacuuagcacaggcacuggccugcuugcuucugucucugucuucugcugcagacuggggcuccuugaaggcagggaccucaugugcuuuauuuuugcccaaugugagacaugcuuuccucuggaggacagguuaaaucagcagccacuguuaggugccuggccauguuccuaccggugggaaggacuggagcugggguucaaauccagagcccuccuuuuuccuuugcuccacuuuagagaaaucguggaggaggauggcaugggggaauggcgaguguggagaagagcaaggggagcagaaagaccagugaggagguggaggcgggagccaaggauacgagagcagggaacuggcuagagaaauguuuagagguggagccccagggacaggacguggauuagauacagcagagggaggaggagcuggcugagagggcagugaugccaugccugaagugaggaacgcagaaggaacagguuggaguaagacaacgagcuuggguugggaccuguugcaucacagggacaucaaggugacaauugacucaggacggagauguagguuggagagaggaauuugggaacuggcagcuuauauuaccaaacucauggcugugagauuggaugggauguuaggggagggaggguguuaggggucugguccuaacccacagagaaggaggagacacagcccuaaaagagaagugucaaggucagucaggcuucugguuccagaaggguuaagucauaagcgcccccuccauccccacagcuccucccgaggaaccaguggugacagcugaggccaugugaguaggauccugaaugaggcuuuaucucuggcuguucgucccaucguccaccguggcaccagcucccucagccagccgggaugggaccagcgacugagagagccagaggcagagaggucagggccugggugaggggauucccuggaggguuuuaggggguacccuaugggcaggguacuccccuggggucauuggagagccauucccaagggacaguacugcagagggggcuaucccaggggagauucgggggaacacugggguggauucucagggaucauccccaaggcucccaggugggaccgugggggacaggugggcugggaagguaagacugugauccuuccccuacaggugagggugaccauauccuggacugugagaggaaugggacucugggccuguagcugccaagcagguggcaggugcuccaggcugugaucugaacccucugaccccugacauugaccuccuacccugaccccugccugaccaagccaugucugaacaggaggcucaagccccagggggccgggggcugcccccggacaugcuggcagagcagguggagcugugguggucccagcagccgcggcgcucggcgcucugcuucgucguggccgugggccucguggcaggcuguggcgcgggcggcguggcacugcugucaaccaccagcagccgcucaggugaauggcggcuagcaacgggcacugugcucuguuugcuggcucugcugguucuggugaaacagcugaugagcucggcugugcaggacaugaacugcauccgccaggcccaccauguggcccugcugcgcagugguggaggggccgacgcccucguggugcugcucaguggccucgugcugcuggucaccggccugacccuggccgggcuggccgccgccccugccccugcucggccgcuggccgccaugcugucugugggcauugcucuggcugccuugggcucgcuuuugcugcugggccugcugcuguaucaagugggugugagcggacacugccccuccaucuguauggccacucccuccacccacaguggccauggcggccauggcagcaucuucagcaucucaggacaguugucugcuggccggcgucacgagaccacauccagcauugccagccucaucugacggagccagagccguccuucuucucacagcggccucagcguccccagagccgagccagggugugagugcaugugaacguugaguacacaugagugcguguaugcccccaggcugggucagcucuucuguggauugcauggcgugugauuaaaagcccauguguucccacacauccacaucaugggaagguuaaugugugccuccuuggaacuggguguugguguccauggaacuuccucucuguaucucaggucaguaggcgcagaaacgccucaugaugaagauucuugagccccauuuccaagaccccucacauccaauccuguccuguaacauccaucaaggauuuccauaggggugacuggugcccacccaagacugcaccagugccugcucauugaggagaguaacugcuggccaggcagaaagaauaugggcucugcaaugagacagaccuggaggggacucucccguugagcacuagcagcuggaggaguugggaguucauggcuaucaugguuguguuaaucgauuguggggaugaaaugucauuguguauggaaggcggggcucauggcugauuggcaauaaaauggcggcugccguugucauugucuccaucucaggaucucaccucagagacccuuccuccccuaccccaagccccgccccauccaaagcaaacuccucacuccuaucucagccucauaaaccgugccuugagggucuccucagucaggccugugguuucuccucuuagguagggagaggacggaguggaugccagccuugggaagguggucgguuuccagucccagggagaggugagggaccugaguccuucgcauuugcucacaugcuaguucaauaugaggccuuaaguguuugguguuaucagcugguuucucuggcaacugcaccucccuucgguugugccucuucagcggauucccugagggugguugggaggcuacaucucccugccccaccucugaaaccagaacaucccacgucugggcaguggcugcaccagcuggccugcucuagguuccugggcaugggagagguguuucaaauccccuaggguggugagagucacuuccugcuuggagucagcccugggaggaucuccccucuguagcaugcagugccauuuccuggcugauggugagccacgggaagcagcacucaaguguuucaucacuuccugcuucucgaggugcagacugcaugaagcccguggaagaugcccagaaaagcagggaaaugagaccugucuccaaagaaac

SEQ ID NO: 14091 - RNA, 1391 nt, Homo sapiens
gauggaacauguagaaagggccaugggagcaaggagaaaugacuuucucuaggucaggguuggggaagacagguaaaagcaugaugaagaggggacacuagcccaacuguguagaugaaccaaccugcccacucacagcagcgcuccugacuaucgggaaggguaagcacuggaugagcuaacacgggggacguggaagcccuggccaggaaucugcaagagagaaaugaugccaucugucuuggcucuaaagggauaugggugaccacaugagcuuccuuuuaucuuuuaaggccugugguccugaaagggaaucagagucaauaaaggagcccaucuguguggccucuuaaggaugaagccccauguaggcuguucaggcuggguguccagccgagggcaggugcacaagacuuuucgugccuccaccuguuggcugugugcccgucuaaguuucuaugcccaguauggccccuggcagucagcuguaagucccagaugaggcaucucuuuucccuuucugugccauuaaccucugccugcagcccccgccccuccaccgagagcacccuacagcaccagaaggaaacgucucugauugcaggagcgagacuuggaagcgcuggucaaaagguuuaaaacagaccuccacaacugcguagccuauauucaggaaccgcggcugcugaaggagaagguucgaggucucuuugagaaguacgugcagcgagcagacaugguaagcucagccuccccuccugccaugcacugaccuccggggucuccucucccucacugagaaucuccugggccccgucagguggagaucgcagggcugaacacagaccugcagcaggaguacacccggcagcgggagcaccuggagaggaaccuggccacucucaagaagaagguggucaaggagggcgagcugcaccgcacagacuacguccgcaucaugcagguaccugcaugcuccccucagccccuguggaggccaagccauccaagaugagagaucccaucaagggucccucugagaccaccugucuucagggcuccccaggugucugggggcccaguagcucccccuaaagucuuauuuuggcuccucuccucugagcucgucuuggcugugacuguggcugagagcucaccuaggagguuuucuaggcacuuccaugcugcacccuggccuccaccccacccaaugcccaccucccuucuccacauacccgauuccucuuuucuacaccaucuuuauccagagcacaccuguguccccugccucacuccucucaucagccccuuggcccucuagaccuucauccacaucaucuuaccucuccugagccacuuucccuucucucuuccauucccaacucucauuu

SEQ ID NO: 14092 - RNA, 923 nt, Homo sapiens
agcagccuuuacauccuuguuccucaggcuguagaugaugggguugagcaugggggucaccaccccauagaaaagggaaaugaguuugucugcaaggucuugcuugucugcccccagcggguccuuagacuugggcuucccauacaugaagaggauggucccauagaagaugaccacgacugugaggugggcagagcagguggagaaggccuuuuuccuccccucagcugaggggauccucaggaugguggcaaugaugaagacauaggagaaagagaugaacagaaccgggacccccaggaagaucacauuggucacucccauacugaucacauugacagagauaucagcacaggccaacuucaggacagccagaaucucacaggugaagugguugaugauguugucuccacagaagggcagccucauugcaagggaugucugcaccauggaagcagugcuuccagcuacccaggagccggcagccuuaugggcauguaggcagccuugcucaugaccacaggguaccuaaggggguugcagauggccacguagcgaucaaacgccaucaugcucaggagaacacacucuguggcucccauggcaaaggagaggaacaucugcacugcacaggcugagaaggagaugguuuuccugggggucaagaagcugucaaggaugagggggacugaggauguuguauagcagauguccaggaaggagagguuccccaggaagaaguacaugggcaugugcaggugggaguuggacacagucaucaggaugaggaccccauugcccaguaggaucaccagguacaucagcaggaugagcacaaagaacguuuucuccagcuuugggugggcagagaggcccaggagaauaaacucggucacagaggcugucugauuggcacuuaccau

SEQ ID NO: 14093 - RNA, 906 nt, Homo sapiens
ucucccugagaaugugcuacuuugucucucaguuucaacacagcuuucuucaccuccuuguuucucaggguguacacaacaggguugagaaggggugucagcacaguguagaaaauggccacaacuccauccacgacgucccuggagccuggucucagguaaaugaaaacacagggaacaaaaaagcaaaggaccacgaugcagugggaggcacaggucugaaaggcucugugccuccccucugagguguggauccgcaggauggaacagacgauggacacauaagacagcacuaucaggagaaagcagcccgaggccacuagcccaauguccacaaagaugaccaucucguuggcugaggugucugcacaggccaguuucaggaugggcggugcaucacacaaauagugcuggaucugguuggguccacaguagggcaaauggaaagucaauauggucuggacagcagagugcagagagccacugagccaagugcugguggccaggagggcacaucugcucccacucaucaugcugguguaccugagcggguaacugauggccaaguagcgaucauaggacaugacuguguagaggaaacacucggugcuccccaggaaguggaaaaaauagagcugagccacgcagcuguggaaggagauagcccugccgcuuggggacaccaaggucaucagcauuuugggcaccgugacaguggagaaccacaugucaaugaaggacagguuggugaggaaguaguacauggggguguggaggugagaauccacccugaucaccagcaggaugaggagguuccccagcacagugagcacguaaaccaccaggaagauuccaaagaguggggcguccagcccuggggcauggggaaggcccgugaggaugaac

SEQ ID NO: 14094 - RNA, 867 nt, Homo sapiens
gcuccuuucacaucuugguuccucaggcuguaaaucaagggguuaagcaugggugugaccaccguguagaaaaccgcaaugaucuugccgccagcccaggaggaccucgacuguggucucauguccaugaagauggcagucccauaaauaagguuaccacugucaaaugggagguacagguggauaaugccugauaccgcccagaggcugaccgcauccugagaacagauugaaggauccggacauaggaaacaacaaugaggaggaaagggaugaagacaaugaugauacugaagauaaaaacaaccagcucugugaaugagguguuggugcaagccaaccucaggacagaaaguaccucacagaaaaagugauucaggauauuaggcccacaguagggcaaacucaacgugagaacauugauaaccauggaacucaggaagcuacuggaccaagaaauaacugccaguugaaugcagguguuuugguccauaaugaagguauaaugaagaggaugacaaauggcuacauaucugucauaagccaugacaccaaggaggacacaaucauuccaaaggagagggagaaguacaucugaguagcgcagcuggagaaugagaugguguucuuuuuccccgccauguuggacagcauuugggggacauugguggauguguagcaaauguccagaaaggauaaauuagugaggaagaaguacauggggguuuggaggagagguuccaucuagauaauagugaugauuauaacauuuccagccaccguugauaaauagaacaagaacauaauaaaaagaauaagcuguaucuuugguucagaggacaaccccaggaacacaaauucagugac

SEQ ID NO: 14095 - RNA, 5588 nt, Homo sapiens
auccugggucccacauccacugcuacagaggcagggaagggccacaauguccagguaggccccaacaguuucucuugucuggcaggucuucuauuacuccacgagcaucuucgagaaggcgggggugcagcagccuguguaugccaccauuggcuccgguaucgucaacacggccuucacugucgugucggugagucuuugcuuacuggcccccccagccaaaccccagggaggaggcagugccaucuuccccacuggucuuugcagugcccugugacuuucucagcucuugaggcaaggccucuggguggguggguucagaagggcacuaggcagggguggcacugacacugucucugcccacagcuguuugugguggagcgagcaggccggcggacccugcaccucauaggccucgcuggcauggcggguugugccauacucaugaccaucgcgcuagcacugcuggugaguugcuagguucuggagagugagggaugcgggagaguuugccugggcuucauaucccaaaaugccugucucagccccaggcuggcaggccuuuugguggcugcauucucccuggcugugggucugacuuucuggcuccugaaguugucuccuuccaaaccacacacauccucucuugaacuugcuccucccugcuugauggauucucagcgcagcaccucuggucccagaccccaaacucucaccuccuuaaggaauugcuuugccuaauauuaacccuuuccaaucuucaucuguagccucaauucaucuucacagcaaccccgggaaguagugcuguccuccccauagaggcgcagaaacaugccuugccucauucaguucacacgacuggagguguaguucaguucuucccauuuuaugggggaggaagcuuaagucccagugagguuaguaacuugucagauaaaggaugaagccaggaaucaaccucagucccaggccugugacugugaccgcugugcuaacccugugccuggcacucacacacaggcacucguuuauuuagccucugggcaaggaaagcaccaugacugucauuuuacagcucaaccugggcuuggaaaguuuggugguugccgaaaggccagacaggcagcaaguggaaagcccauaaauuuucuacccuggccuccucaagaaugguuauaugcagaaccguaugcuuagcgcuuacucugugccagccugagcugggcaccucacacgccuuagaaccugaauccaccccacccccaggaauguucugcauccugccacaggcggacugugcugcaggcacagacaggggaccauggggccucuuagcaccguccacaugcacaccacauuaccacucccagcggguggacucaacacuugcagccacccugcaggacuuaaaucauuuuguucggaugaggaaacuuaggcccaaugcuggauacacaacaaauccaggaccauccccaggcuuccugccuucucgcauagcucugcucuggccucuguagcuucuguuuccccugaggauccaucacaacccagucuaacuuuucccccucuccgucauccucaacaggagcagcuacccuggauguccuaucugagcaucguggccaucuuuggcuuuguggccuucuuugaaguggguccuggccccaucccaugguucaucguggcugaacucuucagccaggguccacguccagcugccauugccguugcaggcuucuccaacuggaccucaaauuucauugugggcaugugcuuccaguauguggaggugagaacccccacugucucuauacucacccgcacgcaugaccccacagugcugugcaaagugcuggcccagcauucucauuaggaaucaugcugaggaggaaacugaggguaggaagcccaggucacaugaccaagaaugcugaccucaacuccaggguucuccccuuagccuugaauggugcuccuggagccuguuacauucuagguacaagcguggucucaguuaauuaugauagcaucccuggguagguggauguucccuuuucagcucaaaggcccaaagguaaagugacuuauccaaaguccuacagccaggauguagggucaugacuccaaccaagugugucugugugucuuucagcaacuguguggucccuacgucuucaucaucuucacugugcuccugguucuguucuucaucuucaccuacuucaaaguuccugagacuaaaggccggaccuucgaugagaucgcuuccggcuuccggcaggggggagccagccaaagugacaagacacccgaggagcuguuccauccccugggggcugauucccaagugugagucgccccagaucaccagcccggccugcucccagcagcccuaaggaucucucaggagcacaggcagcuggaugagacuuccaaaccugacagaugucagccgagccgggccuggggcuccuuucuccagccagcaaugauguccagaagaauauucaggacuuaacggcuccaggauuuuaacaaaagcaagacuguugcucaaaucuauucagacaagcaacagguuuuauaauuuuuuuauuacugauuuuguuauuuuuauaucagccugagucuccugugcccacaucccaggcuucacccugaaugguuccaugccugaggguggagacuaagcccugucgagacacuugccuucuucacccagcuaaucuguagggcuggaccuauguccuaaggacacacuaaucgaacuaugaacuacaaagcuucuaucccaggagguggcuauggccacccguucugcuggccuggaucuccccacucuaggggucaggcuccauuaggauuugccccuucccaucucuuccuacccaaccacucaaauuaaucuuucuuuaccugagaccaguugggagcacuggagugcagggaggagaggggaagggccagucugggcugccggguucuagucuccuuugcacugagggccacacuauuaccaugagaagagggccugugggagccugcaaacucacugcucaagaagacauggagacuccugcccuguuguguauagaugcaagauauuuauauauauuuuugguugucaauauuaaauacagacacuaaguuauaguauaucuggacaagccaacuuguaaauacaccaccucacuccuguuacuuaccuaaacagauauaaauggcugguuuuuagaaacaugguuuugaaaugcuuguggauugaggguaggagguuuggaugggagugagacagaaguaagugggguugcaaccacugcaacggcuuagacuucgacucaggauccagucccuuacacguaccucucaucaguguccucuugcucaaaaaucuguuugaucccuguuacccagagaauauauacauucuuuaucuugacauucaaggcauuucuaucacauauuugauaguugguguucaaaaaaacacuaguuuugugccagccgugaugcucaggcuugaaaugcauuauuuugaaugugaaguaaauacuguaccuuuauuggacaggcucaaagagguuaugugccugaagucgcacagugaauaagcuaaaacaccugcuuuuaacaaugguaccauacaaccacuacuccauuaacuccacccaccuccugcaccccuccccacacacacaaaaugaaccacguucuuuguaugggcccaaugagcugucaagcugcccuguguucauuucauuuggaauugcccccucugguuccucuguauacuacugcuucaucucuaaagacagcucauccuccuccuucaccccugaauuuccagagcacuucaucugcuccuucaucacaaguccaguuuucugccacuagucugaauuucaugagaagaugccgauuugguuccuguggguccucagcacuauucaguacagugcuugaugcacagcaggcacucagaaaauacuggaggaaauaaaacaccaaagauauuugucucuagaggcucagcugacaaaaucugggagaaguuugcuuuuguaacuacaggcaggcuuuuuucucccugacaugaagagggguuguaagaagggugugagaaaggaaaacugguacuuagcaaauggaaauaccuauauguauuaccauuagguauaaagaaucuaugaggacauccaucugcaucucaacaaagaagagcagguugcgaagaauaugcccugccugagccuggggacagggcgguuaacuggugaagggcugaggccagaugaaaggaagccuuaucgugugcucccaaaagacuucuguugaaaggaguuauccggguccccgugcgggagggggugcgggggcagggcaagaaggagaggccgggggcccagguaucuuacuccuacgacgcugcucacucagggcuguccccacuggaccagaaaggaaacagacgggguggggugggguggggugggguggggaugggugggagccccgcgccgguggccggacgcgaggacuacaaggcggauggcgggcggagcucauucacacucgagggcccagaacguuggcagagccaggcagcacccgagccccgccccggcccagagguucagaccccggucugaaaaggcccgacaauccacucgcagcugccucccgcccugggucaguaucgacguccccgagcaccgccauuucccaaacugcaaaaugucagcgcaggcgcagggaagccggcccgcccucagcgugguccagagugccgcgacggcacagcugccggucgguccccugacgccuuuccucuaggggccgcaauccaccccgggguagaagauuuggggccaagguucggccgccuacugccggggucgauggcgcauccucuccagaccucacagcgguccccuaagccgggccaccggcggcgcacggacacgauuggggaugggcggggccaggugguuucuccaccaaucagaggcgcauuguugggcccgacgaggggcgggcuccaagacuccaccaaucacacccuggcgguuccaggcgcuggcccuuggggacgaccugggcgccugcuugccaggcgaugcgguuuacucuggagggggugacggugacuuguguaucgcugggcaucccuggggacguagcucacccggguuccuaucccgcguaaggugacgucuacgguuucugacgaaaagggguaaauagauaacgggacuguucuccaggccaccaucuuuucccagcagugcuuaguuguuucacugacaguguuaugagaucuuucauuugaaaucuuaggcgcaaaaucuccucucccuggaagccuucuggaucagguuuucccgggaacacuacaucggcuuguauuuccuccaucaaagcgcucuccacgcuguaccggaauugagugucuuuccaccacauugggggcgggggcggggacgagggcggggguuggggggguagggcagcugccgcaggaacaggacugagccauuccuugguccccacuucccaccacagacucuggucaggauuauuga

SEQ ID NO: 14096 - RNA, 21376 nt, Homo sapiens
ggccuucgccggggguaggacuccggccuugguggcggguggcuggcgguuccguuaggucugagggagcgauggcgguacgcgcguugaagcugcugaccacacugcuggcugucguggccgcugccucccaagccgaggucgaguccgaggcaggauggggcauggugacgccugaucugcucuucgccgaggggaccgcagccuacgcgcgcggggacuggcccggggugguccugagcauggaacgggcgcugcgcucccgggcagcccuccgcgcccuucgccugcgcugccgcacccagugugccgccgacuucccgugggagcuggaccccgacuggucccccagcccggcccaggccucgggcgccgccgcccugcgcgaccugagcuucuucgggggccuucugcgucgcgcugccugccugcgccgcugccucgggccgccggccgcccacucgcucagcgaagagauggagcuggaguuccgcaagcggagccccuacaacuaccugcaggucgccuacuucaaggugcagaccugccuggaaccaggcggccgggguccuucuggggagaggaguguugcaggggaccugaggagcuugggggaucggggaaguguccgcagggaggggaaaguggccuccuggcuggggagcucuccucggagccggggagagcugcucccuggcaggagaccuuccucgcccaguucgcaugggcagaugcuaaccccaaagguccagccugggguuagggcacaggccaagcaaaacucauggccauuuuguucccugggaaaucuccuggaaggaauuaaagcggcaguuugggucucccauucugaugucauuguaaguguccgagugagaagcuaguagcggucuacaauaucucccuuccgguugguuuuccaguggugcuuuuccugcuguuugauucagcagcucucuuucaggaugugagguugccacgucgccagcaggggcugccuggcccuuucugugugugugugggggcgggggggggacccucuggcuagucugccagguuuacaaagaaaaugaguauuuuucggaaugccagagugccauguguccaaguguacacuugggcuuggagcguuccaggcuuguuuggugguggugauggugacgaugaugaugaugaugauagccagcacauacuuccaggcacuauuuuaagcaguuugcauuuauuaacgcauuugcccuaaucuucauaauaucuugucagguagaugcuguuauuagucccacuguauuggggguggggggagaaagaguugugcauuauaucugguauaucuguuguuuaaaagaccuucgauucgaucuaaagagacacuuagagacucuuggggaccucagauuuccaccccuccacagcauucugccuacacaguuccccucauuuuuccuaguuacucggaagagcgcuggacuugaaaucaaaauaauugcguuaugucuuugguuaugucgcuucaucauagcacuuucuaaaacuauuugacaaacauguauugcauaccuacugcauuccaguucuuguacaaguaauuaaaugcucgacuaacgucuuugcuuugucuugcuuugcuguuaagaguuacuguaguaagggcuacugcaagggcauauacuuagggcugcgggagcacaaaggagggagacucuagcuuuaucucagagaaauuagacuucaaagaagagguaauauugaagccugcccuaaguauugccagggggagaggaaagaaggcuccuccagauagagagaaaaguagaaccaaagcaugauguauucaggaaaaaaaaugaacucuugugauugcaaugucgagauguguguggggaguaguaggagaggcggcuagaaaagucagugaggccagauuuggaagagaauucugcggacugcagggagccauccucagauuuggguuuuaaaacgcuuauucuggaagccauggugaaugagccuuggaagaaggagaaagugguggcacuugauuaggaggcagacauuuguccacaagagaggagguuaaguaccucagugcuuagagaguaaagaaggcuggggguggagagaggagugaggacaugagggagaacagagaaaggcaggagcagcgcugaaagacacaagagcuagaguaauuccaugaaagggacagaccugaaaaaauuucuaauuuuacaguuaaagaaacugagguacagagauggggaguuauuuaccuugggucaccuaaccagggcugacuccuuuagugugccuuuacuaguaccaaugauaagaaaauaaguuuucuuagcauauuaaucauaccaccuaaaauuuauugagcacuuaaucugugcccagcaccauguauuacaggcugcauauuaucucguugaacucucaacaaugcuaggagauagcuagagaaugcuaucuccagaugauagauuagggaaacugaguuuagaaaguaaacuuuaaguaucuugucuacugcccagccagucagugagucauuaagcccagaugugaugcuggccugucucuuuucuuucuuucuuuuuuuuuuuuuuuuuuuuugagauggagucucgcuguugccaggcuggagugcaguggcgaccuuggcuuacugcaaccucugacuucugguuuucugguucaagugacuccccuaccucagccucccgaguagcugggauuacaggcacgugccaucacauccggcuaauuuuuguauuuuuaguagagaugggguuucuccauauuggccaggauggucuggaucuccugaccuugugauccaccugccucggccucccaaagugcgggauuacaggcgugagccaccgcacccagcccucuuuucuuuugagacggaguuucgcucuuguugcccaagcuagagugcaauggugcgaucucggcucacugcaaccuccgccuccuggguucaagcgauucuccugccucagccuccugaguagcugggauuacaggcacaugccaccacgcccagcuauuguuggucucaaacuccugaccucaugauccgcuggucucaaacuccugaccucaugauccgcccgccucagccucccaaagugcugggauuauaggcgugaacccccgugccuggccacggcuggucucuuugauaccaguguccacauaguuaauuacuagaucaucagugauuuauuugguuggauucuauauaugaaaccuguguuacuuugacaugcuggaguccauugcugugggcauuguggucuguagccuauuucuccccccuuggauuucuuuuuuuuuuuuuuuuuuuuuuuuuuuugagacaagagucucgcucugucacccaggcuggaguauggugcugugaucucggcucgcuguaaccuccgccucccggguucaagcgauucuccugcuucagccucccaagaagcugggauuacgggugugcgccacaacgcccagcuaauuuuuguauuuuuaguagagacgggguuucaccauguuggccaggcuggucucaaacuccugaccucaagagaucugcccccuucggccucccaaagugcugggauuacaggcaugagcuaccgcccccgaccacccccucagauuucuuagagcuauuuguuugaaccucaugagcccugagcuuugagucagaaaauacuaugucuggacuuaguaaaggaccuuagaauuuuuagccauccaccuuuucccuaaaugucucaaaaauucuucauuuuauuuuaugcaaaaaaaaauuuuuuucuaggaaaauucuuaggcauagucuguuagcugcucuuuuuucucuaccccuaaauccuugaagccacagaauuucuucagcucaggcauuacauuugauucaugaaauauauauauguauuuuuuuuuuuuugagucaggguccugcugugucacccaagcuggagugcuguggcaccaucuuggcucacugcaaccucugcuucccaggcccaagcguccucccaccucagccugcagaguagcugggacuacaggcauauaguaccauguaauuuuuguauuuuucguaaagacaggguuucaccauguugcccagacuggucuugaacuccugagcucaagugauccaccugccucggccucuaaaaaugcugggauuacagaccugagccaccgcacccagcaugaaaacauauuaugugggcagucagucuuucacagcacuccccauacaauaugaccuuuguuuuaaaauggaacauugcuacuuccuguaaucuggggaaccccuaaaucugacuugggaaagagcuacaaaucugcccagggcacuaugcuccuaaucugucguggguaguuccugcaauaggugugcuuccuggggcuggcaggggcugggcacgcugaguggagggcucagggaggcagggauuuccuguuuauguggacugcucauguggacacaaacguucagagauuggaugugagcauuauccaccuucucaugcuucauucuuagaucaacaaguuggagaaagcuguugcugcagcacacaccuucuucgugggcaauccugagcacauggaaaugcagcagaaccuagacuauuaccaaaccaugucuggagugaaggaggccgacuucaaggaucuugagacucaaccccauauggugaaaaaaacuuuauccccuucuuucuuucuuucuuuuuaaauuuauuuuagagacagagucuugcucugucacccaggcuggagugcaguggcuugaucauagcucacuguaaccucaaauucccggacucaagagacccucuagucucggccuccugaguaguugggacuacaggcaugcauucuuuuguuuuuuuuuaaaugacauuacuaagguuguuuucuaauuacauuacagaaguaaugaauguucauuguauaacauuguagaaauguagguaaguauaaaauaaaaaguaaucauuuguaauaccgccaccuuaagaaaaccaguuuauauuuugcccuauuuuuuaagucuuccguauauaauuuuuucaucuaauuugguguuauaucauguaugcauuuuuuaucaucuuuuuuauuuuuuuugaggcagggucucacuuuguuguccaggcugcagugcaauggugugaucauagcucacugcagccuugaccuccugggcucaagugauccucccgccucagccccacaaauagcugggacuagaggcaugcaccaccauacccagcuauuguuuuuauuuuuuguagagacggggucucacuguguugcccaggcugauuucaaacuccuggccucaagcgauccuacugccuugggcucccaaagugcugggauugcaggugugagccaccauggccagccccaucaucauuuuuuaacuaacauuauuaucaugagucuuuucucaugucuucaguuuuauuugaaaacauaauuguuuauggcugcaugauaguccaucuuaugcagagacuauauuaauucacuagucacauuuuuuuggucauguauguuuuugauuuucacuacaauaaauguuacaguauccuucaauguucucauucuauuuguuuagcaggaaaaguuccaaaggagggacugucugugaugauauagcauuuuauagagaguuuaugguuccuuacauuuuaauuauaaaauaggaauguuagaaacaauauaagaaugacuuauaggccaggcgcaguggcuaacaccuguaaucccagcacuuugggaggccgagguggguggaucacuuaaggucaggaguuugagaccagccuggccaauauggugaaaccccaucucuacuaaaaauacaaaaauuagccaggcaugguggcaugcacccguaaucccagcuacucgacauggaggcaggagaauagcuugaaccuggaagguggagguugcagugagccaagauugugccacugcacuccagccugggugacagagcaacagucaaaaaaaaaaaaaaaaaaagaaugacuuuuaaaaguaaguuguggccaggugcagugggucacaccugucaucccagcacuuuggaaggccaaggcgggcggaucacaaggucaggagauugagaccguccugccuaacauggugaaucccugucucuacuaaaaauacaaaaauuagcugagcgugguggugugugccuguauucccagcuacucaggagccugaggcagaagaaucgcuugaacccaggaggcggagguugcagugagccgagauugugccacugcacuccagccugggugacagagcgagacuccaucacacacacaaaaaaaaguaaguuguguuggccgggcgugguggcucaugccuguaaucccagaauuuugggaggccgaggugaguggaucacuugaggccagaaguucaagaccagccuggccaacauggugaaauccugucucuacuaaaaauacaaaaauuaaccagguguggugguguaugucuguaaucccagcuucucaggaggcugaggcgcuagaaucacuugaacccaggagguggagguuacagugagcugagaucaugccacugcccuccagccugggcugucugucucaaaaaaaaacucugucucaaaacaaaacaaaacaaaaaguaaguuguguuuauuugaaaacuguuagcccuacaaaaaagugcaagaaccuaggccaggcacgguggcucaugccuguaaucccagcacuucgggaggccgaggcgggcagaucaccugaggucagcaguucaagaccagccagaccaacaugacaaaaccccaucucuacuaaaaacacaaaauuagccaggcgugguggcgcauaccuguaaucccagcuacucuggaggcugaggcaggagaauugcuugaacccuggaggcggauguugcagugagccaagaucgcacuauugcacucuagccugggcaacaagagugaaacuccgacucaaaaaaaaaaaaaaaaaaaagugcaagaaucugucacuaauggggggggaagaaaaguacaagaaaaucauaaugaacuccuagauaucuuucaucuagauuaagaguuaaauguuuuuuggccaggcacaguggcucacaccuguaaucccagcacuuuaggaggccgaguugggaggauugcuugagguuaggaguuggagaccagccuggccaacauggugaaaccccgucuuuacuaaaauacaaaaauuagcugggcacaauguaaucccagcuacuagggaggcugaggcaagagaaucacuugaacccaggagguggagguugcagugagcugagauugugccacugcaguccagccugggcaacagagugagacucugucucaaaaaaagaaaaaaagagcuaaauguuuuuaaauuuccagagcuaaauauuuuguaaagaccauuuacaaaaggccuucauuuuauagugguacccaggucaccccuuuccauccauaaccugaggaacaggaaauuaggaccccugugaagguggcugagggcaaggagagaggguuccuccucuguggccugcauuugagugcuccuucuucccaguagcaagaauuucgacugggagugcgacucuacucagaggaacagccacaggaagcugugccccaccuagaggcggcgcugcaagaauacuuuguggccuaugaggagugccgugcccucugcgaagggcccuaugacuacgauggcuacaacuaccuugaguacaacgcugaccucuuccaggccaucacaggugcgugcaguucagagccagaccuucagccaggccuccugggacucuaaggucaccaucugauaauauaaauggggacucuucacccucauuccucaauuuauuaaaucugagaagcugaugaaaaauugcuuccauuugaauuuguucaucuuaaccagaauuugaguucuaaagagugaccucauaguuauuccuucuguuugauuccuuucagaucauuacauccagguccucaacuguaagcagaacugugucacggagcuugcuucccacccaagucgagagaagcccuuugaagacuuccucccaucgcauuauaauuaucugcaguuugccuacuauaacaguaaggccuacuuuccuuccucuuucucugcuggcuaacuaagaagcuaaaggcaaggugggcagggauuacagccacuuacuuccucaagguguuuggcuuauuucaguagcuaugggaggcaccaugccaagugaucccuggguaguuuguuauaaacaacuggccuaggaagccaauaccagcaacccaaaaagcugggggagggagacuuaggaccucaucucuugucccuucuauaacuuguaaucuauuuuugcuuuugaauuaaaguuaauagcaaaauaaggguaugccacaguuuaaacuagcucagaggacauuugcuagcccucucccugguauagcacugaugcuuuuguggggcugccaauuaauacccagaaaaccaacucuuugcagagucccuacugugugcuaagcauuacaaacauauugaugaguguacaauauuuacaguugaguugagaugacuaacaaauaucaacaagaacuauuuugccaaagagacaaucugcuauuguaaucuuccuugucuucugaaaaucuauagaaaaaagaagguaggaagacagggaaauugaucuaaugauugaguguauugaggcaaaauauuaaggaguauuggaauuauuugugaaucuuaaaagaugugggcaugcagagaauucugauucuuuucuguuucauuguuaggcagcccugaggacauugaccaccucaccuuaaaauuaaucacacauucuauguguauuacuuaacuccugccccugaaaucaggccaucauguuaaguagcaggcaccagcuugucaugcugccauugccucaagcuuuguggagacugaacacuaaguggucccuggugcuaggauuuuauccuuuccuuuugacucuuuccucucagccauucuucuuuccacuuugcaguugggaauuauacacaggcuguugaaugugccaagaccuaucuucucuucuuccccaaugacgaggugaugaaccaaaauuuggccuauuaugcagcuaugcuuggagaagaacacaccagauccaucggcccccgugaggugagagacuuccuucuguuaugacagcugccagcugaacucagaccugagggcggaagagugggguagcagaggggaguaggcgcugugcgugcagggcaggggccagaugucaguguuggggccagaugugaguucagucacucggcuuguuauucagaggagaagggagcacagggagggaguguggggaguacacaggagccucaauuagcguuaucugggcccagaagucuauucucugagucccgcagaacugcgcggugagcauauucuuuccccucuuggcaccccuaacuuggacacucgauauuauuuggccaagagcuaucauuuuucacuuaauacugguuguuuuuuuucugcucaccuguuuucugucuccauuuucuuucccaucucuucuucuuccugccauuguuuguucucucccaucuuucagcauuuucccugucucucuccaaaaccaggagaaauaucuguauaacacaaagacugcugcgcugaaaggagacacccaggcucuucuuccgagcucuggagucugagagccuccaguagaaacagccucuugcugccccuccuguguggguugucauuguaguuguccucuuuagccacuagauggugaccaucuggcuuuaagauggcacuuccggucucuuuugucuuguuugguuaauaccuuuucccugccuuccuuauggccauuaaggggagucugaggggagugaggggaaauaaacccacguggccaaucuagcauuuuuaacuagaaguccccuuuuggaaagaaggcaacuaacauuuguugagccgcuguccaggcgaagcucugugcggggugggcuguauccaucaucucauuuaaucaucacagccacccugcaagguuggcacucuucuucccacuuuagggaugaggacuguuagcaucugagagaugaaguaacuugugcaguggcuuguggccagucaguggugaccggaaucuguucccugcuuggacccagugcaggcacagcuccagacacauggcugacacucaguaaaucagcaucgaaugaauaaagauggaagugggguuugcuucauagcagccuuauagggucauuggagaggguuaaaugagauaacauagcauuuggugacagaagccaguaauguaaacuccugaagagaaaacgucucucuuccucuuagguaaauauaguagaugacauaggauucauugacuccuuuaauuccuccuugaacugccucauguuuuauuucaacugaugucuccuuuuucucuuccuuccuccuccugcugcuuggagauuagcagggcaccuagggaaagaugugaccccggaaaguacucaguuucccugcccuggguaagccuugccugggaguccaugugggaagcccagagugccaggcccuccccuuuagcugcuuauccucagggagggguguggucugguuagggucugagaggaggcagguggcagagcagaaagcacaugggcuuuaggacuguaaagacccggcuuuaucuguccaaaugcacauucugcuaugaaaaaaaagaaaaagauaacagaagaccuggguuugacuguaggucgcugcucucccauguccuguagugucaccuuagacagugguacaucuccucugugccucagaugcuuccucuguagaaugagcauacuaguaucaaccucagauguggcuauaaaagaucaaaugaauaacaugucaguugccuaaugccugauuccuuuuccugcuuuguggacuccuguagaagucaagaaggaauucuccuucuuugaagaauauuuccacuuuugagaaucaucagauuaucuguccuagagacuaauggggguugggaugggggaggagcagggcuuuuucccuuaaggaaagccugguuauuccaguaccucagagguacuguugcuugugccaggcagaggacacagaaauuagacuuuugucucaaacuggggaacagacagagagcauugguagggagaggaggccucaggucacaugggagcaucaguguggggugccagggaggggaacucccagagguuaaaagacagggcugaguucugggggauuuguuugcuuuuuuacccucagagugccaaggaguaccgacagcgaagccuacuggaaaaagaacugcuuuucuucgcuuaugauguuuuuggaauucccuuuguggauccggugagcuaggguacaggagccggaagggagcggggaaagagugagcaggagagaugaauggggaggaggggaacacugugcgauucugagagaaaacuugcuggaggcugagccuagccugggaucugugcaaggcagggaugagagacagaugaaaggggaacacugggcagcuagaagggacuuagauguggaaaccucccauuuugucuccugaaaggaagagggugauaagcuggauuacuccugugggccuuauuuuaugcauugagacaccuggaagauuaaguagaucaucuuaccuuuuucauuucuuccugaccuacuuaggauucauggacuccagaagaagugauucccaagagauugcaagagaaacagaagugaggaccuugaagaaacugcaugguuggaucagucugaugaagcacuugaggcuuccugagcccaggcagaugugaacuccuggcaaggggugggcagguccaguuugggaagucgggguggagcccagggcuggcccuggaaugcaguccucagagcggcugugcucauaggucagaacgggaaacagccguacgcaucucccaggagauugggaaccuuaugaaggaaaucgagacccuuguggaagagaagaccaaggagucacuggaugugagcagacugacccgggaaggugagaggacagaaauaggggcaugucuggcuguugucagggagccaggcaggucaccccacauuugccaggcagcgcuccaccccagcauugcagagcucaccaugagccagccacccuuagggugcaaguucaguggacauccuuccuaacucaccagcgggacuuucagcuggaaagagcacugagaaucagccuuuggcucagaaaucagacuccaggauguaguggugcacacccguaaucccagcuacuuggcaggcugaggcaggaggaucgcuugagcccaggaguuugaauccagccugggcaauauagcaagaccucaucuuuaaaaaaaaagaaagaaaugagacuucugugucacagaaacaugagugacuaguguuguccacuuccauagguauuaacucauccugucuccccacucccaaacuguuuucucccgguuuucaccauucgucccuuuacugagacucaacgccuucaggccuccuuuggcuccucuuccuccugugcccguuuucugcaagcugcugggaaggccuacugauuguggcucugcucugcagugcuucucagcucucuccccagccuuuuccguuuuucauugccucaggcuuccuucaggcccuggcaccuccuaucugcacccacccuuuccccgucuggccuguccuugccccugcccacacaagguagcuaggccagucuuccagacacuggccucugacccauccuccgugccugccccuuaaccgaauguucuacucuuguccuguuuacaccgucucuucacacaggacugcacuuuguuccgugagcccgcccacugcccaccagucuguguuuaugccuggcucuccuaguacgcuucccaccaucccugcccaugagggcaucugagauauacccugcaaagccuuucuuuuuuuuuuuuuuggagauggagucuugcucuguugcccaggcuggagugcaguggugcaaucuuggcucacugcaaccuccacaucccgggaucaucaaggaauucuccugccucagccucccaaguagcugggauuacaggcauguggcaccaugccuggcuaauuuuuuuguauuuuuaguagagauaggguuucaccauguuggccaggcuggucucaaacuccugaccuugugauccacccgcccuggccucccaaagugcugagauuauaggcauaagccacugugcccugccguaaagccuuucuuaaccucccagaugauuggaguccccuccuuucuuuugaacuucuuagggcauuuauggucugucuuaugcuaguuauuugcauaauuguuagagaacagguacugucuucuaggauucaucucucacccuaucuggcacaguuccugguacacacugaggccucaguuaucaaguggaguugaacugagucucuaguauuaguaugucccuagcacagagaaacaccaugagaacuguaagagagaaauguugaccuuugcccuauaguugcuuaaauuaacagugguuaauuaaacaagauuagcguaugaaaagaauuuguccagcauuccuuuguuuucagaccacuuucacuuuguuauuucucuugauucuuauaacugagaggugagucaugcagauugcaagauccuuauuuuaaaugaauaaugaugaugauaccaugguagccaaacuuuugaggacuuaccauaugccaaauauuguacuaagcuuuuaacuugccuuccuuguucuuaacauuauacuggcaucaaacauauaagguagaugcuguuugacagaugagaacauuuuaauuaauuaaaauuaaccucagggagguuaaguaacuugccaaggucacacagcuaaucaauggaggaucuaggagucaaagucaguucuuccucguucccgagcucauguuuuaggauuguguuucugauguuuccucaagagugugucauggcccaaaagccagcagcuauuuggucauggagcugggacugggaaucucaucuuucagcucuauguucuguccucuggacuauucuaccuuugaaaaugaccuagcgggagauuuugcuggugaaaaggaaacagcuggaauuucuauuugugacgaggaggcaauauccaauggagagucuuuggucuagcugcugcuagauuuagcuagaguuuugucauugcuuugcagguggcccccugcuguaugaaggcaucagucucaccaugaacuccaaacuccugaaugguucccagcggguggugauggacggcguaaucucugaccacgagugucaggagcugcagagacugaccaauguaagggaagcccagugacugcaccuucccccaaggguccagcauccccccaccaagugccccuugggugguagccuucgccuuccucuuccuggccacaguugaccaccucuucucaagcccucagcugcccuggcuaacaucaccuuguguuuugggccuuguagguggcagcaaccucaggagauggcuaccggggucagaccuccccacauacucccaaugaaaaguucuauggugucacugucuucaaagcccucaagguaagaucaacacugggcauucuagaguguggagaaagggguggggaagggggaagcucaggcuuugaggaagaguuggggcugguggcaggaaaggugaagaggguccaccugccaacauucuuguugccaggaagcgaggaugaguuauguugcgugagguucacuuuugaauccuguuagaccgaguguaaucaaaacaaagugagcaggauaagacuguucgccaaagcuaugagaaugcuuucuuuagaaaggcugauucuagagggcugugcuucugugcaggaugcacagugugcucauaaagagagauaagaaggacaggaggaagaggaauauaguagggguauugggcgugggcagcagaggcugcagcuucaguggggguguggggacgugggaugggccugguacucauugucucuggccccuaaagaggggcguuguguuaguccguuuucacacugcugauaaagacguacccgagacugggcaauuuacaaaagaaagagguuuacuuggacuuacaguuccauguggcuggggaagccucacaaucaugguggaaggcaaagaggagcaagucacaucuuacauggauggcagcaggcaaagagagaacuucugcaggcaaacucccauuuuuuuauuuuuuauuuuuuauuauuuuauuuauuuauuuauuuauuuauuuauuuuuuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacagaccccgcaaccauccgauuucucaauuuuuuccccacccuucccgccuuucuauuccacaaaaccgccaucgucaucauggcccauccccaaugagccgcugggcacaccucccagacggggucguggcugggcagaggggcuccucacuucccaguaggggcggccgggcagaagcgccccucaccucccggauggggcggcuggccgggcggggggcugacccccccaccacccucccggacggggcggcuggccaggcagaggggcuccucacuucccaguaggggcagccgggcagaggcgccccucaccuccuggauagggcggcuggccgggcagggggcugacccccccaccucccucccggacggggcggcuggccgggcagagggguccucacuucccaguaggggcggccgggcagaggcgccccucaccucccggacagggcggccggccgggcggggggcugacccccccaccucccucccggacggggcggcuggccgaccaccccccccggccucccucccggacgggguggcuggccgggcugaggggcuccucacuucccaguaggggcggccgggcagaggcgccccucaccucccggacgcaaacucccauuuuuuuaaagccaccagaucucgugagacuuauucaguauuaugagaacagcacgggaaagauccacccccauuauucagucaucucccaccaggucccuuccacaacacaugggaauuaugggaacuacaagauaagauuuggguagggacacagagccaaaccauaucagucguugagggcagcugaccaucugucuccuuggcagcuggggcaagaaggcaaaguuccucugcagagugcccaccuguacuacaacgugacggagaaggugcggcgcaucauggaguccuacuuccgccuggauacgccccucuacuuuuccuacucucaucuggugugccgcacugccaucgaaggugggccucauuaccccugcagcacccgcccccgcaugcuguaccucagcucugugcuggaugcugaagacacagagagaacaggaugcggucccuuuucuucaguuggggaaccaauguaaauacauggguggcaucccagugugaugcaugccacaguagcauggaggaaguuauagucaaccuaccuggggaucaagaaggcuucccagagggaaauggggugcagccagaaagggggccacccgucacuugucacacaacgcacuuuaauggggaagcuggugcuaaaccauucauagaggaccugccuccggguuaggguuucauacauagcugagcagcucccucgcugccaucuguugaaagacagcccucaacagaagggcuuguuaaaagcaaaaauaauaacaacaacaacaacaacaaaaagaaggcuucccagaggaagcaauggcaguuuugcaggaugaauacgauuacggaguacuccggguggugggaugguguuugcacaggaguggaggcauugugcagccugguagucaggggaacuaagaaaggugccaaauccuggagagcuacauucaagggaauuuuuauccuuuagcucaaccauagcuauguggcagauucucuuuuacuaauuguuaaauaccaaauuugugagagagcuucgugauuuacaagugagaguggccuggagguuauuccucauucccucgcccacccacauucccuuuugcauguccaagaaggggagagguucagcuagugcugcaaggauccuauguggcccagagccggcucugucauacuggagccuccagcaggccccuggcagugauggccauugguacguggcacagaucagagggcuuuccucuaccucagaauguuuggaauucugucacaaucugggcacacccaaagggaccagucagacacacaacugggugugucacaagcccccggugggagagcacaagcacaggugccaggaggccagggaggccucaucaagcagugaaggacguggugaggccuugacuuuuaaaggauucauuuugcugcuguguguguggagagauuucaaaccaaaaagggaagcuggucagcaaugaccucuguggacaagggcaaagcccuaaacucaggaaguggcagugggaggagggagaagugaggccccgggaaggugcaggagguggauggacaggaccuggugacuggcuggacaagugggaauggagaaggaggcacccaccacgacgugacggugccuacauagagcaugccaaagguuugcguuggggaaagacguggucugccuggcauuugacagugagcccggucuguucccuuucgugaccuucucccugcaugguuucuccacccaccccaccccagagccccacugaaguucaugcuuucccuuugcuagccagcucuucucugccccacuuccugccacucagccccaucuccugcaguccugauggaggacugacccacucugcccugcguccgucccaccuccugaucccucauucucacuucccugggccuuuguauuuuguaaaguccagcuacaaaccaggguugugccauucugcccaggaucugcccuugguuggagcccuucauuccugcuugccacacccugcucacuucugccaagaacuguccuaggaagccugcagacuuguccugaccccuaggcuuguggcuuagccaaagacaccccccuaguucauugggcauuccguagacucaaacacauuuugggaagcaccuccccugccaagaagagagcuaugccgucucccgaggugcucccuugcuaacaugugugacauuggccccagagguccaggcagagaggaaggaugauagucauccaguccacguggacaacugcauccugaaugccgagacccucgugugugucaaagagcccccagccuacaccuuccgcgacuacaggugagugcggggcaggugcagggugaggaggucugugcccuccucagaggccccacagugcccugcacucuacuaccccacccuagcacacacacacugguuggggcuagcuguucccagaguccaauccuuuauccccaaacccgcuggauaagaagauaggcaaagagggaaucauaucguggugugacaagaacgguagugugagugggcacaggggacucuaaggcgaggguggagaguggaaagguggaguuuguacggcaucaguauagguucuuaaagguuucccucccacacaaagccacccuccugcugcugguugagagcaccuggaggugaaggcucaggggaaagggaggcagggaagggccaugaugagaugucucugccuuucccagcgccauccuuuaccuaaauggggacuucgauggcggaaacuuuuauuucacugaacuggaugccaagaccgugacggugagugcucccuuguccuugucccugggagauaaaaagucuguuuucuacagcugauguucccaaagugcaguggacaaaaauaaccaacugggcuucccagugggcgguacccuucccccauccagaggggcuuugagacguguccaucacuccucuaaccagucacccuuucucuuuaguucuggucuuagggaagccauacugaagagcugcccucggucgugagcccuaaugagcccaugucucuucugagaguggauuacagucuuuguccugugcaaccccccucccuuucugucccccuuaggcagaggugcagccucaguguggaagagccgugggauucucuucaggcacugaaaacccacauggagugaaggcugucaccagggggcagcgcugugccaucgcccugugguucacccuggacccucgacacagcgagcgggugagagcagcucgagcgggugagagcagcuggugcuguggugacccguucccagagcgcccuugguuugccuuucucuuccccaaaucccauugccaguggcugagacacgaaaggagcacuugggacaccagcuccaacgcccugucauuauggucacauugccuuguccucccugggccugcugugaacgggauccagguggggaaagaggucaagacagggagcgaugcugaguucuugguucccuccuugggccccacuucagcuguccuuuuccagagaguaggaccugcugggaaggagaugagccuggggccauuaaggaaccuuccuuguccccugggaaguagcagcugagagauagcgagugucuggagcggaggccucucugaaugggcagggguuuguccuugcaggacagggugcaggcagaugaccuggugaagaugcucuucagcccagaagagauggaccucucccaggagcagccccuggaugcccagcaggguccccccgaaccugcacaagagucucucucaggcagugaaucgaagcccaaggaugagcuaugacagcguccaggucagacggaugggugacuagacccauggagaggaacucuucugcacucugagcuggccagccccucggggcugcagagcagugagccuacaucugccacucagccgaggggacccugcucacagccuucuacauggugcuacugcucuuggaguggacaugaccagacaccgcacccccuggaucuggcugagggcucaggacacaggcccagccacccccaggggccuccacaggccgcugcaugacagcgauacaguacuuaagugucuguguagacaaccaaagaauaaaugauucaugguuuuuuuuacuugguuuguucagacaauggaaauuugcccauucugucccagaggucucacuugauaaaaauugcucuaggcaggacccaguggcaggugugggacgagaaguccuggcuuggcaccuggcucaaccacuugcugugcagccacaggccagacacuuaaccuucagcaccucgggguugucaucuguauaauggggaucauaguccucccucugcucaccuucuggggcagcuguauggcccagaugcaauaucggaugugacaacacuuuuguaaacgguaaagcucugggugaaugguugggauuauuguuaauccucuucuggcagggagcggcggucagcagugcucuggcacgucaccccuaugucagccacaugcuuccugcucugccgucuggccucaguguccuguaucucggccucccugugcaggaagacacacucuaggaaacacuggaaauggagauucagcuccucuggcuacaucccugguacuagguccagagcuuuuacugugcuugagaugccacagggcguugaguguaggaaccugcacaugaguguucacuucuuccaucaaucaauauguauuuacugagcaccagcuaagugccuggugcugggaacguggcagugaacaaguccccaccuucauacagcuuguauuuuguaggagaaacagauaacacauguaaauugugugu

SEQ ID NO: 14097 - RNA, 1317 nt, Homo sapiens
ggugcccaccggccgcgcgcccgccggcucgcccagcuccggcuaacgguuccgcugcugggcugcccgagggccccacccccgucccuguccgguccucaccgaugaccuucuuguccccgccggcaggcgccgccgaugugaggccgcccgggccaccgcucccugcgccgcugcccguagugccgggcuuggugucggcggcgcugagggcgggggcggcggggggggcggcgggcggcugcugggucucggccucgcugcucaugguugcggugauggugacuggggccggcugcggcagcugcggcuccucccggggugugaugguaacuaggccggcggcggcgguggggcugcucagggcucucugggguccgcucuccgcucccgcuaccgaucgaacuagcgagaauggcgggacaggcgggauaagcccuacgagcgacccgcccuaggcguuguucacuggccagugguacugucaaucugcccaccugaccccaaucccuagcuucuauuggcuaauauuuuaucaguccuccauucucauuggaccuuuggcggcuaauucagucgaccuacaaccguuccugccuccgccggccgccauagagaccggaacuagaauuagaguagucggccacgaaaaccauagaguacccgagaggacgggcagaaggaacgugacuuccacgaggcagccgccgggcuggcgggccccacguucaggguugugucucggcugaaaaaaaggcacgcccgaacgcugggcagggauuacccggccggacccgggauuggaagggggcucgaagacgccuuagccccccgugaagaaaaggcuucccucccucccagcuccaaauacggucccugugaucugagaacauuacggcgggcauagagucgucuuuucuuuaauggccguguagucgcggcacagccgaggguuucuggaauugccuuaaacguaugcguuugaagagcguacccuuuugucggagcagucaccuuggagggaccacgcaggcuauggcagcccggguucagcauguuuagggcgagggugugcuccauggggaccugccuucugauccguuuuaccaggcauauauuuaaaaaaaugugucuuccuuuccaaguauucacaucuuuuucuacugaccacaaaucagauuuaauucaacucacauuuauugaacaagcuagccuguuuuguuuuuucacuuuauuccugcaacagccacgugauagagggauuacuauccacguuucacaaacgauaaaauugaggcugccaccugauguuacuga

SEQ ID NO: 14098 - RNA, 1317 nt, Homo sapiens
ucaguaacaucagguggcagccucaauuuuaucguuugugaaacguggauaguaaucccucuaucacguggcuguugcaggaauaaagugaaaaaacaaaacaggcuagcuuguucaauaaaugugaguugaauuaaaucugauuuguggucaguagaaaaagaugugaauacuuggaaaggaagacacauuuuuuuaaauauaugccugguaaaacggaucagaaggcagguccccauggagcacacccucgcccuaaacaugcugaacccgggcugccauagccugcguggucccuccaaggugacugcuccgacaaaaggguacgcucuucaaacgcauacguuuaaggcaauuccagaaacccucggcugugccgcgacuacacggccauuaaagaaaagacgacucuaugcccgccguaauguucucagaucacagggaccguauuuggagcugggagggagggaagccuuuucuucacggggggcuaaggcgucuucgagcccccuuccaaucccggguccggccggguaaucccugcccagcguucgggcgugccuuuuuuucagccgagacacaacccugaacguggggcccgccagcccggcggcugccucguggaagucacguuccuucugcccguccucucggguacucuaugguuuucguggccgacuacucuaauucuaguuccggucucuauggcggccggcggaggcaggaacgguuguaggucgacugaauuagccgccaaagguccaaugagaauggaggacugauaaaauauuagccaauagaagcuagggauuggggucaggugggcagauugacaguaccacuggccagugaacaacgccuagggcgggucgcucguagggcuuaucccgccugucccgccauucucgcuaguucgaucgguagcgggagcggagagcggaccccagagagcccugagcagccccaccgccgccgccggccuaguuaccaucacaccccgggaggagccgcagcugccgcagccggccccagucaccaucaccgcaaccaugagcagcgaggccgagacccagcagccgcccgccgccccccccgccgcccccgcccucagcgccgccgacaccaagcccggcacuacgggcagcggcgcagggagcgguggcccgggcggccucacaucggcggcgccugccggcggggacaagaaggucaucggugaggaccggacagggacggggguggggcccucgggcagcccagcagcggaaccguuagccggagcugggcgagccggcgggcgcgcggccggugggcacc

SEQ ID NO: 14099 - RNA, 4229 nt, Homo sapiens
uugucuuuuaaugacaccugauaugaugucauuuugauuuugaaauugaacacuagaacuguuaaucaccuuuaaaaagaagagcuuauugggaauuauauauuccuuaaaauauacaugggggccugaaugucagccaucuuuauacuauagaaaaaggauuauggaugcaugaauggucaugcuuuggagaucaaauauugguugaaugccuauguaugucaggcccugugcugagccaugaggauuaaaaagaugaauaaacauaucuuguuuaggaaauggauguauaaaaaaaucaagugcaauaaaguguguguccaaaagcugacacaauggaaaggauguuuuguuuuguuugaaauuuaucaaauauaguaguaggaaagaaggauaccucccugaagauagauuguagaauggugagcuuuucacugcauuuacuuuuugcuucuuauuguagauucaccucauguuuggguaauaguuuacauuucaaguauuuuaggacugcuuuucaguuuaacuuaauauguccuuccaccugggaccaggcaggggccacuuggugaucucuguccugagggaugcauuacagugugguagaguaugggcuagaagucaacuuagccagcugugccaccuauuagcuuuauaaacuuaggcauuugacuuaaucucaguguccacaugcauaaaaugaggauaaucucucugcaaaguaaugccauuuauugugaggaucaaaugaaauagcaaaaagaaagcaucagucuggugccuagcauuugauucacacucacuaaaugguugcaauuauuguuuuucucacuuagcaaagcaguguuacaccacugcccugcuuaaucuuugaauccuugagaaucuuugaaaaacuuucaauacuucucuugcuguccuacguuuuggguuuggagugcacaaguagcauagugcaaaaaaauucccuaaaugaucuguaggauaguccaggugcaauuugaaaaauuagcauugaugacuaagguagaagcagguacuguguuucacauaaauauuugacuuaaaauacaauucaugguguuucauggaguagggaaggguagccccugugucugucugauaauagaaguacaauaaauuuaauugagaagauuugacagaaauucuaagacugaaauacuucauuaaucaggaaaugugaccuugaacagaggaaaaauacugcagcagucaagacuguucuggaagcagcagucccuuugaacaaaaaaauuuucuuagagacaaggucaugcuuagucacccagguuggagugcagugguccaaucaugguucacuguaaucuugaacuccuggacucaagcacuccuacugccacagccuucugagcagcugagacuacaggugugugccaccaugccuggcuaaauauuuuauuuuucauagagacaaggucuuacuauguuacccaggcucuuuuuuuuuuuuuuugagcggagucuugcucugucguccuggguggagugcaguggcacaaucucggcucacugcaagcucugccucccggguucacaccauucuccuuccucagccucccuaguagcugggacuacaggcgcccgccaccacgcccagcuaauuuuugcauuuuuaguagagaugggguuucaccuuguuagccaggauguucuccaucuccugaccucgugaucugcccgccccggccuuccaaagugcuggcauuacaagcgugagccaccgcgcccagccacccaggcuccuuugacaaugauuuuaagugaacuucagguccaauuugcaaaaccccaaaagcagugggcucugucaguggcugcaguacugaagggcaagaaguagaauauguucuucucugcauucauagcuuuauguggaugaugacugucaucuuugaauguacaauggggauauaugggguuaaaaguagaagugaucuuaauguuugucuuuaccauaauuauuaccucccuugggaauuuuauauccugucuuguuaacgcuuaaaaacaaucaguguucuacaugaaauuauuuaguguuuuccacuucaguuuaauuuauauucagagcacuuagauuauuuacacaaguaaaaauuccaggggggugggggagaguguguguguguguuuuaauagcaaauggaaguguauaaagaaaaggaacaugagucaaugaggguaacuaagaaccugaucuuggauggaggaucaaggaaugucucccugaguaggugauacuuaaacugauaaacaggagugaagugggcuacaagugcugguggugagccuuuuaguucagaaaaaaacacuugcaagaggucuagugccagaaggagagguugaggcacuuuauuauauaaagaguaaaauacguccggauaaugcauguagaaccagcaaaaauuugugaaguauucucuuggggaacuagaguaagaccaagaaauguuguguuugggauaccagcaaagcaagggcccccaaaacaugacuaaaaucgaguuugauaauuaacuagaauuuugcaauaagagcaucuaaaaagaugauauaaauugaguauguuaaauuuugugucauuuauaaguuuuuauuuugcauuacauagguggggaagauaacguucaucuuaccugaauuuucagugcuuaggacuucuaaagggcuucagccuuagggacaauucuagucaagcccaguuucuuccuuuuuacaauaauaagcuggauccaaaaauugugauuuaucuuacgugccccacguggcuagugacacgaucuaggccuaaaauucagagcucuugagcuagcacuuccugccccuuuaagaaugaaggaacuuguagaaaaauaaauccaagguuaguaggcaggggcuccagcugaguccuggcgggaaguucuuugagagcuagaacgccccaagacaaaauguauucgcuaagucgcaaacgcucgacauguuaccaugguuacagcugucuccaaagccaauggaaugaguuguacuaucgauacggccgggacaacuccgcccccgacccgaaggccaauggugugagacauaauaacagucuccacaagaaccacagucucugguuccacuggcgugcgucgucucuaugguucccgccggaaggacgcgucugcgucucugcggcgagcgcgguugcuaugacgcccaggucuccguaggcaccugcagcuagcagcugagcgcguaggggccgagcgaccccgggacgcucgcggcacccuccgcaggaaaauuuccgacuugguucuugagguuccugccucagccccaaggaggaaagcacccauucuccccucuuuuccgcauuacgggccuuuucugcuucuccccaguaugguccgaaacuacaggaggggaaccccuccuggcccggccuuucuauucccuggcuggagugauuccgccugaaggagaauucgcccguuuuccccggacccagcugccacaagcauuuaguauuaggcugccgcuuauuauuagagcgggcuuagaacauccucagcgagguaggucggcguuccuuuucucacuuaaaggugaggugucgagacgcgccccuggacagacaacgcccgaagguccaggccacuacgaaguccacggaggggcagcuuuccccuacguguaggcccgcgaacaaagaacuaccguuuucugauuuuuuuuggccgauguucgucaugcagaaccuugaaucccgaugaagauuuggaggccuuuuguauccucaacaucagaggucaugaagucaguuaccuucugccuuucaagcuacaacuuuuuccacuucucucaucacuccaagcaccagcuuucucauccugcuuauuucacagccauuuuaacuuuucccuguucacgcugcacauuauugaauguccauuugucugcaccaccucugucaucuauagaccaccuccuucugcuuuccugcuacaaugcuuugcguaccuaaguauuucgcauucuccagcucugcagucauugggaagauuuucuguuuuucuuugcacuauggcaaccuuucagucuuggguaaacuagagacuaggagaagugcaaauugguaaauauaaacauuaaauacuguaggucuaguguguuuugaaaauggaaaaaaaaaucaaaauugcaguauuggacccauu

SEQ ID NO: 14100 - RNA, 3906 nt, Homo sapiens
ggggcguggcgcggcggccgcgaaacgugcgcaggcgccggccgcugcgcugcagauggcggaaauggauccgguagccgaguucccccagccucccggugcugcgcgcugggcugagguuauggcucgcuucgcggccaggcugggcgcgcagggccggcgggugguguugguuacgucaggcggcaccaaggucccacuggaagcgcggccggugcgcuuccuggacaacuucagcagcgggcggcgcggugcaaccucggccgaggccuuccuagccgccggcuacgggguccuguucuuguaucgcgcucgcucugccuuccccuaugcccaccgcuucccaccccagacuuggcuguccgcucugcggccuucgggcccagcccuuucgggcuugcugagccuggaggccgaggagaaugcacuuccggguuuugcugaggcucugaggagcuaccaggaggcugcggcugcaggcaccuuccuggcaguagaguucaccacuuuggcggacuauuugcaucuguugcaggcugcggcccaggcacucaauccgcuaggugcgugcccuaggaguaccccuuuugccuggaagcacagccuuucuuuccagccacuuauccccuuaccuccugcuuacccacggaucucagcuggggaacccgaguugagaaggagcugauccuauaucguaccucgccgauuuguuaacaccuuguguuucucuuugcaggcccuucugcgauguuuuaccuggcugcggcugugucagauuucuauguuccugucucugaaaugccugaacacaagauccagucaucugggggcccacugcaggugaugggcgcuucucuuccagagaucuaaucccauauaaccaaucuuggguuaauuuccucuugaucuggagauggccuuucugcaucuguauucgcuaggcacaggggauacagagaugaauaagacaccgcccucccucauggaccucacaaucuagugagggagcuggacacagacauaauuacaauacagagugauaaaugcucuaguggagguauguacaaagugcagucagaucauggggcgagugaauccugggggagucgaugaagcuucuuggaggagaugaauugaacuggguuuuaaaagaugagcagaaccgagcgcgguggcucacgccuguaaucccagcacuuugggaggccaaggagggcagaucgccugaggucaggaguucgagaccagccuggccaacauggugaaaccccgucucuacuaaaaaaauacaaaaauuagccgggcgugguggcaggcgccuguaaucccagcuacucgggaggcugaggcagaagaaucgcuugaaaccaggaggcggagguugcagugagcugagaucucgccauugcacuccagcccgggcgacgagagcgauacuccgucgcaaaaaaaaaaaaaaacaccaaaaaucaaaacaaaaugagcagaggguguacgaagugggaaaggucauuccagguggaguauggcaguaggaauuugaaagugggcagugggcugugaaccgaagugcuuugguaaggcuggagagcugacugaagagauggcuugcuuuguagaagacuuuauuuuccuuuuuuaaggagcuuggacuuuuucuuguggagcuaagggacacauaaguaggagaaugagauaaaguuuuuguuugagaacaacauucuggcaucaguaugaaagacgaaguagagaaggagaaaguggaguggguagauuaguugggggcuauuguagguuaaggaagaaauauggauaagguaggugugguugugauuuuagauuuuuggaaccuucaggaguucuuagucauuuauugggugauacagguaggauuuuauuaggagaaacucuuaucuguggggcauuugccgacuuuguagaauaguuuauugagguccuacacugcuguaggacuuagagaugaaagcagugaaaagaaacauacccugccuuuguguugcuuccucugcagaggagacaauaaauaagucaaauacauaacucguuuaguagugauaaaugcuaaggagaaaaauaaaguauaaauaaacugguauaugaucccuaucacacuaacagcuuuuuuuuagggcaaagucugaugauuagcuuagugauuucacgcuuuuuaaucucugggaucuuuaguuuaucccacaguuuuuaguucuaucuugaaaguaacaaagcaacugaacauuacccugagaagggauuggggaugagguacuaggaguuuuggucaagugaaaauaaaaucaguuuccucacugcuaaguuguguuacaugugacaauuuaaaaauggaaucuaauagccauucuaccaaugcaagaaauauuuuaggcugagagguuuaaaaacccaacuuuauuuaggcuucugccaaauauuuguaugaacagauuauuuguaucuguuuauuugaggguuugguucaaaaauaaagggacaugcuugagaaaauauuaauggugguaagguuggcagagcauggcagggcuuauucagaaggcaugguuugccccagaauauguauggagccuugaauuuaggcaucgcugugaacucuacagagccaaggcuuuuuuuuuuuuuuuuuuuuuuugugagacaaggugucgcucuguugcccaggcugaagugcaguggcaugaacacagcucacugcagccucaaccuuccaggcucaagugaucuucccaucucagccuccugaguagcugggacuacaggugggugccaccaugcuuggcuaauuuuuguauuuuuuuguagagacaugguuuugccauguugcccaggcuggucuugaacugggcucaagcgauccacccauccuggccuuccaaagugcugggauuacaggccaagccacuguguuccccuaagacuuuuuaaacuaaacauuuaacugaaaaguuugaugguugagaaaucccacuuaaauuuaauuccuuaguuucccaugagauugaccugguagguaaugaccauuguuugcuuauuaagcuuuucuuuuuccaauacagauaacaaugaagauggugccaaaacugcuuucuccuuugguuaaagauugggcucccaaagcauuuauaauuuccuuuaaguuggagacugaccccgccauuguaauuaaucgagcucggaaggcuuuggaaauuuaucagcaucaaguggugguggcuaauauccuugagucacgacaguccuuuguguuuauuguaaccaaagacucggaaaccaaguuauugcuaucagaggaagaaauagaaaaaggcguagagauagaagagaagauaguggauaaucuucagucucgacacacagcuuuuauaggugacagaaacugaaguaaaaagcccuuauaggaucaaaaauuguucagggcucuuagagauggugaaaacuacaaaaaaaaccauggcuuucauauggacagauaaaaugaaagaaagggaaaaggcagugguguguaggcaaauaugguuuggcauuugucuuuuaaugacaccugauaugaugucauuuugauuuugaaauugaacacuagaacuguuaaucaccuuuaaaaagaagagcuuauugggaauuauauauuccuuaaaauauacaugggggccugaaugucagccaucuuuauacuauagaaaaaggauuauggaugcaugaauggucaugcuuuggagaucaaauauugguugaaugccuauguaugucaggcccugugcugagccaugaggauuaaaaagaugaauaaacauaucuuguuuaggaaauggauguauaaaaaaaucaagugcaauaaaguguguguccaaaagcugacacaauggaaaggau

SEQ ID NO: 14101 - RNA, 10351 nt, Homo sapiens
cuuggaaucauucuucugccuacuuugccucaacaaacuugaacucauuuuucaaggauguggucaaguguuucuguaucugcaaacucuuccuuaaaacacucacucucgccugggaggcagagguugcagggagccgagauggugccacugcacuccaacuugggugacagaaugaaaucccaucucaaaacaaccaaccaaccaaaaaaaccaacaaaaaaugcucacccucagucagaucaaauuccuucuuccacuauccuuccuauaugaaccauacaggggaauaggaagagcuaacauuuauagcacuucucaugugcuaagcacuguguuaagcagucuaccugugcgugguuucaauuaacucacagcauaccuacacagguagguacagaugcuccuucauuuaggaugggacuacauccugauaaacucaucagaaguugaagauauccuaaguggaaaaugcauuuaauacaccuaaucuaccaaacaucauagaucagccuugccuaucuuaaacauguccagaacaauuacauuagccuacaguugggcaaaaucaucgaucauaaagccuaaauaauaaauaauaaaauaaauguauuauuuuauaauaacauguugaaucucucauggaagaguauugugccacauauugcuagccugggaaaagaucaaaauucaaaauucaaguauaguuucuacugaaugcauauuguuuucacaccacugugaagucaaaaaauuuuaaaucaaaccaucuuaagucggggacugucuguauuauuauuauccccauuuacagaugaggaaacugaagcucagagagauuaagcaauuugccuaacuaaaaucauugaacuagugaguggcagggcuggccauuuaaccccagacgagggagcccacauuuuuuuuuuuuugagacaaaguuuugcucuuguugcccaggcuggaguacaauggcgugaucuuggcuuacugcagccuccgccucccugcagccuccaccucccagguucaagcgauucuccugccucagccucccgaguagcugggauuacaggcacgcggcacuacaccuggcuaauuuuuguauuuuuaguagagacaggguuuugccauguuggccaggcuggucuugaacuccugaccucaagugauccgccugccucagccucccaaagugcugggauuacagacgugagccaccaugcuggcggggagcccuuacucuuaauugcuauuaugcuauacugcccccuagcuacugcuuuuaucuuuguacucccagcccuuagcacaauaccuaaccuagaauuagcacuuaauaaauauuuacugaauaaauaaauauucauuucaccagcauuucuagcaaauuucauuuuagaaaaagaucaacuccagaugaaauuuguagaaauaagggugguauauuucaugguagcauggaacaagaaaccccacuagaagaguuaagcuuggcuauacuuaacacugcagaaaaagagaucugauggggggcaguggacauaguauaggccauaaauuaacugcuaaauaguuaaaaagggaaauacuuuacuuaaguacauuaaaagaaacuuugucuuugugugcgcaugugugugugugugugcacaugccuuuuuagcauauuuugcuuuaagaaucauugcaaaaagaaacauuucuuauuuauucuaccauauuaaagugggggcaagccauggaugaaucaugaacuuagaugagauauaaugaaaacagcauaagucaguaaguauucaaaauaguugcuaaaagguggaaaugagauccuuuaggaaaggugaaagauauaggaauuacaaauaaguuuccuuuacguaguaaagcaacucuucuucauuuucacugaaauagaauaugagaugacauauuuaagcagucugugugguguguuagcaaaaggagggauuucaaagucaugaauugaugcucaagucuuuauauugccauucacuagcaaagugaccucaguuucccuugccuauaaaaugaggaggauaaucuccaacucuuacauuacagggauuuauuaauauaaaauauuacuucuuuuucuguuuccugauucugacggaagccaucguucccuccucugaacuucuacagacaucaacauuuugccagucuuguuucaucucucucacacuuuuuuuuuugagauaggaucucuguugcccaggcuggagugcaguggcaugaucaggcucacugcagccucagccucuggguucaagugauccucccaccuuguagcugggacuacaggugugugcuaccacguccaguuaauuuuuguauuuuuuguagagaugggguuuuuccacguugcccaggcugguugagaacuccuggacucaagcgauccaccugcuucagccuuccaaagugcugggacuacaggcgugagccacugugcccggcccucaaauucuaauuaugccaacacugucauacuccagaauuagaugccuguuauguuugcaguauugucacuucuuaagugaauaguagaaacaacagguugaaucucuuccuaguuuugaagaacugauccacagaucugagcaguccuaauuaguucucaggacucucuucaaugcuugcaucaaggacauuccacagaugguuuuucaauuacugcccaguaagcuuuggaaaugucuggaaaguguuaagacuuaggacuuugcaccuauguuugucuaauuuaaaaaaaaaauuuuuuugucgagacaagguacuuucucuguugcucaggcuggaaugcgguggcacgaacacaaaucacugcagccucaaacucccgggcucaagugauccucccaccucagcaucccaagcagccgggacuacagaguuucaccacguugcccaggcuggucuugaacuccugggcucaagcgauucacccgccucugccucccaaaggcugggauuacaggugugagccacugugcccagccuguuuaccuaaauuuaaccuucaccuacauguucucuuaaucuggucccauuaaaaacuugguccccagugcccuucaagcuagauuucucauugccaaguccuuugggaucuucagugucuuccaugcuuugugauuccuucagagaggacugagugccuuuacugaauauuuaucaugcuccagggccugcagauccuauuguuccagauauuuuucauuuauuuggcauuucaaauaaauuagguacacauaauauuuuauauaaaaauuagcuacuaauaaucccuuaacccaaguuagcaauaugucacaacacaggaagagccuuuguggggaguuaggagacuucaguuauaguuccagauuauuccauagcauuaauuugacaaaaauuuacuuauuuagggccuagaggcugccacauacagugauggguugcuagguauagaagcaaaugagcauggcccuuaucucaaaaacagggacugugcugggcaugguaguucacaccuauaauuccaacacuuugggaaguugaggcaggaggauuguuugaggccaggauuucgagaccagccugggcaacauaaugagaucuugccucuauuaaaaauaauaauaauaaaagaaaagaaaaacaggagcuauaucuuaacauucuuuguaaguuccccaccuucuggggcaugacaugguccauggcauuuauaaaggguugucugagcccacagaucaagacugacugaguuucaaauucuguauuuuuauuuuauuuuauuuuauuuuuauuuagaggcacugucucacuauguugcucaagguagggucucucucucucuuuuauuuuuuuugagacagagucuugcucugucgcccagacuggagugcgguggcacaaucucggcucaccgcaaucucugccuccuggguucaagcaauucuccugccucacccuccugaguagcugggauuacaagcaugcaccaccacgcucagcuaauuuuuguauuuuuaguagagacgggguuucaccauguuggccaagcuggucuugaacuccugaccucaggugauucacccgccuuggucucccaaagugcugggauuauagguaugagccaccacucccggcgggucucuaacucuuagccucaagcaauccucaugccuuggccucccaaagcucugggauuacaggugugagccaccaugcgcugccucaaauaccucaaauacuguauuuuaaagccuuucacuauacuacaccaaucaucccauucucuauaucuucucauaauccccaagcaaucuuucuaccugaagaugacaccagaaauuugugucacuaaagagcaagauucagaaagugucugcauuagucauuauaggcucuguuaugcuaugguaucaaccccaaaaucucaguggccuaaucagcaaagguuguuuuucucgcuuaugcuguguccuucccaggucagcuguggcuuugcugcacauugucuucacucugggacugaggcugauggauuagccucuauccagaauguugcuugucaugaggacagcaggaaaggaaaacauggugcagcacauugacugagagcuuccagcuagaaguggcucauacugccacucacauuucauuagcuaaugcaagucacacagccaagccugcugucaauaggaaauuacaauccaauucuggaaggcacaguaaguguuugggaacaauuauauagucuuccacagggucucuuuacccuuuauuugugacacuuggauguaaacacaccuucucacagugccucacccaggaccuuacgacucgcauauugguguaaacaauccugcugguuuagagucuuugaaggcaggagagagggcuuaggaucagacaauuuuggcuucaaauccugccucugacacuuaaaguacugagccuguuuccucuucuuucacacgaugaccaucuuguaguuuuacuguaaggauuaaaaaaaccaaacagaugcaaagggccuauuguguugcuacucacacaaagaacaguaaauguuaacuauucccccaccaaacuccaucuagcauugggguuucuugaugguucuuauuuagcucauuaggcaugaaguaagccaauuaucuuugcaacuuuaaauaauuguuucuuacuacugaguuuguaccagaguuucagguuccuuugggcugcaaaccuuggcuacuuuuuccugcuaaccagguuccuuucuaucaucccaaaagauauugcuaacuaacuggcagagagauuuuccuugauccuacucuguuugaacauccucugacucacccuuccuagugccacccaaguuucaucugcaccauugcuuacacauaauacaaguacuuuauuuacuuacgcauuuguuaauguuugcucagcugucuuggugccuuugugucuuucacugugcuuuuaauuagcucggcugauucuaagaguggagguaagccaagguuugaaccaggugguuacaaggaacauggagauggguugcaggugggggauggcagauuguuaugaaugcacuagugcaaaaucauugacagccuaggaaaaaaaaguauuuuaggcuaaugccuucuacugggaaaaaauaaacuaagcuacuccuuucuacuaauaaugauuaaguaguagagucuuugggaaggaucacauuuugccuuuacugauauaaucugaaguuaacaccaagcuaccagaggacaggaacuugaugguuuacauagagugauguggucuagcugcaugaguuaguuauugccaucagccaccaauauuuaaugacuacuuauaagacuaucacuucuguggccucuacuuuucuuguaucuacccaaccucuuugacuuugcacaagcuguucucugcccccaauugccuuucucuacucccagucuugcuucuaucucugcguggcaaauuccuacucauuuauuaaaauuuagccuuaacuuuaccuuuuaaggaugaagcuuucuuuggccccagugacugugccccacccuccaccucauccaauuugacagaauuaagcuuugcuucuuuucuguuuccauggcacaaguauaaauuucuaccaaauugcauugggauuaacuguuuacaugucugcuucucuuuuauucucuuuugacuccuugguauuuaguacaacaucugguauagaguaggugcuugcuaaaugauuauugaaugcucuuuaagugugcauagcgaccaaugcccaagcauuuuccuuaaauagcagucaguagugcugagaccucucagauggccuacauauagccuuuuaaaaaaccuaauucaagaauuauaaaauauuagauaaagauacccaggaaaucuggaaggcucuucccgggcuaggaauaauagaaggggcucucucguguuuuucccucucccucuugcaagucuuggcucauuuuaaauucauuucucauuuucugauuuccucuuacaauaaauacagagggagaaaaggaucaggugaaggcucauuuaucuuagcgucuaggucaugugaaguguugaacacucagcuguugaagcacugccaguguccaaucaagguuuuuguagggcuauugcagcccagcucugggcuguguuccuuucagagaauucagaauucagaugaagcuaggacaagauugcaaacaauacaaaacaauaaaaccacuacuucauuccucugggcaaucugugucuuuuaaggaucugucccuugagcuggauaauaucuccucuuugaaggcuauccugcucugcacccucccuucuaguccacucccgucucccaagacagucaacuacuauacucuuuucugugcugacacugggaccuuauaaauaauaacagcugucuuggggaccuuuauuuuuggcagccugugcauggucucuuuugcuacauagcuaugauuauuguucccauauuauaggcagggaaacagaggcuaagagaaacuaaauaacugauguaggcacaaaggaaguaagcuauggaauauuagacuugaaucuaggucugccuucucaaucuaggcuuuaagcuuuuccuccucacaauguuccagaauucccccugcugcuuuggccauccuagcuuuuuauuuauuuuuuauuuuucuuagagucagggugucacuuuguugcccagguuggucucaaccucaugagcucaagugauccucccaccugggccucccaaagugcugggauuacaggcguuagccaccaugcccggccugcuuuauucuuucuuucuuucuuuuuuucuuuuuuuuuuuuuugaggagagauacuccuccacuuuuuuaaaucuauauauuuaagguacacaacaugauguuaugggauagucaaaaagucacuauagugaagcaaauuaacagagccaucaucucacacaguuauccauuuuuuuuguuuauuguggcaagagaagcuaaaaucuacucauuuaguaugaaucccauauguaauaaauuuuauugccccuccaccuuuuaauacccugggacucauacuucuuuccuucccaaaggcugcugauccccaccuucccaccucauucuggcagcuauccaccucuguucucucuccagcccuaucccauauuagcucaggaugagcacuucagggaagugccuuagaauuccagacaagugagagaagcggagcugcccaacacuuguaagagguggugcuaaacaggaguucaagacaagucugagcaacauagugagaucccauuucuauaaaguuaaaaaauuuuuauaaaggaagaaaaccccaaaagcuccagacuuggagcuaagucuaguuucucucucuuuuuuuuuuuuuaaagacagggucucacucuguuacccaggcuggagugcaguggcgcagucacaacucacugcagccuugaccucuugggcccaauccucccaucucagccucccacauagcugggaccaaggaugcacaccacccugccggcuaauuuuuuuauuuuuguagagacagucuccuuauguugcccaggcuagucuugaacucuugugcucacgcaaucuuccgccucugccuaaguguugggagaccauagacagacuguacguuauuuauuuuuuagagaugggggcuugcuguguugcccgggcugcacuugaacuccugggcucaagugauccuauccuccugccucagccuccuuaauaacugggauuacagucaagcgccacugugcccggcugagacugcaucuuauuuaucuuacucauugcuacuaucuaguucaagccaucauucuguaccuggguaauggagccucuggcuuccaccauuguccucuuaguucugcucuuagcacggcggccagagugaucuuuugaaagcacgagucagauccuaucacuccucuguucaaagcccagcagugguucuguuucagccaagauuccuacagcucccuacuugagaccccucucucugaucuuaucuccucauuaggcucccauuugcucacggcuccaaccguccuggccuucucauuauuuuuaacacuucccgaggcuuuugucuccaggccuuuccaccagcuagcuguuccuucugccugggacacucuuccccagacaacugcauggcugacucccucagcucuuucaggucuccgauuuaaagucauuuuauaaaugaggcccaugcugacggcucuauuuaaaauugcaggccaggcgcgguggcucaggccuguaaugccagcacuuugggaggccgaagagcgcggaucacuuuugaguucgggaguuugagaccagccuggccaacauggugaaaccccaucucuacuaaaaauacaaaaauuagccgggugugguagcgcgcgccuguaaucccagcuacuuaggaggcugaggcaggagaaucacuugaacccgggaguugcagugagcugagaucgcgccacugcacuccagccugggcgggagagcaggauucccucuuaaaaaaaaauugcaaacccccuuccuccaguuuuccucauaccccuuacccugguguauuuuuuuuuccccauaugccuucuaacauauuacauaauucucuuacauuuaucaucuuucuccuuauauuagaaugaaagcuccaacagggaaggguauuuguuuucucucucucuucuguuuacugauacaucccaagcacuaaaauagugucuggcaaccuuaguagugauuggcaaauauuuguugagugaaugaguacaugaaucuucagaaucuugcuagucuuauaaagaaaaggaauaugugaauacuuugaaucuccagugccuagaaaugcuugaccaaacggcagguguucaauguuuacugaaggaauugugugcucagaucugcuggaggucuuuaucugaacccuuugagacuaugucaaaaaaguacccagggccaauucacucaugccucuccuuuuccucucauccaaucagccuaguauucaucuaacaaauaucuaagucuccaaauauugagccacccauugugaguucaaaagcguguuuggcgcugcaggggaauaugugacuaacgcgaaugaagcaacagcaaauacuacacuggaauguaauuaagugugaaauuauagggcagauuaucagugcuaauaguuuagagaaagaaucagugaagacugacguagaaguaaauuccaaaguucacucgucgaccaaacuacccuucuaaacgcuccaccuacugauaguaguaccauaaccuggguagcuaccuugagaauuagaagggccuuuagagguccaacuccuuuaagaaagaaagaaagaccaggcacgggaaaggccuccgcagacaugagucuagcaccugggacucaugaaguucugaaaagagggguguccugaagguccaaggcgccuuuguugggggucccggaauccgcggugugccaggucggaaaaggcguccgcuuuccuggagaggaggcuaaggugccgggcgcuucggugagguggcggauguuggggggcgggggagggcagaaggcaccauuccuucggggcauggggccccagguauccgugggcaggguccaaagccaccgaucccuacuguccucaacugcgggguugccuccgccgccuuugcucccagacgccacuccgaggcacaaggaccccaagucgcucggaacugccggccgcuagaugacaccggcugcgccgaugcagagccucgggagucucagggcacua

SEQ ID NO: 14102 - RNA, 10351 nt, Homo sapiens
uagugcccugagacucccgaggcucugcaucggcgcagccggugucaucuagcggccggcaguuccgagcgacuugggguccuugugccucggaguggcgucugggagcaaaggcggcggaggcaaccccgcaguugaggacaguagggaucgguggcuuuggacccugcccacggauaccuggggccccaugccccgaaggaauggugccuucugcccucccccgccccccaacauccgccaccucaccgaagcgcccggcaccuuagccuccucuccaggaaagcggacgccuuuuccgaccuggcacaccgcggauuccgggacccccaacaaaggcgccuuggaccuucaggacaccccucuuuucagaacuucaugagucccaggugcuagacucaugucugcggaggccuuucccgugccuggucuuucuuucuuucuuaaaggaguuggaccucuaaaggcccuucuaauucucaagguagcuacccagguuaugguacuacuaucaguagguggagcguuuagaaggguaguuuggucgacgagugaacuuuggaauuuacuucuacgucagucuucacugauucuuucucuaaacuauuagcacugauaaucugcccuauaauuucacacuuaauuacauuccaguguaguauuugcuguugcuucauucgcguuagucacauauuccccugcagcgccaaacacgcuuuugaacucacaauggguggcucaauauuuggagacuuagauauuuguuagaugaauacuaggcugauuggaugagaggaaaaggagaggcaugagugaauuggcccuggguacuuuuuugacauagucucaaaggguucagauaaagaccuccagcagaucugagcacacaauuccuucaguaaacauugaacaccugccguuuggucaagcauuucuaggcacuggagauucaaaguauucacauauuccuuuucuuuauaagacuagcaagauucugaagauucauguacucauucacucaacaaauauuugccaaucacuacuaagguugccagacacuauuuuagugcuugggauguaucaguaaacagaagagagagagaaaacaaauacccuucccuguuggagcuuucauucuaauauaaggagaaagaugauaaauguaagagaauuauguaauauguuagaaggcauauggggaaaaaaaaauacaccaggguaagggguaugaggaaaacuggaggaaggggguuugcaauuuuuuuuuaagagggaauccugcucucccgcccaggcuggagugcaguggcgcgaucucagcucacugcaacucccggguucaagugauucuccugccucagccuccuaaguagcugggauuacaggcgcgcgcuaccacacccggcuaauuuuuguauuuuuaguagagaugggguuucaccauguuggccaggcuggucucaaacucccgaacucaaaagugauccgcgcucuucggccucccaaagugcuggcauuacaggccugagccaccgcgccuggccugcaauuuuaaauagagccgucagcaugggccucauuuauaaaaugacuuuaaaucggagaccugaaagagcugagggagucagccaugcaguugucuggggaagagugucccaggcagaaggaacagcuagcugguggaaaggccuggagacaaaagccucgggaaguguuaaaaauaaugagaaggccaggacgguuggagccgugagcaaaugggagccuaaugaggagauaagaucagagagaggggucucaaguagggagcuguaggaaucuuggcugaaacagaaccacugcugggcuuugaacagaggagugauaggaucugacucgugcuuucaaaagaucacucuggccgccgugcuaagagcagaacuaagaggacaaugguggaagccagaggcuccauuacccagguacagaaugauggcuugaacuagauaguagcaaugaguaagauaaauaagaugcagucucagccgggcacaguggcgcuugacuguaaucccaguuauuaaggaggcugaggcaggaggauaggaucacuugagcccaggaguucaagugcagcccgggcaacacagcaagcccccaucucuaaaaaauaaauaacguacagucugucuauggucucccaacacuuaggcagaggcggaagauugcgugagcacaagaguucaagacuagccugggcaacauaaggagacugucucuacaaaaauaaaaaaauuagccggcaggguggugugcauccuuggucccagcuaugugggaggcugagaugggaggauugggcccaagaggucaaggcugcagugaguugugacugcgccacugcacuccagccuggguaacagagugagacccugucuuuaaaaaaaaaaaaagagagagaaacuagacuuagcuccaagucuggagcuuuugggguuuucuuccuuuauaaaaauuuuuuaacuuuauagaaaugggaucucacuauguugcucagacuugucuugaacuccuguuuagcaccaccucuuacaaguguugggcagcuccgcuucucucacuugucuggaauucuaaggcacuucccugaagugcucauccugagcuaauaugggauagggcuggagagagaacagagguggauagcugccagaaugaggugggaagguggggaucagcagccuuugggaaggaaagaaguaugagucccaggguauuaaaagguggaggggcaauaaaauuuauuacauaugggauucauacuaaaugaguagauuuuagcuucucuugccacaauaaacaaaaaaaauggauaacugugugagaugauggcucuguuaauuugcuucacuauagugacuuuuugacuaucccauaacaucauguuguguaccuuaaauauauagauuuaaaaaaguggaggaguaucucuccucaaaaaaaaaaaaaagaaaaaaagaaagaaagaaagaauaaagcaggccgggcaugguggcuaacgccuguaaucccagcacuuugggaggcccaggugggaggaucacuugagcucaugagguugagaccaaccugggcaacaaagugacacccugacucuaagaaaaauaaaaaauaaauaaaaagcuaggauggccaaagcagcagggggaauucuggaacauugugaggaggaaaagcuuaaagccuagauugagaaggcagaccuagauucaagucuaauauuccauagcuuacuuccuuugugccuacaucaguuauuuaguuucucuuagccucuguuucccugccuauaauaugggaacaauaaucauagcuauguagcaaaagagaccaugcacaggcugccaaaaauaaagguccccaagacagcuguuauuauuuauaaggucccagugucagcacagaaaagaguauaguaguugacugucuugggagacgggaguggacuagaagggagggugcagagcaggauagccuucaaagaggagauauuauccagcucaagggacagauccuuaaaagacacagauugcccagaggaaugaaguagugguuuuauuguuuuguauuguuugcaaucuuguccuagcuucaucugaauucugaauucucugaaaggaacacagcccagagcugggcugcaauagcccuacaaaaaccuugauuggacacuggcagugcuucaacagcugaguguucaacacuucacaugaccuagacgcuaagauaaaugagccuucaccugauccuuuucucccucuguauuuauuguaagaggaaaucagaaaaugagaaaugaauuuaaaaugagccaagacuugcaagagggagagggaaaaacacgagagagccccuucuauuauuccuagcccgggaagagccuuccagauuuccuggguaucuuuaucuaauauuuuauaauucuugaauuagguuuuuuaaaaggcuauauguaggccaucugagaggucucagcacuacugacugcuauuuaaggaaaaugcuugggcauuggucgcuaugcacacuuaaagagcauucaauaaucauuuagcaagcaccuacucuauaccagauguuguacuaaauaccaaggagucaaaagagaauaaaagagaagcagacauguaaacaguuaaucccaaugcaauuugguagaaauuuauacuugugccauggaaacagaaaagaagcaaagcuuaauucugucaaauuggaugagguggaggguggggcacagucacuggggccaaagaaagcuucauccuuaaaagguaaaguuaaggcuaaauuuuaauaaaugaguaggaauuugccacgcagagauagaagcaagacugggaguagagaaaggcaauugggggcagagaacagcuugugcaaagucaaagagguuggguagauacaagaaaaguagaggccacagaagugauagucuuauaaguagucauuaaauauugguggcugauggcaauaacuaacucaugcagcuagaccacaucacucuauguaaaccaucaaguuccuguccucugguagcuugguguuaacuucagauuauaucaguaaaggcaaaaugugauccuucccaaagacucuacuacuuaaucauuauuaguagaaaggaguagcuuaguuuauuuuuucccaguagaaggcauuagccuaaaauacuuuuuuuuccuaggcugucaaugauuuugcacuagugcauucauaacaaucugccaucccccaccugcaacccaucuccauguuccuuguaaccaccugguucaaaccuuggcuuaccuccacucuuagaaucagccgagcuaauuaaaagcacagugaaagacacaaaggcaccaagacagcugagcaaacauuaacaaaugcguaaguaaauaaaguacuuguauuauguguaagcaauggugcagaugaaacuuggguggcacuaggaagggugagucagaggauguucaaacagaguaggaucaaggaaaaucucucugccaguuaguuagcaauaucuuuugggaugauagaaaggaaccugguuagcaggaaaaaguagccaagguuugcagcccaaaggaaccugaaacucugguacaaacucaguaguaagaaacaauuauuuaaaguugcaaagauaauuggcuuacuucaugccuaaugagcuaaauaagaaccaucaagaaaccccaaugcuagauggaguuuggugggggaauaguuaacauuuacuguucuuugugugaguagcaacacaauaggcccuuugcaucuguuugguuuuuuuaauccuuacaguaaaacuacaagauggucaucgugugaaagaagaggaaacaggcucaguacuuuaagugucagaggcaggauuugaagccaaaauugucugauccuaagcccucucuccugccuucaaagacucuaaaccagcaggauuguuuacaccaauaugcgagucguaagguccugggugaggcacugugagaagguguguuuacauccaagugucacaaauaaaggguaaagagacccuguggaagacuauauaauuguucccaaacacuuacugugccuuccagaauuggauuguaauuuccuauugacagcaggcuuggcugugugacuugcauuagcuaaugaaaugugaguggcaguaugagccacuucuagcuggaagcucucagucaaugugcugcaccauguuuuccuuuccugcuguccucaugacaagcaacauucuggauagaggcuaauccaucagccucagucccagagugaagacaaugugcagcaaagccacagcugaccugggaaggacacagcauaagcgagaaaaacaaccuuugcugauuaggccacugagauuuugggguugauaccauagcauaacagagccuauaaugacuaaugcagacacuuucugaaucuugcucuuuagugacacaaauuucuggugucaucuucagguagaaagauugcuuggggauuaugagaagauauagagaaugggaugauugguguaguauagugaaaggcuuuaaaauacaguauuugagguauuugaggcagcgcaugguggcucacaccuguaaucccagagcuuugggaggccaaggcaugaggauugcuugaggcuaagaguuagagacccgccgggagugguggcucauaccuauaaucccagcacuuugggagaccaaggcgggugaaucaccugaggucaggaguucaagaccagcuuggccaacauggugaaaccccgucucuacuaaaaauacaaaaauuagcugagcgugguggugcaugcuuguaaucccagcuacucaggagggugaggcaggagaauugcuugaacccaggaggcagagauugcggugagccgagauugugccaccgcacuccagucugggcgacagagcaagacucugucucaaaaaaaauaaaagagagagagagacccuaccuugagcaacauagugagacagugccucuaaauaaaaauaaaauaaaauaaaauaaaaauacagaauuugaaacucagucagucuugaucugugggcucagacaacccuuuauaaaugccauggaccaugucaugccccagaagguggggaacuuacaaagaauguuaagauauagcuccuguuuuucuuuucuuuuauuauuauuauuuuuaauagaggcaagaucucauuauguugcccaggcuggucucgaaauccuggccucaaacaauccuccugccucaacuucccaaaguguuggaauuauaggugugaacuaccaugcccagcacagucccuguuuuugagauaagggccaugcucauuugcuucuauaccuagcaacccaucacuguauguggcagccucuaggcccuaaauaaguaaauuuuugucaaauuaaugcuauggaauaaucuggaacuauaacugaagucuccuaacuccccacaaaggcucuuccuguguugugacauauugcuaacuuggguuaagggauuauuaguagcuaauuuuuauauaaaauauuauguguaccuaauuuauuugaaaugccaaauaaaugaaaaauaucuggaacaauaggaucugcaggcccuggagcaugauaaauauucaguaaaggcacucaguccucucugaaggaaucacaaagcauggaagacacugaagaucccaaaggacuuggcaaugagaaaucuagcuugaagggcacuggggaccaaguuuuuaaugggaccagauuaagagaacauguaggugaagguuaaauuuagguaaacaggcugggcacaguggcucacaccuguaaucccagccuuugggaggcagaggcgggugaaucgcuugagcccaggaguucaagaccagccugggcaacguggugaaacucuguagucccggcugcuugggaugcugaggugggaggaucacuugagcccgggaguuugaggcugcagugauuuguguucgugccaccgcauuccagccugagcaacagagaaaguaccuugucucgacaaaaaaauuuuuuuuuuaaauuagacaaacauaggugcaaaguccuaagucuuaacacuuuccagacauuuccaaagcuuacugggcaguaauugaaaaaccaucuguggaauguccuugaugcaagcauugaagagaguccugagaacuaauuaggacugcucagaucuguggaucaguucuucaaaacuaggaagagauucaaccuguuguuucuacuauucacuuaagaagugacaauacugcaaacauaacaggcaucuaauucuggaguaugacaguguuggcauaauuagaauuugagggccgggcacaguggcucacgccuguagucccagcacuuuggaaggcugaagcagguggaucgcuugaguccaggaguucucaaccagccugggcaacguggaaaaaccccaucucuacaaaaaauacaaaaauuaacuggacgugguagcacacaccuguagucccagcuacaaggugggaggaucacuugaacccagaggcugaggcugcagugagccugaucaugccacugcacuccagccugggcaacagagauccuaucucaaaaaaaaaagugugagagagaugaaacaagacuggcaaaauguugaugucuguagaaguucagaggagggaacgauggcuuccgucagaaucaggaaacagaaaaagaaguaauauuuuauauuaauaaaucccuguaauguaagaguuggagauuauccuccucauuuuauaggcaagggaaacugaggucacuuugcuagugaauggcaauauaaagacuugagcaucaauucaugacuuugaaaucccuccuuuugcuaacacaccacacagacugcuuaaauaugucaucucauauucuauuucagugaaaaugaagaagaguugcuuuacuacguaaaggaaacuuauuuguaauuccuauaucuuucaccuuuccuaaaggaucucauuuccaccuuuuagcaacuauuuugaauacuuacugacuuaugcuguuuucauuauaucucaucuaaguucaugauucauccauggcuugcccccacuuuaauaugguagaauaaauaagaaauguuucuuuuugcaaugauucuuaaagcaaaauaugcuaaaaaggcaugugcacacacacacacacaugcgcacacaaagacaaaguuucuuuuaauguacuuaaguaaaguauuucccuuuuuaacuauuuagcaguuaauuuauggccuauacuauguccacugccccccaucagaucucuuuuucugcaguguuaaguauagccaagcuuaacucuucuagugggguuucuuguuccaugcuaccaugaaauauaccacccuuauuucuacaaauuucaucuggaguugaucuuuuucuaaaaugaaauuugcuagaaaugcuggugaaaugaauauuuauuuauucaguaaauauuuauuaagugcuaauucuagguuagguauugugcuaagggcugggaguacaaagauaaaagcaguagcuagggggcaguauagcauaauagcaauuaagaguaagggcuccccgccagcaugguggcucacgucuguaaucccagcacuuugggaggcugaggcaggcggaucacuugaggucaggaguucaagaccagccuggccaacauggcaaaacccugucucuacuaaaaauacaaaaauuagccagguguagugccgcgugccuguaaucccagcuacucgggaggcugaggcaggagaaucgcuugaaccugggagguggaggcugcagggaggcggaggcugcaguaagccaagaucacgccauuguacuccagccugggcaacaagagcaaaacuuugucucaaaaaaaaaaaaaugugggcucccucgucugggguuaaauggccagcccugccacucacuaguucaaugauuuuaguuaggcaaauugcuuaaucucucugagcuucaguuuccucaucuguaaauggggauaauaauaauacagacaguccccgacuuaagaugguuugauuuaaaauuuuuugacuucacaguggugugaaaacaauaugcauucaguagaaacuauacuugaauuuugaauuuugaucuuuucccaggcuagcaauauguggcacaauacucuuccaugagagauucaacauguuauuauaaaauaauacauuuauuuuauuauuuauuauuuaggcuuuaugaucgaugauuuugcccaacuguaggcuaauguaauuguucuggacauguuuaagauaggcaaggcugaucuaugauguuugguagauuagguguauuaaaugcauuuuccacuuaggauaucuucaacuucugaugaguuuaucaggauguagucccauccuaaaugaaggagcaucuguaccuaccuguguagguaugcugugaguuaauugaaaccacgcacagguagacugcuuaacacagugcuuagcacaugagaagugcuauaaauguuagcucuuccuauuccccuguaugguucauauaggaaggauaguggaagaaggaauuugaucugacugagggugagcauuuuuuguugguuuuuuugguugguugguuguuuugagaugggauuucauucugucacccaaguuggagugcaguggcaccaucucggcucccugcaaccucugccucccaggcgagagugaguguuuuaaggaagaguuugcagauacagaaacacuugaccacauccuugaaaaaugaguucaaguuuguugaggcaaaguaggcagaagaaugauuccaag

SEQ ID NO: 14103 - RNA, 4912 nt, Homo sapiens
ccuuugcugccagguucacacugggagacguucugugacuucuugguggcuccacaugcagucugaaacucagaaggggaauugcgaaccaccuuuuaucuagggauaaggaucuagaagaaauaggggugauccuagagacagaaaacaaaauccugaagaaaaaguaaagaugagaggaggcugagaagucucagauauggcaaagguaagggacagaaaagcagaccucuagauaguaggugccaggccaguaguucugaaggcugacccugggccccugcaggugcugcugcuagcccugucccccacucucagcccaggccccaucccagcuccuaccugguagguaccugucguggcuguggcuguacucuauggcagugagugacaagugagucuguguaaagggcugguugccaaacagauugucacuacgaagguuguggcagaguuucuccaggaagcggaggacguaggugaugcuguugacugcugggagguugaggguaugcuguucccggucaaacacggcuguggagugaguaaacagggccaagcaugucagccuggcaguggaguacagcgcuaggcaggacgaguccagcccacugcuugucucaggcuuaccugguuacacaaagggaaucagugccccacguuuccucccucccucccuuuaacucccucccucgagggcuuugauuuuugccuccaacuguaaagggcuugcaaauaugggaguggccaggccaggucuguugcacccugggcucuggaaugauuuuauucaacuugugaaaacaacugugaacauaauucucucugcuccaucacuugguuggaccucccccaggaaaucugcucauuuagggugcuauuuucacaagaacugcccaagaacagagaagcuuggcagaagaguagaauauagccauagccagcaaugguauggguacacaauuucugaucuacauaagggcacuagaauuuuggcaacauuuggaacuguuucaugcuugguguuaguuuacuuccuaucaucuuuuucuauaaaaauguaucaguauaaaccuuaaaaagcaaagaccuguguauuugucucugagggcagcaaggacauggggauuuggggagauaggucauucucaagaaccaguuuugaggcaggagaagaaccccagagaggguauaggagagcagcuaaagagaggcaguaaagaaggccagguuccuacagaccauuacacagaaacaaagaagagaccagggaguaggcugggccucagaagggacauaaggcuuaauuucccaggcacuucccagucuuuuuuuuuuuuuuuuuuuuuugagacggagucuugcucugucacccaggcuggggugcaauggcacgaucucagcucacugcaaccuccgccucccagguucaagcaauucucuugccucagccucccgaguaucugggacuacaggcgugcaccaccaugccuggcuaauguuuuguauuuuuuuuuaguagagacaggguuuugccauguuggccaggcuggucuucaacuccugaccucaggugauccgcccaccucagccucccaaagugcugggauuacaggugugagccaccgcaccuggccaauuccuagucuucuauaaaaauucccugccugucugcuccauccuccucacagccaaguacucccuagucuggguucccacaccacucuguauacauuucccuauuacagcacuucucacaguuagcuauguauauucuuucuuuuucacugguauggagccuaagcugucaucuucuauucuccccuucuccugaccagugucuggcaaucaccugacacauaguaaggguucaauaaauguuugcuaaaauaauacagucugguuauuuauggagucuuccaugccagcgggguuuccugaagcugguuauuacaaccugcuagggaggaggggcaggggaauauggaauagcaucaguuaagacugaaaggcucuaggucaagucuucauagguuuaguggcuaaacaggauuuuggauuuaggaaaacugaaacagaaucaggacacaggagaaaaaaugaguauucugugagagcaaaaaacacugugucacugaaucaaacucucauagcaguaaagaaaaaggaaaugacuuuucccaaccacccugggauuuaauucucuucuucugggccugguuuaggacgaggaagcuaaggaaucaaaggaaugauagaggaguucagugguuccugaaaccaggugggaggcugcaacagucuggagaaacccuccugcugccacaacauagcccccucuggauucuuucuccuauacuuucuguacggacaggucaaucagguagauggggggaaucaguuuagaggcucacugaagcagaaucuguggguauucuccuuggcagagguaugcauaaggcucagaggggcucuugggggguuggagaugaggaauggaauaccuucacauuuuuccagagccugcagguaugaagugggaaccaggaugccuuacaagaaaucaaccaguugagaagguggguccuucuggcugggaggcaauaugagccaaagugugcuuaccugagauaaccucaccaccauggccuugcuugaggaagcugaagacgguuuucuggugauaagcacagucgauacaggccuggacagccugcugcaacaccacagaggcacgggcugguccaaaauggucagggaguugcuggaccuucuucuuaucuaagugggggccugugcugccauucuuguucaaguagauacaaacuaugggagacaaagaaucaaagaagcuucaagagucucugggauagagaagucagagaacagcauccuauuccaucuuuuauaccuuggccucugguuccuaacagaauuccuagcagcugagcuggugaaaugcugugggagguagaggguggagggucaagaaaaggcugugcccagcuacugccaacccaaacugcaugaucaaagucugugggaagacuggaagaguggcccagaccaaaggccaagacacagaguuugcacuuugucuucugugcacugaaaagaaaaucuagacaauuccccucuuguacguacuuccauuuuuuuguacuugguugccucacauauucuuuguaccucuuaccauauauguguaaggcacuguggggcaauggcaauauuagcaagggcauauguguguguguguguguguguauguaugucauuggauuuagaauaguugcaccauugaucauuugccuugcuuucuguuuugggccuuagggucccuuuguuaucuucuacaucaacacucaugcccaaagaauauaauaaaaauuuuaaaaaaaauuggauuaaaaaaaaaaaaguugggcugggcgugguggcucacgccuguaaucccagcacuuugggaggcugaggcagguggaucacgaggucaggaguucgagaucagccuggugaagaggugaaaccccgucucuauuaaaaaaaaaaaauagccgggcaugguggugggcgccuguaaucccagcuacucgggaggcugaggcaggagaaucgcuugaaccuggaagguggagcuugcagugagccgagauugcgccacugcacgccagccugggggacagagugagaauuggucucaaaaaaaaaaaaaaaaauugggugcaguggcucacaucuguaaucacagcacuuugugaggcugaggcggaaggaucacuuaaagccaggaguuugagaccagccugggcaauacagugagaccacaucucuacagaaaauuugcuaggugugguggcaugugccuguguucccagcuacuugggaggcugaggugggagaacugcuugagcccaggaguucaaggcugcagugagcuguaaucgcgccacugcacuccagccuggaugacagagacuccgucuuuaaaaaaaaaaaaagugaaaagagcuugagggucccaagacggcuaagcacucuccuagcuacuggccuccaccuggcacugcaguggggaaggggugcagugggcacaggagaccgaggcaguccuaacagaguugucucuggaguuguucucuccucaggacccacagcaaccuggucagcaaugacauuuucuccuccaucugcuuuccagcuucccauuugaguagcggguacuauucuuucuugugugguuguggcucacuagcugaagggguagaagggcaaaagucucuuugcuauuaaagguagaaaagauaagagcaguaauuguguggcccguggauggacuguuguucuccuugggucucagguucaccaccugaaaaaugaagugacugagccagaugcucucugaggauucuccaccuucauaauucuaauucuaaggagaaccaacauggacggaagaaauggaaaacagaaaguagggaggugauauguggaaagugacaggagaaacauaaaaacaaaaagaagaaaaggguaaacaagaugaauugaacgaauacauuuaacucuguucucuccaaaaacucacuaaaaugagccagauaauaagagaggagaugacaauaagauuaggaagguggaaagcggacuggaaacguagcgacugacucaacagacccaacaaagcuguauacccuaaagcuggaguggggagugaugagaaccacgcucucauaauuugcaaaaggccuaauaaucggcagaguuggugccucuggaggugagugugagggggaucuaauaaaagaagguuuaacugaagucuuuuaagaaacaggauuuucacaucuaguaaugugacucuuuuacugaaauaacuaaaaaugcaggaauccagagagauaagaagagu

SEQ ID NO: 14104 - RNA, 6531 nt, Homo sapiens
gagaguuugccccaggagagaggcgagcguuauguaaccuaggaucugggguggguaacagucugugcagugucaaugugagaggagaaaacacccaacgugagggaauggucagguaagaaaggaccagaaguuccgguucuaccauagcaaggaccuaaguugcuaauuuagguucuuuaaugcagaccuggucuuucagaacuucuuucucuucccuagccuugucauuucagcauucuggccuucccuaugaggaggaagaucaacgaagucacaggugaauaggaguuucucuucuaaaguuucaucuccuuugucagggggaaucgauacacucucucaucucuuccuuggggaaaaagaaggagaucuaucuucaucgagugcuaauaugcguacuauauguuaucacucaauggucggauaucucaguaggguuaguagguauuuuaaaaaugugucaguaacuucaggaaaacuagaaccuuguccaagcuuacucaaaaggcaaguagcauacuacuaaaugcuaccgaacuacucaggauuagguuuagaauccauaucuguaggacucccagacucuuggcauuaugcuguuucccagcaucccauucacuuacuaccuaacaauuuugccauaccuguguacuaccuguauuauucuauguuuuuacuuacuuuuuuuuuuuauaaaaaucaaacuuguccuaagaaacaauaucugugaaauuagccauuugauggcugcuccaauaacaguauaguuauucuaagguguaucuaaaaauguugguccaugugcuauguaaaaucgucucgugucagacauacaaacuacaauuugggacacaaugcacugcauuaugcucucuucuggauucuuuucugcguaggaaagucccagacacaucugagcaucagucauccaucccuaguguacuguuuuauucuuauagaugaauacuuucacagagaaugcccugcuuuguaucuucuccaaaagacauuucacuucccuguuuagaacuaccuguucucaauguuguauguaaaacaaguaggaacuccauacauuucaggagcuuccucucucuuuggggaguuaauguguacacaggaaauagucuaacucuaugcuguucaguagagcuuucugugaucagggaauguucuguaucugugccuuaucuguauccaccagccagauguagcuacugagcacuuaauauauggcuagugcaacugagaugugaauuuuauuuuauuuuaauuaaauuuaaguagccacauauggcuaguggcuacuaauggcuaccauauuggacagccaggucuagauauuugaaauaaaauauuuuaagguuauugauuuggacuuggaguucccccucacccucacaaauaccucauagcauauguguuauaaaugcccuuuagggcugggugcgguggcucacgccuguaaucacagcacuuugggaggccgaggcgggugcaucacgaggucaggagaucgagaccauccuggcuaacacgaugaaaccccgucucuacuaaaaaauacaaaaauuagcugggcgcgguggcgggugccuguagucccagcuacucgggaggcugaggcaggagaauggcgugaacccgggaggcagagcuugcagugagcugagaucccgccacugcacuccagccugggugaaagagugagacucugucucaaaaaauaaaauaaaagaaaagaaaaaauaaaugcccuuuaacuuuaguuucuuggugaaggguaaauauucuuuccaauuuucagagacuucauaguugaaauaaaguuucuugaaauuauuuaaagcacauugacaguuuauaacacuuguguaaaugcacagcuucuguauuuuguuacuauugaaauauccuguaaagcaauaauguuguaggauacucuauaagcaaaagucuuacuauuguauuauuuuuauucauugcagauaacuuuucuucuagcuaucuauguuuucuuucauuagugacauuuagacuauuuaaaaaucaguuaaacacaaccacaacugauauuaaugacguuuucagggcaucacuucuuacgcuuugacauaggaguuggugcauucaccuuauuucacugcuuauuagaauagcaagaaggggacauuugguucauagcuaucucuaucagcuaaaauucuaugucaaauuauuuauuuuccuggcacucaaagucaaacacuaauggacugguuguaucuuguuuugcuuacucucuaugcagguuagauaugugggguuagaaggaaggcuuaaaaagaguaucuucauaagauaauuugccuaguuucuuuuuucuuuuuucuuuuuuuuuuuugagacggagucucgcucuguugcccaggcuggagcacaguggugggaucucagcucacugcacgcuccgccuccuggguucacgccauucuccugccucagccucccaaguagcucggacuacaggcacccaccaccaagcccggcuaauuuuuuguacuuuuaguagagacagguuucaccguguuagucaggauggucucgaucuccugaccucaugauccgcccgccuuggccucccaaagugcugggauuacaggcgugaaccacugcgcuuggccgcccaguuucuuaagauuaaaaaauacuugaaagacaaaacaaucaaacauaauguguggucuuuguuuccuggauuaaagaaaagcuaucuaggacauuuugaggacaguuggggaaauuuauauaugaacuggaauguuaaggaauuacuaauuuugucagaugugauaauguaguuaugaggagaaugucauuuggaagacaguauugugguuaugaagaagaaugccauuuggaaauuaugcugaaacauuuagauuuuaaaguuuuaugcuaucuguaauuuacuuuaaaauaguucagccaaaacaaaaaaguacacacacaagaaguaaauacagcaaaaugucaacaguuguucaucuacaugguguggacauggguguuuguuguuuuauucuuucuacuucucuguauguuugaaaauuuucuuuuucuuuugagauggagucuucacucugucacccaggcuggagugcagugguguuaucucagcucacugcaaccuccacuuccuagguucaagcgauuuuccugccucagccucccgaguagcuaggauuacaggugcccgccaccacacccggcuaauuuuuuguauuuuuaguuucaccaugagguguauuuuuaguuucaccaugcuggccaggcuggucucaaacucccgaccccaggugauccaccugccucggccucccaaagugccgagauuacaggcuuuagccacuguacccggccuugaaaaucuuuauaguaaaaaguugaaagaaaaaaggaguacaguacccauccccaucccacaguaggguagugagauauuggauguaaaacacguggcucagugucuggcacacaaaaaauaaccgcacaauaaauauucucuauuauagcaguaaauuuugaguuuuuaauaaugcuguaauaggcagauuuuuuucccauuauaagcuaguuucuuguggagggagaaaauaaacuuaaugggaaacuccaguuuagugacagacaccaauuucuauaauauuaagaggauaauuuaugaagucaagcuacuaauuuccaugugucgcuguaacauccucuuauuauuucaugcauuaauuuguguuagacuauauuuauuuguaucuauauauaguugaucuuugaauuuugccauacuagguuccuugaacugcauuuaaaaacaguuauugcagagcuccuuuuucucaaggaacaguuuguaguugagauucauuuugcucgucaaggacuuuguauaaaggaaauuguagaaaguggcccaugguaaacuucucaaacauuguuccuacauuuacaaagauguauauucacuuaaaauaaugaaauacucuuucaagucaauagaauuuugaagcagaaaaggcaaaccucaaaucuccuuuuuuuuuuuuuuucuuuuucuugagacagagucuugcucugucacccaggcuggagugcaguggugcagucucggcucacugcaacuuccaucucccuguucaagcaauucugcugccucagccuccugaguagcugggaauacaggugugugccaccauaccuggcuaauuuuuguauuuuuaguagagaugggguuucaccauguuagccaggcuggucuugaacuccugaccucaagugaucugcccaccucagccucccaaagugcugcgauuacaggugugagccacccgccccgccucaaagcucuuuuuaaaucugaagaaacugaggccaagaaaggugauuugcuuaaagucacacacaguauguuaguggaagauccaggaauaaaacuauuuuuccacuuaaaaaauucugcaguggcucaugccuguaaucccagcacuuugggaggcuaaaguggguggaucaugaggucaggagaucgagaccauccuggcuaacacagugaaagcccgucucuacuaaaaauacaaaaaauuagccaggcgugguggcgggcgccuguagucccagcuacucgggaggcugaggcaggagaauggcaugaacccgggaggcagagcuugcagugagccgagaucgcgcaacugcacuccagccugggugaaagagcgagacuccgucucaaaaaaaaaaaaaaauucugccaagagauauauauggauauauauaaggagcccuauagcaauacauaccuggacuauaacucaaggcauuacuaauuggucauaaauaaacuggcuuuuuaaaagaauguaaauaaauaauuugucauaauuuuguuuuuaucucacugaaauuugaaagugcuuuugagaacguuuuuauuugaacaaugcauuucuuuaacauguuaugcagggcccuucuagcccaauccagagcuguaccauggcagagacaagagaagaggagacagugucagcagaagccucaggguucucagacuugagugacucagaguuccuggaguuucuggaccuagaagaugcccaagagucaaaggcuuuaguuaacaugccuggcccaucuucugaaucccuugggaaggaugacaaacccauaagcuuacaaaacuggaaaagaggauuggauauauuaucacccauggagagauuccaccuuaaauauuuauaugucacugaccuggcuacucagaacuggugugaacugcaaacagcauaugggaaggagcuuccugguuucuuggcaccugagaaggcagcuguguuggacacuggugccagcauacaccuagcuagagaacuagaacuucaugaucuugugacugucccagucaccacuaaagaagaugcuugggcaauuaaguuucugaacauacuuuugcugauuccuacccugcagucagaagggcacaucagagaguuuccaguguuuggggaaggggaggguguacuucuuguuggagugauugaugagcugcacuauacagccaagggggaacuggagcuggcggaacucaagacacgcaggcgcccuaugcucccucuggaagcucagaagaagaaagacuguuuucaagucagccuauacaaauauaucuuugaugccaugguacaaggaaaagugaccccugcuagccuaauccaccacacaaaguugugucuagaaaagccacuggggccaucagugcugaggcaugcccagcagggaggcuucucugugaagucuuugggugaccucauggaacuugucuucuugucucuaacacugucagaccucccaguuauugauaucuugaagauugaguauauccaccaagagacugccacugugcuggguacugagauuguagccuucaaagagaaggaggugagagccaaggugcagcauuauauggccuacuggaugggccaccgagagccccagggaguugacguggaggaggcuuggaagugccggacguguaccuaugcagacauuugugaguggagaaagggcaguggagugcucagcucuacacuggcgccccaagucaaaaaagccaaaugaauagaagguaugcuuucaagaauguugauccuuccugcuccuguuguaccuaagcaaaagaggaccagucucugagcuuggcuuuuauggagaguguucuuauuuugguucuuuuuuuuauuuccacaaccucuaaccacauucaguccaggaccaaggcucagggaugagugggagagauggguuauacugucccuggagcuucaucaugauugccugagaagacagaugcucaucauggcuggaaugaagguauccuucaguaaacuuugcuuuccuaagaaaauucuucaguuucugauaagucaucccuauuuuuaucuugaucaaggcuuucuacaguuacauaauaaaaugaaaugcuguccaggacag

SEQ ID NO: 14105 - RNA, 36524 nt, Homo sapiens
cccgccuugagggcggggcucuuucccaagugcccucugugagagccgggccgcucucuccggggcguggcgaagaggggcggagucacgagcggggcggugagacuuccugcccagucgcgggccagccuagcgcuucagccggcggcucauuuccggugggggcgccgcgcccagugagggcccggaagugggucgcgcggagauugcugggcgguucuugccggaagcggagagcggcugaucgcaguccggaggugaggcggaacucugaggugagggugugcagcuugguagggauuggggucccuuccggggcccaucggccccuggugguguuaauggcccuucuggccuacgcgcgugucaugaacccugccgagagggccggggcugaggcccucaggccgacccggacucuugggcgcggucucuugagguggggccggggugagcagcugaguccgggugccccggggaggccccucugcccgauuucgcagcgcugcccaucagcuucagcggaggccugauuccugaggugcucugacuggaaggaaccuccgagaucggagagucuucccugucuccuguugaugcucccauugcacugauagguaaauugaucccuagagaagaggcuagucugagauauauagcgagugaggaaaagaaucggaaucaugauccuggugccuuagauaaccagccccaguucuucccguguugcucggaaccucucuaacuugggauggucuuccggucgguguugccccgcaggcugcugcagguuaaaggccagcgcugcguggaacuuuuuuuuuucucuccucccaaauugagccguuugaaaugccuagggaguuuuuaaaagaaaggcgggcacauccuuguauuuacaggcagauauccucccuuuccuccucggcugcugcucuuacuuugacaagccaggcuaacauugaagguauguacuucuggaccugaaaucagacggcucagguuuggucuggccucagugcugagugucuguggccauaggugccuuaaacuucuuucagccuccuuuuguucaucuuuuaaguggagaucucugcugaccccacaagauuaaauucagcguaacaaauuguguuuauucugugccagcauuuucccagaugcggggaaugcagcuuuaaaacaaaacaauguagacccugcccgcguggagcuagcaguguuugcagggauguuuaagaaguaauuauaaauguugaugaguguuaggaaagaacagggugcucugaaaguauguaacaggggguucaggaaaagcccuucugaagaagcagaguuuuuaagaugaauuuugaaggauaaauaggaaugcguucgaagaguggaaugagaacauuugagacagguuagcaucagaacugugucaguugaagcucuuuguggggcucucucuucaagagaaaauccgggggcauaucagcacauuuaucauuuaccagacuuuuauuuaauuuauuuauuuguauuuuuaguagagaugggguuucgccgugaaggccaggcugcucucgaacuccuaaccucaggugauccccccaccucggccucccaaagugcugggauuacgggcaugauccaccgugcccggccccaccagacguuuauuaagaccuuaauauguaugaggcacauuuuaaugagauagccuuuguggcaaagaauacaguucuucuggaguuuacagugggagaggaaauagacaaguaaaugagggauggcuuacagugucauagugcauagcacagggcuacaagagcacaguggagaaauaccugagccaggugcccaggguuccaggaggaaaugggaggcuaacucuugaaauauuuauuuagcuacauagggaauccggaaaagggauuuccaggcagagacuacuacaggugcaaggaccuggagaaccggacagcugaaagaccaugacgaguucagugugacuggaauucuaguaauggcuggggaaguggaggaagugagauguggucaggucagucauauguggaggacauuguaagucaugcuaaggaauuuggauuuuuacccugaaagcuauggagaugcuuugaaggguuuuaugcaggaaaaugaugucgucagauuuauauuucagaaaguucauucugucaaguaggaggggaccagcccuguggggaaguaaaacaguguuuggaagcucuugcuguagacauggccugaacuaagacaguggaaaugggaauggagaggaggcaucagaugugagcaauauuaagaagauagaauccauagaauuggaggcugauuaugggaaugaagagguaagaauagcgcgauugccuggcuuucuggcuuagggaacugaauggguaguaccauucagauagagaguaugagagguaaauuagggaagugacaugggaaaaaaugcauuuugaauguuuuuaguuugagguguuuguagcacauccaggcaaagaugucuaauaaggugggucagcuaaaggaaagagcaagaguaaagauacggaggcaggagagggccuaaauuguucagugauacuggggccuggaguuuugcagaagaccagacugcaaaaaagguuagaugucggccaaguugugaagggcuuuuuguuuguuuguuuguuuugagacggagucuugcucuguugcccaggcuggugugcaguggcacaaucucgggucacugaaaccuccaccucccagguucaaggaauucuccugccucagccuccugagaaacugggauuacaggcgugcgccaccacgcccggcuaauuuuuguauuuuuaguagagacgggauuuuaccaugcuggccaggcugguuucgaacuccugaccucgugauccgccugccucgcccucccaaaguguugugauuacaggugugagccuccgcacccggcgugaagggcuuuuaaugccuuguugaauuuguuuggauuugauuuuguggguggcaguuugcuaauugauuugcccagguccagcauaaagaaauuucugggcugggcacagugacucacgccuguaauccugacacuuugggaggcugaggugggcaaaucacuugagaucaggaguucaagaccauccuagccaacauggugaaacaccaucacuacuaaaaauacaaaaauuagcugggcgugguugugcaugccuguagucccagcuacuugggaggcugaggcaggagacucgcuugaacccgggaggcggagguugcagugagcugagauugcacugcugcacuccagccugggugauagugagacucugucucaaaaaaaaaagaaaagaaaaaagaaauuucucgcuuuuuccagaaauacuuccucaauuggguaggcauaauugauaucucagagaaguuuaaauaaaaugguagcagcaaaaguacuuuguagaauacagccugaugugcaaaccaaaaguggugauauuguuaagauucagugaguauauuuuugcuuuggaguuuagcuauugagucuguaaaauguuuuguuuccaaccuagggaugaucuuuuauucucacccuuuuuccugguugcaguuauuuuuuuagcuuuuaaaaagugacuuucuugaggcugaguuagagacuagccuggucaacauagugagaccccugucucuaccagaaaaaaaaaaggugacuuccuccuuucaguuuuuugugaagcauugugaaucaaauuuuuuuuuacuuaagcaaaugcaaugugucacuggaagccgaaccucugguuugaaauuuaaugcugagauuugaaauaugagaguucucgagcgguaucuuacccaauuuuagugauuauuacuuugaaauguugacaucaguuucuuucuuuauuugugcuaaccuggcuuucaugaccuauacuucaguuucucuaugacaaccagacaaaucuuuuuaaaguucucuaagaagaagcauuuuucaucuuguuagucuucacugacuucauauuuacaaagaauaaauucugaacucuuuuuuccaucuuacagaauucucuacaguuuagacccuuaucuuaauuuuuauuagaugauacagguugacuuucuaauuuagaaagucgugaacuagcauuuuacuuaaccuuuugcaccucccuaugcuccuuauuaaauuagaacaggguuucucaacguuggcacaauugacauuuugggccauauaauucuuuuuuuuuuuuuuuuuuuuuuuuuugagacagagucucuaucugucacccaggcuggagugcaguggcacaaucucggcucacugcaagcucagccucccggguucacgccauucaccugcuucagccucccgaguagcugggacuacaggcgcccgccaccaggcccagcuaauuuuuuguauuuuuaguauagacgggguuucacuguggucuugaucuccugaucucgugaucugcucgccucggccucccaaggugcugggauuacaggugugagccaccgcgccuggccauauaauucuuuauuauggaguuguccugugcacugugggauguuaagcagcaucugucucuacccaguagaugccaauaagacuuccucaguugugacaaccaaaaaugucuucagacauugccauaugucuccuggaggacaaaauugccccugguugagaauugcugcguuagaaaguaucguagcuaugauuguacaauguccccaacuaaauucugugagggcaggccccauagccauacuuagcacagucgaugguacaugauaagcacucaguauccuacaaugaaugaaucauuuguuucuguugaagcuucaagaaauuacuguuccuucaaggaauuucugggugggcagguuggaguacaauggugcaaucauggcugauugcaaccuccaacuuuugggcucaaguaaucuucucgcuucagccuccugaguagcugggacuacaguucuuuuucuuucuuuuguuuuuuguuuuuuugagauggaguuuugcucggucgcccaggcuggagugcaguggcgugaucuuggcucacugcaaccucccccucccggguucaagcaguucuccugccucagccuccugaguagcugggacuagaggcacacaccaccacacucagcuaauuuuuguauuuuuaguagggacaggguuuugccauguuggccaggcuggucucgaacuccucaagggaaccacccaccucagccucucaaagugcugggauuacaggcaugagccaccaugcgcucggccaaauguuugauuuuuuucagagacagggucuugcuauguugccugggcuggucuuaaaccccuggccucaggugauucucuggccucagucuccugagucacugggauuacaggcaugagccaccacaccuggcagaugugaucuuaagagaagugccauugguuugaguacuagaagcaagcuucuuguugaugguguaagucagcagauuucccucucuauugaaaauugugugaauuccuguuuuguuuguguuccuuguauuuagagugcuugguuuuaguggacagggacuaucauuuauuuuaaaguugcauauaggcugggcguggugauucacgccuguaaucccagcauuuugggaggccaaggcggguggaucaccugaggucaggaguucgagaccagccuggccaacaugguaaaaccccgucccuacuaaaauuacaaaaauuugcugggugugguggcauguaccguaaucccaacuacuagggaggcugaggcaggagaaucacuugaacccggggagguggagguugcagugagcuaagaucgugccacugcaugaucugcgccagcuugggugacagagcaagacuccgucucaaaaaaacaaaacaaaacaaaaaaaaacaaacaaacacuaaaguugcauauaguuuauggaguuauucacauuuauuuuaguugauaaaauuauacagucauguguugcuuaaugacagguacauucugagaaauuugucauuaggugauuucaucauugugggaacaucauagaguguacuugcacaaauuuagaugauacugcacaugguguaacuuauuacuccugggcuacaaaccuguauaguauguuacuguaucuaauacuguaggcaguuuguaacacaguguaaguauuuguuuauuuaaacuuuuuuuuuuuuuuuuugagacggagucucacucugucgcccaggcuggagugcaguggcacgaucuuggcucacugcaacccccgccuccuggguucaagcaauucuucugccucagccuccugaguagcugguacuacaggugcgcaccaccacgcccagcuaauuuuuguauuuuuaguagagaugggguuuaacuauauuggccaggcuggucucaaacuccugaccuuguguucugcuagccuuggccucccaaagugcugggauuacaggcaugagccaucgcgcccggccacauuuuuaaaguacaguaaaaauaggguauuauaaucuuaugggauuuuguguugauuaauccccauauaaucccauauaaucuuaugggaccacuguugauuuugugguccauccauugaccaaaaugucauuauguaaugcaugacuguaguuucauaauuuuaaauuaaugcagcuacagcauucaccaugaaauuauuucuugauguacuauauguuaaccugauaaaaacaaaguucuaaaaauaugccucagcuacagugcugcuuuguuugccuuguauuaccagaccuuuugugccaaacuuuuccauuuggcuggaaaauaguugaaauguuuaauggaaggagcagacuugcuuuguuuuguuuuguuuuuuccuccagagggcauugaaauuccuauacuuuaguuaauuauagacuuacagucuuuccauauuccuacuuguagaugaaucauggcuaaggacaaacgucauccuugaauccaucuuuauauauuagagugggaaaugcuguuuuauuaaagcaacuauucaggcugaaaucagccaaugcaguuuucccuuacacgcuauaaaacauguagaaguagaaagggacugccgagugcucugugcaauuagucuucauaauauucuuugaacguaggagagaagagaacccaugaccacacaaaguuaccuguuugcuccagacauugaaacagcuaguucccaagucuaauuucacuuuauacacuaacuuuacucacuccuggaguuucagguagaggacauguguaaggagggaacaggagacagguguugauguuggguuggauuccuucccuccguagaagauaggccuuucuuuuaaaaucuaaaccucggguggcagugacucaggcacuaaaugucauugguuuaaucagugaaaccaaaugcuuagagaagaacaguggcuccugauuuggguuagauuuagauggcaucuuuuuuuuuuuuuugagauggugucuugcucugucuuggcucaccguaaccuccgccucccggguucaagcaguucuccugccucagccuccugaguagcugggauuacaggcaugagccauugcacccacccaccaucacgccuggcuaauuuuuuuauuuuuguauuuuuaguagagacgggguuuugccauguuggccaggcuggucucgaacuccugaccucaggugaucugcccuucucagccucccaaagcgcugggauuacaggcaugagccauugcaccuggccuuacaggcaugagccauugcaccuggccuaaauggcaucuuuacuggggcaaaguggugccuguuauuugguuucuguguuaaacaagccaacuuguaucuucugguagcauguguagguuuuacuuugugacauguuaaaaccucgugauaagaauucauuagaaguagaacuaacuacuacauaguuuagugguaauuuagaagggauagucaaguagagauuuuuauuauuauuauaaaauauuauauguuaaaagaaaguuuggaaaacagguagaaauugucaaaaacccaucacccaaaugugacaaauauuguaaauuuugcguucaaguuuuuuuccacacuucauuuagcuauuccccuauaauuagaaguccaagauagauauagauagaucaauagaucuaacauugcagcaaacaucuccaugcuuaucacuuuucucacauuaugauuuacuuucuuaggauaaaaccucaggaacaggauuacaaaauuaagagaagcauuuugaagcaaaucaauugggcuaccauaguagacaggcugauuuguaugggugcuuuauuuucaauuuuaccuaaggaugaugacuuagaaaaacaacugugggacaaaguagaaaacauuucaagcauagcaacuuccuacucaaguagaaauucaugcuacugucuuaauugccuggugggaugcaacaagaacugcacgcauaaccugguuccauuuacuucugaaugacuuccuugaauaggcagaaggaauuggguuaaguuguuagaaguauaagagugugaagcagcuuuggcaggaaucacuagccauuucuaauuuuuuuuuuuuuuuuuuuuuuuuuugagacagagugucucucugucgcccaggcuggagugcaguggcgcgaucucggcucacugcaaaccuccgccuccuggauucaagagauucuugugccucaguucuggcagaaggugguguuuuuacaagaugauuucuaggauuacaggcaugcaccaccaugccugguuaauuuuuguauuuuuaguagagacgagguuucgccauuuuagccaggcuggucucgaacucuugaccucagguuaucuacccgccucagccucccuaagugcugagauuacaggccugagccacugcgccaggccugguuuuuugguuucaaaccacaauagacauugcuggagaaucaagcucauaguuucuuuuuacucugcaugauaucccuccaaaagcuugucuguucucaugacuucaugacaguucuuugccaaugauuugcaaacauuaucuccagucuugauucuuuccuaggcuuuauuucuaaauacucacuagucauuuccacuuagaagcuuugucuucuuuucaaacucagcauauccaaaacugaccucaucuuguugcccuaacuagaacaugccacaacccauuucugccuauaaugucauuauucucuuaaggcccccauauuugcaaaucaggagucaucuuugccucccuucucugaaugcugcugugcucacagucaguaccauacaguuaguacuuguucucaguuuaaugcacacuuguuucauaugaccuccuagggcagaaccaagauucguggguggaaguugcagggaggcagauuugccuccauauaaggaagaacuuuuuaauacuuugagcugucugaauggaauggacugccuccagaagucucggguucuccaucacugaagguguuugagcagaggcugccugacuaauugcuaauugaaaggacuguucuggcauaagaugguguuuuuacaagaugauuucuagaaucccucuaauccugagagccagugagucgauagaagguagcuuugucucuccugcuagacucccuuaggacagggagacuauuuuaccuuucuuuuauauucuguacagcacuuaauucaggugcuggucucuuaauugccuaaagaugauuauuuacagguuaauugauucuuuucauuuuguuccaauauuugguuaaacaccaaauauuguggauuuuuuuccuuugaaauaucuuggggagaccaaggcagguggaucaccugagaucaggaguucgagaccagccaggccaacauggcgaaaccuugucucuacuaaaaauacaaaaauucgccgggcgugguggugcaugccuguaguuccagcuacucgggaggcugaggcaggagaaucgcuugaaccuggaagguggagguugcagugagcugagaucaugccaucacacuccagccugggcaacagagugagacuccaucucaaaaaauuacaguaauaauaaauaaauacaaauaucuuuuguaguagcauuauuuuagaugaauaacagcuuuuaaccuaacuuucuagacccuaauaucaucacuugucuccacaucccauucuguuuaucagacaguacuuguaagcucuuugcuuucaucauauuauucuuucacucaaaacccuugaauggcuucacauugaucacaacgucaaauuuaaauuuucccuggcuuucagugcccuccaucaucuggcccagcuugcucaugcauccuuguucccuauaauacuccauguuccaugcaggcuaacccacucacauuuucuguacauagccugcuuggucuccuuuuuugcuuuugacuugcucuggaauggcuucccuuuuuucucuugccucuucaagaugccucacuucccuccugaaaccaagcuaccgccaguccucauugauuuccucugaacucucagagcauguaguaauuuauguaauucagaaccguagcaacaacauucugugaagaaaaaucugcaagaauaggcugauaauuuaacuuucccuaauccaacuggauauucccauaauaaaacuuuuaaaaauauaggcuggcugucaugguucacaucuguaaucccagcauuuugggaggcugaggcaagaggacuguuugagcccaggaguuugagacuagccugagcaacauagugagacucugucucuaucacacacauacacacacacacacacaaaagccaggcaugguggcauguaguuauagucccaguagucccagcuacucaggaggcugaagccaggaggucaaggcugcagugagcugugaacacaccauugcccuccagccuggucaauagagccagacccuguuuuuuguuuguuugggguuuuuuuguuuuguuuuuuuguuuuuugagauggagucucacucugucgcccaggcuggagugcaguggcgcgaucuuggcucaccgcaagcuccgccucccggguucaugccauucuccugccucagccuccugaguagcugggacuauaggccccugccaccgugccuggcuaauuuuuuuuauuagagacgggguuucacaguguuagcuaggauggucucgaucuccugaccuugugauccgccugccucggccucccaaagugcugggauuacaggcgugagccaccgcgcccagccuguuuuuuuuuguuuuguuuuguuuuuuaaauaaaagcagaaaaacuuuaacaaauauaaucuacaguauuuauuccauucacauuuuauuuuguugucuuaaccaauaugagugcuucuggaggggagggaccaugugucuucuauuucuucaguaggcccacaaugcuaagcacuuugauuuuauuagcaucuucugugugccuaguuuuucuaggugcugggagauagagucagugcaggagguagaauggauaaauucccauccuucuugagccuauauucuaguacguaauauguagugcuaacauuuuacauuugaauugcauuuuaaggcuucugaagugauuacucguaucuaugaaaucaccuccuuugauccuuauaucuguguaugcuagaugaggauuauaauccauuaugugacuguguaaaguugcacaguuaguauguacagcuugggacucaggccucagucuucuaauuuuauuuggacuuguguaauuuugaccaccuguguuucugaagcuuuuaugaugaaugcuuaaguaguugggaauccggacauucauuuauggagguuuacguauaguucuugguuauugacaauuagaaauggcaaggagcaagauuaggcagacauacaguucucugcucugauacuucuguguuugggagaagccuuauuuauuuauuuauuuaaauaaaagagaugagauuuugcuauguugcccaggcuggucuugaacuucuggccuuaagccauccuccugccuuggccucccaaagugcugggauuauaggugugagcuaucaugccuggccugagaagccuuauuuuaaacauuugcuuuccaaauaugucucaucuauccugaaugugauugaaaaaaaguuggccuccauggagaaaauugaaagcagaaaaauggaagaugcuggccaggcgcgguggcucacgccuguaaucccagcacuuugggaggccgaggcagguggaucaccaggucaggagauugagaccauccuggcuaacacggugaaaccccgucucuaauaaaaauacaaaaaauuggccaggcaugguggcucacgccuguaaucccagcacuuugggaggccaaggcgggcggaucaccaggucaggagaucgagaccauccuggcuaacauggugaaaccccgucucuacuaaaaauacaaaaaauuagccgggcgugguggcaggugccuguagucccagcuacucgggaagcugaggcaggagaauugcuugaacccgggagguggagguugcagugaucugagaucgugccacuguacagccagccugggugacagagggagacuccaucucaaaaaaaagaaaaauggaagaugauaauaauguaacuaaagacaccauaaagagaccuugagcccauagugcugugcaaacaaguuggggcuggauacugugauuaaccauauagucacuuaauuuguuaaaagccauuguggaguagcaagaagagcugcagaguaggauucagaauauuuguacucuaggccuagguucuuuacucacuaguuguuugaccucuggcaaguuuuuuuuuuugagauggaguuuugcucuuguugcccaggcuggaguguaauggcgugaacucggcucacugcaaucuccgccucccagguuccagcaauucugccuuagcuucccaaguagcugggauuacaggcaugcaccgcuacuccaggcuaauuuuguauuuuuaguaaagacgggguuucuccauguuggucaggcuggucucgaacucccgaccucaggugacccacucaccucagccucccaaagugcugugauuacaggcaugagccaccgugccuggccaucuggcaagcuuuuaacugcugugaaugucaguucaguuucuucauucuaaaaauagggaucaaugucugcguaacauaccuugcagaauuauuuuaagucucaaaagaaucaacagauuaauaauguuaagcauuuacaacuauacagaauuacuauauuuaauugauauuauauauucuaagaagaguacuuuccuuaugguacuuaguuugaagaucucuauaucagugugauucguggcugagaaggcaacauuuauuugaaagacaggaggguuuguaagguccugcaaaagcagauaagcaaaaaauuaaaacaaaacaaaacaaaacacuucuccauggauucgauagagaagauagccacacuguguugaggggagagugaguaagagccuuuauuuauuuauuuucuuacucaaacaccuuuauuagcccacuguucuuuuuuuuuuuuuuggaaacauaaucucacucuguuguccaagcuggagugcaguggcgcaaucucagcuuacugcaaccuccaccucucagguucaagcaauucucaugccucagccucccaaguagcugggacuacaggcgcauaccaccacgccuggcuaaguagagacgagguuucacugugcuucccagcuggucucgaacuccugagcucaggcaauccacccgucucggccucccaaagugcuaggauuacaggcgugagccaauguacaguguuuuuaaugccuccuauguuuauaguaguggaauuacaguggcaagacaugguccuugccuuaggguggcuaguugccuguugacuguuagaggagaucagaugcauucaggggauuauggccauaaacucuuagacucugaaggcuauuaaauaaauuauuuuauuuuuuuauuacuaaugucuugagacagaaucuugcucugucacccaggcuggagugcagugguacuaucucggcucacugcaaccuccacuucccagguucaagccauucuugugcuucagccacuguaguagcugagaucauagcaugcgccaccaugcccagguaauuuuuguauguuuaguagagaugggauuuaguagagacgggguuuugccauguuggccaggcugaucucaaacuccuggccucaagugauugccuguguugcccucccaaagugcugggauuacaggcgugagccaccaugcccggccaaauaaaugauuuuaaaccagugugugcaguguugugacacagauaagugcacaguguugugguagcacauacuagaaauacuuccccaggaggugauaacuuagcugagacuuaaaugacaauaggaguucuagaggggcagaugggaaagggaaaacaucuaagcagaguggauagcauuauaaaggcucagaagugagagaaagcauggcuuuuucuggaaaacgcaaguagucccggguugcuguagugugcuaaggaaagguguagcaagagauaaaacaggagugguagaagauuaagcaggacuagaugagagaaacccuuguuuggacuuuacccugaacgcucugggguaugugucaaaugcaacucuaauaucauaucuuaaaugcaaauauaauuauaaauauuucuuuaauaccauucaguacucugggaaguguugagauagaucacucugacuauaauauggagaauggaugaacaaaguuuauuacuguaacuaggggagacuagccaagaagucauugcaguaaucuuggugaagucuugauauccuuuuuuuuugagacaggaucuugcuuuguugcccaggcuggagugcagugguacucauggcuuacugaagccucuaccuucugggccuaagccauccucccaccucagucucccagguagcugggaccacagcuguacaccaccaugcuuggaaaaauuuuaaauuauuuuuguagagacaaggucucccuauguugccccggcuagucuugaacuccugaccucaagcaacccuccugucuuggccucccaaagugcugggauuagaggagugagccacugugcccagccaguauccuaacucuuaucagucaggauggaggcaagaggcaucuauucaugagauacacuaaauagagccuauggauuuugaugacugauaagauguugugggggaguuuauggaauccuuacuauuuuccaggacugugccaagcacuucuacauggauuccuucauuuauucucacugaagcccuuuggauuuuugugcuauuauugucuucauuauaaagauaaggaaauugagucucagaaaguuugauaacugcuuauagucacaaagccacugcauauuguuauucaaaccuccaaucucucugauuucucuaaagaacacucuuauccacuauauaauacugcccaacaguuuccaguuacugacuugaucaaucaggugauugauagcagugcuggagcaauguuagggaauaugauuucugcuuuuggacauuucagguugccuuugggacauccagguagcgaugucuaggugaaagcuggauuuuuuuuuuuuuggagacagggucucacucugucacccaggcuggagugcaugguacaaucacuacucauugcauccucgaccuccugggcucagguaauccucacaccucagccuccuggguagcugggacuacagguguguaccaucaugcccggcuaauuuuuuuauuuucuguagagauggaauuuugccauguuguccaggcuggucguggacuccugagcucaaacacuuccucccaucuuggcauuccagagugcugggauuguaguugugagccacaguacuuggccugaaucuaaaauuuaaucccagaugaauggccugagcuagauggauaugcugcucugguagucuuuagucuauaggugguuauggugguaccaccucgcaaauaggcuggguguuacuacaacaaggguagucagaggcuuuaggaguguacaugaccaccggaagaauguacguguguauagagaauaagaaaaggugugucuuucacacaacugaaucucauucucuacacacacauacaaugucauacuuaaauucuggacauuauuuuccauaacaucucaaaucucaucuuacucccaccaagagcaaaaaaaacaguuucuguucuuuuguauuugguuaaugguagaaugagauuagcuauaaaugguagcuguauuguccuuuuucauucugcuuaagucagacagcggaacuuuagcuuguuuagcagugaaagccuauaaauacaaaugaaauauggaaaaagggagccaaagucccaugaagcucuauuauuaagcauuuaagauugguaaauguucacaaacucuggcagccucuagcaauacauguacugugucuccauguuaacaguggucucaaccugaaacauccauguaugaaggaacauguuuuaauaacagaacugagugguaucuguucauggaagguagcuuaggaguuuauugcguuccuugccuuuuccccuggacuuacagugugguggauuguauauauaugugagucugucucuugaucaguaugcauaauggaacagggcaggaauucagauaucaguugauagugucauaacauuagggaaaguauguugacugcuuauggucugcucuauuugagaguaggacauagaccuggaggcuucugcugcugcugcaggccaaggaauggaaagguuuguuugguucucauucucauuuuuuuucuuugcuucucuuuuaaacaacacucucugacaagugauugggcccacagagaccagagccuguacacagagaauggacagagacuauauugucuuccuuacuuuaucuugugagcugcuuaucucuuccacagggaggacaauguguuaaauugagauaauucuggcaugcugucaucuuugggggaaucauaauugcuguugucauuuuaggcagcuucaagggaguugaguucauucagcuucaguuaccugaacugaauucaguugccugaauugacgcuuuugugaaauggaaucuuuccaagucaaagcuuggauugaaauuucacugacugguuuuuaugagaucacuuagggucucaaauacuuuauguagaggugcauugaucauauuuuacacuuaugugugacuuaugggcaacuuuuagcacccuuaucccucuggaguuuuggaaugcuauuugugagguuuauaacuucauaaauauuuauugaacaucuacuaccugccagguaguagucuagaugguagaguauacaguaaggaacaagcuauauaagguccuuucucuguuggagcuuacuuucuuugggauauuagacauugaauuaggcuauuucagauaagauaguacuugugaaagaucuauaacaaauucuuuuggaugugucuaguguccuucccuacugcauguccagaucuuucucaucuucauuugaaggcuggcucaaauggcagcuucuccaucauauccuuaucugauccuuccagcugauauauuacuccccucuuugaaaucucaugccucucuaucagcaacuuucuuaugucaccuuaacauuuuuuucuauuuguuucauaguuguuagugcauauguuaagucuccccauuagacuauaaauuacugagggcaggccgggcacaguggcucacgccuguaauccuagcacuuugggaggccaaggcggguggauuacuugaggucaagaguucaagaccauccuagccaacacagugaaacccugucgcuacuaaaacuacaaaaaauuagcugggcaugguggcgcacaccuauaacccuagcuacuugggaggcaggagaaucccuugaacccaacaggguggagcuugcagugagcugagauccugccacugcacuccagccugggugacauuguaagacuuugucugaaaaaaaaaaaauuauugagggaagaguaaacauccuauucaucuugguuugggauauuucacaugcaggcagcaggauguuguaggaaaaaaacacacugaacuuagaaccagaaggaucagauaaggauaugauggaguacuggcuucucuauucacuggccgugugacuagacaagucauuuagcuucacugaaacuaaguuuucuaucucuaagcguguaguaaucauccuucuauuccugaauaguugucgggaggcucaaacugagauaauguaugugacuauccuuugcaaauucuaacuuucuacacacaguaucauaguaaauauugaguauuugaaugaguaagcauuuacuuuagugaacaccuuuuccugagcaguucucuugcuuaaugaggucuuuugauuuuguaaauaugcuacuuuuuuaucugauauuuuuguauuguuccauuuugcagaugauaucuaauuuuauuaaauuauucuguuccugagaauuggcauccucuucauccaccuggggaugaccaggaauuuucuguuuuuuucucuguaggugcuauuuaauauuuaaauaacaaaugacauuugaucuguuucagcaggugguccauuauggcugacaugcaaaaucugguagaaagauuggagagggcagugggccgccuggaggcaguaucucauaccucugacaugcaccguggguaugcagacaguccuucaaaagguaagcaguccacagcccagcagaaugcuuucuuugagcgucuuggccugaaaauuuucuauuauucucuccuuuggcgcuaacuucccaaaacuuaaucuagaaaguuuaccuuuuguaauuuguauugcugugaacagauaagagaggaaaugacuuguacagggaggccugugguuaaguuauuuuaacacaagaacuuccugcuugugcaauauuuccugcucuuucuuuagcagaaugacuccaauguaagucaaaugacaagugauaauaaaauuccucucuccaaacaauuggcaaauuggacauuuugcacaugcaccaguuggaacauagaauguuagcacuaaaaaaaaccuuggaggaucauuuuguuuauuuucauuuuauagauaaagaaaauuaagcucagagaggaaaaggaauuuagucagggucacacaaccaguuaguggugauacuggaccuggaacccagguuuccuuacuccuguucuguauccuguugacuguauuaccuugccuccccacuuucauguagaagcacguuuuaaagaagccuccuucugaugcauggcugauucuuugugguguguuugucuuuagcaggagcagcuccauaugugcaggcauuugacucgcugcuugcugguccuguggcagaguacuugaagaucaguaaagagauugggggagacgugcagaaacauguaaggauguuuugccuuuuuccccuucuuuuaaggacuaacagcuuucuucagucagccaagguccucauccuugguuuaagagcuccuugagaaguuccucuugguuuggggcauuacacauguucuuucucuuuugccuguacugaggaguucagucuagccacagaaacgauuccucauuuuuuucuaggccccuugcuuuuaucacguauuuauacagaaagcuugcuugguacauaaaauaugguucuguucaucuuuguagugaagaauaugcaccaguuugaucccaacauauuacauaaucaaaccuacaguggcuuauuuaaaggagucauuaucaugacuuagcauuuauaaaacuaugcuugauaguuauuaguuaugcuaauguggguuauuuucacacuuaacccacagcaagaauaugaaguaggcaaugacaggugccuuuccucccaccuuccuuuaugccuccuacgucaucaccaccaccccccacccccaccccacacucacauauacauucuaccucuauuuuugggacccaaaaaccuuccugcuagcucaccgaauuauaaacaguaaccaugcuugggaacuucuucaccuaaaccuuucucgaagacugguugcuuggcuuuuggaaaaucuauuuugagccucucaaauaccaucuguugccaaugguuuuagcucuagagagugggacugggacuuuaauaaggguguggaggcuugcauuuuuacuuaauacaguucuguaacauuugaaaaaacuuuaaaacauuuaucauuuguauuuuaaaaaugcaaauccagaaaaaauagauugcuuucuuugaauuuuuguauuuuaauagugcuuacagucucauguuucuuaaauucuuuugacugcgaaugacccuuagaaagaaagaacauauucguaacugagauaaaaguuucacaagaugauauuuauacuacuucugcuguacuuuuuuuuuuuuuaacuuuuuauuuggaaauaacuugaaguuggugcacugcacucauacuuuuguuccauuaagcucacuaaauugauuuaauuauuuauuaaugggucaugguaucuggcauuugagagauagcuuuaaucuaaaggaguaaauaccuugagaauuuucagcagaaauuuaggccuuugccuuuacuccugucuccaauuuuugagaaaagaaagguguuuuuuugguugcuguuuguuuuauuuugcugaugugaaauaggaaggauuuuucagugcacgguaucacaaugcauguguaagaugcuaacaugacuucauguaagcuaggugauuauccaauuaacuucacuuccaacucuggauauauaucccugaugaguuccaauaggaacaguaguguauguaauucugcucucagucccuggaaucuggaauacaugaggaggauaacaugaagugccuggguugcuaucagaguacauggaaguagagguuucagguuauucuuaucaagacuucucuaguuauaaugugucaucaauagcugauucuucuuucuggcaggcggagaugguccacacagguuugaaguuggagcgagcucuguugguuacagcuucucagugucaacagccagcagaaguaaguucacuacuagcugguuucauuuugguuugaugcucaggacgaguugagagauuuaugucaagcuauuauaacauuuuaaaauagaccuacuaggcuuuugauaauauauguucauaccaagucccagagguagagccauacuucaagugccuuaaugggaagguacuauuggguacuuaauggucucuacuggcuuuuucucugucauuuugcauaggacugugguuaucccugggacuuugcuugccugccucuuugcugaguccacauucaucauagugucuccaaagcccuuuaaagaugauucucuugcuucacuguggaugggcuuuaguagugcuccuguggagaucuuaaaacuccuacaguauugcuucucuccucauccuucacugguugggagacucucucuuuaauuuuacucccaccucaaaauuuuauggugcaagaugugaaaaguugaauuagagaaaauuuagauuucucuuggagucaaagaauauagguuuccuucuuuugcauuugguuuuccuaguuacagaggaauaauaaagcaaguuguccuaaaugcuguauuaaaacccuugacccucagcaugccuagauaauauaaaaauagugcaagauaaugucaaauauauuagauucugguuaagugugcuggcucauuccuguaaucccagcacuuugggaggcugaggcaggaggaucacuugaggccaggaguuugagaccagccugggcaacauagcaagaccucgucucuauuaaaaauuaaaaaaauaaaauaaauaaaaauagccaggcaagguggugcaugcguauagucccagcuacuugagaggcugaaaugggaggaagauuugggccugaaaguuugaggaugcagugagccaugaacacaccacugcacuccagccugggcgacagagcaagaccuucucucaaaaaacauuguguguguguguguguguguguguauagaugccaucuaauucuaauauguagaauuagauuuuaauucuuaaucuguccugaaugguuaagaucugagaauugagauguucaggaaauggagcuuuggaggaagggugcaaacacaaacaaaauucauccauuuugccaaggugccuacuugaaugcuaagccccuaauuguuuuuuauuuuauuuauguuuaaaaaaaaauuuuuuuuuugagacaggguguuguuuugucacccagacuggaggguaguggugcaaucacagcucacugaagccuugaccucccagguguaaugauccucccaccucagccuccugaguagccuugacuacagugugcaccaccaugccuggcuugcuuauuuacuuacuuauuuauuuauuuauuucugagauggaguuucucucugucgcccaggcuggagugcaguggcaggaucucggcucacugaaaccuccaccucccaggcucaagugauucucccaccucagccuccugaauagcugggacuacaggcaugcgccaccaugcccagcugauuuuuguauuuuuauagagaugggguuuccccauguugcccaggcugaucuuaaacuccuggacucaagcgaucugcccaccuuggccucccaaagugcugggauuacaggcgugagccaccaugccuggcccuaauucuuuuuauuauuuguagagacaaaguugugcuguguuguucagucugucuugaacuccuggucucaagcaguucuccugccuuggccucccaaagugcugggauuacaggcgugggucaccaugcccagacuaagcccccuaauugcauuugauucaucaguucuuuacagcagcuacuauauggcuggcaaugcauugggggcuuucaugaugauaaaagagcucgucuuugaagaauuaaugagaaaguaaaacauauucacauggguccauuaauaguuuguauuggugagugauaaaaugccaagauugguuaugcugacaacaaaugcuguaggaggcugguguggcuggguuggagggcccucaugaagcaugaggaaaauuuggauucaugggaaaaaaagagaacaucaugaguaaggcacaggaaugauguccugaguguauguccucugaguggaacaaaaaagagacagguggcugaaauggagguucugugguauagcugaaguauggguccugaucaugaagaaccaucaggugcagccugaggaguuggaacucuacgaggagagugagaugaugagcaguauuuuagccuuaggaaucaggacaggacucaugcaguuuauuugggugcucacuagaguccauagagaauucuugccuucaggaucagaaggcauagacaccuuuguggaaagauguuaaccugaaucuuuucuuguaucuuuuccuagaauaagcuuuccgauuuguuggcacccaucucagagcagaucaaagaagugauaaccuuucgggagaagaaccgaggcagcaaguuguuuaaucaccugucagcugucagcgaaaguauccaggcccugggcuggguggcuauggugagcagcgcagauuccagggcuggggguggguauagauuuuaagagggaaggcaauauaguuggagagguccugagucacugacagcuugucucucucuaggcucccaagccuggcccuuaugugaaagaaaugaaugaugccgccauguuuuauacaaaccgaguccucaaagaguacaaagauguguaaguucagccuuuucucucuuuuuuucuuuucugagacagugucuugcguugucacccaggcugaaguacaguggcacaaucacagcucauugcagccucaaccucccagcucaaacaauccucccaccucaguccuccaaguagcugggacuucaggcacgcuccaccaugccuggcuaauuuucuaauuuuuucguagagaugaggucucacuguuucccaggcuggucucuaaugauucuccugccuuggucuccccaaagugcugggauuacaggugugagccacugugcccagccaaguucagcuuuuucucaagggguaaaggauaaacccauuugguuacuugcuggaguagcacuuuggaguuacugagggcugcccuuagccacugugcugguuuuaucucagggcugcuuucuggagagcuuuacagauauugucucacagcugcauuugcaagcaggaaauacuucugcuuccacuucugcuuucucuccuuuuuugguagaggcccuuuuagucuucugauccuuacccuucuggguuuaggaaguuuugcuggcaguaacauggacuaaugcccuuuauauaagauuuuguuccuuuguugagaauuuguuacuggcccaauggcaaaggguucaauaggacuuaauagaaauuuuucaugaagucaguuaaagugagaguaaggcugccuagccaaugcagguauuacguagggcagucauugcaugucuaaccacauacgucuaccaguucugacuucuccauugcugguuuugagcuggaaugauugcaggcaaaauuuauuaaguugcauaucuacacaagccuuuccuuucuuccauccuucaucaaucaacaaacauuuauuaacuacucuuuuuaaggaaaacuacaccuuccugugagugaaaugugucccagaacaacaggcacuuccuuauccuucuagcaacauggaauuaagcaugacaguguuuugauauaucccaccauuaucccaucacuuuacaguugaggaaacuaggucuuaggcuaaauaaccuucccaguuaauacauaagaagagaggggacuugaaccguaggcacaaugcuauuucuauaauuuaaggcugauuguuucccccuaagggaaaguuuuuaaguuugcuuuuggucagggugggcauauuuugacauaaggcauugucucauaaggcaguuaaguuucuuagucuuuagaguuccacagugauacuuaagagcucuccucucuaccaugguuuuaugcacagaaugucugcuuuuaucaguuuuacauauuagauuguguuuaaggucuacuuugaaaaaaguuucaauaagcagcaaguggucaaaagaaaaaaaaaaguuuugguacuuaaaacaguuugagaaacauugcuaugagagauagagauagaauccagagucucuaucuuaguggaguuuggucugauuaggguaauagacuagguuguauauacauagaagcuggugaugauagaaaagcugccauugagcggagccuaagaaacaccacggguaggagaaugugagcccauaggaaagaaggguucuggagucaccacuguuauguacccggaucaccugugacaaguucuucuuuaauccucccagggauaagaagcauguagacugggucaaagcuuauuuaaguauauggacagagcugcaggcuuacauuaaggaguuccauaccaccggacuggccuggagcaaaacgguuagugaauccuuccucccucccucccucccucccacuuucucucuccagcaugggguccacagguuucuuagacuucagcacuaccaaagucugugagggaaugcuaguuuuuucaguggaagggaggaagaaaaggaggagaaagaaaggguaaaaagaguagaggaagcaaggaucagaggagaaggaauauucagugguauucaauuucaauaaauauguuagggacagugauuggugcuggagcaggagacacacacaaaugaguuacacuaucccagccuuuaaggagcuuaaaaauaagaaugcaaaaccccaauacaaaucaccaagccaaaugcuauaauaaagauacagacuagaguaugaggaagagaagagugcuucucacuagaagagauuguacuuugaagguauauacucuucugugagacuugaaaguaguauagggcagugagaagugggauacuacaaaaggcacagcuuaaacaaaauacaugcagaguaaauguagagauuggucaucucuggcuucaauaaggggaaaugaucagaauuuuaggagaaaaggcuggaaaggaagguaggcugagacuuugggaugagguauuugagcaagggagugauaaugauucaauuugucuuuaaaagagucucaguguauagguuagggauaaggacucaugcucagauuaugaaaguggucaugguguuugggggauaguagaaaaacauuugcaggagauagcaccaagauaauagagauuugauaaggucgaagaaguuggaauccucaaagaagauugaauagucagucuuggauaguaacaucuuucacugaaauagggacaaggggaugauuguacagggagaggagcggcaggaaaugaugaaaucaguuuugaaucuguugaaucagagguacugguaacacacuaaggaagaugucaaguagauuuguggaaauaguuuuuagagcuggaaucaggugaguucaaaggcaaaaugugauggucaagaaauagaacugagagcuggauccuugggaaagggugagaaggcauaaagccaaguuggguauggguaggacacauuaaucauugccucaaaggcugugguggggaccccaugugcacuggcccauguagggcacuacugggaaugguacagaggggagcagagaggaugaugauguuaccugcacuuauuguuccaggggccuguggcaaaagaacugagcggacugccaucuggacccucugccggaucauguccuccucccccuccaccaugccccccuccucccccagucucuaccauuucaugcucauaugagucugcuucccgcucaucacuguucgcgcagauuaaucagggggagagcauuacacauggugagugagcacuuggacacgaacaguagguacaacaaguugugugggccagaccccaccaaccagaaccgucuguaaacuacaacccuggcuugugugguggagacucguuugguguguccuguuccuuuaagggacggcaaagcuggcuuaaauggaaauugaaaaugaugaucacaguuggaggaagccaucugccccaugggaaagugacuuaauauuagguagcauauauagaggacccucuugugccaaggcacagagcuggcgguuuuccccagagcuuuuuccguggcaccacauggccucugggaaggcauuguguuagggaguuaacuuccucagaagaugcauacugguuacauggaaaauuugcaugagagugaccuaauguugguauaaaguagauacccuuaacacagcugguggaagucugaguuguccagccacuucuaggaaucuaugaucauaguagcuaaaaaugguguaacaaccuaaauccaacuguaagagaaauggcuaacuaccacauguccucuugaugaaauguuuuuuauuuuuuuauuuuuuuugagacggaguuuugcucguuucccagccuggagugcaauggcgcgaucucggcucaccgcaaccuccaccucccagguucaagcaauucuccugccucagccucccgaguaccugggauuacagccaugcgucaccaugccuggcuaauuuuuuuuuuuuguauuuuuaguagagaugggguuucuccauguuggucagccuggucucaaacuccugaccucaggugaucugcccaccucggccucccaaagugcugggauuacaggugugagccaccacgcccggccucuugaugaaauguugugccaccauuacauguuuuucuacagugaaccauguaauguuuaagaaaaaaaaaaucuaguauguaaauuacaaccacaaggaaugguggagauaaaaaggccauucaguauuuguuauacaguuaacauagaucuggccauguucaaagcgaggcgugugucagccugcugugggagaugaugaauuauuuuucccuuaaaacauaaaagaaauauauuuuuacuuuuauuuuuuauuuuauuuuauuuuuuuugagaugggagucucacuuuguugcucaggcuggagugcaguggcgugaucuuggcucacugcaaucucugccucccagguucaagcaguucuccugccucagccuccuaaauagcugggacuacagcaccugccaccacacccggcuaauuuuuuuguacuuuuaguagagacuaaaaauacaccaugguagccaggcugguuuugaacuccuaacuucaggugauccgccugccuuggccucccagagugugggauuacaggcaugagccacagcgccuggccuagaaagauauuaaacuacagguuaacaugagaaaguuuuuaagugucaauaguugaacuaaauuuguuaacaaucuguaugauuauaaccaacaaaaccaaauauauguagaaaacaauauuguagaguugcaaaugccaacacugacugaggaggugggggaaguaggguuagcuguggggagugaggguauuuuuuucuuuuccuuuuaccaaauuuucuuuacuaccacucauuuuucuuuauugcuuuaaaaauuauauauuugugcacauacauuugauaugucuuucuagacauagaggauaaggauuuacauauccuuauccucacccacaauauacacacauuccauguuguuguuaauggaaccauauaauuuaaucuuggggagaagagaaaugauaaaaguacuuuuccaaaacugcuugcaagagaacaucucaaaggcucugguuuuggcuuugaauuuucuguuaaggauguuuaacaugacgauagcagcucaaaggucugguaugaaggacaggaacaagguagcuguuguucuuacagcccugaaacauguaucugaugacaugaagacucacaagaacccugcccugaaggcucagagugguccaguacgcaguggccccaaaccauucucugcaccuaaaccccaaaccagcccaucccccaaacgagccacaaagaaggagccagcuguacuugaacuggagggcaagaaguggagaguggugaguuaaaaauaccuagacaggggcagguauuuuuauuauuuuauuuuuuugagauggaguuucacuuugucgcccaggcuggagugcaguggcgcgauuucggcuuaccgcaaccuccgccucccggggaaaaggaguaggaacaggagguuaaauggagcuuagcuagaugagggcagaguucuggcuucaauugcaagaacaaaaaguuugggauagccugguuauuuuuuguucggugugugcuuugugaugagaauccugggaucucucucuaacaggaaaaucaggaaaauguuuccaaccuggugauugaggacacagagcugaaacagguggcuuacauauacaagugugucaacacgacauugcaaaucaagggcaaaauuaacuccauuacaguaggugagucuuugucgcugucccacgcaagccccgucccagagcccgagaaggcuaauaccauuuuaccuacccuauccuuaaagauuccuaaauguauauuacuuuccuuuaaaguuacacguugacacacucccuuucuucuccuagauaacuguaagaaacuuggccugguauucgaugacguggugggcauuguggagauaaucaacaguaaggaugucaaaguucagguaacucgauauuuuggcuccuucuuuuugucccugaggaauuaauucaaagagacaugguagacccacagauguugcuuuggugggaaucugauucuacaaagucuguaagcugagcugcuuuggacguggcagaagaaggguuggcucuucaagcaaguucuuuucaggacccaucccaacccacccgaguauccagugucuugcgcaucugugagcuuuucauguaguugcugagucacgugaaacaggaaaccuuuuccugcgacuuacuguuguccuucccaaccacugggacucaguucucuuuguuuacucugcagguaauggguaaagugccaaccauauccaucaacaaaacagauggcugccaugcuuaccugagcaagaauucccuggauugugaaauagucagugccaaaucuuccgagaugaauguccucauuccuacagaaggcggugacuuuguaaguuucuugaucucuuuaguaugauguuaaaaacagaagggacugaagauuucuggcauugaagaaagcuauuuuaugaacauucugcacugagcagguaaaaacccaauaaugcacaccaaaaguacacagaaaugagguagucccauguaguggagccccaaagguaggugcuuucugccuaaguggagcucaagguagcaaaaaauaauggggaugagccauggcaccuugucaggcuggugcuauaaagccauauguacuguuauuuacaccccauagacuuaauagucuguccaagaucgcugaacacuagaacauagcauggcucuguggguuugucucuugcuacauuguaccgugcuccugggguuaaguggaagcaagcauugggagaaaugugugagauuuagccccagcuguucuuuagcucagauuuaaaccugcugucucuucuuuauuugcagaaugaauucccaguuccugagcaguucaagacccuauggaacgggcagaaguuggucaccacagugacagaaauugcuggauaagcgaagugccacuggguucuuugcccucccuucacaccaugggauaaaucuguaucaagacgguucuuuucuagauuuccucuaccuuuuugcucuuaaaacugcuucucugcucugagaagcacagcuaccugccuucacugaaauauaccucaggcugaaauuuggggugggauagcaggucaguugaucuucugcaggaaggugcagcuuuuccauaucagcucaaccacgccgccaguccauucuuaaggaacugccgacuaggacugaugaugcauuuuagcuuugagcuuuuggggguuauucuaccaacaaacaguccauuggaaagaaaacagucccuggaauuaacagaucagaauguucacacugguuaaucuuuuuuuaacaaugagcaugaagguagcagaagcugguguguuuccagaugguucuucuaaccaaacuaauuuuucacuguugacaagcgaggcaaggguugcacuggaccaaaggcugaggcuuggccaucuagcauuccauacaaaauuguuuccuauaagcauuccuuuuauucucuauucuauccugggucugccucaaccgugagauaggagagucucugguacuagcugcuguagcagugcccuucauccagggcaguuaauggagucuuggacccuuucuuucucugggaucccugcccagcaccuuccuauagagaugacuuuaaaaggaaaaaaaaaaaaaaaaaaacccacaugauuucaaggagucuggcauuccugaauccuucuucccugccaggugccugucaccugucuucacugccuccuuuucccugucaugcucaucagcuuauggcuucugucuaagcaccugaacagaggacugaaaccuccacugcaggcugguuuuaggucuugaauuauguaagaaucuugcacagcacugcuaauguaaauuucaguuguuuuucccucuaggacaaacacuuaccaaaauaugcaacuuuuuuuuggugggaagagagauuguccugugauuucuacccauuuccugaggccuguggaaauaaaccuuuauguacuuaaaguuauacagaaaauagaauaaaguuaauaccaaacuugcuuaguuguuuaccugugauauuggcuguacagaaaugcaaaaaauacugaaaacaccaaggauaagaaacuacucuuuauuuuagacaaccucauaaaauuauuuucacaucccccccaacuucuugcucuuaauccucaucuuuuaguugaagaauaaggcuuaagagagagaaaggaaaaaccauaauggcuaaacuuagcagcaccaacacgguucuuucaucaaggcguagcucaucauuucuccaaacugacaugcuacagaaaugucuuccaaaaagcguuaaguuuucacagaguggggacuaugauuuccaugcucaaauaguguaggaaaugguagauuacguuaguuuuguuuacuguaacaggaauucucaggaguccuuagacacucuaauguggguugaucuccagaaggagaaagggaguguguaguauuuuccaagcuuuuugagcaaacaauccuuuucucauggaacacaucagaaacaguuuggaguaugcugguaaauguguuuuggggauggaagucagaaagccugaucuuuuucauaugguuccuccuauucucugcuaaagccagcaacagaguaaguugacucuagcaucaagaccacuagucauauuaagaaagggcagguuggucgagaauggaauaggaagaacuagcugccucacuuuucacuuucgcgccuacauuuucuucgcucccuaaguuauacaagauguacauuuccucucuuaagcaacuuaauuugggugcuacuucccuccuuuugugacagcaacuaauucaucacuaccugaggagacaaagugggugcugcagaagcaagacuguaggccagugggauuugucuaauaauugaugauaagaugauagcacagagggcaacguacugagagaggaaggcagccuuaagaaaugaugcagaaauagccaagcaagauuuuuccaagcacugguuaaaucaccagcaaaacaaagcauuuaugugaguaccucaggccugggcaccucuuugcuugaaauauggcaagacuuggaaaaauguuugcccuuagaaucuaucucacuacuuuaguuaguugucuccuuugggccugggcacaguucuggcacugaucuggaacagacucccuuuucuaaaacugaacuugaccacaucaaaaguuuguaaaacaaucuccaugguaauuaaacuugcauucaacaccauaugguaacagaagauggcaaaggauaagauucagaucuuagaucuuuccaaguagggcauguuagaugauagaaggauuaguugcaagcuggaucugagcucaggcuugggcaugaaggaaacugucucccaugugguuuggaagaguuaggggcucccugagcucuauugugaacuauacggguuucauccaaggaaugguaugaugugggcauaaaaccauucuucagacaacugaagaugguccccuucuguagccagaaacacuagcuguccugcauuguccauuuccuuuagccccaggcgguccugcagaaggaaaggccauaauuaauuaaaaagcuuaaugaaguuuuggaguaaaaugguaaguacguuaacuugagauauauuuucaaaaugcaguuuguccugaguauuaaaauugagguguauuuucaaaaaugccaaaaagaauaucuccuacuucuuuuucuuucucuuuuuucuuuuucuuucuuucucuuucuuccuuucuuuucuuucuucucuccucccccuccuccugucccccccgcuucuucuucuucuuccucucucucucucugucucucuuucucuuucuuucuuucaagacggagucuugcucgguugcuuaggcuggagugcaguggugcgaucucggcucacugcaaccuccacuucucuggcucaagcgauucuccugccucugccucaugaguagcuggaauuacaggcgcaugccaccaugccuggguaauuucuuguauuuuuaguagagaugggguuucacuguguuagcuaggauggucuugaucuccugaccucaggugauccacgugccucggccucccaaagugcugggauuacaggcgugagccaccacacccggccaguuuuuucuaaguauuaaaaauagauaugcaauugagauugcucuauacaguguucuagauucugauuuuugaaaagcucagagucagaggacuaccuauaggugggcaagccauagacgacacugccucagaaugccauagguaagugggacugagccaaagacagaacauuagcuagguaacuuaaaaaacauccaacccaggacaggcgcgguggcucacgccuauaaucccagcacuuuggauggccaaggcaggcggaucaccuguggucaggaguucaagaccagccugaccaauaugaugacacuuugucucuacuaaaaauacaaaaauuagcugggcaugguggcgggcaccuguaauccuagcuacuugggaggcugagacaggagaauucgcuugaacccgggaggcggagguugcagugagcugagaucaugccauugcacuccagccugggcaaugagcaaaacugucucaaaagaacaaaacagaaaaaccauauccaaccguuagguaacaaacccuggacacuuucauauucuggaguugaaaaugucauuacccauagccuagaugcuggagaacaaccucugguugggaagauaagcaguuacgacagugccagaauggugcuucugccguggccaacaucauuuugaguuuucacaguaaggaaguucuuagcuguaauuucucaagccuuuuuuuuuuuuuuucucaaaucagauucuagcuucccuuuuuaccucaccacccaaguugaggcacccagugcaaaagaaaagccaagccaagaggagacaaaugaccucugaaauaacauggaggaauucuaguagacggugauugguucagauguaguacuuagcauuuuggagagucugucuccaauauaaaauccuuagggcugggcgugguggcucacaccuguaaucccagcacucuugaaggcugaggcagguggaucaccugaggucaggaguugaagaccagccuggccaacauggugaaaccccgucucuacuaacaaaacaaaguauuaggcaugguggcgugugccuguaaucccagcuacuagugaggcugaggcaggauaaucgcuugaacccaggagguggaggcugcagugagcugagaucacaccauugcacuccagccugggugacaaagcaagacugucucaaaaaaaaaaaaaaaaaaaaaaaaaaaaaaaaauccuuaaaguguagaaggccccagaacuggagguggcaaauuacugcaacuucugcuuaagauacaggaccuacugcuaaacaaaauucaaaacucuagucccacucaaccuccugcaggagccucccuugucagugcguaauuuagaaacaggauuucacaucuauuaauguuuaaaaguaaugucccuuggccaggcgcacuggcucacgccuguaaucccagcacuuugggaggcugagguggguggaucaccugaggucaggaguucaagaccagccuggccaacauggugaaacuccaucucuccuaaaaauacaaaaauuagccaggugugauggcacacaccuguaaucccagcuacuaagggggcugaggcaggagaauugcuugaaucugggaggcagggguugcagugagccaagauugcuccacugcacuccagccugggugacagagcgagaccccgucucaaagaaaaaaaaaggaaugccccucaucaugcauggaggcuuccuggauuuguagcagacuguaccucagccaaggcagcuaguuuuaaaaccuuuuuaucaaaagaagggaaucagacaugagguuucucuuguuguuuggaaaccauaagguuucaggauguaguggauuuuuguaacccagugccuaauaagcuagagcacauaaucaagagccuaacaagcuucacccauauuggacaugagucagguguuucaggaguaccuagugcucugagguguaaaggaaagggcuccagcaccaaagaacauagcagcuucaggaacugggagcugaaaaaacaccaaccucccaagauagacucccugccaguuaccuguguguacagggaggucuccuguaagggaaugguuuccuuggcuuggccacuucuguaaaauccaaaccacugcagaagaagcaaaggaaagaagcucagauaugacacacagcacauacugccaaaauaauuugagacugguuagaagcuaaaacugccaacaaagugaacaucauaaagcuguaggaagaaggaaaaauggauag

SEQ ID NO: 14106 - RNA, 5573 nt, Homo sapiens
gaaacacagauuucuagaguuugaaacggaugggaggcuaaagugagacugcccuaaauauagcguccuggguauuuccggacaccuggggaaaugugggcuuuauuccgcaacuacagccuuuguuugauuggcaggccagccccugccacggggcccugcugcccaucucacuuccagccuggccucuacccucaccuccacugugucuucuaauuccccuccacccacgccgccucccugcugcccccguccccugugcuucccacuggccagaggcgcagcccaggcuccuggcccgggauucgcacccucagcaggcaggccgcagcagagcucaugugccguccccaacaucgcugaccugugggcgccuccacccugugcaugcgagguccccucucccuagagcacccucccugccaccuucuccaccuaccaagacccaucccacccuucaaagccaguucagaugccaccugcucagaucccaucacccagugagacccuccgacuuccccagcaccugacuggccucucugggaguugucacuccugcccugguuuuucuuguuccuuuccacguuucccuccuuccucuuccagcuuguuccagaaaggaaacgugggucuccugcccucugcuguuuccuggugcuugcuuucccugcccugcccucagaccccucugcucuggcccucugccuuggcuggccggccccugcagggcccgucucccugacaccauggcagauucgcacucaugccucagcccagcucagcugucagcccugagcccuccccugccgcaccucccauccaggcagugggcaggcucuggaugccuuguguccccugagaugccgucaguuaugucgguuauguuccugucuaccagguuucccugcagggcuggggcccuuuucugccuuggguccaauguccaucuucccuuuagccuggaaguucccagaggaggcucccuccucugucucaucucugagucccaggaccagccgggccgagaagggggcgcaacgggaguucaggguuuggagccuggggccugcugagcaccagccagcugcggggcucagggugagccuggcugcagggccucuuggcccugucuacaccccgggaccaagccuggaacaaacguuugcacuaaaugaagccggccccacccaggccucccuggguccgcuccaccuugagugguggguggcugggggcgguggcucacaccagcucugcccccuccagagcccgagccauucugagugccagcccagcgcugcuuugucuucuaguggagcgagaccgugcccugggccaccaggagccccauuggaaggaguuccgcuuugaccugacccagaucccggcuggggaggcggucacagcugcggaguuccggauuuacaaggugcccagcauccaccugcucaacaggacccuccacgucagcauguuccaggugguccaggagcaguccaacaggugccuuccccuuggcccgggugccccaccuaaccccccaccucacagucucauggucaaggcagcccagcagggagucguggugggcugaaagagagccucaaagaugggaaggaugcuuggcccgaggccccugcacugugggaagagccccagugacaauccugacuucaagucccugcccugccauccuggcuguggggacuuggacaggucacugagacucaguuuccccauguguacaccucugugggcugaggcaaugagaugaggcucagaaggggcgcagccagagucaggugggagacacuccggugacagcccccagcgggcccuggagacacggaggcagcugugccggccgccgguuaauuguucuuucauguccacagggagucugacuuguucuuuuuggaucuucagacgcuccgagcuggagacgagggcuggcuggugcuggaugucacagcagccagugacugcugguugcugaagcgucacaaggaccugggacuccgccucuauguggagacugaggacggugaggcugggggcucugcagccccuggggcuucucugugccagcacaggcagcgguaguggcuuccuguggcccugggugcccggccucaccagcugugcccgcugcaagggucacugagguccagggcacgaggucuggccuagugggggugcucccuccucucccucugcuucccaggaagcaggcggcucuucccacggagcagccuccaccuugggaguuucuguccugggaagggaaggaggggaaguggcuguacccucaggcacugaggccaggaggcuggguuugaagcccagcuuggcagugcccugccucagugaccuuggcugggacuuaccuuuccagaccccgucuucucuuccgcaggauggggauucacgcccuuguucauuccacaggugacacuggggagagccucuuuuaugccaggcaguaggaauacagaggccaaagugggcacgagauggguguguuugaggcccggcaagggggcgccauggagcagcggugagggcgggggacccaggggccauucugagucagaguaaaccagggccaggugcugggguucuuagcgucauuuauuuuauuuacuagcaguggaggacgacaggaucugauucagguuuuaaaagagaacccucugagaugccccccucucgggguggagcagagcuccccaccccuuccgugggcugcacccagugacuugcuucccgaaagugcgguguggacagggcgugggggaccugacgcgcagcgccucagccaggugaggaaggcucacugcagugaccggcacggugcuagcaugugcccugggugaaagggaaggagaaggccacugagccucagagggcccccuccgugaacccaaaaccccaguccagccacgagaaaaccgucaaacaaacccaaagagaagggcuuuccgcagaauaccugacaagcgcuucucaaaaccgccaagcucaucaaaaaaaagggaagguugggaaauuggaggagcccagaggcaccuaagaagaccagcucagugcaugugggguccuggguugaguccuggaccagcaaaaggucauuagggagaaguuaugaaauccagaucgaucaugguguuuacuuaauaauaagguaucaguauugguucauuaguuaugagaaagguacccugcuaguguaaaauauuagcauuucccagaggaaacuggguccagguguaugggaacuccuuguguaguuuuuuuuucuuugagacaggguuuggcucuguugcucaggcuggagugcaguggcgcaaucacagcugacgguaaccuccaacuccugggcgcgagcgauccucccaccuuagccucuguacuaucuuuacaaaguuuuauguaacuaucaacuguuguaaaauuaaaacuuaauauaugcauaaaauaaagaacccccugacuucaguggagagagcagacugagauggacaagagugaagucagagagacgugugggggccccacagugguccaggugggcgcugugagcgacuuguugguagcaguggagauggagaaagaugagucgauuucagugucaggacaugcuuauagcuggcgaggaggugagggaacaggaggaagccugaaugaugugugguuggagccaguggauuuuuuucaauagauuuuucuuuuuggggaaaagauagaugaagggcagguuugagguggguggccaaggguucucuuuuggcuggaauauuacugaccccccugggauguuacugagaucacugguccucauggaaaugccauuacagggaccggugagugugaagacccaggcgagggaggugcuggcauguaaguggauuuaaagcaugggaugggaccaggucaucuagggaaggaggguagugauggagaagaaagagggccuggcccagagcccugggaccuccaacauccagagaccucacaaggaggggccacagagagcccacagagaccagccagggagggagcaggacaccuggaggaugaggugaucuagacgccagaguaaaguguuuccagaagcaaggguuugucauuuguguccugcugugggcacugaaggcaagaacagagaagugaccaaggguuuugccaucacagagguuguugaugaccuaaauauccguggagugugggucugacugaggagguggagggagacaggcaguggaggcaggagacagcucuuuccagaaccuuugcuggggaaggggagcagagacaugggcuggggcuggagagaacccgggacaaggcagguccuuuccaggugaggagacgccugcacgcugcuguggugaugcagugauucugugcagagggaagaaaacugcaaaauuccgcacaaguuggagcagggagcuggagugggggagguggagagggcggggggaugcagaggacaagacggggggccucuucagagcagggacccuuccugauggaggugagggauacuguccccacugucgcagugaggggugaaccugagcucugggaggcuguaguggggcaggcacucacucuccggguugucacaggauuaaaggagggugcuuggcacagagugaugcccagugaagguguucaugagcgucggugucacccagcggcgccugcucauuggacacuuggugucuuuaaugagcuggggaagcuggggggaagcuugggcggggugguuggaguuugugucugaggcuccacuggggcaggaggggaccuagccugugcccuucucgcggagccugaccucagcucuguccugcgcccgggccugugcgcuggacacggaggacugacucgggggcccccagcccagggcggagccggcccccucccuguugcgggucgcgggccuagccuagagccugcgccuggccggggagaccugcugggagggagugcgucagggcgcgggcgcccgcccugcucugugacgcgcggcccgaggcgcacgcagggcucacaccaccuguccuggccuccgacccgggccgacuauggcggcgcugcggcuccuggcgucagugcucgggcgcgggguccccgccggcggcucagggcucgcgcugucccagggcugcgcccgcugcuuugccaccaguccccggcuccgugccaaguucuacgcggacccgguggagauggugaaggacaucucugacggggcgaccgucaugaucgggggcuucgggcucugcgggauccccgagaaccugaucgccgcgcugcucaggacccgcgugaaagaccugcagguggucagcagcaacgugggcguggaggacuucggccugggccuccugcuggccgccaggcagguccgucgcaucgucuguuccuacgugggcgagaacacccugugcgagagccaguaccuggcaggagagcuggagcuggagcucacgccccagggcacccuggccgagcgcauccgcgcggggggcgccggggugcccgccuucuacacccccacg

SEQ ID NO: 14107 - RNA, 14870 nt, Homo sapiens
guggggaagaggacgggucgagugcuggcuuccggcggaaaagcgcgcgagcaagauggccaccaccaagcgcgucuuguacgugggugagcaggagggguugcuaggcggagucugagugaacgcgacccccaagggucggggcguggggugggacgcaucucugaaccaggaggacggcgagcugcugucaaggccgggucucuggcgguagugcuggcgauagcucuggcugugcuuaaacuccuuccaagguuucccacuguccucaggaaaaagugcagacuucuuagcaguacgcacuucuccagcuucuuugcuuugcuucccgauucgcugggucucccgaaaaaugacccacuugcccccaagguucagguuauuucacaccuuugggccucugcuuuugcgacucccuugcagugaacagccuugccacacaccucaggugcgugaacccgagacggaaugauuauucugacuuccuagcccgcugagcuccagcgggccccgaggagcgguaaaggaguauuauggcccuucggauccucucguucauuuguuuuacaaacauucagugcagcgacggcucagccccagccccugccauaaaggaaggaguucccagacuagccagaaaaaaaguggaauuaccucaguagcacacuuuugauaagcgcuguagugaggauggaucaugauaauaugggccuggcugcgggacaaaugacccauccaucuggagaagcgagggcaaauucuggaugcggcgaugccagagcugaugagcaggaguuagcuacguaaccgaagcagaggcaaggccguucacugcaagggagucgcaaaggugugaaauagccugacacuugggggcaagugggucauuauucgggagacccaggaaauuaggaagcaaagcaaaaaagcuggagagguggguacugcuaaggaguuugcacuuuauccugaggacagugggaagccuuugaaggaguguaagcgaaaaguuacggguucaaauuugcauuuuccuaagaucauucuaguuggcuuuguggaguugauggaauggaggcagggaggucaguugugaagcuauugcaguaaucccaggacuagaugagagucugaaagaagggcgaagagaggaauauuuuucauaaguaugggugggcagagaugagagggggauguuuguuuacccaaagaacugaauggaaggguccuguccccuggcuagcaugcuaacugggcugcaaggacuucugcaagaguauggagaucaguggcucagaaggcccuuggcuuauuugcagguggacuggcagaggaaguggacgacaaaguucuucaugcugcguucauuccuuuuggagacaucacagauauucagauuccucuggauuaugaaacaggugaguuagugucucucacguucagaauccucuuacuaggaaaauaccuuaaaaaauuaaagucacaucacaauucuaaauaugcauucuaaauaugguuaguauacacuacagguaaguucaggaaggugucuggugacagugaucucgauggagaaggaauguucugaggccaugugguugugaacucugaauacuuuccagagucuucagcuguuggguugagauaagacagauuuuucaauagaccaguagggagauagguuugaacuacauugagauuugaauguuguuuuaaucuaccugauggguaccccaucccaccugcaccuucuugcagcugugcuauuaaaugaggcagcgggaaagccuagccccauaaugggggugggugagggcggggguucuuggccucugcaccccuggguggguuucccaucgauugguaucacaaccacaguucaguuuucuguuuaccuuuguugucauuuuuaagauuauaguuuuaggccuaguuuuaucaucaaccuugcauaugauuguuagcaaagucuuuaaacucucugggccugggaaaucuuuauuugcaaaaugauaagguuauguuggcuuucuaagggccuucuagucucugaguucuaugauaaacauuauugugcuuggucuuucuaguuaguucagcauuuuccugaagauaaagacugagcaucuuuaucagguuuuaggauucaugcuuuaugcacaguugaugcgcaaaauauauauuuagauagauaauugauaggucaaaugacuuuauuuuucuaauugcuuugcaugcaaugguuaagguuuuaaguuuggcuuucguagaauaauugaauacuuaucaauuaaaaauacaguuuacuauucagcuauguccauuaaaaaaacaaaguuuauuauugcuuaaaauauuguauaagaagaaucaagaaugagauuccuucuuccuaaauagugauuggauagaacuucugguguuuggauacgacauguaacugacuucacuuugugaccauccuguuucuucccacuaccccacauaguaauuacuuguuuuuguuuuuccauuuuguagaaaagcaccgaggauuugcuuuuguugaauuugaguuggcagaggugagagucuguguuacuagugucuaguccuugguuugugauguuguuacugauuacaaaggaagcuuuucaccauuugguuagguuuuugggccuuaggcugaugcuuccagagagaucagaaguaagugcuguucuaaggaaagcgucucucacauaaucagacuggacugugaauaacaugucagaccugccaggcccucccauucuugcccugcagaggagcuagcucaugcaccccuguucauugagcauucuugccuggaaguagugauuauuucuugugccuucaacuagauggcaaauuguugcaccaccagcucuaaaaucagccaggaagugcucuuuguuagaaacacacaaaaccuaggcaagaaauacagagguggcauuuuucuggauuuuugcuacugagcauguguuuagacaccauaagaagcauuuggcugcaagccuaaacuuguaccuuugucuuuccuuggcaggaugcugcagcagcuaucgacaacaugguauggcugggaaucuuaauucuaacuaaaguugcuuuuuggugguacagaggcuccuuauucauauaucaguguucuggacuuccaaaguuacaagguugcauggggagguaaaaauucucacaugaaaauauucacugugaauugaucacuuauaaaauuaguucuuacucagacuccuucgccauuucagaauaauguaaguccucaucauccuuguugaccagucucucacuggcucucccauguuuaggauaauuugcagacacagugcaaauugauugcacgguguaacugcauauuuugcaaaauagcaggauuucaugaaguguuagaccaauuuacaauugagaagagaaauuuaauuauggcaggugcaaaucacugauacaaaugauuuggauauucuggaaagguccuugggaaaaaugaugaugcucuuuaguauuugugccuuccuugagauccuuuuaguuuucaugucugauaagaagugcaaagauaccauacuguugauagaauuuuguuggaaaaauaauacuucagugccuguuacuuuucuuucuuucuuuuuuuuuuuuuuuuuuuuuuuaacaaucuugaacucaugaguucaagacuucucagcuucucaaguagcuggaauuacaggcucaagccaacagggcuaccugggcuaccuguuacauuucuuucuaccaaguuacauuucuuucuaccgauuagugcauaguuaguccugaauauuaaugguaagaaacuuguuuuuauuauuuuuaguuucaucacaguaauuucccagucagccuuuuaaaauuuuucaauuuuaccacgaaaucuucaucaccacuucaaguggagucaccuuaaaugaccuuuccugguaccgauuaucuuuggauaaugagauguuguuuuauuuguuguucuguuauccauucaccaaacauauucaucagcugucagagaucauuuuucuuucauuucaaagcuuaucuugacuuuugaaggugaacucaaauacugggaaacugcauuuauuuuuguaauuuuggaguguucugaacccagaguuacuuuugguaauacaggucuuugugugcugcuaugaaagaaaggggugugaguucccugaaacccacagguggcuuugggguggcugcauagcuuacugguagaggcccagggauuaagggaggacaaaucaugagugugucucagaaguauauggaaagcuggcuggcccucuuuuaaccuaagagaguuuaagcagcuggauuuucaaucuuuucagaaugaaucugagcuuuuuggacguacaauucgugucaauuuggccaaaccaaugagaauuaaggaaggcucuuccaggccaggugaguaggagcaacuuccagauucccugugauguucugcaguuuggccuuaguugcauuuuuugucucuauuuacuuggaaguagaugcuaaaugcugcuuccugguagauaggaguagaugaugguucacauugggaagggcaugcaccaccuuuuuagagaaacaagugaguuugagcuucucagcaaagccaaagugauuguuucuguuaugagagaaauuccugccugagcucaucuuucccaguuuucuugauauuccauuccuggggucuccaucaagggcugaaaucagcaaaggcuacaccuuugcuuucggcauagcuauuuuccuuagcccuacugagagcuggacuucagggccuacauucuggaugggaacuuuccuuaccccugggaguucucaguggggaauugucuggcauacaggccacauagcaucuuccacuuugcugaccaaagcagcuacuuuucaguucaagcugacagcuugaaugaacauuuguuugauucuuuccuuucaguuuggucagaugaugacugguugaagaaguuuucugggaagacgcuugaagagaauaaagaggaagaagggucagagccucccaaagcagagacccaggaggugagaaugaagcuccugcuuccagagcacaggccggcgcuguccacaggagacuuuuuuuuuuaaguuuuaauggaaauuugccaauauguauaucaaaguggagggaaugaauaaugaauucuuaguacuuugguaaagucaauauugaguucuuaguacuuugguaaagucaauaucgagugaauucaagggcgaaacuuugggucucuuguccauguuguguucuaugugaugagugucucagcucugcucagguauggauuugugauuaucaacugacagggaggaagcugaggugccccucuucaccccuccugaucagucccccuccuucacugaagaguuugccacaagggucguggucuuccuauuccugugcuaauggaggggagacagaauaggguagugucccuuccuucaaccuguacauggguucaggguucuccaguccuacgggaaccugcuggggcacuucccccugauucucagcauagucucugacaguugcuuccugggcguccccuccucugaguacuuugugaauguugucauucuucuguauuucuuucuuggcucaugguuucucucucuucucucagcugaaacaguagcagucuaucucuaguuuuaugcagccucuguuaugcuguugaucuucauggucucuuucuaguccugagcuucagauauuucugccugcaagucucaugggcagcuuaaguuugccuaaaauggauucucccgcuucucuaauccugucuuccuguguucucaaucuuggcuaauuugccaccauucauccacacauugacccacgccagaaauuugaaugcaaaucagaacucauaaaguggccaucacagucaguggagucccccuggaucauccuguauccucugcuuagucuuaccuacuuggagcacaaugcaaggcccaacaucuuccacugucuucugagcacuuaggccugagcaagagggcugcccccuugcuuccauguaguuagccaguguauaugcagggccaggcacagagggacgaggugguacauggaugggucugccuaacuagaggacagugggugggcuggaacuggcauuugaagauacugagaguuguggaucauggaccagaaaagugcuguucugugacugugaagcaagaggaggaagcagaugcaucugagggcaagcaugaugagauaacacccccgugugugaggcucagguuagccagugcugagaccuccugucgcugggcauccagcugggugcuacggccauggcuccugccuccugcagcccuaucagggcccaaggccuuccccgucagcacuugcuccagccuacgcacuggaguuguguucuggguggguguguagaauacucgcacuccuacuuagggcgucagggagcucucucuaacuagcaauuucuucugcaccuagggagagcccauugcuaaaaaggcccgcucaaauccucagguguacauggacaucaagauugggaacaagccggcuggccgcauccagaugcuccugcguucugaugucgugcccaugacagcaggugagcaggacgcuguggucagaacggcgggacgcugguggcugagcagugagccuuucccagguucuuacugcuucacuucuuguguccuugauauugcuucugaccuaaguugauuugaggcaucucagauccugggaucuaguaacagauaagucagagcagguguuuuugaagcuuuauaagugcuggcuuacuguuuuuuaaucguuuuuuaaaaauacaaguaaauaauguauucuuuuuuuuaaagaauagcauauacauauauuccaauaauauuuaagacaauaaauugaaaauucauuuuccccucucuacauccaguccucaauucuagaaguaacuagugcuuuuauugaguauucuuuguaauuuauuaaauauugacuucuauucucuuuuuaaucuaaauuuuauuaucuagacauauaaagagucaauucaguuucacaaagcuuguuuugaaaaaacagucguccccuggugcugucccugugcccugcugccaacaccauuugcugcuccucagaggagcggauuucaacucuuagguguuuugguuuuuauuuccauguugauaacaguuuuauauuucuacuuccuguuuuccauuuuaaacauuaucuucugauuuucuacuucagagaacaaagaauuaguuuuuuaaaauccccuucccugcccccucaucuucccuguauagguaccauaauuuugguuagguccuaaguuauuuuaacaauguaagcaucaugugauaaccuccuuucaugcacagcauuuuguuuugccuggaauugauaauugccuuguuuuugcauaguuuucuguguaaucauuccugauuuucucccagaccauccugcuggggguuuugcauccaggugucugcaucuuguuaaggggagaugagggcaaggcugaauuccucaacauucaguauauaaacuuucacauaaucuccauuugucauuaugguaccucagcccucacuaugcguaggauguccuaguccagagacccucugcuuuaaccuaccaaagacuagacccccagcuggcuaccagguuggggagggguggcccccagcugcagagucagggaaaggaucccaaagauuaaccacuuucuuaaaugggcuuucagccaaacuuacugucuccaggauuaccugcacccuuuccucugagcuuuuggagugcaaauugaguugcuucuuggcuuuuaccagcuuaagauucagcuuucucgggucugcuauaucauuuaggacucaucuauuuuguuuucuaacuucagaaauuuuguugcuguugucucuuccucccugcuuuuuaaguuuauuuuuuggcuauuuuagccacuuuaaaguguuuguuagcaguaauuacucuguucgaaauuuuugaaucauccuaaacaaaaccacuuauuaaagguaccuauuaaauaauaacuccccauuuucuccuccccuuagcuucugauaaccucuaaucuuugugucuaugaauuggccuauccuagauuuuucauguaaguggaaucauacaauagcuguccuuuuccacgccuuguugauuuugcauagcauaaugcuuucaagguucauccuuguaccauguaucagugccucauuccuuuuuguggcugaauaauauuccguuguauuuggauaaauaucuuguucauucauuuguugaugggcacuugcacauuguuuucaccuuuugacuauuguaaaugccugugugaauauccacauguaaguauauguuuaaauuccuguuuucaauucuuuuggauauauaugccuaggaauggaaaugcuuagucauaugguaacucuguauuuaacuuuuugaggaaaugccaaacuauuuuccacaguggcuggaccauuuuacauuucuaccagcaauguaugaguguuucaguuuuuccacaucuucucuuuuuuuuuuuuuuuuuuuuuuuuugagacagagucucgcacuguugcccgggcuggaguacaguggcgugauauuggcucacugcaaccuccgccucccagguucaagugauucuugugccucagccucccgaguagcugggauuacaggcgucugccaccaugcccagccaauuuuuuguauuuuuaguagagacgagguuucaccauguugguuggccaggcuggucucaaacuccugaccucaugauucgccugccucggccucccauagugcugggauuacaggcgugagccaccaugccuggcccacaucuucucuuaacaggugugacauggcaucucauugugguuuuuauuuuuauucccuacugacuaaugauguugaacaucuuuucaugugcuuguugaccauuuguauaucuucuuuggagaaacaucuuuucaaaucuuuggcuuauuuauuaacuggauuguuuguuuuguuuuuuuuaagagacagggucuugcucugacucccaggcuggagugcaguggugagaacauggcuuacuguagcuuugaacccuugaccuccagugauccuccugccuugaccucccaaagcacugggauuacaccgugccuggccauuuuguuguugaauuauaggaguucauuauauauucuggauauuaaacccauguuaaauaugauuugcaaauaagcauucuccuguucuguggguugcuuugcccucuauugguacgguucuuugaugcacgucuuaaauuuugauaaaaucuaauuauuuuuuucuuucaccucugcuuuuggugugacauuuaagaaaccaucaccaaauccagagucaugaagauuugccccuauguuuucuucuaagauccuuugguuuuucuuuuaaaaaaucaguuuccuaccaauuuagugugguuuuaaaagggaacagagcucgaacauguauauucaaucccccuucaacagaaucuccuauaguccuggccagguguggugguuuacaccuguaaucccagcacuuugggaggccaaggugggcggaucaucugagguaggaguucuagaccagcuuggccaacauagugaaaccccaucucuacuaaaaauacaaaauuagccagguguaugguacaugccuguagucccagcuacucaagaggcugaggcaggggaaugacuugaacccaagagguggaaguugcagugaacugagauugugccauugcacugcagcaugggcaacaagagugaaacuccgucucaaggaaaaagaaucccuuauaguccuuacaagguuaguaucacaaagguuuauaaugaguaucucuuauuuuaaaacaaaaauaugaacacuaaaccaaaguuuuuucgagguuuuuuauuuuguccuauuuuuuaaccccagcgcuuuuuccuuucucaauuccagagaauuuccgcugccugugcacucaugaaaagggcuuuggcuuuaagggaagcagcuuccaccgcaucaucccccaguucaugugccagggcggugauuucacaaaccacaauggcacugggggcaaguccaucuaugggaagaaguucgaugaugaaaacuuuauccucaagcauacgggaccagguaggagccaguuggcauguggugacgagggaggcugggcaagggugggauggccaggcaggauggaaggacagguuguaguucuggcuggcggacacuaagagucuggaggagacccagccaccagacauaggagaaccaugcagccuugcuaggguggaguuggcuuguugacauucagguacuguucaucccccaaccguguccacaauuccuauuagccccgcuuggauucuguggucugcuguugcaggcucuuaugcucucaaccccacugcucucccugcccucaccaucagauuuacucaguaaaaucucggugguuagucccccagcaacuagagaaaaaacacagaauuguacugaacaaucccacuugaaauuuauaacuauaguucuuaaggggacccuugccaaccugaccagauuucccuacuugaugcucagucccaaccggagaugauguguccaugcccgucuucacuucugaagcccucauaucaucaccuucccaccucaucuaaugcuucaccuccugcaucucuccacucgugcaugcucuuucuuccaauuacaggggaugagcugucucuccuaggccagccucuccaccuguggacuggauccugucccucuccucuacuuaggaacauggcuucuaaaguuguccccuucuuguaauccauuuccccugcucugcuagaucaguccauuagcaugaaagcaugcaguuaucaaccuuuaaaaaaaaucuucauccgguugccgggugcaguggcuuaguccuguaaucccagcauuuugggaggcagaggcaggcggaucaccugaggucaggaguuggaggccagccuaacuaacauggagaaaccccaucucuacuaaaaauauaaaauuagccgggcgugguggcgcgugccuguaauccuagcugcucggaaggcugaggcaggagaaucacuugaaccugggaggcggagguugugaugagccaagaucgcaccauugcacuccagccugggcaacaagagcgaaacuccgucucggaaaaaaaaaaacaaacuucauccuuguacucuuguucccucuccagcuaucacccaugccccuggucccccaucuuuuuucaagaaguaaaagcauaacuucuugaaaacaugguacagacuugcugccuucgcguuuucucuaaucccuucuaggcagacuucuagucccaucucgccauugaaaccacucuugccaaaaauacgaguagccaguucuuggcgaucaucuuaucccaccucccagauguuaucccaccucccaggagcauuucauacuacagguugagugucccuuuccugaaaugcuugggaccagaaguauuuuguauuuuggaauauuugcauuauacuuaccaguugagcaucccaaaucugaauaucucaaaucugaaaugcucgagugagcaguuccuuugaguaucauaucagugcucgugaaguuucagauuuuggggcauuuuggauuuuggauuuucacauuugggaugcucagccuguacuaacucuguucuccuugacuccuucuucacuuggcuggcaggacuccugccucuucuugucuccuuuuaccuagauggcugcuuuuucugucuuugcugucuccuucuuuuccugacccuuaaacacugaaguggcucagagcccauucuuugguucuccagaagccuguuacccugugcuccguuuuucuaacuggugguuuguagggccccucuuuacuauacugaacugacauguguaggugauauagcccacugacccacaucguuauuuuaaaaaucaguauucaucuguaacuauaauagggaagaacaucagaggaaauaaacgaauuuguauaauacucgaauauguuuccagauguacaugcuuaagcacagcugugucagaacacaaagugaauuauucaggcgucugccccuguacucaaacgcagcaguuagaaaugcagacgggagugucaacuggauaccacuaggagugaugcuauuggugauacggcuuugugaaaugguagauaaaguugauuagaguccaaaguaaagaauaaucuguuuauuuacauaguaguuacauuccuagaagauuccauggaaaaucaaaagcacuccaaaacuuugggcuuauauguauaauggaauuauguuuuaggugcagauaacuguaaacacauuuuuuaccuauaccaauaucuggcaggauauuuguuguuuuguuguuguuugguuuuuguuuuuuugagacagggucucuuucuguugcucaggcuggagugcaguggugcaagacggcucacugcagccucaaccucuccagcucaagcaguccugccucagccucccaaauagcugggauuauaggugcacgccauccauaaugccaggcuaauuuuuaaguuuuuuguagagacaggguuucauuauauugcucaggcuagucuggaacucuuagcuucaagugauccucccacuucagccucccagagugcugggauuacaagcauuagccacugcgcccagccucuagcaggauguuuguaagggccaagaggauaugagacaauucauugugccagacauugcagaacaucuagcauuccaggcccccaccugcuaaaugccaguagcacccccacaauauuucagacagucaaaaacacuuucaggccaggcacggcggcucaugccuguaaucccaacacuuugggagucugaaguggcagcccaaagccagaggaucacgugaguucaggaguucgagaccagccugggcaacauagugagacccuauaucuacugaaaaaagaauaaaaaaauuauccaggugugguggugcacgccuguagucucagccgcuugggaguugaggugagaggauugcuugugccccagagauugaggcuacagugagcugugaugcacuccuguacucagccugggugacagagugauccccaucucaaaaaaaguaaauucagauuuccaaagguuuccuagggacaggacaccaaccccacugagaagcagugcccuaagcagucacacccggucccagggcuuucagcgguaucucugaguuaaguuugugcagacuggcaucugcaugcugauggcucccugagcuccagacuccuguccaacugccugccuguugucuucacuggauaucccacgagcaucucacacuuuacaugucuaaaacagcucuuggccuucuccccuaaacucuuccuccuccucuucccuguuucaauaaaugacuccaccauccacuuagccgcuugaucagaaacuuaggagucauuguggacacacacacacauacauacauguacacauacacacacagacacacacauauacauguacauucucuuacgugacaaauguccauguuaccaggccucacugugucauagcugucauuuugaauggcucuuuuccacugauugugagcuccaccagagcuuggacuauguucugcucaucaguguucccagggcuuaacagggaccugguugucaaguagacacuuaauuguuaaauaaaugaauuaaugaaagaacagaccaguauaaagugauugaaacaccucacuuaccauuucacugacuauuaacugaauccaagauaagguggccgcauuugcaugugaucugugcauccccgagucugagccugacuggcugaagggcugucaacagccugcacagacguccuuuaagggcugguagccaggguucggggagcugaugguuguucucucccucaggucuacuauccauggccaacucuggcccaaacaccaauggcucucaguucuuccugacaugugacaagacagacuggcuggauggcaagcaugugguguuuggagaggucaccgaaggccuagaugucuugcggcaaauugagguauguggccaggaaugggccuccuccuuacccaggcccuaggagcacagcccugugugagggcuggagagucucuguggccugagagagauggccaggggcuguguccagcgggaggggcugcugcugcccagguuccgggguggaagugggcaaaugggcaggcagggguugguaucccuaaaccacuguuagucuccggccuuacucccucacuucuauucugccacaaaggcccagggcagcaaggacgggaagccaaagcagaaggugaucaucgccgacuguggggaguacgugugaggcggcacucucucugcuucccccuccgcucuugacccugcauauccaggaaggaacugccagccucagaggaggcagcaccgagggugccuguuugaagcaagcagcauuugggauaugugcccuuccucagggucugcuuggagcagcuccucugcaggcacagccuggacuauucccaggcacagcugugggcccaggagccagcucaggugcuccccuccaccaugggcaggcugugcaaaaagccacuggcuuuucucagcauuugcugcugggccucuccugggacuaccaguguggcucuuacguguuuucuuugcuaaaauaaacccuaguucuuauauugcucuuccugcu

SEQ ID NO: 14108 - RNA, 2114 nt, Homo sapiens
ucagguacuuagcugaaugaggcuuucuugggaacugcacaaauauuuggagucgggugugugccaauaggcaauuaauugaaauguggacacagcaagcuucuggaggaaggaaacugaaguugagaaauuaacugugggaagugaucuuccgcaagauacaaaacaguaauuagggaauuuccuuuagugcaaacugaaauugauuugguaugguaaaaggacaaaacaaaaaacagugaaugaguguaggauuaagguuaacuccuaugauacuagggcuggaagggguucuuggagaacacuggucugacccucuuggaaagggaagagaacccaagguaaauggcaagucacggcaaauucaggaccagaagcaagauguccugacuccagcccagggcaccuucuacuuuuuacgcugacugucuaccuggagaccuggauuaucauauuaggagcuaaagggcaaggacugcgauuuaagcauuuuccugucaccaaugacuuugugaauacauuuaguaaaaccuguaacaaaaucaagcuucucacugaguguacucuuaacucgaguggaagcgcaucuggccaaccuccuacuuggugucuggcugccugcugagcacuggcgauggagcugguuaaaaauagaggcccugcuucaugcugugugauguuggccugaugccaggugagggccccacucccuguuuauccucuuuggaaggcaugcagccucuaggcccaucuauguuuccccaucucccaggagaauggacccaucuccuuaauuguuauuauuauuauuauuuugagacagaguuucagucuuguugcccaggcuggagugcaauggugcgaucucggcucacugcaaccuacaccuccuggguucaagcaauucuccugccucagccucccaaguagcugggauuacaggcgugugccaccacacccgacuaauuuuuguauuuuuaguagagacaggguuucgccauguuggccaggcuggucuugaacuccugaccucaggugauccgcccaccucggccgaccaaagugcugggauuacagccgugagccauggcuuuuuauaaaugaugaauaaggaaagaagaucucugugccauugcuuuaagauucagauugucuuaagaugauaugaaaucccuuuuuauugcucagauauguagggccagagugaucauuuuuuaggcuuccccuagaacauggcuuucaaagugucgucccugaaccagauguaucagcaccuccugggaacuugcuagaaaugcaaauucucagguuccacuuuagcccuccugaaucaaacucugggaaacagggcccagcaaucuguguuuuaaccagcccuccaggggaaucugacguacagugaaguuugaaaaccauugccccagaaaauuaugauguggaagucugggcugcuggauuccagcaccaggaaaguaauuuauuuuugauuauuggacccuuaagaauaaacucucuucauuucagaaugcccaggugagcuguuuccauacauugcugaguguuaaacaggaaaaaauuucuaaguaauucuucaaaauuuaacugaccagcacagcgagacacaauucugguaaccugacauauuuccagcaagugcaauauuuucauauuuuaaaauuccauggaaugacugaauaaguuaauugauuaccuaaucuguuauuuuuagaaucccacuuccuuaccucgugugaaaguuuauucaaaauucaaaugggaacauuuuauuaccccaaaguguuuuccuauauacuuuaacauguuacuaaggaaaccaguuguaacaucgcagugauauuguugcucuagcaaauuaacaauucaccaacauauaugccaugcuauaaugauuuuuucccucucucucuggaaaauuucacgcuuauugaauuuacacauuuauaacacaggacauuggaagcaaugggaauaaagagguaaggagaaauuguaucccagagugacagaggauauuucccaggauguguuuugugcuguuugagcauaggcagagcgaggugauuuuucauucagcaucaggagcuccucugcgu

SEQ ID NO: 14109 - RNA, 22723 nt, Homo sapiens
agacagccacaggaauucaggaucccgggucgcagaaucgaagccugugcaggaacaaaugggggcagacugagccacgagcuugaagagccggcucugcaugauuguauuaucccaagagacuccggcccuguuucucccgcgcacagaaggguucugugcgcacugagguucaaaugcaagaauaauugugaacacaaaaguacuauuccaaggcagagaccaccgccauuccuugaaccucacgguaacuaugugccaaggucugugccucguauaaauauuaucuuccuacuccucguaacacaccuuuuaugagggaggaaacuauuaucccaauuuucuuuucuuuucuuuuuuuuuuuuuuuuuuuuuuugagacggagucucgcucugucgccuaagcuggagugcaguggagcgaucuccgcucacugcaaccucugccucccggauucaagcgauucuccugccucagccucccgaguagcugggacuacaggcacgugucaccaugccuggcuaauuuuuuguauuuuaguagagacgggguuucaccguauuagccaggauggucuugaucuccugaccucaugauccaccugccucggccucccaaaguguugggauuacaggcgugagccaccacccccggccuauuauccccauuuuauauacaaggcaaccaaguucagagagguuaagucugaggucgcagagugacuagcagaguggaggauucaaaccgaugccagaggguuggaggauuucaccacccauaaccuccagcagcaguuggcagcccacuccagagaaacacacgccguaaguaagcaguguguuuacuaugaaauauaucaagacaaguccucuguuucucccuuaaccagacugccacucucccucuuagaaauucuugagucaccucugucucugacucaaacccucugacucaaacuaucugacucuggaacaguugcucuuaacccuccugcuaucccaccugcucugucuguagagcugcaugaacccgaccgaacugaauaggaugugcaaggacaugauauaugagaagacuugaguuccaguccugacuauggcacugccagacacagcuuuuaaguugucuucagcauuuacauacuauuaacccauacuuggccucgucugauccucaaaaaacuuggcuuauugaagaaggcaaguuuauauuuccauuguauaaauaaaaaagccaaggucugaaaaaauaaaauauauaguagggccaggcgcaugccuguaaucccagcacuuugggaggcugaggcgggcagaucacgaggucaggagauccagaccauccuggcuaacauggugaaacccugucuccacaaaaaauacaaaaaauuagcuggccaugguggcaugcgccuguagucccagcuacucgggaggcugaggcaggagaaucccucuaaccugggagguagagguuucagugagcugagaucgcaccacagcacuccaaccugggugaaagagugagacucugucucaagaaaaaaagaaaauacaaaaauuagccgggugugguggcgggcaccuguaaucccagcuacucgggaggcugaggcaggagaauaaccugaaccugggagguggagguugcagugagccaagauugcaccaccacaccccagccugggugacagagcuagacucugucucaauaaauaaauaaauaaauaaauaaauaaauaaauaaauaauagauaaaauaaaauguaguguucacauucacauuuaggaagugacagaccugggaucugcacugaaaucucugaacuccgagggcuuuggcaucagaaacugaaguuucaaaccuggucccauuacuucaauuuuuauuuuauuuauuuauuuauuuauuuauuuauuuauuuauuuauuuauuuauuuugggacaaacucuugcucugucgcccaggcuggaaugcaguaacgugaucucugcuuacugcaaccuccgccucccggguucaaaugauucuccugccucagacuccugaguagcugggauuacaggcacacggcaccacgccuggcuaauuuuuguauuuuuaguagaggcgagguuucaccauauuggucagucuggucucgaacuccugaccucaugauccgcccaccucaaccucucaaaagugcugggauuacaggugugagccaccccauccggccccuauuacuucaauugaugauugaucuuggguaaguugcuugccuccucugugucaauuuacucgucuguaaaacaggauaucuacuucuuaguauuguucagaagaccaaacggagaaauacaguuguugugcauugucucgguaucuagaaaaaugucuggcacacaguaggugcucaauuaauguuagcuaacugugaucucuuguuagcugauguuucucuaauaguagauucuuagccaagacacuuccacucucuggccuuuugugcuguacaacauuauccaucaaggacuggguggaaaaaaccuaguuccuuuugccucuagugccucuaguaaaaugaaagaguugggcugguggauaucuaagagucugucaauacugagagucccuucuaacccaggucccucccugaggaaauccccaucaugacaagcacucagagaaguugguugguacagaguuucucugcugguuaccccaggugugguguggaccccagaaggaugacagguaaggggacugcaagacacacacccaauccuaaaagaaagaagucauccuugacuccugucuuucauucucauagcuaccaaccucugcuccugcagucaacaaauauuuauuaagugccugcuaucugacaggcgguguucuuuuuuuuuuuaagauggagucuuggccgggcgcaguggcucacgccuguaaucccaacacuuugggaggccgaggcgggcggaucacgaggucaggagaucgagaccauccuggcuaacacggugaaaccccgucucuacuaaaaaaauacaaaaaauuagccgggcgugcuggcgggcgccuguacucccagcuacucgggaggcugaggugggagaauggcgugaacccaggaggcggagcuugcagugagccgagaucgugccacugcacuccaguccgggcgacagagccagacuccaucucaaaaaaaaaaagauggagucuggcucugucgcccaggcuggagugcaguggcacgaucucggcucacugcaaccucugccucccggguucaagcgauucucccgccucagccucccgaguagcugggacuacaggcacgugccaccacgccuggcuaauuuuuuuguauuuuuaguagagaugggguuucaccauauuggucaggcuggucuugaacuccugaccucgugauccgccccgccuuggccucccaaagugcugggauuacaggcgugagccaccuugcaggcuggcacuguucuuaucucugcggaugaaguugugaacgugacccaaacucacugcccccauggugccuucauucucaucaguuugaccucucuauuuuucaaguccaucccuccuuccccauucccaucaccagggcucucccaggucccagccucauuuuccauuccuuagccauuccaguacauuccuaucucccugcucuaguucucuuuuucuauaccaguugccagaggaacuuuucuaacuugcaaaucuugccuuaucacucuccagcuuaaaaauuccuuaauggcggccgggcgcgguggcucacgccuguaaucccagcacuuuggaaggccaaggcgggcggaucacgaggucaggagauccagaccauucuggcuaacauggugaaacccagucucuauuaaaaauacaaaaaauuagccaggcgugguggugggcaccuguagucccagcuacucgggaggcugaggcaggagaauggcaugaaccugcgagguggagcuugcaguaagccgagaucacgccacugcacuccagccugggcgacagagugagacuccguaucaaaaaauaaauaaauaaauaaaauuccuuaaugguuccccauaagcuauagggcaaaguccaagcucuuugcuggguagcuaagacccuucaugagaugcucucugcugaccccuccuggcucagcucucuccacacccuccucuucccccaaguucaguccccaccaaagguccugcccuucccuccgacugccaagcccuuuuccuccuuguugccugccuggggaaaaacucuucuucauccuucuagccuaagcuuaaauaucaccucuggccgagcgcggugguucacgccuguaauucccgcacuuugggaggccgaggcgggcggaucaccagaggucaggaguuugagaccauccugggcaacaugguaaaacccugucucuacuauaaacacaaaaauuagccaggcauguuggcaggcaccuguagucccagcuacucaggaggcugaggcaagagaaucgcuugaacccgggagguggagguuguagugauacaagaucaugccacugcacuccagccagggagucucaaaaaaaaauucaccuccuacaugaagccuuccugggcuguuuauaggggagagggugccaugagcuaaggaagcacuagagcaaaacacgcaagggcucaggcucuggagcagaacuuuuuuuuuuuuuuuuugagagacagagucucgcucugucacuauauguuggccagucuggucucgaaccccuaaccucaagugauccacccgucuaggccuuccaaacugcugggauuacaggcaugagccaccgugccuggccuggaguagaacuauauaauccugccuaauccuggcgcuaucguuuaccagcuagguacucaggcaacgcucuuauccucucugagccucaguuuccucaucuaugaaauggacacaucgauaauacuucccuuguaagaucgugguaaagaguauaugaggccaggccgggcgcgguggcucacaccuguauucccagcacuuugggaggccgaagugggcagaucacaaggucaggaguucgagaccagccugaacaacauggugaaaccccgucuuuauuaaaaauacaaaaauuagccaggcaugguggcgugcaccuguaaucccagcuacucaggaggcugaaguagaacagucacuugaauccaagaggcggagguugcagugagccaagauggcgccacugcacuccagccugggcaacaaagcaagacuccgucucacaaaaaauaaauaaauaaauaaauaaaaguaaaugagaggcugggcaagguagcucacgccuguaaucccagcacuuuuggaagcugagaugggcaggucaccugaggucaggaguucaagacuagccuggccaacgugguaaaaccccaucucuacuaaaaauauaaaaguuggccagggacagucgcucacgccuguaaucccagcacuuugggaggccaaagugggcggaucaccugaggucagaaguucgagaccagccuggccaacaugguaaaaccugucucuaccaaaaaauacaaaaauuagccaggcaugguggcaugcgccuguagucccagcuacucgggacgcugaggcaggagaaucgcuugaacccaggaggcagaaguugcaguaagcugagauugcaccacugcacuccagccugggcgacagagccagacuuugucucaaaaaauaaaauaaaauaaaauaaaauaaaaauaaaaauaaaaauacaaaaauuagccaggcauaguggcaggugccuguaauccuagcuacuugggaggcugaagcaggagaaucgcuugaaccccagaggcggagguuguaguaagccaagacugugccauugcacuccagcccagaugggcaacaagagugaaaguuggucucaaaaaaaaaaaaaaaaaaagcuggacacgguggcucaugccuguaaucccagcacauugggaggccgagguggguggaucacgaggucaggaguucaagaccagccugaucaacauggugaaaccuugucucuacuaaagauacaaaaaauuagcugggugugguggcaugcgccuguaccagcuacucgggaggcugaggcaggagaaucacuugaacccaggagguggagguugcaaugagccgagauugcgccauugcacucuagccugggcaacagggcgagacucugucucaaaaauaaauaaauaaauaaauaaauaaauaaauaaaauuaacauuaaauuuaaaaaauuuuuuuaaaaaggaguaaaugagauaaugugugaaaaguucuuggaauagugccuaacgcaugccaaaucaacaaugaaugugagcuacgagucuucuuguagaggggaaaaacauuuucugaguuccugcuaugugguaggcacuuuuacauguguuaucucauuuaauucucacaacccaugaauaagguauucauuacauacagaagccuacaaaaacuaaaguucagagaggugaaguagcuugcccaaaguugcacagcuagguacuggcagagauggguuucaaacucaaggggcuguauagcuucaaagcccaggcucuuugguguuauuucuauuauuauaccuccuacaacuauuauuaauaaucauaaaauauguuauccuuuuauuuuaagauuuagagauaaauuucccccugcuuaauaaauuugaaaccucuuggcugggcgcaguggcuuaggccuguaaccccagcacuuugggagaccaagguggguggaucaccuuaggccgggaguucgagaccacccugaccaacguggugaaacccugucucuacugaaaauacaaaaaauuaugcugggugugguggcucaugccuguaaucccagcacuuugggaggcugaggugggcggaucaccugaggucaggaguucaagaccagccuggccaacaugaugaaaccgugucucuaccaaaaauccaaaaaucagcugggcgugguggugggcgccaguaaucccagcuacucgggaggcugaagcaggagaaucgcuugaacccaggaggcggagguugcagcgagccaaggucguaccaccacacugcagccugggcgacaagagcgaaacuccgucucaaaaaaaaaaaaaaaaaaaaucagcuaggcaugguggugggcgccuguaaucccaccuauucaggaggcugaggcaggagaauugcuugaaccggggagguggacauugcagugagccgagaucgcgccacugcacuccagccugggcaacaagagcaaaacuccgucucaaaaaaauaaauaaaauaaauaaaccucuuaaccaggcauucaaagcucuauaaucauguuucuacuuccuuuuguuuuuguuuuuguuuuuuuuuuuugagauggagucuugcucugucccuaggcuggagugcaguggcgcaaucucggcuuacugcaagcuccgccuccuggguuuaugccauucuccagccucagccucccgaguagcugggacuauaggcgcccgccaccaugcccggcuaauuuuuuuauuuuuaguagagacgggguuucaccguguuagcuaggaugaucucgaucuccugaccuggugauccacccgccuuggccucccaaagugcugggauuacaggcgugagccaccgcgcccggccuguuauuuuauuuuuuagagacaggggucucacucuguugcccaugcugcggugcaguggcgcaaucauagcucaauguagccuugaacuccugggcuccggugauccuccugccuuagccucccaaguaguugggauuacgagcaagcuacuaagccuagcuguuucuucugcuuccuuuucccuuauccccuaguuugaauccaagggcaguccccuuccuggcacagcaagcaaaauaaagugaagccccuggaggcucaggcuccacagcaagaccacagagaagaccagcccucucccauugccacaaagacaagagauagcuugaaagaagacagcuaaaagugguggguaaacauuuaagccccagcaccuguuggcuugaauuugcauguucuaugacuaauccucugcucuguacacaaacucuccuuuaccugccgggcuaaugucccauucuaaacaaauuuuguccuaaaggccacuaacguuucacugcuagcccaaagcuagaccauuuucucagcggcagugagugacagcaggguucaagggcaggagagccaauaugacagaugguucuagcugugaguucuagcuguggguggcagagagagggaaguugggccgcuugaagcugcuuagucugccaacuuguaagagauucugcaucacagucacaaccuauccugugcaacccugcccagagccaggagagcaaaggggcccugcuguaguuaacacucaacuccagaaacuguaaacacaaaagcaaacaccaugguuggcuggcagccugggggcacuauggcuuuacaccagcagcuucgaaaggacacagaaaccaugggguaagaguccaaaggguggagagucaacugggguggguaggugaauacccagcaacccacccacccccagggagccuggggucuuaccuaccuggacaggcccuggcaacuucguggaggaacauccugguuugugaaccaaagggcaguuggaauacgaggcuaagcucugcuguguccagcuggacggucacaucugagccugcacaaaggaggcaggaaaugaacccuuggcugccaggagcuaagugcuugaugcagccuaagccugagaauggagaaucagcaacccagacucccaaagccccuucagcccuuaagcaacuuacuugggacagcugcugggacaacaaggaaacccucuguacccugaguuccaaauuaacaucauccccucuuuauacaggaggcagaagaaggcucugaaaagucaguaagccucaacugcaguacuagauggaacugggaaagaacagguucucuggauguguagucuguuccccucccgaugaaaugaaaagcacauagaggcagacaagagggaauguccaugggucagucuaccugacuaugccagguagugugauaggcacagggaauaccauggugaagagaauacacgugggcccgucucagggagcuagacuguagaaggcuucccuauucauagcauauacccaauaccgggcacauggugagcacucaaaccaugugcugaacuaacagacaaacagaagcaaccuagcagagcgauuaagagugugggcuaggcugggcacagugacccaugccuguaaucccagcacuuugggaggccagggcaggaggauuacuuaaagccaggaguuugagaccagcuuggaaaacacaaugagacaccaccccccgccacccaaucucuauaaaaaauuagccagauguggagucccagcuacuugggaggcugaggugggaggaucgcuugagcccaggagguugaggcugaagugagccauauuugugccacugcacuccagcccgagugacagagcaagauccugucucaaaaaauaaaauaaagggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcaugguagcgggcaccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaauauauauauauauauaaaauaaaauaaaauaaaauagugugggcucuagaaucugaauucucuaaguuugaaucuugguuccaccccuuacuaaacuguuuaauuucucugggccucaguuaccuuguccauaaaauggagaugcaaacagugauaaccucauagagcugugagaaaagccugauuuaggcccggugcgguggcucaugccuguaaucccagcacuuugggaggccgaggugggguggaucacaaggucaggagaucgagaccauccuggccaacacggugaaaccccgucucuacuaaaaaaaaauacaaaaaauuagccgggugugguggcaggcgccuguagucccagcuacuugggaggcugaggcaggagaauggcgugaacccgggagguggagcuugcagugagccgagaucgcgccacugcacuccagccugggcaacagagcgagacucugucucaaacaaaaaagagaaaagcgugauuugguguauguaaaacuucuagcacaaugcuggcgugggauaaucauuaacucauuauuugcuucuauuauuauuauuguuguauagcaaagcagacagacauuaaauaugucaauauaaagaauuacaucacugauugagagaggcuggcaaaaauaagaaaaaggcaagccaggugugguggcucacgccuauaaucccagcacuuugggaggccaaggcagguggaucaucugaggucaggaguucaagaccagccuggccaacauggcaaaaccccgccucugcagaaaauacaaaaauuagcugggcaugguggcgggugccuguaaucccagcuacuugggaagcagaggcaggggaaucacuugaaccugggaggcggagguugcagugagccaagaucaugccacuguacuccagccugggugacagagugagauucugucaagaaagagagagagagagagagaggaagggagggagggagggacagacacauguauccaugggauacaaaacaauuucaggauuuuuuggggguuuuuuguuuguuuuuugagauggaguuucacucuuguugcccaggcuggagugcaauggugcgaucuuggcucacggcaaccuccgccucccagguucaagcaauucuccugccucagccucucgaguagcugggauuacaggcaugcaccaccaugccuggcuaauuuuguauuuuuaguagagacgggguuucuccauguuggucaggcuggucuugaacuccugaccucgugaucuuggcccccccaaagugcugggauuacaggcgugagccacugcccuggccuaauuucagggguuuaacaaaggcugccugggaagagaaaugcaugaauggaagcccugaaggcugaguaggaguuggcuaggugaagagaugugaggcuugcaggaggagaggacagcgugugcaggggcuccggggugagaauguguguuaucgggggagacggaaacagcagcaaggaggagagugaugggagaugagcccacggagaugggcugugccagauccuacagggucuuacuugcugcaauaaguuuagcagggggugcucuuacuuuacaccauucuucuuucucugaaaaucaggcaccccugccccgagugggacccagaccaagaggaccacucaccaaggauguagaguucaccaucuggggacacuguggggagggaaaugagaaugcccuuagcaauugagcuuacucccccuugcccccccaucaaggacaaagaugagcuggggggcccauaggagaggauucauaccacccagcccccuguggcaccuucuuccagcguaaaaucccgcgagacuggcacuaucugguccagagagacaucguccccgguaauggccauccuccggugcguauagaggaagagacuaagggcaggaagcagaggugaggaugggggcccgcuggcugucccucagcccuaucuuggaggucucggggugcucacacucgcucguuggucccuaacacugugcugguggugcccuggcuaggcacacuccucaugccaucucugucuguggugcccaucagagacugcaguuuuauggaugaggucaucaaaccagaacuuuucucaucugcaggagccccugauuguuaguaaaacacaaacacauguuugaucuaaccauggugcauucuagcacugugugugacaggaacagugcaaccuuagcuacccacuucucucccugaaccuguuucccaucuguaaaacuggggugauggaucagaaaaugucuaaggcccccucccucccagcuccuagacccugagucacuuaccagcuaugagaccuuugacaacuauuacucucucucugcuucugugugguauguggguguuacuagacaacauuuauggagcacuuucuuuuuuuuauuuauuauauuuuuuaaauuauuugaaauagagauaggggucucacuauauugcccaggcuggucuugaacucaagcaguccucccagcucagacucccaaaguguugggauuacaggcaugagccacugcacccagccuuauugagcacuuucuacacaccccaugguguucguuuuuuuuuucuuguuuuuuuuuuuauagagacagggucuugcuguguugcccaggcugcaaucguaguucacuguaaucucaaacuccucggcucaugugauccucccgccucagccuccugaguagcugagacuacaggcaugcaccacaacacccagcuaauuuucuuauuuuuuguagagauggagccggggagcgggagguggggcgggguagggggggcggucucgcuauguugcccaagcuggucucgaacuccuaggcucaagcaaucuuccugccucagccucccaaaguguuggaauuacaagcaugagcuacugcaccuggccuaacucacuuuacucuuuaauauggacaaaucgaggaguaaaacaacuugcucaagaucaugugguuccaccaggugcgguggcucaugccuaaaauuccaacacuuugggaggcugaagugggagaaugaccugaggccaggaguuccagcaugcagcuaugagugcacuacugcacuccagccugggugacagaaagagaccccgucucuaaaaaaaagaucaugugaggcugggcacgcuggcucaugccuguaauccuagcacuuugggaggccaaggcagguggauaacuugaggucaggacuucaagaccagccuggccaacguggugaaacccugucuuuacuaaaaauacagaaaugagccaggcaugguggcgggcaccucuguaauaccagcuccucaagaggcugaagcacgagaauugcuuggaccugggacgcagagguugcagugagccaagaucaccccacugcacuccagccugggcaaagaccaagacuccuucucaaaacaaacaaacaauagaucauguggcuuguuaguaacaaagccuggguuugaacccaggcauuuggaccacgaggcucaagaucuggacuaguauguuaaacugucucuucucaagaaacuuccuccuuagaucuugaggauuaugaguuaguacgugugcaggguuuaaaauauaguguucaaaaaauauuaacuaucauugugauaauuauucuaggagacucagacccugcccuggagggacaguugaaguucagcuggagggugcagugaugaacaaccccauggcccagacagguggggaccaagccccucacucacgcguguuccuggccgccgugcuccaggcgguagcgcacgagucccaggaggcggcucugccggcugucccccucacacagcacaccuugcaccgccugcggcucagagucaagggaagacaacccagaggcgaggccucuccccacccaggcugucccaccuucccucuguuccccugcccccccagauucacuguguggccuugggugagcacucaaaccaugugcugaacuaacagacaaacaggcucucuaagccuuccuuaucuaugaaaugaggauaauaauccccaacuucauagggaguuaggaggauaacugcguauuuaaagcauuuggcugagaguccaggacucaguaaguacuuaguaaauacugauuuccuucuccccugaugguucagaggggcaggagaggggauagacaccucgacaccuuccauuccucuucccaaggccagggcaggcucagggccgcaguuagcacaggaaggauaugaugacgcaguauucccccucagccagcgucuccuggauugccacagacugguccaugcuggccccugcugagcgcacacacccugugggaggggagauaggagccccgcuuuggucaacaaguuacgcauggggugguggagcugccucagagggguugggggcaggagggaggggccuuugcagagggagaugguaccggggaggccugauccuccuccuccuccucuuuguccucccuagaauaggccuuucaguuuuuagggauagggguccagucccuuugccccgcugggaucuacaguuugcuauacugccuuugucugggagggcauccaguugcucuugaguguggucuauccuuguuggaagugggguacguggauuggagaaggggaccuagucccuuugcuccuaggacauggcucuuccucucuuuuggggacaguuuuuguucugcuagcgccucucugggaggugucagugguguguccaugugggguucagggaacauccccuuacugucauucaggagggucccauuccucuuuccuuggagacaggaagugucccauugcugcuugcccuucacccccgccccagcaggcccauugcaucagcugcaggccggggguuggggggugucccagcccucagcuugcccacucccuccugcccagcccugcccuggcuuuccugcucugcucccacccacagcucccugacauugucaccuaccuccugagcugucaccacagggcgcacgggacuccgcugccccagguuccgggacagugacuacauuucccaacagccccugcgccacaugguggucagucagccugcaagucccagcaugcccgagucaaucgugggguggggagucucuccauccguguuaaccccuuaggcccugggguacacugggcuuccuauaccagaaagguuuucuaaugauugcccucacucccauccccagcccucuaggucauggggccagagcuucccacccagaaggaagauggucacauuuuaucuuaggggaagaauauaaugcauuuuuauuuucuccuuaguuccauccucagcucuucucacuccaggguagacaacccggaccucuacugaaacucuuccccuaaaauaacuaccuucuccugguuuaauggagggagaaccagacuaugaagaaccauuauguccauuuuccagguggagaaacugagccuuggauagguuaagcaguuugacauuaaguccugcagcuagcagguggcaacacugggacuccacugaaagucugacugcaacuccugggccauuuauaccgcuacacacugcccuauuuccucccuuagccccacccagcccuccugccacacagggcuguuugaggcuacugggugugaacgcacuuuauaaaggguaugacacuguuccuguccggcaacguccuuccccugauccgccuggcuuugugaccuuggccaagaccuuucuucccuugggacucaauuuccccaucuaagauaaggagguuacccaagauggacaaaaagagccagcacagggacugggcacaguggcucaugucuguaaucccggcacuuuggaaggccaaggagggaggaucgcuugaggccaggaguuugagaccccaucucuaaaaaaaaauuuuuuuaaauuuagccggguaugguggugcaugccuguagucccagcuacuugggaggcugaggugggaggauugcuugagcccaggaguucaaggcugcagugagcugugauugcucacccagcucagauaaggaaugcuaggaucauucucacuuggccuauuggcuguuuaauuaagcuguaagcucccguuggacaggacuaugccuuuucaucaacauaccagcaguuucuggcacacaguuaucuauggaguuagugaauuacuuucugaacuauuuuaauaaauacaccuucucucaagcuuuggcccaaacugaaggaaugggccuucagugcuggggagggggugacuguugugacuugugaacaguuucccuuccucuuuccccaagugaaguggccauccuaaugaccaguucaacuuugcauauguaaaccccuuccagaaacagucguugccuucuucucaauccauuucuuuuccuggaaacauccacagcacaaauggagcucaaguuuauuugaauucagugucuaagucauguggacgaugaggggaaaggggauugacucagacccuuaggaucaagggguggggucacugcagggaagcagaggaaccccaauuccagcccugcucuagugucaaagccuggcgaggagggucugggcaaaguagauggggcugugugcuuuuuaugaugaagaaacugucccugcaggauuuggggguccucccacugggugggggucaggcaggagguuuucuguuuuuccagacaaacccuauccucucccugagauuagggcugagggccugcccccuugggggguuccauggucaggccuaggcccuagaaggggagaagugaggagccuuaagcccagagcugugggcuugauaaaggccuuuuacuaaagaugcaacuacaggaaucagagcuggagggggaccugaaggcuuguagauccuacagggucuucuugacugcugcucccagauucugcugggcccagcuaggggagcaggaauaggagcagagcagaguggaggagaaguagcauagccacagccagggcccagugcaggggguuucugguggccccaggagcugccugguugaagugaaguuucccauccagcugaaggcagcugccugagguugaggcuugacagcacuccugguagcaggguggggccacagccccaugacacugggaggucccugcuucacaggccuggcugcagccugcaauguaaccugagcuggagcauuucagcugcaagaagaggugggaccauucaucuuccccuugccccucuuccccacucaaaggcagaaaguguuaagugggucauggguugagcucaaccuccuuggaccccuagcuuccugcccacaagaucagugaguuccuagugaacauacaggguggucagaaaaaaaggggcacaucguggagguauggaaaauuccaguugcugccuuugguguuggcaucaugcagagcugagggggucaagcuugcuagaccccacggcugcucccagcaggucuagcuccagccagauucuacugcugagcuacccacuccagguagaaggagaaagccaugcagcucugagggaggagagcucccuaauucuuggagcaucgcagggcucaccucacagaaguccaagcccucagggcacauggccacagcuuucggcccuuugaaacagucaccaccuuggcaggagaaaguagcacagauuuucuucuggaagagaaagcaggaggagguuugggagcucugugcagacugaacaggugguaaaugcuggacagaggcaaggcuggagcccuaucaugccugugucacuggccccauccaccacacgcuguccauuccugccuccacuuccuagaggaggcaggugagaaugagacacauuucccuggagggcuggcaaggugguggucaccagggguggaauggaauguagcuuguccucugggaucgucgggugggcuaggccuaggagcagagcaggacugccuggggaagugcugugacaccucuguaaagcccugacccccugccuugcccccagggagagcaugaugugugugggcagcucacaaccugacaucucccccaccacggccuagaugagcacaggugcuugccccaggccucuuuguagcuuguuggggaggggagugcuggaugggcuggacuggggaaugguggggauguuaggaguggggaaucugagaggggguggggcaccaaagguagaaagcucagacuuggggagcuaaugaggaaggcagaguuuuuuuuuuuguuuuuuuuuuuuguggugagguggagucucucucugucgcccaggcuggagugcaguggugagaucuuggcucagugcaagcuccgccucccagguucaugccauucuccugccucagccuacagaguagcugggacuacaagcgcccagcaccaccaugcccggcuaauuuuuuguauuuuuaguagagaugggguuucaccauguuagccaggauggucucgaucuccugaccucaugauccaccugccuuggccugucucgaucuccugaccucaugauccacccgccuuggccucccaaagugcugggauuacaggcaugagccaccaugccuggccuaggaagacauuaaagguaagggucagggccgggcgccgugacucaugccuguuaucccagcacuuugggaggccgaggcggguggaucacgaggucaggagaucgagaccauccuggcuaacauggugaaaccccgucucuacuaaaaaaauacaaaaaauaagccaggcauggcggcgggcgccuguagucccagcuacucgggaggcugaggcaggagaauugggugagcccgggaggcggagcuugcagugagccgagaucgcgccacugcauaagccugggugacagagcaagacucugucucaaaaaaacaaaagaaaaaaagguaggggucagucagaaaaggccuagagguuagcauauucauagagguugggggggcuggugaaaauugagcugagauuugagggccucucaaagggcuggguucaaaguugaggguuagugugcagaagggcucugagcuuguggaugaguaggaaugggagucagaggugggggcucugaggaauggggcugggagcugcagguuggcggggcagggcugaguauuaaggguggggcugucucaccccaggcugacucauugagcacgaaacagaguggcccuccauugcagcacugcagccugcaggggucugggcugggggcugagcuauuggacagcagacaagggcuaggaccgguuucauuucccccuucacagcugaagcugcaccaggccauguagugggaagcguugaguugaaucagcuggguagagagaaugcaggcauguccaggaggaugggggcacagccaggccugggccauagcuccacguucccagcaucccagauacugacuccucucccucccgcuucaggaucuguuccugcaccuuacuguaccugaaugucaaucccccuuccaauggccucccuccacucuccuucaccucugagaaguacccuggcuugggucccucacagccccagccccacaccucgcaguggugcugcccgggcuaacacucuguggucugguuggagaacuuuuccuccugguagcacaucucuccgaggcaguggaaguuguggcauaucugcggaaagguuugaccacuguggucacacgccuggggcugaaggcauuaggaaggcuguccccucccucauaugcugcuuaccuggacaggagcaggggucaacugacugcuugccagguucugggcuaccaguaaggccagcaggaggacugauaggaggaaaaggagagagggagccacugcagaggcugaggcaggugaaucaugaggucaggaguucaaggccauaaccagcucaaaggucauaggucaaagaaaggucaugcagcaguuaaguggaagaggucaugaacuuagggaaaaguaggggcagucccaggguccagcaguagucaugguccaggaaaggccaggaucccugggcugaggacagcuaccucugagcaaagcagcucuguggcuaccauuggccacauacaucuucaacugaggugcugcaggagccagagagagggaaggaccaguucuggccagcugaggaaaccuacaagcaaaauuuccauuacuguacuaugcagaugaauaaauugaggcuggggaacuagggugggggugggucaaccuuuagggaauaagaggucucaggggcucagcuuucgcuuccugcaagucauacugucagagugacacuggggcaggcacaaaggggccugcaucccaguaacagccccccgagacacauuuugucacuggcauggcaacagcagcaucccagccugaggggaggcagaacuggagcaggugcagugacaggaaauacauacccagugacucugaucuggucucauuugcugccaacgucagaaggugcccgggugugggaaggugggagucaugggcuuccucagaacccagggcaggaaaacccuaggccacagagggucaaaaguccagacucacuuuguccaaguguucuucaggauucagaccccagccugucccuaaaugagugcugagccaaagauaggagguagcucucagacuuuggguuccuggaucccagacucugcccccugcaacacuaaggggccacaccuagaaaggucugcuaagccuggguuuagguuuuuccauacaagguaggaaacugcuagagaugagaguggggcauuauuccuaucuucucgcccagcccuggaagcugagcacaacccagacccuaccauucccaaugcuaauggggcaucuguuucccugcccucauggauguaauccuccaucagcacucagacuugucucucaagugacagcagccagggugaugcgauacacaggagagugugcagcaaggacuccuggguugggcccuucugauggugucagccucucuguugcccauccgucccccccaccaacaaacacuacacucaagaaacaguucucuugcugggcaugguggcucacaccuauaaucccagugacucaggaggcuggggcaggagaacugcuucaggccagaauuucaagaccagccugggcaagauagugagauucccuucucuacaaaaaauuagcugggcauggaggugugcaucuguaguccuagcuacuugggaggcugagguggggaggucacuugagccugagaguugggaggcugcagugagcuaugaucaugccacugcacucuagccuggguaacagugagaccuuguuaaaaaaaaaguuuuuggggccgggcacgguggcucacaccuguaaucucagcacuuugagaggccaaggcagguggaucaugaggucaggaguucaaggccagccuggcccauaugguggaaccccgucucuaccaaaaacaugaaaaaauuagccagguguggcagcgcacaccuguagucccaacuacucgggaggcugaggcaggagaauugcuugaacccgggaggcagaggcugcccugagccgagauugcaccacugcacuccagccugggcgacagagcgagacuccgucuuacaaaaaaaaaaaaaaagugacagagcgagacagagucucacucugucgcccaggcuggagugcaguggugcgaucucggcucacuguagccucugccucccggguucaagcaauucuccugccucagccucccggguagcugggacuacaggugcgugcugccaugcccgacuaauuuuuguauuuuuaguagagaugggguuucaccauguuggccagaaaggucuugaucuccugaccucaugaucugccugccuuggccucccauaguguuuggaugacaggugugagccaccgugccuggccucccauaguguuuggauuacaggugugagucaccgcgcccggccaaaugaaguuuuuacacagucagccccucuccaaggggacuucgguuuccaaaggccaaagguucaaagggcucaaagguucuacccaggucccugaagcuuugugaagagcccaggcuucccacagaagccccuuuccuccuccuuacuuugcacaguugaggcuggagggacaucucaggaauaugauggggcagguggacagacacugagcagaaucagaaggcugggcaaagauagauggguaccuccuaggcuguauuaauccaggcuucuuguccaucuccuuuagucugugugccccuccauggcuagagcauauucucaauauucucugugccccacccuaucccagcuauagaccuaccugcacacuugaaggugcagagggcugugagugugcaugcacaaggcagggaggcuacagcugccgccccuggaaacuggaagcugcccuuucuccuccccuccaaucacuugucaccucugggauuugccucucauguugcugccaccagggacacacagggaccacagaaaagaagaaagcauagcugcugcccagacuguaguuggagggagaaaauaaagccacuugagcagaucaaaagaccgcugucccagcaucccacugggaggugccuuauuugucuggaucggaaaccuggcagguggagagggcucucagaagagaucagagggagaggagaccaguguccucccagggu

SEQ ID NO: 14110 - RNA, 1236 nt, Homo sapiens
cuuccgguccaggagacucggccccgccucugcgccgggcagcuuaaagggaccacgacccccaggaggauugaaggagaccgguggggacggggcggggcgcagccuugcgaagcccuaacgcagcgcuggggaggggggcggccgaaaggggggcgguggucgggccgcgcaagcggagauggaauggggcccgggcucagacuggucacgggggugagagggggcccgucggggcgggaggaaggggcuuggccccgcgcaagcgccggcccugaccgucugucucucgcucucucccgggcagggaggcugccggcguggaccgcgggaaggcggggcuggggcucggcgggaggccacccccacagccgccccgggaggagcgcgcccagcagcugcuggacgcgguggagcagcggcagcggcagcuccuggacaccaucgcagccugcgaggagauguuacggcagcugggccgccggcgcccggagccggcugguggcgggguuagugcccacccugggcugggcuggggugggguggggucugcccacuggcuaggcuggccaagcccuagcuuacccuggaggggggaaguaugucuccgccgcuuuaucccuaaccuccuuugaucuggugagagguuucgaaaaaguuaauacuauccaaaugccaaauggccacauccuuguggggccuaauccaaggccuugccucccagccucacuuuuuuccuuucuguuccaacuagaacgucucagccaaaccuggagcgcccccccagccggcugucuccgccagaggcggcuuuccaaaggaugcuggcgauggagcugcggagcccugaccauccccgagcagaauacccugacuucucucccuccccagggccgguggcuggacucugaacaacucccuucaguaaaggggccagucuucacuggcaguggcugguacuuggcucucagccuggaguggcagcucugcuagcagcuggguucacucccacuucauccuggcugaaagcagugcugugcuuugaaaugcagccaaugaauacccagucugauuacccagauuugggcagaccagcagugcucgccagaguggucuggccugcuaugggggauccaggugguguuacauguccauuucauguuuugggggcuuuuagccccacaaaacaccuucaguagagccuugauuaaaaggaaaccugcagacucuccuggu

SEQ ID NO: 14111 - RNA, 5243 nt, Homo sapiens
auguuuaauagcagcauuucuuuaaagaaaaacaaaguucaaaugcccaauaauaauuauguuuaacacuugguacacauauaaauagacaaaaggcugcggagaacacuggauuuaaauaaagguguuauggguauaauuaacuauaauuuauuuuaugaauaaauaagaaaaaagucccuggcuauaaaggauaguggagguuuauuucccaauauucuuccauuuggacugaaccccugccaacuaagcagacaucccacuauuacaccaaaaagacugcucucccugcgagcaauuacaauacaugacaccacuaggcccaauggcucagagggaagaguggccuguggcucuucaaucuuuauccaaaccugguucuagcuucaggagccuuuggucaccugagacuuuuuauuuauuaauuuuuaugagacggaguauugcuauguugcccaggcugauucugaacuccugggcucaagcaguucucccgccugggccucccagaauguugggauuacaggcaugagccaccacacgcagccaccugagacuuuuuaaacagcaccagcacuucuggcugguuugaaccuuaaaugccaccacccaccagagaggaggcucucacuagauucuaaaucuguuauuuaauuacuuuucaauugaaaaacaaaacagacagaagaaacuuauuagaauaaggccaccuaggaauguucuuaacuuuuccauucagcuuuuggcugauauaugaaaauacaaauaaauacauccuuuccccaggugcaaggcuaaaccagcagcuccaagggcuuggucuacagugcucagaaagacacacugccuuaaaagucaggcuagugcccuagcuccgguggccucugcaaaugaggccuugacagucgucaguggacagacacauaguauccagcaccaggucuugggccuuccugcuucccagaguuucacagguaggacgcaugugaggggagcaguccguacuucuguuggaggauggcuguaguacuuuccagggcacugaggaggaaacaggacaguuaccagucugacuucucagaagucccgagcccaccagaggcuggugagcagggacaucgaaacuggcuagccuuguuaagcccuguucaucaacccuugaugaaaccuuuugaauccuaagaaagccaggaaacuuagucccacugcaacuaccacuucuccaaaccuggcccacacuccuucagggcaacauaggaggcaccaucuuuaucuugucaaagcuuuuuugcaucucuccaaccucccucaaauuauuuccccacaccacaggaaagagacuuaccagccuggacgaaugaugccaaacuuuccgggcacagacaaaucaaccacaguugagccaaggcgacacucggggcucuggccauccccaauuugucccccaucaauaaccaaggacaacugaggccagagauccuggaacuccugagaagagggagaaggaagagcauggacacuaucccugguguauccaauaaugucaaacugcacgcagucaucaaaggccauauagucuuaaaacagaaggcacuuuccucuaagcagagaaaggagcuucauuuaguuaaggucaacugugccaaagacacuguauucuaugagguuuggaggccuccuggguuagcacuccaaguaacaccuaucuaggguuuaaagaaaaucuugcuaugucaaaaggaaauuucacacauugcuucaguuagggaaauauaaguacaaugaauggaguucugggcagagauacgggcuauaacucuagacuuuccaucguaucuccgugugacugcaugcaaguuacucuauccaggccuacaagacaagugggcuggacuagaugauccuauguccucauuucauuuguucuaaucuauguagccaagacaggacuaggaugaucuuuucuuugaccuggcuugccgcaaagauaagagaacagggucaagagucaaaaacuagguaaaaagaccaggcaugguggcucacgccuguaaucucagcacuuugggaggcuggaucucuugaggccaggaguuugagacuagccuggucaacauagugaaaccccaucucuacuaaaaauacaaaaauuagccgggcaugguggcacacgccuguaaucccagcuacucacucgggaggcugaggcaggagaacuguuugaacccgggagauggagguugcagugagcugagauggugccacugcacuccagccugggcaagagagugagacugucucaaacaaaacaaaacaaaaaaaaacuagguaaaaaucuggucacuuaauggcugcguaaccuggaacaagugauuccagcuccuucuagcucuagaacuaugcuccuggaucucacugcgacucugaucaggguaggaagaguagaacaugguagauucugcaugccaccagcacucagucuuugggcuaugagaaggauacucccccuagagcaguggacugaauuguuaacugagcuagagcuuccccaaccccccaaggaagacacugcaguggcaguuaggccuggaaaucugggacaggaaaucauaaauaccaguuacuguguuggacaggucaaaugauugcugacaagguaaaaaccuccccucccugugccacaucccgauucuugcuccugggguacagccaccaggaccaagucaaaccugcacucugagaaugggaagggaugcugaacucucacuuucuaagaacccugagccccacucuaggucugggaauggaaaacccaucgaauggaguucugagcagggauacgggcucuaacucuggacuuuccaucguaucucuaugugacugcacgcaaguuacucuauccaggcuuauuagcuggauguaauaagcccaaggaaggcccaaggccugaugcuggauacuaugugugauacuaugugucuggccgagucuggggacacaauguagcuuauuacuacguuuuacaucuuaguaauaagaaaaaaaacgaaauuucuauguguccuccuuuguucuaaucuauguagccaagaaaggauuaggaugauccuuucuuugaucuggcuuguggcagagauaagagaacaggggcgagaaucaaaaacugguuaaaaaucugagucagucacuuaauggcugugugaccuggaacaagugauuuaacuuucuggaggcuaaacuucaucuuuuuuuuuuuuuuuaagagacagagucucgcucuagagcccugccuggaguacaguggcacaaucugagcucacuguaaccucugccucccagguucaagugauucuccugccucagccucccaaguagcugggauuacaggcaugcgccaccaugucuggcuaaucuuuguauuuuuuauuagagauggaguuuugccauguuagccaggcuggucucaaacuccugaccucacaugauccaccugcuugggccucccaaagugcuggggucacaggcaugagccacugcccuuggccuucuucaucuuucuuuacagcacugucgugaagauuuauagccuaacuguguucuccagaaacuguuaucuccagaaaaacaggaagacauuguucuuauaaucuuuccuauuauuauaaagacugaagaaaagaccaauucucccccuggcuuuucagacuuugagauaaaaucuuucaaauuuuuuuaauuuauauugccccccaccaccucccugccagcugggcaaccuucccacuguuggcccaagaacucucaugccuggccaucccaguguacuaucaaugccacugauucacagaaaacaguaugugcgcuggugacauuuccaggggaaggacuggguaaacucaccucgacauucagagaacuggccugggagcugagguuggcacuagugagagcaagcggacccucaaacaucugagccaagucuugcauaaaagcaugaucaggaauccgaaugccuacaagcuguaaggcaaggggaaagggaucaugagaaagguuggaagggauaagaggguaagucuuaucuggauccuagugaaagccaaguggccuggagucuggggacacaagagaaaacuugacucacaggcguaaaaggguuuagguccuuguugagcuccuccgagcguuccaucaccagggucacugguccuggcaguaggucuuucaggagccccucagguacucucacacggcaguaucugggaaacacagaagaauaaauccauucaaaauugaagggccacuggugguccuuuccuagacucuaggcagacguagaaaaggaauccuucgaguuuacaaugggagccgccugucucccugcuucaccucccuaagagcuugagcagaaagcagggcuccagaggcgcaccccuggcuugacgcccaugugccucuggucucagggacuacaacagcugcaccgcugugauaucaugauagugggaucaagcuccacguuuuauuuucuucaaggcauucgcuauuaaauuaagcuacuguguuuguuugcuuuuuucccgggggccuccccaauuagcacaaauacgccaagggaacagggucccugccuuucucguguguugcugcuucccagcagcauguaguucagggcccggggcacguuaaguccucgguacauauuuccaguuccggauuccuuggugagccuggacaagccccucccgcucucugcgccucagucucccaagccugucaccggaaaccccucccgcggugccgccccuagcggggccgggucggggcggccuuaccuguagacgucggccacgcggccgaggcauacggccagaggcuuggccucgcugcgacccuugaggcgguacacagcgcgcagagccgccgagcagcucgccgcgcaggccaggccguacagcguaucgguggggacggccaccacggcgccggcgcgcagcucggccacggcggcccgcagcgccucgguccagccggcgcgcuccgggcucgcggccugcacggccccgcuccccgggagccgcaacagccgggcgccgggggccgccggagcgggacucggcgggcggaagaggcgaccgcuccgggagccagcaggccccucgcucaaccccacgcuggcagccaccgcggcccucaucccccugcaccgacgcgccggagacauccgcccaggcccgcuuccg

SEQ ID NO: 14112 - RNA, 10020 nt, Homo sapiens
agugcccuggaaaguacuacagccauccuccaacagaaguacggacugcuccccucacaugcguccuaccugugaaacucugggaagcaggaaggcccaagaccuggugcuggauacuaugugucuguccacugacgacugucaaggccucauuugcagaggccaccggagcuagggcacuagccugacuuuuaaggcagugugucuuucugagcacuguagaccaagcccuuggagcugcugguuuagccuugcaccuggggaaaggauguauuuauuuguauuuucauauaucagccaaaagcugaauggaaaaguuaagaacauuccuagguggccuuauucuaauaaguuucuucugucuguuuuguuuuucaauugaaaaguaauuaaauaacagauuuagaaucuagugagagccuccucucuggugggugguggcauuuaagguucaaaccagccagaagugcuggugcuguuuaaaaagucucagguggcugcgugugguggcucaugccuguaaucccaacauucugggaggcccaggcgggagaacugcuugagcccaggaguucagaaucagccugggcaacauagcaauacuccgucucauaaaaauuaauaaauaaaaagucucaggugaccaaaggcuccugaagcuagaaccagguuuggauaaagauugaagagccacaggccacucuucccucugagccauugggccuaguggugucauguauuguaauugcucgcagggagagcagucuuuuugguguaauagugggaugucugcuuaguuggcagggguucaguccaaauggaagaauauugggaaauaaaccuccacuauccuuuauagccagggacuuuuuucuuauuuauucauaaaauaaauuauaguuaauuauacccauaacaccuuuauuuaaauccaguguucuccgcagccuuuugucuauuuauauguguaccaaguguuaaacauaauuauuauugggcauuugaacuuuguuuuucuuuaaagaaaugcugcuauuaaacauauuuguaaaugguuuguuuuucuucuuuugaauuauuuccuuaggagaguaggucaaaguguaggaaguauuuauggcucucaguauggauuagccuucaaaagaacugagucaaguuacacugcuguuagcagugugugagaauggcugccucugcccccuggccuucccauguuuaguauuuuucagauuguguguguguuaaaugaagccaguguugcuaccuucuguaaauuacuacaggucaacauccaacccuuucagcugucccugccugccuugguuuccccagcuaagccccaaagccagguggccaggccugcucaucucucugguggggcuuaauaucaguuaccuaacuggggcuggguguccuugaggugaccacuggggucuauuuccuccuuccuccccuucccucuuguacccuaguucccaaaauucugauucagucuuuuuuuuuuuuuuuugagacagaaucucuguugcccacacuggagugcaguggcacgaucuuggcucgcugcaaacuccgccucccagguucaagugauucucacacaucagccuccugaguagcugggacuacaggugugcaccaccacacccugcuaauuuuuuugguauuuuuaguagagauggaguuuugccauguuggucaggcuguucuugaacuccuggccugaagugauccacccgccuuggcuucccaaagugcugggauuacaggcaugagccaaggcacucagcccauuuuuuacuuuuuuaaagacacgucucucuguguugcccaggcuggucucgaacuccugaacucauccuuccaccucagccucccagagugcugggauuacaggcaugagcgaccacgccuagcuuccaauucagucuugagcccauaaacuucucaguacagugguuuccaaugcaccuguuuccaaguauauccuaagaaucuuguguuaacaggggccugcuuuaaucaggguuccugcaauuagcguauuaguuuauugguaaauaagcacugguuuguuaauucccucuagaaaucuuguuuaguaauguuuuuuguguuuucuuuuuguuuguuuguuuguuguuuuuguuuugagacagucuugcucuugcccaggcuggaguccaguggugccacauuggcucacugcaaccuccgccucccagguucaagcgguucuccugccucagccucagaaguagcugggauuacaggcacccacgcccagcuaauuuuuguauuuuuaguagggaugggguuucaccauguuggccaggcuggucucgaacuccugaccucaggugauccaccuuccuuggccucccaaagugcugggauuacaggugugagccaccacgcccagccuuguuuaguaacuuuuuuuuuuuugagacggagucucgcucugucgcccaggcuggagugcaguggcgugaucucggcucacugcaagcuccgccucccggguucacgccauucuccugccucagccucccaaguagcugggacuacaggcgcccaccacuacgccuggcuaauuuuuuuguauuuuuaguagagacgugguuucacccuguuagccaggauggucucgaucuccugaccucgugauccgcccaucucggccucccaaagugcugggauuacaggagugagccaccacgcccagccauuguuuaguaauuucuuaagcaaaccuacuuguugugguaaagccauagccagcccagcuccuguaucaguuugucacagaaucuaaggucagaaucugugaggucuuaaagagagcaaaaggaaugcuuacuugagaauaccaguucauauuuaauuacuacuaaucacaguagcacugaacauggcucuagugagugggccucagucaguucaggcagcuaaagggagggggauuuccuccuaguccucucccuagagcuaaauaugcaucugggaaaaauuaggcucuggagcacagagguauuuuucuagaggaaaaagaacugaacucccagcacuagguaaaacugcaaaaagaaaaacaccugugcccaggcacuagcuacaaggccacaccagaaaaggaaagcuggguccuggaagcuucaggacaggaacucuuccuuggucaaguuuuccccagcaccuagcacauaggaaggugcuugaugagugaguguuaaaugaaccugugagugcucaggaugauuuccugauaauuggguucaggaaucuacugggaggagcuuaaaccuagaaguucccuuuuugaaagucucaaauaugguucccuaacuuagagaagacagaugaugugggaaggaggccugaggagaggaugcaggcuggcagaagggagcagggugcaugcgagcccagacccugacacccuuccaaggguggugacuggguggccacuacacagcaccagccugcugcagaguucaaaacuagaagggguuacaugaaaguguucccaggauguggagcugcccugggcuaaguucagucaccugccagccucugccguucccaucaccacagagcaccucagcaccacucgccugaggaacgggcucuguguugcacaggcccaugccugacggcccacccagaaacacccaucugcugaccucugaccugggaacgagugaguggcuacaaccucagcugaaccccacauggugacaucuuccagcaaggcaaggacaucagcaccucacgcccauuuacaggccccucacaugagccacugcuccuucucuuugaugaagugcuccgcccagcggcgugucagcuccagguacaggcugggcuggugaggcagguaguccaaauacaggcgggugggugucuucuugggaauggccuucucaaucugggugcccucgugccacucauugaaggagguaauggaaacgaucucgggccucacugucagggccgccugcagggccgucucauaguacuugccauugacccuguugcgcguauugugguuguuccagggccgaaugcuggugucuauguagccaggccccacacuggggaugaacaugagguuguuggcaucacaaaaguucuucacagcuuuccaguucugaugggaagaaccaaaggagaaaccauuggaggcaaaguagguguacaugccgucaaauccggcggccaggauaucguggguguggcccuccuccaccagcagcgcuaugaagaccccaucguagggcguguugcggaucgaauggggcccguuuggugucaggaggugggcccaggccucaggggacgucagguaugagucguagauauaaaagagugggaggcucuugcccaugcuguucuuauagcgguaaaaugcaccaugggagccauaccugagaaggagaaagaagagccucagcuggaugggagagaccagcacagcuguaggaccucccguggaugagauacggaugcaacacagcccaguucuggagccagucagucuccacaguuggagucaucaugccucuaagcaagaaccugguucccuccuuccucucuccaguugucauuccuaagccucacuucccuacccuuagccaagccaccaccgucuuccaucuggauugcaacaacagccagcuaacuggucuccaggcucccauccugccuccauauaauccauucauuauucccaccuacuugaucuggcccugccuacuccauuccugcucuuuucccagcuauuacuccccaucuggccuuucuauccggcucucaugugucaugcaagcuuguuccaucuuaugggacuugcaucugccagcccucugcuuggaauuuucucccugccuccggaucuuugcagagcugacccuuuuucuuuucuuuuuucuucuuauuauuacuacuuuuuucugagauagggucuugcucuguugcucagagcuggagugcggugggcgaucucagcucacugcaaccucuaccuccugggguucaagugauucaccugccucagccucucaaguagcuggaauuacaggcacccgcuaccauaccugccuaauuuuuguauuuuuaguagagaugggguuucaccauguuggccaggcuggucuugaacuccugaccucagucaauccacccaccucagccucucaaagugcugggauuacaggugugagccacugggccugggcuuuuuuuucuuuuuucuuuuuuuuauucuuaagucucacuguaucgcccaggcuggaguacaguggugccaucguaacucacugcaaccucaaacuccugggcucaagugauccacucaccucagccccccaaauagcugggacaauaggcaugcaucaccaugcccagcuaauguuuaaaaaaaaauuuguagagauagagucuccccauguugcccaagcuggucucaaacuccuggccucaagugauccucccaccucagccucccaaagugcugggauuacaggugugagccaccacacccagcccugacugcucauucagguguuagcucaccuguugucuccucagacucaccugaccugacuauccauucuuaaguagcaucgugggcacacucuagcacaaaauccuguacagaucacuguuugauuuuucccauuuaauuacugucugcuccacaguaccugcaacauacacuagaaaguaaacauuaugaaaucagaaauuucgcuaguccuacccauuacuguacaacugggcuuaagucagugccuggacacauguaggcacucaauacucucuuuuuuuuuguuuguuuuuuuaagagacagaaucuugcucuguucucagcuggaaugcagugguguaauuguggcuaacuguaaccucaaacuccugggcucaagugauccucccaccucugccuuccaaguagcuaggacuacuacaggcaugcacugcuaugcccagcuaauuuuuuuuuucaguagagauggggucuugcuauguugcccaggcugaucucaaacuccuggccucaagcaaucaauccucccaccucugccucccaaagcccugggaggccgggugcagugguucacaccuguaaucccaacacuuugggaggucgaagugggcagagcaucugaagucaggaguucaagaccagccuggccaacauggugaaaucccaggcuggaguacaguggugccaucauaguucacuguaaccucaaacuucugagcucaagugauccacucaccuuagccccccaaguagcugggaccauagcugugcaucaccacgcccagcuaaagauacaaaaauacaaaaguuagcugggugugguggugggcaccuguaaucccagcuacucaggaggcugaggcaggagaaucgcuugaacccaggaggcagagguugcagugagccaagauugugccacugcacaccagccugggcaacagagugagacucugucucaaaaaaagaaaaaaaaaaaaaaaagcacuggcauuacaggcaugagccauugcacgcagccucauucaauauuuauuuauuuauuuuugagauggaaucucgcucugucacccaggcuggagugcagcggugcaaucucggcucacugcaaccuccgccucccagauucaagcgauuuuccugccucagccuccugaauagcugggauuacaggugugcgccaccacgccuggcuaauuuuuuuauuuuuaguagagacgggguuucaccacguuagucaggcuggucucgaacuccugaccucaagugauccgccugccucgaccucccaaagugcugggauuacaccaugccuggccuucauucaauacuuucugaaugaauaaaugaggugccuacauuguagaagcuacuuucacauauauuaauucgugugauucucacaagacucaaagguuaagaggcuugccucaucacagauuagaagccacaggacaggaauugaaacccaggcugccugacuuuaggcccaguacucucuuacuauaaaacagcugcugggaaacacaggcauuaugcccugugucucuugaccugccccuccaaaccuucuaucccuaccuccauuuugauccccaccaaaaucccggcccccagagcagccuuacgugucaaugauguacuugauguugucauguacagugaugucaucccggcccuuguaggguuggauguggaaggccaccugccacaaacagaggaguaauggucaggugagugucuaucuaggggccacaacauaucaggcucaggaucuaaccauggccuggaggagaggcugaguucagaagagggccuggcaguggugggcacaguagagauaaaggcagcugcugcccuugaaggccaaaacaggggugagcaguuugcccaucucccgcagcagggcaugugggaaucauuuuggugggcuguuacaggguggcuaauagguuucaaccuugugccagcuccaagugguuggugcuagcugccugaaacaguggaauaaguaugcugaagcugugucaguggaaaacugcugugaucuguuagacaugucagugguggaauucucuucaggaauaggggaguggggcuuuucuucuuucucuaucauuuuucuuccuucaccacagaagcaagggaugacuuacuugauuggcacauguggggaaaugcuucguccaguccguccuuccucuugaaagugagcccaccugcugagaacaccugccuacuccucgagguccagcacugccucccacuagagaguugagucugcaggucccuuuggcucuugccuacccuuuuuccaccaggguuuacaaccuaaccucuauuauuauuuaacaaaagugauaauuauuuagucuucucuugguccuauauuuaguuuucucaguuuucuuagaauucaaaaaacuaagagcaacauaggcaccauuuaucugaacccucccccaaaaccacacuugccacauauuuguuaucccuuugggcuacugccaagaacuucuguagaggcacuaacccugugggcggaggagagcaacucuccagaauagggcagagagcacguggccucuucuuggagacucaccuggaugcuguacugaugggcgguguccagaauggcgggcaccaggucaucugagggcuccccguuaucaucagccaugccagguggguaccaggacaggaccaggacgccugagacgcaacacagaggccacuucagagacacacaguaccccccucaacagagauuuuuuuccucacaaacaucuccaauugcaaaaaugguuccuaaaaaccugaagcaagccuccugccagguucacuuccugcagaugagucccagagccucgcgccccggagcuguccacgcccgcggugcugaagcggagcgccugcgggaaccguagcgcgccaggccggaagggagccaggcuuuagacugccucagcaaguaguagaacaaagggaaugggaggacagugccacacccaccuggaagccacaggccuaccucugaagaagagaagcaccccuaacccuaacgucccgcauggagaagagcccugagcagaggccaucuguaaaauccagcaaaauucagugacgaaauccgaaauaagugagccuccccuccauagccuacgaaggaggcgcccugggaccuucccuccagcugggugcuugaugaaaagccucuaaacccccaacacuaccuccaacugcaaauagagcagaggccuucauggaacacgggcacacuuuccucucugcagccagcaaaagcaggaacggcugcugcucuacccuguaccugccaugaaagcagaggccgcccuaaguuccacuccucugaaccccagaaccugcgggccaggacuccaggccucacuucccaucgcccaacaaauuugaagacucugccucccucuccuggugcaaacuccuagcaguuccgcccuaugggaagggcccuggauguuagggauggaagggcccagcuggggggucugaauacuagacggaggggcggugucgcauggugggcccaggaugagagugggagggaacagcuaagaagccaggcuggcggauaagugggaccaaagggccggugacaggaccagagggagcuggggugugggaaggaggaagggugaggcuggggggcagggccgcccgggguggggggcgcucaccgauggcggcuuccuugagcugggucauaugcucccgcagcacuucggggucccgggagcuguagggccccagcuccggguagaagcuggagcccaagucgucuggggggcuguggcggccgcggggguagcuggccgagaucuuggggucccagugcggcaccaugacguggucccagugaauguaguggcccucgcgccgcgggcucccguaccacgaguaguagaaggcgugcagguccgaguagacgcgcaggcucugcacgggggcgggcucggccuccgcgggugccggcccaggggagccgccaggguccgcggugcggggcggcggcggcggcgggggcggcgcggcaggggcugccggggcccuggcagcgggcgcgggggcccccucugggcgucgcucaaagggcgccagcuccaggcccgggcccagcgccgggaguccguccggagccuugagcgugcgcagacccaugagggugccgaaggcgaagagcagcaccaggaacagagcgaugcaggcgcggcgccgccgccgggccauggccgacugugcgcuccugcagccgccgcgcuaccucccagcgugccgcgccauggccgcccgcccggccgcgcgcuucccaggcagacugugcgcccggcagagcgcggcgugggcggcgcccggccuguccccgcagugcgggcgggcucggcacacaggacgcaggcggcgcggaccaaguggccgcgagccgaggggga

SEQ ID NO: 14113 - RNA, 10020 nt, Homo sapiens
ucccccucggcucgcggccacuugguccgcgccgccugcguccugugugccgagcccgcccgcacugcggggacaggccgggcgccgcccacgccgcgcucugccgggcgcacagucugccugggaagcgcgcggccgggcgggcggccauggcgcggcacgcugggagguagcgcggcggcugcaggagcgcacagucggccauggcccggcggcggcgccgcgccugcaucgcucuguuccuggugcugcucuucgccuucggcacccucaugggucugcgcacgcucaaggcuccggacggacucccggcgcugggcccgggccuggagcuggcgcccuuugagcgacgcccagagggggcccccgcgcccgcugccagggccccggcagccccugccgcgccgcccccgccgccgccgccgccccgcaccgcggacccuggcggcuccccugggccggcacccgcggaggccgagcccgcccccgugcagagccugcgcgucuacucggaccugcacgccuucuacuacucgugguacgggagcccgcggcgcgagggccacuacauucacugggaccacgucauggugccgcacugggaccccaagaucucggccagcuacccccgcggccgccacagccccccagacgacuugggcuccagcuucuacccggagcuggggcccuacagcucccgggaccccgaagugcugcgggagcauaugacccagcucaaggaagccgccaucggugagcgccccccaccccgggcggcccugccccccagccucacccuuccuccuucccacaccccagcucccucugguccugucaccggcccuuuggucccacuuauccgccagccuggcuucuuagcuguucccucccacucucauccugggcccaccaugcgacaccgccccuccgucuaguauucagaccccccagcugggcccuuccaucccuaacauccagggcccuucccauagggcggaacugcuaggaguuugcaccaggagagggaggcagagucuucaaauuuguugggcgaugggaagugaggccuggaguccuggcccgcagguucugggguucagaggaguggaacuuagggcggccucugcuuucauggcagguacaggguagagcagcagccguuccugcuuuugcuggcugcagagaggaaagugugcccguguuccaugaaggccucugcucuauuugcaguuggagguaguguuggggguuuagaggcuuuucaucaagcacccagcuggagggaaggucccagggcgccuccuucguaggcuauggaggggaggcucacuuauuucggauuucgucacugaauuuugcuggauuuuacagauggccucugcucagggcucuucuccaugcgggacguuaggguuaggggugcuucucuucuucagagguaggccuguggcuuccagguggguguggcacuguccucccauucccuuuguucuacuacuugcugaggcagucuaaagccuggcucccuuccggccuggcgcgcuacgguucccgcaggcgcuccgcuucagcaccgcgggcguggacagcuccggggcgcgaggcucugggacucaucugcaggaagugaaccuggcaggaggcuugcuucagguuuuuaggaaccauuuuugcaauuggagauguuugugaggaaaaaaaucucuguugagggggguacugugugucucugaaguggccucuguguugcgucucaggcguccugguccuguccugguacccaccuggcauggcugaugauaacggggagcccucagaugaccuggugcccgccauucuggacaccgcccaucaguacagcauccaggugagucuccaagaagaggccacgugcucucugcccuauucuggagaguugcucuccuccgcccacaggguuagugccucuacagaaguucuuggcaguagcccaaagggauaacaaauauguggcaagugugguuuugggggaggguucagauaaauggugccuauguugcucuuaguuuuuugaauucuaagaaaacugagaaaacuaaauauaggaccaagagaagacuaaauaauuaucacuuuuguuaaauaauaauagagguuagguuguaaacccugguggaaaaaggguaggcaagagccaaagggaccugcagacucaacucucuagugggaggcagugcuggaccucgaggaguaggcagguguucucagcaggugggcucacuuucaagaggaaggacggacuggacgaagcauuuccccacaugugccaaucaaguaagucaucccuugcuucuguggugaaggaagaaaaaugauagagaaagaagaaaagccccacuccccuauuccugaagagaauuccaccacugacaugucuaacagaucacagcaguuuuccacugacacagcuucagcauacuuauuccacuguuucaggcagcuagcaccaaccacuuggagcuggcacaagguugaaaccuauuagccacccuguaacagcccaccaaaaugauucccacaugcccugcugcgggagaugggcaaacugcucaccccuguuuuggccuucaagggcagcagcugccuuuaucucuacugugcccaccacugccaggcccucuucugaacucagccucuccuccaggccaugguuagauccugagccugauauguuguggccccuagauagacacucaccugaccauuacuccucuguuuguggcagguggccuuccacauccaacccuacaagggccgggaugacaucacuguacaugacaacaucaaguacaucauugacacguaaggcugcucugggggccgggauuuugguggggaucaaaauggagguagggauagaagguuuggaggggcaggucaagagacacagggcauaaugccuguguuucccagcagcuguuuuauaguaagagaguacugggccuaaagucaggcagccuggguuucaauuccuguccuguggcuucuaaucugugaugaggcaagccucuuaaccuuugagucuugugagaaucacacgaauuaauauaugugaaaguagcuucuacaauguaggcaccucauuuauucauucagaaaguauugaaugaaggccaggcaugguguaaucccagcacuuugggaggucgaggcaggcggaucacuugaggucaggaguucgagaccagccugacuaacguggugaaaccccgucucuacuaaaaauaaaaaaauuagccaggcgugguggcgcacaccuguaaucccagcuauucaggaggcugaggcaggaaaaucgcuugaaucugggaggcggagguugcagugagccgagauugcaccgcugcacuccagccugggugacagagcgagauuccaucucaaaaauaaauaaauaaauauugaaugaggcugcgugcaauggcucaugccuguaaugccagugcuuuuuuuuuuuuuuuucuuuuuuugagacagagucucacucuguugcccaggcuggugugcaguggcacaaucuuggcucacugcaaccucugccuccuggguucaagcgauucuccugccucagccuccugaguagcugggauuacaggugcccaccaccacacccagcuaacuuuuguauuuuuguaucuuuagcugggcguggugaugcacagcuauggucccagcuacuuggggggcuaaggugaguggaucacuugagcucagaaguuugagguuacagugaacuaugauggcaccacuguacuccagccugggauuucaccauguuggccaggcuggucuugaacuccugacuucagaugcucugcccacuucgaccucccaaaguguugggauuacaggugugaaccacugcacccggccucccagggcuuugggaggcagaggugggaggauugauugcuugaggccaggaguuugagaucagccugggcaacauagcaagaccccaucucuacugaaaaaaaaaauuagcugggcauagcagugcaugccuguaguaguccuagcuacuuggaaggcagaggugggaggaucacuugagcccaggaguuugagguuacaguuagccacaauuacaccacugcauuccagcugagaacagagcaagauucugucucuuaaaaaaacaaacaaaaaaaaagagaguauugagugccuacauguguccaggcacugacuuaagcccaguuguacaguaauggguaggacuagcgaaauuucugauuucauaauguuuacuuucuaguguauguugcagguacuguggagcagacaguaauuaaaugggaaaaaucaaacagugaucuguacaggauuuugugcuagagugugcccacgaugcuacuuaagaauggauagucaggucaggugagucugaggagacaacaggugagcuaacaccugaaugagcagucagggcugggugugguggcucacaccuguaaucccagcacuuugggaggcugaggugggaggaucacuugaggccaggaguuugagaccagcuugggcaacauggggagacucuaucucuacaaauuuuuuuuuaaacauuagcugggcauggugaugcaugccuauugucccagcuauuuggggggcugaggugaguggaucacuugagcccaggaguuugagguugcagugaguuacgauggcaccacuguacuccagccugggcgauacagugagacuuaagaauaaaaaaaagaaaaaagaaaaaaaagcccaggcccaguggcucacaccuguaaucccagcacuuugagaggcugagguggguggauugacugaggucaggaguucaagaccagccuggccaacauggugaaaccccaucucuacuaaaaauacaaaaauuaggcagguaugguagcgggugccuguaauuccagcuacuugagaggcugaggcaggugaaucacuugaaccccaggagguagagguugcagugagcugagaucgcccaccgcacuccagcucugagcaacagagcaagacccuaucucagaaaaaaguaguaauaauaagaagaaaaaagaaaagaaaaagggucagcucugcaaagauccggaggcagggagaaaauuccaagcagagggcuggcagaugcaagucccauaagauggaacaagcuugcaugacacaugagagccggauagaaaggccagauggggaguaauagcugggaaaagagcaggaauggaguaggcagggccagaucaaguaggugggaauaaugaauggauuauauggaggcaggaugggagccuggagaccaguuagcuggcuguuguugcaauccagauggaagacggugguggcuuggcuaaggguagggaagugaggcuuaggaaugacaacuggagagaggaaggagggaaccagguucuugcuuagaggcaugaugacuccaacuguggagacugacuggcuccagaacugggcuguguugcauccguaucucauccacgggagguccuacagcugugcuggucucucccauccagcugaggcucuucuuucuccuucucagguauggcucccauggugcauuuuaccgcuauaagaacagcaugggcaagagccucccacucuuuuauaucuacgacucauaccugacguccccugaggccugggcccaccuccugacaccaaacgggccccauucgauccgcaacacgcccuacgauggggucuucauagcgcugcugguggaggagggccacacccacgauauccuggccgccggauuugacggcauguacaccuacuuugccuccaaugguuucuccuuugguucuucccaucagaacuggaaagcugugaagaacuuuugugaugccaacaaccucauguucauccccaguguggggccuggcuacauagacaccagcauucggcccuggaacaaccacaauacgcgcaacagggucaauggcaaguacuaugagacggcccugcaggcggcccugacagugaggcccgagaucguuuccauuaccuccuucaaugaguggcacgagggcacccagauugagaaggccauucccaagaagacacccacccgccuguauuuggacuaccugccucaccagcccagccuguaccuggagcugacacgccgcugggcggagcacuucaucaaagagaaggagcaguggcucaugugaggggccuguaaaugggcgugaggugcugauguccuugccuugcuggaagaugucaccaugugggguucagcugagguuguagccacucacucguucccaggucagaggucagcagauggguguuucugggugggccgucaggcaugggccugugcaacacagagcccguuccucaggcgaguggugcugaggugcucuguggugaugggaacggcagaggcuggcaggugacugaacuuagcccagggcagcuccacauccugggaacacuuucauguaaccccuucuaguuuugaacucugcagcaggcuggugcuguguaguggccacccagucaccacccuuggaagggugucagggucugggcucgcaugcacccugcucccuucugccagccugcauccucuccucaggccuccuucccacaucaucugucuucucuaaguuagggaaccauauuugagacuuucaaaaagggaacuucuagguuuaagcuccucccaguagauuccugaacccaauuaucaggaaaucauccugagcacucacagguucauuuaacacucacucaucaagcaccuuccuaugugcuaggugcuggggaaaacuugaccaaggaagaguuccuguccugaagcuuccaggacccagcuuuccuuuucugguguggccuuguagcuagugccugggcacagguguuuuucuuuuugcaguuuuaccuagugcugggaguucaguucuuuuuccucuagaaaaauaccucugugcuccagagccuaauuuuucccagaugcauauuuagcucuagggagaggacuaggaggaaaucccccucccuuuagcugccugaacugacugaggcccacucacuagagccauguucagugcuacugugauuaguaguaauuaaauaugaacugguauucucaaguaagcauuccuuuugcucucuuuaagaccucacagauucugaccuuagauucugugacaaacugauacaggagcugggcuggcuauggcuuuaccacaacaaguagguuugcuuaagaaauuacuaaacaauggcugggcgugguggcucacuccuguaaucccagcacuuugggaggccgagaugggcggaucacgaggucaggagaucgagaccauccuggcuaacagggugaaaccacgucucuacuaaaaauacaaaaaaauuagccaggcguaguggugggcgccuguagucccagcuacuugggaggcugaggcaggagaauggcgugaacccgggaggcggagcuugcagugagccgagaucacgccacugcacuccagccugggcgacagagcgagacuccgucucaaaaaaaaaaaaguuacuaaacaaggcugggcgugguggcucacaccuguaaucccagcacuuugggaggccaaggaagguggaucaccugaggucaggaguucgagaccagccuggccaacauggugaaaccccaucccuacuaaaaauacaaaaauuagcugggcgugggugccuguaaucccagcuacuucugaggcugaggcaggagaaccgcuugaaccugggaggcggagguugcagugagccaauguggcaccacuggacuccagccugggcaagagcaagacugucucaaaacaaaaacaacaaacaaacaaacaaaaagaaaacacaaaaaacauuacuaaacaagauuucuagagggaauuaacaaaccagugcuuauuuaccaauaaacuaauacgcuaauugcaggaacccugauuaaagcaggccccuguuaacacaagauucuuaggauauacuuggaaacaggugcauuggaaaccacuguacugagaaguuuaugggcucaagacugaauuggaagcuaggcguggucgcucaugccuguaaucccagcacucugggaggcugagguggaaggaugaguucaggaguucgagaccagccugggcaacacagagagacgugucuuuaaaaaaguaaaaaaugggcugagugccuuggcucaugccuguaaucccagcacuuugggaagccaaggcggguggaucacuucaggccaggaguucaagaacagccugaccaacauggcaaaacuccaucucuacuaaaaauaccaaaaaaauuagcagggugugguggugcacaccuguagucccagcuacucaggaggcugaugugugagaaucacuugaaccugggaggcggaguuugcagcgagccaagaucgugccacugcacuccagugugggcaacagagauucugucucaaaaaaaaaaaaaaaagacugaaucagaauuuugggaacuaggguacaagagggaaggggaggaaggaggaaauagaccccaguggucaccucaaggacacccagccccaguuagguaacugauauuaagccccaccagagagaugagcaggccuggccaccuggcuuuggggcuuagcuggggaaaccaaggcaggcagggacagcugaaaggguuggauguugaccuguaguaauuuacagaagguagcaacacuggcuucauuuaacacacacacaaucugaaaaauacuaaacaugggaaggccagggggcagaggcagccauucucacacacugcuaacagcaguguaacuugacucaguucuuuugaaggcuaauccauacugagagccauaaauacuuccuacacuuugaccuacucuccuaaggaaauaauucaaaagaagaaaaacaaaccauuuacaaauauguuuaauagcagcauuucuuuaaagaaaaacaaaguucaaaugcccaauaauaauuauguuuaacacuugguacacauauaaauagacaaaaggcugcggagaacacuggauuuaaauaaagguguuauggguauaauuaacuauaauuuauuuuaugaauaaauaagaaaaaagucccuggcuauaaaggauaguggagguuuauuucccaauauucuuccauuuggacugaaccccugccaacuaagcagacaucccacuauuacaccaaaaagacugcucucccugcgagcaauuacaauacaugacaccacuaggcccaauggcucagagggaagaguggccuguggcucuucaaucuuuauccaaaccugguucuagcuucaggagccuuuggucaccugagacuuuuuauuuauuaauuuuuaugagacggaguauugcuauguugcccaggcugauucugaacuccugggcucaagcaguucucccgccugggccucccagaauguugggauuacaggcaugagccaccacacgcagccaccugagacuuuuuaaacagcaccagcacuucuggcugguuugaaccuuaaaugccaccacccaccagagaggaggcucucacuagauucuaaaucuguuauuuaauuacuuuucaauugaaaaacaaaacagacagaagaaacuuauuagaauaaggccaccuaggaauguucuuaacuuuuccauucagcuuuuggcugauauaugaaaauacaaauaaauacauccuuuccccaggugcaaggcuaaaccagcagcuccaagggcuuggucuacagugcucagaaagacacacugccuuaaaagucaggcuagugcccuagcuccgguggccucugcaaaugaggccuugacagucgucaguggacagacacauaguauccagcaccaggucuugggccuuccugcuucccagaguuucacagguaggacgcaugugaggggagcaguccguacuucuguuggaggauggcuguaguacuuuccagggcacu

SEQ ID NO: 14114 - RNA, 40824 nt, Homo sapiens
cagcgcaaggaacaaaggaacuggcuuuccugggccaguccuggaaggcucgcuuggcaaaugugugacgaugagggugucacaaucccagggaccauggaaaguauucuccuaaggauuuggaacuggagcaggacacugagaugggaagaggcuguggcgguugggugggugaggcagugagcuguggcccugcugacccaagccugccccauggggaugucaggauggccauucaggcaguugaacuccacugucucaucuuggaggacuugaagagggaggacucggugcugaggccaagugacuagcaggcucaugaugacagaacucaacauuuuaaucugaucaucguucccaucagauuuaucucugagggcuuuacauauggauaaugguucccgauuugagccagugucucguugcuacacuccuugcugccuggggcaugaggaaaccacacccuaaaggguauuggacugcccuuggcgcaccuugggccucaggagccaauggcgcggcaagcccaaugugagcacugcccuggguugggccugaagcuggagccaccucuuugugggccccagaguagaaacucagccugcccagcuaccuccagggcugggcucagcguggaggagugcagcagcgccucccuacuuuggacagaaaagucugauaaaaagcugccuguuccagguugagauacacauaacccgucuggcucagacuucggauaugccccaggggcuugcagacucuggcaacaauugccuugaauauauacuuggccuuucucccaagggcaggaccauugcugauagacugugcuugauuucucucaugcccgcacauucauucucacaagguauuuuacuguacgagguauuugccuaccacacauaguuacaauucuuuucccaccaccaaaccaacaaaacguccacagacauugcaccucaauuuuucacaaacacauuuucaucgcauucccaugguuuacccuucuguuucccucuuuuuuucucccacuuuuuucaaaccuguuucacccuucugauccuccugaucucucuccaugcuggcugacuggcuucucugcucucccagacggccuguagcaccccaucggucacucuccuuucucuuccuuuuuuuugcuuuccuuuggcuguguagccacagguucuucacagccauggcuugcccaguccauauuuuuccuguauauuugaccaauugcauuugucuuuugguaucacaagcuagauguuuguugauugaaugaaugaaguggucccucuuggauggguauguucuuauauuagcccuggagaugauaauuauugauggugcuuacucauuuuuccuucuaggaggcaaaaugaggccagcaucaaaguucaguggagcaccaggccaaaagcaaugcaaucucgaucuuucugucauuuggccacaacuguugaugacgacccagauuuccaggcccaucuccugccacccccauccccugccccaucuacucuucuacucagaauuacucacugugcccaauacaaauacacauucaaguucccaugccuucgucuaugcuguucccuccaccuaaaauguguuucucccugcuuucaucuguagaccuucuacucauauuucauaccuagauggaauuacccuuccucugugaaggaggccccuccccaguagcugcuccuccuguauguuucuauggacuauuucaccuuuaugacauccaugucugugucccauagccuaagguuagcuccugagagcagagacugugggauguauuauugcauuccuguucuuucccaagucucuugaggcuguggguacaguuggaaauacucucauagugcuuacacuaugcgcauacacauaaugcuuacaguacuacacaucgacacagugcuuacacuauucuaagccuuuuacuugcauugcuucauuuaacccucaacacagcccugugagguggauaccauuauuaggccgauuuuacagaugaggaaacugagacacaaagagguaaaaggaugugaccaaggacacacagcuaauaaauaaaugaggucagaauuggaccgcagguagucuggcucagcuaccacuuagcuauuugaaaaccugcauuuuccaugugcuuuuccauaccuuaguaccaugauaugcagccuggugagugucucauuuauuggcaggaggggauucugaggguuggaucauaugugcuuacaaauaacgcuauagggccugcaaggacauccauccaccccugccuugccucuugagccccucaucagcaugcauugcucacaaagcuacucaagaccaccugccagugugugcccccaugccccacugcaggggcugccuccaacacaguugaagcugcccacccuggguguagccccuagagaccacggugcaccagaaccaugccgggcaaguggaccaucuccucuacuuucuguugugcuuugcuucaaggucaccaaaguugcuuucacaaagacugcggacaaaggagcccuuuggauuucugccugaagcucccuucuccuuuggccucaggaaaaaaaaaaaaaaaguccuggagcucaguuaggggacugacaggucagugcugcuccccugagacuugcuuuugcccucuagcaccggcucucucuccgugaauuuuaaaccucugcagagagcccccugcuggucuaugaaagcaucagcuacaucaggugaggaguggacccucguuugaauccccagggcagaaaaaaugaaauauaccucuauagugggaugggcaauguucacucucagagagcaauggcaaauaaauagucauugaauggucaauucccugucucuucaaugaucagaacacauaccagugcccuagcacaggggguuguaggcaaguguuuucuguaaagggccagguaguaaauauuuuaggcuucacaggccauauguggucugucguggcuacucaucucugccuuuguagugcaaaaucagccauagaccauauguaaacaaauaguguggcugugaaccaauaaaacuuuauuuaugaacccagaaguuugaauuucauauaauuuucacauguuacaaaauacuauucuuauuuugaauuuggucggucauuuaauaacauaaagaccauucuuagcuuuugggccacauaaaaacagcaacuggugggauuuggccugugggcuguaauuugccuaccccugcacucagagauaagcuacuugguuugguucaugccuuuucuugacguaggagaguggggaggacacagcaaaaccugaguccccagguccugggcacagugacugggcaucuuggggauuucccuagcucuagcuagaagcaaaacugacaacuuuaaagucucucagauagacuuuuaaagcaucuagaaggggcuaggugcagugguucaugccuguaaucccagcacuuugggaagcugagguagguggaucauuugaggucaggaguuugagaccagcuuggccaacauggugaaacccugucacuacggaaaauacaaaaaucagcugggcauggugacaggcaccuguaaucccagcuacucaggaggcugaggcaggagaauugcuugaaccugggaggcagagguugcagugagccaagaucgcauuacugugcuccagccuggaugacagagugagacuccgucucaaaacaaacaaacaaacaaaugacaacaacaaaaaaccaucuggcagggcgugguggcucaugccuguaaucccagcacuuugggaggccgaggugggcagaucacgaggucaggagaucgagaccauccuggcuaacauggugaaaccccgucucuacuaaaaauacaaaaaauuagccaggcguaguggcgggcgccuguagucccagcuacucgggaggcugaggcaggagaauggcgugaacccgggaggccgagguugcagugagccgagauugugccacugcacugcagccugggugacagagccagacucugucucaaaacaaaacaaaacaaaacaaaacaaaaacaucuagaagauuccuccaaacuggguuaaaaagugaguaggaaggauugcuuuucccaaagaugagggagugauagacuuaucuuuuucuaacuggggcucuaaaaaaggaaacauagcuaaagguuuugacuaguucuuccucugcugcuugagaagauauucacccugacuuucuuccauaccuuugccugaaucucuauuuuagaaauaagauuuuguuccuagucuagacagaagagcaagagggauggaggaggucaaggaaaaucucagugucuugcugggcagaggaugcccuuagggcaagacugaacuucugacagacagagcuccacugaucuguugguuuuagaugggaaguuaacuuuucagauucuuuaacaugacauuauucuacuggaaacaaaccaagggaccuggauaaaguuuuuaaaaaguguuuucuuaaagaaaaaggagggagguaggcaggagagaagggaguaaagaauuacacaaagauuuggucuaacggcuucaaaaucaaaaggaucccuggacagauagauauugaguguaauaggaaacacacugauccuggggagaugacuuaauauaggcccuccagccuccucagagcuuaaacaauuaccuacaauuuggaauuauacuuuaaauucccacaucaauguguguucuggauccacuucucaggacacggccagcagucuugaguuaucuaaaccaugcugaaaauuagaggccauuaauagcaucucauaaaagugcuucucagauuuucuugagcagaauaugccgaagaccacaagggauuuggugauaggaaggagcgaaaugcuucuaguuauuuuuccaaagcuuaaucuggggaucuuuuugaagagcuccuacccagcagugagaugcaugccaagacuaauacgacuguuuuucccacuuagaaguggugaccaugaagaaaaguuucuugggguucccagaggugagucuccuagccauuuuuacagguagcaagcccacuaguuugcuauauccuuguccaagaauuucccagacacccuagacugaaaacugaggguaacuuggccuaugaagcucuaaguuaauacacuuuucuuuucuuuuccuuuuuuuuuuuuuuuuuuuuuuuuuguggcagggucucacugugucgcccaggcuggagugcacugguguaaaucuugacucacugcaaccucugccucucaagcucaagcaauucuugugccucagccucccuaguagcuggguuuacaggcgugugccaccacgcccgguuaauuuuuguauuuuuaguagagaugggguuucaccauguuggccaggccgaucuugaacuccugaccucagaugaucugccugccuuggccucccaaagugcugagauuacaggcaugagccaccacgcccggccgaacuuuacuuuucugauacuugaauuugcuuguaaaacuguugagguuguauaaccaaggacucacuuuuuuguuuucuaucagugaaacaaaacaacaaaauccugaagauguauauucugagccuuucucuguucuuccagagucccagaaccuagcauuuggggacuaggacuguuucacauugggcagcggccauuccaggggcccaacucuuggccucagcaggcacgggucaaugcuucaugggcuugccagaggagagacacaagaggccccaaaagagcagcuucugcuagcaguucaacugggaaguacaacucaacaagccggcacuaauuaagagcuaauggccuuacaaaugagcauugccaaaggauaacgacccuccggcugcagcauaaauaucaaggcauuuggggcagagccaagauauauauuuucagagugcauuagacacugcagcagccuuccucacccuggcucugcuaagaagaacaagaugauuuaagauagguaggaaagaagcuugaucuuccagggcugccuucuggucagcaggucagaaagccuccgagugacucuuggaaaagacuucacuuuuguauauacaagaaucacuugaggagcuugcuaaaauguagauucucuuggccccacccccaagauggucugauuuuggaagcucugggauaaaacccagaaaucugcauuuuuguuuuauuuuauuuuauuuuugagacaggaucucacucugucacccaggcuggagugcaguggcacgaucucacugcaggcuccacuucccaggcucaagagauucuccagcuucagccucccaaguaccugggacuacagguuugagccaccacgccuggcuaauuuuuguauguuuuguagaaacaaaguuuuaccaugucacccaggcugaucucgaacuccugcgcucaagcgauccaccugccucugcuucccaaagugcugggauuccaggcaugagccaccaugcccagcauuuuaaaacagaucccccaagugauucugaugcuugugguucucagaccacacuuuaaaaaauguugcuuuagaagcugcugcuauuugcccauuagaccccagugauaaacuuuuuacagaaugaagauaaaagugaggucagggcccggcacacuggcucaugccuauaaucccagcacuuugggagacugaggcaaguggaucaccugaggucaugaguucaagaccagccuggccaacauggcgaaaccccaucucuacugaaaauacaacaauuagcuggguguccuggugggugccugcaaucccagcuacucgggaggcugaggcaggagaauugcuugaacugaugaggcagagguugcagugagcugagaucgugccauugcacuccagccugggugacagagcaagacucuaucugaaaaaaaaaaaaaaaaaaaaaaaaguaaggucaggauugucugcuuccugugaagacaccaguccagaacauggcauuuccagccagucuccauccauuaaggucuucucauucacacaaaccugugguuaccaggagcaacauuugaggggaugaguagcucaccuuggauuuugagaaaaauagaaagcaucccuggccggugcaguggcucaugccuguaaucccagcacuuugggagaccgaggcgggaagaucucgaggucaggaaauugagaccagccuggccaacauggcgaaaccccgucucuacuaaaaacacaaaaauuagcugggcaugguggugcgugccuguaaucccagcuacuugggaggcugaggcaugagaauagcuugaaucuaggaggcagaguuugcagugagcugagaucaugccacugcacuccagccuggugaaagggcaagacuccaucucaaaaaaaaaaaaaaaaaaaagaagaaaaauagaaagcaucccaucugcaugauguguaccaugucugcgaugcuuucauauacuguaacucauaugaucuuauugcagucuuucagaguaguuaagcuauugcaucuguuuuaaagcugaggaacuguagaccuggagguguaucuugccucugcuaguuggcaugacaucagaaaagagagugaaaaauagucacugcauuacaaugcggcaagcagggcaggcaaaucaaaccaguaacuuaagcuugacuuaccuugaucaggcuuuuuaucugcugguagaauugaaguugguugucgagaucggcaaauauuguuguaaaaggauugaugggucagauuauaaaaauagauggaaaguuuguaagauaaaugcaagcagaguaugagaacaggagagaaacaacccaccauaucaucugggaaaaugaaacuccuuggcaagacuucacaacagccugauucaaaauuucauaaugaaauuaugucucugaucaaagccugaaugagcucauaggcugauuuuugccauccguguuuauucugguuugcaccaacuugaggcaucagaaacacauuaacugaaucuucucucugggaggaggcuaugguauccuuguuuuggggaucagagggacagugugggguggaagggggcaucuucacugaucaugaaguuuuuuccaaauagcucucagagcuucccuaacacaggucacagucagggccuucccagcagagcugcauuuaaucucaugauacuugcccuuggggcaauaaaagcgaagcuugagggacagaagguauuuccagcucuagccuaugacauggccugcuuuugcucuaaagagaauguuuugggguuuguuucaaacucagagaaauaaagacucaaucauccccugcucaauuagaauaccucacuuuauaacaaauuguuuguuuuuaugaaaugagcuacacugcaugaauccacccuuccucuugccuaaccaucucuucuuuggccuauccagaggguacaaagauggccauuuucugacaauuugagguaccaaaaaagagagagggaccaggcgagguggcucacacuuguaaucccagcacuuugggaggcugaggcagguggaucaccugaggucaggaguuugagaccagccuggccaauguggugaaagcccgucucuacuaaaaauacaaaaauuagcugggcaugauaccaugcgccuguaaucucagcuacuugggaggcugaggcaggagaauugcuugaacccgggagguggagguugcagugaaccgagaccgggccacugcacuccagccugggcaacaagagcgagacuccgucucaaaaaacaaaaacaaaaacaaacaaacaaaaaauaaauuguaaaaagagagagggcuucuugguucaaacacuggcaucuagacacuuuauucuggcuaguagaaacagaaaucacugggucuuaaugccuuccuucauccucaaggcaagagacauucccaucuacucauucuuucacuuaaugaauauuuuuugaguccuuuguuucagaugcuauucaagucuuaaagacacagcagugaacaaauuaacaaggucccugcuuuuaagaaucuuacauucuaguuugggggaagcagccaauaaacuuguaaaaaaaauucaacuagugauaaaugccaugaaauaaauaaaacagaauacuguaacagaauaacugugaaagggugaaagguggcugauuuagacaaauuagacaggaaugaguucucacagcaggaagggucaccagauaaaauacagaacguacaguuacauuugaauuucaggcaaacgaugaauacuuuuuuagucuaaguauuuuccaggcacuguuggagguguacuaaagaaaaguauucauuuuuuuucucugaaauucuaauuuaauuugguguccuguauuucuauuugcuaauucuugcaggccuaccaauaggugauauuugagcuuaggauugaaugacagcuaugcaaagauucugggaaagagugauucaggcagagagaauauccaguguaaaugucagaauaaccagagggagggacguacacaugagauuagauaaauaggcaggcaggggccagaucacagaauccuguagggauggcaaaaaguuugaaucaaucucugucucugucuguuucucccuucucccuuccccuaccucucauucuaagagugaugauaagccacuggaguuguaaggaagagaaugacaccuccuaacggauauuuggcugcuguguggucggcaacuuuuggaaggacuuagaagacaaauucagaagacaaacuuaagcuugugccacuggccugggaagaagcuucuuuauucggagguggacccaacugggagcucuggccgcgcguucagguuaacuaggcgguugcuaugaacgggcagcuuggcgguugcuagggcuggagcgggcuggggcuccacgcagggcgacgccuaggcggcuggagcgggggcggagccaggagggugacggcgcgcgccgcgcguucacaggaagucgcucugaggccgagagggacgcgagcggaagugacguacgucgugcacacgugguccggcgugguucaggcgggugucuucggccgggcuugggaacauaaaaguuuguuucaccacguaagccggaccucgcacuccggucccggucucgucgccaagauggugaagcccaaguacaaaggacggagcaccaucaacccguccaaggccagcacaaacccagguacaggcggcagggcugaucgaggguggagcuuggaggaaguauagggaagggcuccgaggagcacuggaggggaaggaggguuacucgaguggcauugcuuagaaugacuacgagcgggguggcuguuggggaugaaaagggaaaaaggaaagcaauauuuguggugguuucuucucaggggggaacugaggagggcucagugcacgccuggcaggccaaaguguagucaacuggucugaagucaaggaaagugaacacucaggcugacagccuuggguccucuccaguugagagaugcagagaaagucagauuaaaaaugguguagguugacccuucgggccuuuuacacgugaucauacuugccugccaccuuagcuuugaccuuuaaaaugagaaagggcuuauaguuuuggcccuuggaauuauucuaucugguaaagugcuuagagaacccuacaaagaagucaguaugaucauugcaguaaggcuguuuaggagauguguguaaguuuuggcgagguuccaccuguacgauuaacaagacauccuaugggagaguuccuuccauucagguuuaauuaauaaaacuuuguuuuaaaauaugguuuagaauuuuugacaauuuuaaugcaaguugaauguuuauuccggauugauaauaaauuauucacuuugcacaaacuggaaucucagaauguuagaccccaaaaggcccuuagagauuaugauuuuacaggugaagagacugaaucaaaauacaggaaguggccugucauaauugcaacaguuagugaguaguaguagagccgccaguuucuacuguuagagacuguuaggagagccaaugggcugugguuucagccugucuucuacuguaucacuucaggaccagacaggugauuuaaggggcuccuggccaggugugguggcucacgccuguaaucccagcacuuugggaggccgaggcggucggaucacccgaggucaggaguucaagaccagccugaccaacaugaugaaacccccucucuacaaaaauacaaagauuagccgggcaugauggcggaugcccguaaucccagcuacucgggaggcugagguggaagaauugcaugaaccggggagguggagguuguagugagcugagaucgcgacacugcacuccagccugggugacagagcacgacucugucucaaaaaaaagauaauaauaaugaauaaaugaauaaauagguaaauaaagggcucccaaaaugagaagcuaggcuaguauuacccuauucguuuguccuucucuuucucuuugagauguaaggcaagaauugcuguguugauuaaacaaaaaucaaacauuaagaaaguaagaacacauauaucaaaauuauagucuccauggugccuugcauggagcaggcacucaauauuuguuaaacugagacacagagguagguaucuucgugguuaagaccauagauggugaucaaaugcucauguacaaauucuggcucugccauuuaguaacgguuugaccuugggcaaggugucugaccacugugccucaguuucucacuccgcagcauggggauaauauaucuauaggauuauuguauagauuaaaucagaugaugccuauaauuuggauaacacagugccaucauaagugcucaaaaauauuagcuauucuucucaaauacaauccuaucgaagaucaaagauugggucagcuuugucauaccauguagcuucaaguacuaauuauuggagcaacauauggagaaaguagagauuuuugugguugguggcuucuuaccuaauuugggugaacuacuuguugcauuuuaagcaaugacuuguugguuauacugguugguuaucaaauagugcacuguguacuucugccuuuuguagaucgagugcagggagcaggaggccaaaacaugagggaccgggccaccauccggcgccugaauauguauaggcaaaaggagcgcaggugagcacugggugcugucauccuuucucuuuuccuucaugcccuugacugcuagcugagacugaugaagccuuugcuguucucacccccacuuccuccaaauaggaguuauauauucucaaauauaauuguacgugagugucguuaggauaaaguguuaacuuuugguuaaggacauggguagcuggcggugaaauagugaugguuucacaauacucaaaaguagaggucuuguuucucacagcccugaccuccacaaauggcgcauuaaaucucagaguuaaauauggccagauauaacaaaaccuacaggacuguaguuaggaaagccaccagaaaauguguuuuuuaaugccaaaauguagaucaugacauuguggcacuuggacagucaucaaaacuccgaguucugcugagguagccucuaccacagggauuugcugaguguggcauuccgcuaacuggucuuaauuuguuugguaauuagauucuccaucuccgucuguccuaaaagaugugacuaaaauacaaaugucaaagaacuuaauauguguagucaucuacuuugcaguuuguuuuagaauuuggaauuccggcguaaaucacccucuacgugaaaaauucauuuaaaccagccuuugaauaauuacccaaaaaacucaaguauguauguguuuuuuuuuuaaaguaaacaguaaccagauuuuuuagaacgucaccauuaguuguuauucaucuagcagaaaucauuacgugcucuguugcaagagguuaaauggcuuuugggcaaucuguuucaaauguagaaguacuuuguguuuacuggaauugguauuucaugaucauuuaaaaccaaaguaagaaguccuuuugauggaaaauauauucuguaaaucaaacuucgcuguugccauuuuucuguugucaaccaauaucuguucuuuccucaauuuaggaacagucgugguaaaauaauuaaaccccugcaauaucaaucaacgguggcuucuggcacaguggcaagaguagagccaaauauuaaaugguuuggugaguauuauccccuguuacuuugcucuacaaaauauaugcugaguggaaacggcuaggauguuuaaaugucuaaacagcaggaguuuuuggugagugaaaccggcaaggauuaucugagaaagggauaagaagaauuacugggaaaaguagugguggucaauuuaauaaauaacuucuuuuugaagagcgcucaccauuaguaauuguaauugaacccucuuaagcagauaagaccauccuuaaugacuagcauucacagaccuuagaaugcucaucuuaaucuuuucugcuuuccuaaagagauacuguuggagagguggccuuguagguuuugugcauauauccuucaggguaagugcauuagcccgaaguuccucugaaauacuucuuaaugggguuuuuauuugaacuugggugacaauuaaagggucucacuguugaacuguccaacagugaauagaguaucuucagucucagggugaucacagcuucuuccuuggaaaacucccugucucauuucagucugggcucuuaacuuugcccuuagccacugguaaauguaugggcacuuuagaugaucagaccccaguguuugcuugguguuugaccucuguccuugggggcagguggcagcuaucuuugagucucuuauacuuucagugggauacuuccuaagaacugcaacacagaaaggugucaaaacucugcagagaagcauuuagcauggcugcuggguacugugacucgauuagacugccuggguuugaauucuaguucugucauuuaugugccagugggcaaguuauuaagucugucuguucaucaguuuucucaucccuaacaugagaauaagaugaaaccuaucucauaagacugucaugguaaucaaaugaguaaauacaggcagggcgcaguggcucacgccuguaaucccagcacuuugggaggccaaggcuggugaaucacuugaggucaggcauucgagaccagccuggccaacacagugaaacccccaucucuacuaaauauacaaaaauuagccagguguuguggugggcaccuguaaucccagcuacuugggaggcuggggcaggagaaucccuugagcccaggaggcagagguugcagugagcugagauugugccacugcacuccagccugggugacagagugagacuccaucucaaaaaaaaaaaaaaaaaaagaguaaauauauauaaagugcuuagaauagcgccuagcaaauagugaguauaauauaagcauuacuugcuaccgucauuaccaccuugcuguuuugcauuuaugccgcagcaugcuguuuaauugaaugcuuuucagggucucccucacaagauguuuuccaggugguggugcagggcucuaucuuguucccuugcauggacucauugguuaauagucccuuugaauccucauaacccuaaaaguggcuaacuaugacucaaauuucaguguuucaagauucucugucuauacugacugaucagcugugauuggcuccagguuucucugcuagaucuagcagguaguaggacauuugacagaucucaguuccauuccacgcuauuuauuucucaguuucauuuaguuaggaaacuggacuuggaaaacuauugaaacccuuugugggucuggauuuguggaauaguucauagugugcaagugcgggagaggcaguuuuuugguuuuuuccucuuuuaaguuugaaaacagcuccaagggauggauggaucaggugcuuggguaagugaggguaauuuaaaaucuugccuuucaccgugucaguggaagauggaugcgcaaauauuaacuaaguggcaacauucuuuauuuguaaaacaggaaacacacgugugauuaagcagucaucauuacaaaaauuucaagaggaaauggauacaguuaugaaggauccauacaaaguugucaugaagcaaagcaaguuaccaaugucucuucuccaugaucgaauccggccucauguaagauguaggauaucccuggugauggaauuuccugggcaaacuccaugcagaucccucucuaacauauuugucuuuuguuuuuccuuagaaaauagugacuuuaauguagcaaugaugaacuuucuaagaccucucuuuucaccuuuucauguuuaguaugaggugcaguaguguaguggaucaaagcacagguuuuggaguugagaccugaauuuuaauccuugcucuaucccuuccugugcccuuaguuggguuucuccaugaacuuuaacuucuuugccuugaaaguauagauaggucggacacaguggcucacgccuguaaucccagcacuugggaggcucaggcaggcggaucaccugaggucaggaguuugagaccaaccugaccaacaagaagaaacccugucucuacuaaaaauacaaaauuagccaggcgugguggugcauaccuguaaucucagcuacucaggagaggcugaggcaggagaaucgcuugaaccugggaggcagagauugcagugagccaagaucgugccauugcacuccagccugggcaacaggagcgaaacuccgucuaaaaaaaacagaaaguauagauaaccgaccuccuuggguuauuggcuacagaugaagcaucuguaaagcacuuggcccauagugagcacauagcacaccaccuaauaagagcuaaauugauaacagcuauuaguaauauuauuuauuuugguaggcaaacuuguuuuaagugguaauuccaucaaacuuugggacagcguagaauuaggauugaguugguagaacuuugguguugcguacguucagcuuuugugagauccuugagauuuuuucucagcugaaggaaggggugcuggucacauugguugucaauugcuaaaauuugaagugcaguaaggauucaaucuggguugaguggaaugaguuucacacagaacaaagaaagaaucuguuguuugucugcuuauuuuuacuugcauugaauaauaaauucccagaaauguagccaguacguaagcuucaguuccaguaugaggaggggagaaaaacauugacaugcauacguggguuaaauaguucaggcugggcgcgguggcucacgccugaaucccagcacuuugggaagccaaggcggguggaucacaaggucaggagauugagaccauccuggcuaacacgugaaaucccgucucuacuaaaaauacaaaaaaaaauuagccgggcgugguggcgggcaccuguagucccagcuacucaggaggcugaggcaggagaaugauaugaacccgggaggcagagcuugcagugagccgagauugcgccacugcgugccagcccaggcgacagagcaagacuccgucucaaauaaauaaauaaaaauaaaauaguucaaagaaaacuguuuacuugcagaacaaaauaaaaaccaaggccugguuauugccucagguuuugucaguuauguuuuguuuuaugaugcacuagaagaauggcaccuauuaguagaaugacuguuuucuuucaggggaacacaugaguguaauucaugaaccacagacaaguugcucauuucccuuguucucuuugucuguucucccuaaagccaucuuuuaagcaacuauugaauccuguuuaugagaagaacagagagguucugugauggauuuauugcuucguugccuguacuuguugucagugcuucuaaaauucaguguuuaaauaucugguauguagaaugaagggucugcaguugcaccagucagcuucuuuguugaugcagaaagcugcucagaguaauugaugaguuuucugcuuuggccuugaaaaaccuuaacuauuuuauuuuaguguaauaucuauuacuuauaaaaucuaauucugagauuauuuugcacaguggaguuagaucagauacgcauauucaucuauauguguuuuagaacuacuguauuucuguagcaauacaguaagaguacuguaacuuugcauaugugcuuuauauacuguauauuacuguguuauacuuacuaauguguguuauacuuacuaauguguagguuuauagacauaaagccuuggguacuguaacuuacagguuaagagauuuugaaggauaauuuuggucacacuugauuuuacccagugacauuagacccuauuucccauguaaaaugagcugcuucuguuuggagaugcucccgaguggaacguagugacuaaaacuaaacugaguuguggguuagggcaucugagaaaaugauaauaguuuaaggaucuuuagaaguuggaagaggggaucuguuaaaguucagaaaccacaggggcugcugcaucauccucacagcuuuugguaguggugcuuacggaggagcuuguacuagggggaaaagggugauuuuuuuuuuuuuaauugucugcaggcuguuaacauuccguuaugugauagaucccaacucuuuuaucuugcuucagaaauuccuaugccuguaacuccuuuacaggcacaucaaguucuaguuaguaucagguuccuuuuaucacaucuaaacuauuauuuuggacuuuugcuagauguuuuucauccgaagacuugccaugugcauuuaauaaaaacguuaccuaaauuagggaaaauguuaucugaaacuaaaaugcaucuuacaaaacaagcaauuccuuuuagccaugaaagaaauuaacuuccaagaaaaaguuggcauuuacaguugguuuaaaaaaaacucacaaauuugaguaugauuguccuugacaaaaucuaugaauuuggcgaauuuuaugcucuuguuugaaagcuauaaaaaaugguggaaaagauuaauuuucaccacuguagccuuaauuacauuugacugaaauuuaugauaaaugaaauaaagcagaguuuuuggcaaguuuuuguacaacuauucauauuuacuuugauuauuuguauuacuuuuguauuucuccaaggaagcuuacagaacuucagaauaagggaaccaguguuugugccauuucaacaaguaauucugauuugaaaccagacugaaaccaugucuuacagauuuggguauggguugaaccuuggaaaaauaaaaucagaaagucuuuccuagguggguguugagcuuuuugcuuuuucucagugcuuuucuuaguuuuaccuguuauucuccuuucucuucagaacuugaaggugcacauucuugauacugaaaguuuugaaacuacauuuggcccuaagucacagaggaaacgaccaaacuuauuugcaagugauaugcagucucuuaucgaaaaugcugaaauguccacugagagcuaugaccagggcaaggaucgugauuugguaacugaagacacuggugugagguacauuuuuuuuuuugcuucuuuguuuuuguuuuuuuuuuuuugagauggagucuugcuuugucgcccaggcuggaaugcaguggugcgaucuuggcccacugcaaccuccgcuucccagguucaagcaauucuccugccucagccuuuugaguagcugggacuacagguggaugccuccaugccuggcuaauuuuuuguauuuuaguagagacaagguuucaccguguugcccaggcuagucuugaacucgugagcucaggcaauccacacuccuuggccucccaaaaugcuaggauuacaggugugagccacugcacccggucgagguacaguuuugaaguucaugcaaaucucaucauuugcucuucugcaacaaaacauuuucuuucaacuuauuuugccugugugaagcucagugcuuuaacucauauauggaguuaucuucuucccucagacuggagacguuggugaaauuggggcuagacugaagaugucuaagguggcuugauugacaaaggucucuccucauccccaaaauaaauaacauuuuuucauuuauaauaguaauacaccagucauagacaaauuaggaaauauaguuaaguuggaaaauacaacaaaaagaacauaacucaugaucccauugcugauauuaagcauuguuaaugccucugugaauaucggggcuuccuuaacuggaggucucugaguuaauggauggccuguaagguuucuuugacucuuugaagaaaauguggaaaauuugugagcuuacauaaaggcaguaggguuuuguguuuuuuguuuuuguuuuggggaggaggaggaggagaggaaguaucuauaauuuuaaucauauucucguagggauccauacucaaaaggagaaucagucaccggcuggcugcaguggcuuaccuguaauacuaguuuuuugggaggcugaggcaggaagaucgcuugagcacaggaguuugagaccagccugggcaacauagugagaccuugucucuacaaaaaauaaaaaauuggcugggcauagagucccagcuacucagaaggcugaggugggaggaucacuggagcccaggaauuugaggcugcaguaagcugugauuauuaggaauauauuucuaugucaguacauaaucaacaauaauauaauauuuauugucagaguaguauuuuguuuguuauggccagucucauuguuggacauuuauacuguguauaguuuuuccuuauggugaacaacacaaggaugaagcaucaaugugaccgcaucuuuuucauccuuaauuauuccccaaagauaaguucuuacggagcaaagcaugauaucaaaagguaugcaugcuuuuugauaggcagcugccacauugcucuugagaaaggguuuaauuucauuucccuugggcagugcuagaaagcucucauucucguccaucucaugucucuuaaaugaaguggagguuuugcugucuuagugaagaggcauuguccuuugacugcaucaguguuauuaccucauugcuauugucagcccaucuucaagcauugggccaccuagagauaaaaugucaagccauuugaggccaagcaaaaagaggcagugaguucauuuauuuguucuuagaauuauuugaacuuucguuggcuuuguauucugccgauuugaauuuuuccuuccgcaacagguauaguagguaaugcaguaaagacaaaacuauuuuuguuuaccuuggguaaauguccuagagacuaguaaauaaacagauucuaaaccuuaucagaaaaauacugcuguauaugggagcuauggaguauagguugugauucagguccugccaauuccauuuuguaauucucugugacauacugccuaauucagucaugcuuuuuuuuaguuuaauguuuuauugugguaaaauauauguaacaaaaaauguggccagacgcaguggcucacaccuguaaugcuagcacuuugggaggcugaggcgggcggaucaccugaggucaguaguuugagaccagccugaccaacauggugaaacccagucccuacuaaaaauacacaaauuagcuggacgcaggggcgcacaccuguaguaccagcuacuugggaggcugaggcuggggaaucgcuuaaacccgggaggcggagguugcagugagccaagaucgcaccacucauuccagccugggcgacagagcgagacuccgucucaaaaaaaaaaaaaaaaaaguacucuucuaaccauuugaugugaucucggcucacugcaaucucugccucccggguucaagcgauucuccagccucagccucccgaguggcugggauuacaggugcccgccaccacgucuggcuaauuuuuuuguauuuuuaguagagacaggguuucaccauguuggucaggcuggucucgaacuccuggccuuaugauccacugccucagccucccaaagugcugggauuacaagugugagccacugugcccagcucuucuaaccauuuucaaguguacaguuuagugauacuaaguucauuuacauuguugugcaaucauugcagcuauccaucuccagaacuuuuucaucaucccaaacugaaacccuguacccauuuaacacuaacgguccguuuccccucucccccagccccugguaacaacauucuacuuucucucucaugaauuugacugguuuaggugccuaauauaaguggaaucauacaguauuuguccuuuugugucuggcuuauuucacuuagcauaaugucuucaagguucauucguguuguagcaggugucagaauuuucuucuucuuuuuuuuuuuuuuuuaauuaauuauuuuuugagacagggucuugcucugucacccaggcuggagcaguagccugcucauggcucacugcagccucaaccuccugggcucaaggaguucucccaccccagucuccccaguagcugggauuacaggcaugcaccacuaugcccagcuaauuuuuguauuuuuuguggagaugggguuuugccauguugcccaggcuggucucgaacuccugggcucaagcagucugcccuccuuggccucccaaagugcuggaauuacaggugugagccacugagccagcuggaauuuccuucuuuuuuaaaguugaaugcuaucuuguguauauaugugccacauuguguuuauccauuuauuuguugacagacauuugggcacacuuuuuaaauucaguuuguuucugguccaucuccaacuggguuugauacuguuuuuuuugguacauugacuuuacccuaaagcauccuuuuagucuugauggugcuucaguugcucauuuggggugcuuucuuauuuagaaaugaagcucaagaagagaucuauaaaaagggacaguccaaaagaauauggggugagcucuacaagguaagacuccuaaauucucucccauugagugguuccuugggcuuucaugauuuuguagaagaaaacuaauuuugauauauugaagcucuguugcgcagaguacaggcaccacugccuguuccauccucuuccuccuacaaagaaacucggaaggcguacuaccauugaucuagguaacugcauuuuuuaaaguacuuguauaagaguaacagcuaucuuuuauuauacaaucacauauuuauuaccugucaguauuuuuuaagauuuccugccaaauuuaucaugccuaguuaaagucacaugcaacauuuuaaguuauuuaguccaccccucuccuuuuaucgaugaggacuccugucuagaaagguuuaaugcuguaccuagcucgacuagcuuguuagugaaggaggcuuuguauaucuugauuucugauccagugaucuuuaaccggcagagguuuauguccaugcacuaauaauaaccuucagaagaaaaauuuucaaguauaaucacguaauuaaauaguaacaugauaggaaacuaguaccgugaaggcaagcuaaacuuuguaguuuuuugugaaauacacaaaaccuauaauauuacaaacuuaaagauaauauuacaaacuuaaagaagucuaagaaguaaaugauuuaguucaauaauccauaguaguuaggaaauaaguugaguuucaucuaagcuaguuuuucuguuuuaaauucagcagguuucaaaagccacaggaugaaaaaccuuuugaauucugaucacugggccuugagauuagccacaacgaacucugcccagagacuguuuugaaguugucucuaaauauuauuauuuuauuuuucccagacucccuuaaaugucaucccucuuuuauuuguacuguagcaaaccauuuuugccuuucugaauuuucaggugauagauucaucagauguuguaguucaaguucuugaugcuagagauccaauggguacucguuccccucacauugaaacuuaccugaagaaggaaaaaccuuggaaacaccucauuuuuguacuuaacaaaugugaccuuguuccaaccugggcaacaguaaguacaacuacuaaaccagaauagacuauuaagacaucuguuaguaagucaguuguagggcuuuuaggcuaaaguguuguccggcugagauuguaguaaugggagugcucucauuggaaacacgaaagugugcucauugauagugggcagaggcaccaggagacggcuucugaggccacugccugcuucacauuaugcuccauuaauugcauuuaguaacaaugaagacauuuuuuggaauauuguuuuguauuuauaagacagaagaacaaagcauuaacuguuauacuuggaaaaaacauuucaaagaauuauagcuaacauuuuccuuagacaacaguauauuugaaacaguucuguaauucaagcucugauucuuccacauaauguaaauaaauguacugcaguuuaccaaaauguuuucaucucuccuucuagaaacgguggguugcuguccucucccaggauuauccaacacuugcuuuccaugcaagccuuacuaacccguuuggcaagggagcauucauucagcuucugcggcaguuuggaaagguauugagcccugaucuguuucuccuggaguuguguagcugugaguugguauaagaaucugucuugccauggcauagcagaaaguugccaacuucuuagccggacgugguugcgcaggucuguaguccuagcuacucaggacgcugaggcaggaggauugcuggagcccaggagaucaaggcuacagugagcuaugauggcaccacugcacuccagccuggguaacagagcaaaacccugccucuaaaaaaaaaagauguggccgggcgcgguggcucacaccuguaaucccagcacuuugggaggccgaggcaggcagaucacaaggucaggaguuugagaccagccuggccaauauggugaaaccccgucucuacuaaaaauacaaaaauuggccaggcaugguggcacacgccuguagucccagcuacuggggagacugaggcaggagaaucgcuugaaccugggaggcggaguuugccgugagccgagauugcgccacugcaccccagccugggcgacagagcgagacuucucaaaaaaagaagaagaagauguaaaaacuuccagagauguaaaaacucacagagcaucaggauuauaagagauucugaaguguuuucuugcucagccuuugcccccauccgugaccaguguugcuuccauuucugccacagcccuggcaccugacguuccacgcucugcugggcuuuccaggccugcugugcauccucugcccauggagcccaugcagcuucuauguccucugguuggagagggcccugccaaaauucaagcuucagaucccuggucagacgucagcuccugagggaagccguggaaccagacuacccuaucaaauucuuaaagcuucauguucuguaccugucauuuugaauuugucuauuuaguuaauucuaccuggcuucuaacaaaagacacaugucugcugucccacccuuccccacuuuacagaagcaaaugcuuccaauagccauuaguucuguuauuuuccuccauauuuuuaguacaugcuuaugauuuucuugaucugugcccaccccucacccccaguuuaagaugcuuauuaauuucuuacuauggaaaaugaggauuugcuaucuuauagccauccucucucuguauguacuucccccuguauuguuagaugccaauguuggguuacaguauuauucauucaguguugguugguuguuguuguuguuuuaacuuggaaaggagagcuuuauuucucauaaaggguugcagccugcaggguggccacucuaacaggcugggaagaguagucuuggccauucagucuuuacauugucaugacuguaaaauauuagucacagcugauccacauggugugcuaugaguauaauuccuuucugaucgaagcuuuuauuuucgcuaguguuacuuugcuguguucuauuuguaucugucacuaucauacuaccaaauucucugauacagugggaacugucagagcuuccaggcagcacagguaguucccuucgguggccagcacuccguccuccgcagggcuggccgcucuccaggcugcugcagcgucgucuuucugggauuuccuuucacugucauccagagaauucccauggcuguuuuccuguaugggaccucuuauuuauaggaccucuuuucuucuuuucugguuuacuccuuucuuuccaugggacauauuuuccaaaaguuuccugagaaggaauacuuggaaagaacauuuuuuugagauacgccuugcguucugaaaauaucuuuauuaagaucuuuauucuacccuuuaugcuguuuuuccucagaauacugagguuaccacugcacugucuucugaauucugaggaaucugaggccauucugaccccucauacuuuguguggcugugauuucuuguuuugagacagggucuugcuuugucacccaggcuggagugugguggcacaaccacagcucacuguaaccucaaacuccuaggcccaagcgauccuccugccucguuuuggccuccugaagugcugggauuacaggugugugccaccacgcccagccaaucuuuucuuauucuaaaauuuaaaauuucucuuguucuaaaauuucacaguggugugucuugaagugggccuuuuauugcucagugagcuuggcguuugaugagacuuuagucugauauugucuuacauuauuucuuugaaauuuucuuuccucccucaguugucuguauucuuguucagaaauuugcuuuuaccuccugguuuaauucuugauuuauauuugcuuucuuuuuuuuuuuuuuuuuuuuugaggcagagucucacucuugucaccaggcuggagugcaguggugugaucucggcucacugcagccuccgccucccggguuuaagcgauucuccugccucagccucccgaguagcugggacugcaggcacacgccacaacgcgcagcuaauuuuuguauuuuuaguagagacggguuuucaccauguuagccaggauggucuugaucucuugaccucgugauccgcccgccucagccucccaaaguguugggauuacaggcaugagccacugcaccuggccuauauauuuuuucuuuugguacauauaugacauuuuccucuauuuucuggguacuuuuuuuuuuuugugagacagaguuuugcucuuguugcccaggcuagagugcaauggcgcgaucucggcucacugcaaccuccuccucccagguucaagcaauucuccugccucagccucccgaguagcugggauuacaggcaugugccaccacacuuggcuaauuuuguaucuuuaguagagacggggcuucuccguguuggucaggcuggucucaaacuuccgaccucaggugauccgccccccucggccucccagagugcugggauuacagacgugagccacugcucccggccacuuuccuuguuuugaucauccagcugcccagucacaaaauuuauuuugccaauugcuuuuaauuuuuaauuucugagagcucuuguugaauucugauuugcucugccuccuuuuacaucuuauuucacagucacaguaucauuaaugacguuuugaaauuuuccugucugcauugauucuguuaccuccaaauuuuuguggguuuuuuuguguuuucugcuacagucacgcuuaaaaauuuuuucuuuuacuuuaaaaauuuuuuugagacagggucuuguucugucuuaacccaggcugaagugcaguggugcgaucauggcucacugcagccucgacccgcaaguagagucaacuuaaauguuuauucuugguucucuauuuauauuuaagaguaaggcauuaggccagguagaguggcucaugccuauaaucccaccacuuugggaggaugaggcaggcagaucgcuugagcucaggaguucuagacgagccugggcaauauggcaaaacuccaucucuacaaaagauagaaaaaaauuagcaaggcauaguggugcacacuuaugguuccagcuacccaggaggcugaggcaggaggauugcuugagcccaggagacagaggccgcagagagcugugauugugucgcuguacuucagccugguugacaagggaagacccuguuucaaaaaaaaaaagaguaaggcauuaaaaagcugauagguucuuuuuuuucuccauggaguggccuuguugacugauagacuucauuguaaggugauuaaauagggacucuaauuuaauuuaauuuuuuuuuuuuuuuugagacagagucuugcucuauugcccagguuggaguggaguggccugauuuaggcucacugcaaucuccgccuccuggguucaagcaauucuccugcuucagccucccaaguagcugggaguacaggcaagcaccaccagaccugguuaauuuuuguauuuugaguagaguugggguuucaccauguuggccaagcuggucucaaacuccugaccucaagugaucugcccaccucagccucccagaguucugggauuacaggcaugagccacugugccugacugggacccaaauuuuuuguugggaggacauccuguagauaccagugucuguaggucuuuuuucuugggcuugugaguuuccccagaagagaaucuuucaaucucuagcucuagggguauagaauccuggcugcuagaguucugggaacucagugggaauaguagacugggcaucucacuauugaauacuuagauuuucaauuaaucauucugggaauacuguuauuaucucuaaauccaggaucccuuucaagucugaagauuacagauacuuucaaacaugugacauuucaaaaaauccaaaagccacuuucauaggcccuggauuucuuugagaguagagaaguugugugcccacccugaaugagggaggggauggagaaguguggcugcuuuggcagacuaucugcugguccuuguuuucagcccuaucuuaagagggaucuaccaccaauucccagugauucccaaugaaucucugugauucauugucauuauuauugcuggaucuuuaguuuuucuaucuuuacaaccacuuagcuuuuauauuuuguaaugggccaaguuugauacuacuuuuaagcaucuaguauuuuguuuaacaucacuuuaguuuuuguugucucaucuccaucucauucucugguucaguauguuugguucuauugguuuaaaaguguuaauguccacugcugucauucuaguggaguuggugagggaacgggguuagcauguauguucaguccaccaucuuuaaucggaagccuccauucguuuguaggcccucuucuugauagcaagcucugccuuuuugagacuuucacccuguagucguaacuuucaagguugcuuuuuuucuuuuguuauuuauuuuuggcaguggaaaugcagauguauuaugcaaagaaaagggggggugaguugugggauuguccaguugaugaaccuguucauauucuuuuucccgaagauguuuuaucaauagauggcauuguucuaaaucagugacuaacaagcuguuuuucuucuuuuguuucuuuuuuuuuuuuuugagacuggagucucugucacccaggcuauagugcagugcaugaucuugguucccugcaacuucggccucccagguucaagcgauucuccugccucagccucccaaguagcugggauuacaggcuugcgccaccaugccuggcuaauuuuuguauuuuuaguagagacaggguuucaucauguuggccaggcuggucucgaaccccugaccucaggugauccgcucuccuuggccucccaaagugcugggauuacaggcgugagccacugugccgagccuucuuuuauuucuugaccuacauacuuuuaaccuuaacacauacaaggauaauuucacuugcaugacugaggaaaugacucaccucugauuuauuaauaagcauauguauccagcuuacucagauuauguaggugguguguaucuaggcuucagaucaaguuguaucaacaguuuugcacuguauucuugauauuaacaaaguaauacaaccuacuuguccaaagggauauauaugacugcauguaugugcuguguauucucucuuugaacaguugcacacugacaagaaacagaucaguguuggguucauuggcuauccaaauguuggcaagagcucugugauaaauacauugcguucuaagaaaguuugcaacguggcucccauugcaggugaaacaaagguacguugggcgcagggugaccuuacuuuugcauauuuucuuuucauagagagugauuguuuaggacuuguugauuucucucugcuucucuugaaugcagaccaccacuaggaguuuagcucaccauauaauaguuuggaacguaucagaguuguuucugcccacuuugauaagacugagaguauuuuauaugcccccguguggcuuuggccuguguuaguuaaugugauucauauuuagaucuguuuuaaauuaucacuccagccuuuuauuuugauaaacaaaacuaacccaagaauauuugaugccuggguuaagaagccucaaacuuaagguagguucugaaaguugggggucauauccuagaacacauaguggggaacagcaugguuuugcuuaaaggcaaugaggucaagcaguacuaagcucucaagaguacuucuaaaacucaggaaagguucaccggguauaauugcacaauacgagauggaaauccugucucuguguuguuuuuagacucuuagcugauggaaacuauaguuuacacuuaguggaaguaucuugugcacggcacagaugagagaguuaguagcuuaauuacuuagcgcguugcuuuucuuugacucaccccuuccuccuuuccagcuucauacaugagcaucagggguuugugaaauuagacucuuaguguuugauacaggacaucucugacuuuuuucugacuucaggucuggcaguauauuacuuugaugcgucggauauuccugauugacuguccaggugugguuuaccccucugaggacuccgagacagacauugugcuaaaaggaguugugaguauuuggcccugauaggcuguuuguguuugcgggggaguguucuauagggaacccuggauaccuuuccuuuuuacuuauuaagaaggcaguuuggggucagccugucugaccaaacuuuaggaacaugaugcugaacagcagccucucagcauaagcuguuugaggaauuaguggaaccaugggcauaucuggucaauaucaucccacaaaagaguuuguaguuuacacacaggauccaaagggaagcagggccuguuuaugcuuagcgauaauucgucuucguggguuuauggguugagucauuuuggaacccagucauuuccucacuuguuucugaauacgacugaaaaacuguaaaugguuccacuuaaccuugaccaugcuucuggcuauacauccuguacacauuccuccucuccuuucuuaaacuauuccauuauuuuuguguccugggaugggcaggcuuuuaaccauuucugcaagugaguaacaugaagcauuccaaguuuaaacuguggcagccacacaguuaguuuguggugaguggggauuaaagcugaguucugggcuccguggcuauggucagcuuucagcagugcuccuugcagcugaccaugucuagccccgucagagacaggcuccugccaaucuccacgagcuuugugauguugaagucuauuuucaaauagugcugcaaaggacacugggaacuucacugcuuccacaacaaaguuuguaagugagagauuuccuauuaacauuuagguucaaguagaaaaaauuaagaguccugaagaccacauuggugcuguacuugaacgagcaaagccagaauauaucagcaaaacauacaagauugauucuugggagaaugcugaggacuuucuugagaagcucgcuuuccggacugggaaguuacuaaaggugacccggcguuugugagaauuuagacugauacuugucacaagcauguauguauaugauaugggccuuuuuuugguaugcauguaugagcagugugaaacuugucacuuaagugaugaugaaccccugggacaacugaaauacccccaaagugguaggugguuuugguccuuugaauuuaauugggaaucucuuugugaccuuucaggguggagagcccgacuugcagacuguggguaagaugguccucaaugacuggcagaggggccggauuccuuucuuugucaagccacccaaugcagagccacuuguggccccccagguaagagcagggugggcccaccucuggggagcauggguccugaccuagauuugguguagcuugugauugucucucuucauagagcguguauucauucagcugcggugucucucauuuuauuauuuuuuuaaauauauaaaaauauuuuuggggccgggcauggguggcucacgccuguaaucccagcacuuugggaggccgagguagguggaucacaaggucaggaguucaagaccagccugaccaauauggugaaacccugucucuacuaaaaauacaaaaauuaaccuagcaugauggcacgcuccuguagucccagcuacucgggaggcugaggcaagagaauugcuugaacccaggagacaaguugcagugagccgagaucgugccacugcacucuagccugggcaauagagggagacuccaucucaaaaaaauaaaaaaaaauuuuuuugagggugaagcacuguugggagccacugcuggcccauggcgaucacuccacccucucucauucuagagugccagugccauggccuugcuagggggugcauuuggagacuaauaaguagacauaugagagaagaccaaacuuagauacuagccuuuagggccuuggaaaaagagggcucauuaaauguaagugaucuucugguaccuguaucuuuucuuaugcuuacgaaacagaaucauugcuaagauaacauuuguuuaacaaacauuuauuagcaucgacuaugugccaggcacagggaauauaggaacgaaaaacagcccuggcccucaaaaaaccugugauccagugggaaaggagagugguacuacugauagucggagaaagaagacugaaggcuggggccagaagcucuccuacuauccccauuucccucacccuggcagugggccgccacaaggcucaacguuaacguuuugccuuucugguucuaggaccuuuuucagaacccagccaagucucuugaaaugguggcuucaaauugugcaucuaugcuugcuagugucguuggguccauacagugcugguuuccucucaccugaccccauuccaaguugcaguugcagcuagguauuuucaguugaauguauucugcagcauuugaaaguuagccugaaacugauguuaauugacauucucccuucucccugcccaaaccaucaaacaaccaaacaaaaauuucucucccucuucauguguauugcaucuuucauucauuaauucacugauacauucacccagcaaucccauauugagugucuccuguuggccacagacucuucuggguacugguggugcuguggugagaaacugacaagcugcugcucuccugcacauauauuccagcaggggagugugugguuucuucugacaccaaauacauaauuuuuuuccauaucaguucugcaguucucagauaccagcugagugucccaacaauuuaauucaguugugacacuaacucccggaguuagcacagaccccacaaguuaaggacuagguccccugcuucagauggcagcuucaggcuauccacacuuacgcccggcuaacuacaaauucagggguucugggguuugauaauuugccagaaggacucccagaacccaggaaagugcuguguuuacaauuaacgguuuaugauaaaggaugaaacucagucacagccaguggaagaggugcacaggguaagguaugggggagaggcacagagcuuccaugcccucuccacacauugauguguucagcaacccagagcuuuccaaaccccaucauguagggguuuuuauggagguuucauuacauagacaugacugaugaaaucuguggcaguuggugauagacucaauuucuggucucccuucucuccucugaguggcugaaagcaccaaccauguggucaagugcuuugucuuucuggugaccagcgcaucccccauccugaagcuaucuaggggucuaccaugagucaccacauuagcauaaacucaggugugguggaaaggggcuuguaaucaauaaaaaagauacccaucgcuugggaaauuccaagggucuuaggagcucugugccaggaagugugacauuuauaucacagggagacaguaggcagauaaacauauaaugucaggaagucuugcgugcugugaggaaaacuaaaccaggcuaagggguuugggggagaugaggaguacuuugggguggucggggaaggccucugaggcaguggcacuucagcagagcccuuaauaugagacaggagccaugcuaguaucuagggagaauguuccaggcaaggggaacagcacauccagagcagcuggggcaggaguaugcucuguguguccugaugcugaaaggaggucacuguggcuggaaugucgugggccaggagagggugucauggugggaagccauuggagguuuugaguuagcagcuggauucuagggucauucuggauguccguaucacugcugucuugggacccuguguggaaacacuggcauugucuucagcccuuccuccguauguagucaguaaguguagauaaguaguucagauaauucuuaagaacuauuguaaccauaauagauuuguugcccaaugcacacagcaagucaauaugcugagacaccaccagguugcagcagagaaagaaguuuaaccguagggucaccaaaggaggagaugggaggaauccugaaaucauuuccacgaggaguuugggguuaggguuuuaaggguuuuggagugggcuggagugagggucauugguugggugaagagugcagggugaagucacggacagggagaugaagaagcuguguucucaugcagaucccguuucucuggggaucuucaaacugguugcuggaauuagggaucugaaaagacauuuuaagcaauccuuaaacaaaaaccuuaugauucuaaugucagagaucuugccuauaggaacaaugggggugcauaucaauucuuacauagucuuaugacccaaaugucagaaauccuaucuauagggacaguggggaugcaaauggucaguaccuaguguucaggaacuuuuagcaacaaggauaugggccaaagugcccccuaauuagugcuuaauuauaauuguauuucuguccagaacuuggcagauacuucuugucaacccuuuggaggcaguuucacucucauaugccuuacucugugauucuguuuuucuuuuuugguuaagagcagaaaccccuucagaaacugaaagccaaaaauugcccuuccuagaaaaauguauguauaaauuuugugugugguuuccugaauuuuauaguucuguacuuauuuagugauuugcccggccacucuugacuuuagaacaucacuuuuaaguucucugaguuuuuguugcaaggauaaaaugauauuauacaugugaaacaccaguagaaagcuuggcacauacuuaucuuugcgguuaccuaaaacaggccagucauuucaggguccccagacuuaguucucuaaugaacucucuucaaucacagaauucccccuccuuaccuuauacucuugcuucaggaugccuccuaucuuagucuguuuugugaugaugcaacagaauacuacagauuggguaauuauaaugaacagaaauuguuuuggcucauguuucuggaggcugggaaguccaguaucaaggcaccagcaucugacaagggucaucccaucguggaaagugggaggacaagagcaagcaagagagggucaaacuugcuuuuauaacaaacucacucuuuuuuuuuuuuuuuuugagacggagucuugcucuguugcccaggcuggagugcaguggcacgaucucggcucauugcaaccucugcuuccuggguucaagugauucuccugccucagccuccugaguagcugggacuacaggcauaugccaccaggcccagcuaauuuuuguauuuuuaguagagaugggguuucaccauguuggccaagcuggucuugaacuccugaccuugugaucugcccaccuuggccucccaaagugcugggauuacagacgugagccaccacauccggccaacagacucacucuuaaaaacgaacccauccccgagauccauuaguccauucauggggauggagcccucaugaucuaauuaccucuuauuaggccuuaccuaccaacacuugcugcauuggggauuaaguuucuguaucaguccauuuucauacugcuaugaagaaauacaugagacugguuaguuuauaaagaaaaagagguuuaauggacucacaguuccacauggcuggggagguuucacaaucauggcggaaggugaaggaggaacaaaggcaugucuuacauggcaucaggcaagaguguguguccagggaaacugcccuuuauaaaaccaucagcucucgugagacuuaauucaucauaggagcggcaugggaaagaccugcccccauaauucaauuaccucccacccgguccuucccacaacacauggggauuaugggagcuacaaaucaagaugagauuuggacacagccaaaccauaccaguuuccaacauaugaauuuugggggacacauuuaaaucagaggaccuccucaaaugccucucuuaguacuguucucaucuguaacauccagccuggccuucauuuuuauguaguugugugugcugauuuugcaugugcuuauaucagcagcccccuagggaaggucuagggagccuugcuuuucuaugauaaaucauugguugguuuuaaugguuuaaauagucuuaguugguucauccuguggaacuacacauguauuccuuugauccuaguacugaucucugggcuuaauguacauugguuuaaaaauacauuaaugaaaugacucaaauuuggguguuuucaauaccuucccuuaguccugagaagaggacuguuuaagagcaagauaugaguucagaaauuccauuuuucauuuucugauucuauuuauuucccccauuuccaccccuuaauagcuucuacccuccucaucuuuggaaguugucccagaagcagcccagaacaauccaggggaggaagucacagaaacugcaggugaagggucagaauccaucauuaaggaagaaacagaagagaacagucacugugaugcuaacacagagaugcagcagauucucacacgaguucggcagaacuuugguaaaaucaacguggugccucaguuuucuggggaugaccugguuccuguggaggugucagaucuugaggaagagcuugagagcuuuucugaugaagaggaggaggaacaggagcaacaaagagaugaugcggaagagucuuccucggagccugaggaggaaaaugugggaaacgacaccaaagccguuauuaaagcacuggaugagaagauugccaaauaucagaaguuucuagacaaagccaaagccaaaaaguuuucagcagucagguaauauuuucaucuucucacaaauugcagauuuucauuccuuucccaaaaauuugccaugaguaccagagccauauuuuuacaugggguuauugccauuuguuuguucgguuggguuuuuuguuuguuuguuuuuugagacggcgucucgcuauguugccuagacuggccucacucuccuggguucaagcaaugcugucaucucagccuccuaaguagcugugacuacaggugugcaccaccacacuuggcuguuauugccauuuuuaaaaagugaacuguaaauuuuguaaaauucagcugccugcaguaugagaagcuuuagaaacacccagggagguacaaacauguuggauguugacuucuuccacuggugauaacuacuuggauaggagugggguuucuuuagucugugaguuugucgcaggucuccaggucaguaugugauucgggcgagugagaggaggaauguuacuuugcuuuucuguuucagaauauccaagggacugagugaaaagauauuugcaaaaccugaagaacaaagaaaaacacuggaagaagauguagaugacagaggugaaguuaaauuauuucaaucauuuagauguaauuugcauauuuagaguuuugagaaaccuaaguucagucuccaaauuaucucagucauccacauaaauguuugucauaucuggcagauuacuuuaaauuuacauaguguuaugcaaauugaauuaucugcuuuucauucugcacauuuuuuaggauuaaauuggcaauucaggaaacuuccuagaaaggguucauuauuaaccuagaauccaaggguggguccacagacaaagagggggguguguuuccugcauuuauccauuccuccauuugaccaucagcuuucacacugagagcauggcuuagggcauccuuuuaccuggcagccuccccuuggccugcuuuacucaccacugugcucaccugcucuguccacauuggguguccuccuccugauacaucaagcuuguucccaccguuggguuuauagacaaauuuucaauagaaaauuccuguuuguguauuguuuguauccagcaccuuccaaaaagggaaagaagcggaaggcacaaagggaagaggaacaggaacauucaaauaaagcucccagggcgcuuacaucaaaagaaguaagugucauagguuuuaaguauggcccaaguagaguaacuagaacuccaguugucaagacccacugaaacaaaugguccagagcugaaucccaagaaccccaguccucguugaccuaguugaggucagauaaauagggucgggucuggcccacuagaugcagguccuugaguccaugucauacguuuuaggaguuucuaaucaacgucuccacacgaguggacuauccucuagaggagucaguuucuagucccaagggaaacgacccaaugagcagaucugcuuugggcagaucacugacuucugugaaggacagcuuuggagcugagcuguucagagcuagagugggcccucuggggaggggagugguuagcagcacucagccuugcugcaggggacuugucaggagugaugcagaacagauucuugcacuggcuaaggguuggaucacauguggauuuguaacuuggaguugcauaagucacaauggaagaguaaccuuaggucuacgggggagcccucccucauuagcacugcuuccaguagcuguggaagcagcacgggaaauagaacacagagaugagaagcagagacuccuguuuugugaaugacuuucaggguuuuguuguuuuuuuucuucaucuuuucuugccauuuuuuacagcggaggcgagcaguacgacagcaacggccgaaaaaaguuggugugcgcuacuaugaaacacacaacgugaaaaauaggaacaggaacaaaaagaagaccaaugacucagagggacagaaacacaaacgcaaaaaauucagacaaaagcaguaauguuuaaaagguuuuuauuaaauuauacaaaaacaggcaguuagaaauuguguuuucuuccugccccauugacauuucuaaggcccuaaugcauuuguucugagguuugacaguugaagcccuucaccagugcuagggaaauaaagccuccucaaccuuaaggauuucagugauaagagucugaaagucuagcacuucagguagacuuuggaugaacuaagagguuccacagucacccugucauauaacugucugacagaaauaggggaugaggucuauaaaauggaaagggugguauuucguuuuuauugguaaugaaugauuuggaauagaagcauacagaacugcaaauuucaaggacguuaguguacauggccuggccuuugaaauacaaggagaaaguugggugcagaagaaauaggagaaaacuacaauaauuucugccucauugagucugugaaguagacccacuuauggcacauacguuccugucuuagaggccuggaacuagcagaucucguggaaagaguucuuucccauggaaaugacaacacaggcaggucauuugaguggaggcuuaaaauuccucaggauacuggaucaggguaaaagcugcuccuuagauuccagaugagaauguguaugguguguucagcauagggaacacagcuuuucuggggaaaugacagugcuuccauugugagccuugaagcucacugaacccaagacggauggcagguggaagcucugcuaaggagaggcccuucuuacgccucuuucuggggaaccugagcauguuagugccuuuuagguaauguuacuugugcagccuaacugaaggaugaaguccuccagcuuaccacccuagcccacccuggcuugccccgaacuaaagauuuaugucacucauucaaucuucugggucuacaaaaccaggagaauggaagagaaauacuaaaaugcaguugucuagcagccguacuccaauuauuagucauuagaccugcaugugagauuuaguuaccucuucaguuguuaauuaacaucacuacuucggggagugcagagucagggcuugauuuucugcaggauaaggggaacagaucugugcugggggaagagcugaguugcagacaacucacaaaggccacugugacuaguauuccuuucuggcaaacauuuacuuucuccaaagccauggguuugacugccauuguuuccuaauguaggcagucugaaaccgaggaggaagggguccaguugacuggcaaguggggauaauacauuagaaaaccaaagcuccaaagugaguuagaaaugcauuagaguagggaaaagaagacauuaaguaaggaaggccagaggcccaagaagcccaaguuaagguagaagaugaauugugaacuaaaaguuugaggggcagagaagcagauucauuuggccagaaauaaguauugguauagagugaugaugagaaagcaguggcuuucuuagaauuugaguuggcaguucccaaggcuggcuaguaagccacacacggagacuaacagggccacaccaucuuccauugcccagccaggagccuggcuggcagaccuuaggugucugaugacauuggaguaauagugugacuucuaac

SEQ ID NO: 14115 - RNA, 12684 nt, Homo sapiens
uacagcggaggcgagcaguacgacagcaacggccgaaaaaaguuggugugcgcuacuaugaaacacacaacgugaaaaauaggaacaggaacaaaaagaagaccaaugacucagagggacagaaacacaaacgcaaaaaauucagacaaaagcaguaauguuuaaaagguuuuuauuaaauuauacaaaaacaggcaguuagaaauuguguuuucuuccugccccauugacauuucuaaggcccuaaugcauuuguucugagguuugacaguugaagcccuucaccagugcuagggaaauaaagccuccucaaccuuaaggauuucagugauaagagucugaaagucuagcacuucagguagacuuuggaugaacuaagagguuccacagucacccugucauauaacugucugacagaaauaggggaugaggucuauaaaauggaaagggugguauuucguuuuuauugguaaugaaugauuuggaauagaagcauacagaacugcaaauuucaaggacguuaguguacauggccuggccuuugaaauacaaggagaaaguugggugcagaagaaauaggagaaaacuacaauaauuucugccucauugagucugugaaguagacccacuuauggcacauacguuccugucuuagaggccuggaacuagcagaucucguggaaagaguucuuucccauggaaaugacaacacaggcaggucauuugaguggaggcuuaaaauuccucaggauacuggaucaggguaaaagcugcuccuuagauuccagaugagaauguguaugguguguucagcauagggaacacagcuuuucuggggaaaugacagugcuuccauugugagccuugaagcucacugaacccaagacggauggcagguggaagcucugcuaaggagaggcccuucuuacgccucuuucuggggaaccugagcauguuagugccuuuuagguaauguuacuugugcagccuaacugaaggaugaaguccuccagcuuaccacccuagcccacccuggcuugccccgaacuaaagauuuaugucacucauucaaucuucugggucuacaaaaccaggagaauggaagagaaauacuaaaaugcaguugucuagcagccguacuccaauuauuagucauuagaccugcaugugagauuuaguuaccucuucaguuguuaauuaacaucacuacuucggggagugcagagucagggcuugauuuucugcaggauaaggggaacagaucugugcugggggaagagcugaguugcagacaacucacaaaggccacugugacuaguauuccuuucuggcaaacauuuacuuucuccaaagccauggguuugacugccauuguuuccuaauguaggcagucugaaaccgaggaggaagggguccaguugacuggcaaguggggauaauacauuagaaaaccaaagcuccaaagugaguuagaaaugcauuagaguagggaaaagaagacauuaaguaaggaaggccagaggcccaagaagcccaaguuaagguagaagaugaauugugaacuaaaaguuugaggggcagagaagcagauucauuuggccagaaauaaguauugguauagagugaugaugagaaagcaguggcuuucuuagaauuugaguuggcaguucccaaggcuggcuaguaagccacacacggagacuaacagggccacaccaucuuccauugcccagccaggagccuggcuggcagaccuuaggugucugaugacauuggaguaauagugugacuucuaacaaauaccuaggugguguuuaggggagguuauggcuuguucacucaggaaacuagcuuuuuauuacaaagggcuuaugaugauuuuauuggcugccagaggaacacaguaaauaacucccaagugucuuguuggaaauuaaucauguggaaauuaucacuucuuuggugcaauaaugccuuccaguugggccugaaaaacaaaaacaagcuccauuaauacuugaaacuugcagccugauacaaauagcugagaggugaucaaaucucugggaagaagaauccacaugcugucacuccaaggguucuuuuuccccuugauccccaaauccauauuuucuagauuagcuaguuucuagcuuggcauacagucuuuaguauaugaggagaagccagagcuguccugguuucaacacaauaauggcuccggguaugauauaaagcauugaaaaggauauugaaugcauuguuguaagggcuuuucauggcucagguuucaggccagaauaugucugcuaaguuaaacauuuggcucucuggccgggcgcaguggcucauuccuguaaucccagcacuuugggaggcugaggcgggcggaucgugaggucaggagauccagaccauccuggauaacacggugaaaccccgucucuacuaaaaauacaaaaauuaguugggcgugguggcaggcgucuguagucccagcuacuccagaggcugaggcaggagaauagcaugaaccugggaggcggggcuugcagugagccaagaucgugccacugcacuccagccugggugacagagggagacuccgucucaaaaaaaaaaaaauauuggcucucugguuuaggauccugggaguucugcugggaccagagguuugggaaacagugaauuuucagccacugagacaacuuggcacacaauuagagaaaugcugccagugaauacagagcugucccucuuuguugggggguggggguggggaauggaguuuugcucuugucacccaggcuggagugugauggugugauaucgguucacugcaaccucuaccucccggguucaagugauucuccugccucagccuccugaguagcuuggauuacagaugcacaucaccacgcccagcuacuuuuuguauuuuuaguagaaauggguuucaccacguuggccaggcuggucucaaacuccugaccucaugugauccaccugccucggccucccaaagugcugggauuacaggugugagcuaccacacccagccgagagcugucccucuuuauguaaagcuuaagacacuugggaguuauuuacuauguuccucugguagccaauaaaauaauacuggacagaucuuuagguaggucuauccuggggacagcaaagcugcuuuauuugcaaugcaguuuugagccaauaaaaauagcucacuuccuguauuacaagccuguaauuccagcacuuugggaggccaaggugggcagaucaugugaggucaggaguucaugaccagccuggccaacauggugaaaccccaucucuauucaaaauacagaaauuugccgggcgugcuggcacaugccuguaaucccagcuacucaggaggcugaggcaagagaaucacuucaacccgggagguagagguugcaaugaguugagauggugccauugcacuccagccugggcaacaagagcaaaacuccgucucaaaagaaaaaaaauuuaaaaaugccaacuucuaaagaaucuuucacccuggagauuacaagauugcuuuuaaauguuagaaacaugcuaagguauuugguuugcucuuguugcuaauccaggaagaacugaggaacucaggcuuaugaaaaaggaauauggcaguuaaggaaagcagccucagaggcugcuaaggaaacagauucaucucuggcugugaaaguuucuugcuuuucuuugugcaacaagaaaaguuccaguagugguuaacagaaagccuucuuuaucgcaaauggccaguccugcugguguguagaccaaacaagccugcaaugucaagauuguaagguuucuaucugagccuagggaggagagggagauccauccaggguccuuuggccagggccaugggagaaggccacuaaaugucaguaggccaucuuuccagaacagugaugcucaaacuucugcaaacauuagaaucaccugagaccuuguuaaagcacauugcuggaccccaaccccgaauuuucugauuugguagaucuggggugggcccaauaauuugucuugcuuugccaggugaggacgauguugaucuagggccuaccuuuugagaccuuuggaccaaacagcugggaguugcagugccuguagcauggccuccugcccagcuuuguccaccagcccccucccuccuaucaccucagcuggauaaaagaccacugcuggcaucggacuucgaggaagagcaccugugccuggguuccccgaccacauuucuggggaagguuucugauuugaaaugguucuuccucucaaagggcccugcugcccuuugacuucuucccugguuaugcccugaaacagggccucagaggagacagccaugggauggcacuaccacgcaagccaccuggagcccagcccccuccagaaaggcuccaacauaccagcuuccaggggaauggaguuccacuuuuugccauauccaccucuuccuugaggaugggcaacuuuuuuccagggagaagaauccuccacuggagagccaggcugaggcgccucagagauuuggaguugagaguagagacccccucuggagcccuccccuucucccaccaccaaagucagcuuccuuuauccuuuggcagugcauguggacaaacauuuaaaagccauggaaaaggaaccgaaugccuggccuguggggcugggucgcagggcagggggcaccuccaccccacccugcgcguugauuaccuucagcugcugauuuguucgcuucaggaacugaaucuccucauugugcuucuucuccuccaccugccgccucucgcucucccgcuucucaguggcuucacauuuugccuucugcucguucacuugccucuccaggucucucuuuuccgucuccaauucugcgaucugaggagagaaugcccagucauccugggaugucgccaggugaauggaauggugugagccuggguggaagggacaugggacaugacauugccaggguauauacugccacccagugggaggucagugccuggcauggagcgucuacagcggaaacaacucugccaagaccaccaggcuggccaucauacucaaccaggggucccucacugaggugaugcaaguccaggugucgugacugucagcagagcaccuuaggaggucagaauguagugcuggaaugauaagcauguggcccugagguuuacagaagagaugggaccaagggucacgguaaaccccacucacuuuccucuccaugucugacuuccccugcucagccugcagugccuuccucaugccaaacgccacgcugcucucguacagggucugguaggcagcgauggucaugcggaucucgucccggacucgcagcagcagcagcccccucuccgcacaguugauggugaccucccggaucaacucaucuuccaaugcacacacaccaugagaucagacagggcguggggagggggcuugcaguaugucuacugcaaacacccuuccucuugggaaggacauuaggguguucucgcuuggagacaaagugcaaggccucagagaagggccucagggagggugccuucaguggcccaaagagccuugccaugcagucacuccucugaacuuggcacuugugaguagcacagucagcaagacuggguuggccagagcaaaggagacaagaggcucugguuuguuuacagcacuggguccccucccuuccugccuuagguaaaaacugguuacuacucgaaaaaaccugacuuuuucuguuuaaagauggcagcuguuuuaaagcagcugggacauccugugugcccccuuggcugcacugguuugagggaaauggcagggucuagagcuugcccaucuaucuccccauaaaugcugaccuggagggcaaaccauaauaacacacggauagggaagccugcuagacccugcagcugccugaggguuuggaggugguuugcagaucggcguccauaagagccaaugagacugggcugggagacagccauuugacaccagcacucaaggaggugcaucuuaaaucucucgugucuguggguuaacaacaaaucacaauauuuuucuggaccaagggccaaauauugauggauggauggauggauguaaauacugaacauuaaucuuucugacuaaaaaauuagcacaugcuuauuauagaaaaucuuugaaaaaacagauggaaguuaucguuuuacuccaaacaucugcuaaggggugaggaacucaaguugccaagaauauagugguuggcagcuggaggacuuguagaagaggcggggcugguguagggaaaagaaggagagaucagacuguuacugugucuacguugaaaagaaagacacaagaaacuccauuuugaccuguacccugaacaauugcuuugcccuaagaugccguuaaucuguaacuuugccccaaccuugagcucacagaaacaugugauguauggaaucaagguuuaagggaucuacggcugugcaggaugugccuuguuaacaaaauguuuacaggcagcaugcuugguaaaagucaucgccauucuccauucucgauaaaccaggggcacaaugcacugcagaaagccgcagggaucucugcccuggaaagccagguauuguccaagguuucuccccacgugauagccugaaauauggccuggugggaugggaaagaccugaccgucccucagccugacacccgugaagggucugugcugaggaggauuaguaaaagaggaaggccccuugccguugagauaagagaaaggccucugucuucugccugccccugggaacugaaugucucaguauaaaaccugauuguacguuuguucugagauaggagaaaaaacgcccuguggcgggaggcgagacauguuggcagcaaugcugcucuguuacucuuuacuccacugagaugucuggguagagagaagcauaaauccggccuacgugcacauccaggcauaguaccuucccuugaacuuauucgugacacagauuccuuugcucacguguuuucuugcugaucuucuccccacuaucacccugcucuccugccacauuccucuugcugagauagugaaaauaguaaucaauaaauacugaggaaacucagagaccagugccggugcggguccuccguaugcugagugccgguccccugggcccaccuuucuuucucuauacuuugucugugucuuauuucuuuucuuagucucuccuccugccugaggagaaauacccacagguguggaggggcuggcccccuucagcugggaaggggaagggggcaguuagcuguugcugggugggucaggcagggggagaagaggggauuccagcaugagaugggcuccagcuccaaggugcucaggcuuggaucugugcugaaggugaagggaagggagcaguaggguguguagugcccaccccucaccuggcucacucaccaaaacacugugaguagaguucccugcggacagggcagaugccuguuucccuggccugccgcugcugcagcuuuaagucuaacugcuccuggaggugcaccacguccauccuggugcuaggggugcuggacaccugcuggauccauagcugcgugucuuccacccacucccuguggcagacacagcgaggcugagcaaaacccguugacuugaaggucccuagcacaugagcagagggcccuuugagcccucugccugaguaguggugaggggcagcuuugccaccaacccaccagaauccuccaucccuuggggugugaggcuccaaagccacacccacuaugcugccuccacagggaucuugggaauggguaggugguagacaauuuccaccuuggcaacgggccucugugaaaucauuccccacuguuccagaucuuacccuccuaacaugcugaagaccgauuuaugguuguugcuugaugugaacaguaggaacuacccaccaacuuacggggugggaaacacaggacaucaugaaccuugugcgagccagaaagaggcagauguguguaucgggguggagagguucaugaaggugugugccugcguaggcccccauuucccuuuuccucauagccuuaccaacugugcugucaacuuauuacauaaaaauagaugaaaaggcauguccuuuuaucaauguggcugcagaagaaaaaagcaagaaaaggagaucauguugggcaggggugcucugcuauagcaaauucucaaggaaggccuggaagaaaugaaaggaaccaggagaauaucaaggggagaacaucuuuggcagugaaaacaccagcugucagggcccugugguaggagagugaaugaggcauuucagaaauagcaagugaggucccuguggauucagcacagugaacaagaaacagaauaacaggagauaaggucagggauacaucguaggccagaucaugccacaucuuccaggccauuguaaggauuuuugauuuuagucugagaugggaagccacaaaagaguuucuggcagagacuggcaugaucugacuuaugacuuaggggcuguauggaggauagauucuaggagcagaguggaagcaguguuuucagauaggaggccacugcagcagugcgaguggccaccagugacuaggagcaagaugguggaagcagagguggugaaaagugguuggauuugggaaagaauuugaagguggagccaaaagaaugugacgaaggauaggacacaugcugugagagugaucaaaaggaaugaaaggugguuugagucccuaguaaaaaggagaauacgggggaugagcagauuggggaaggaagaaauugugauuuaguuugaauauauugaguuugagaugucuauuagauaucuucaugaagauaaugaggaagcagaagacuauaugguccuggaguuuaguggagaagacagggcuggaaauacacauuugggagccaucagcacauaggugguaucuaaagccaugagauugggugacagcaugcaggaaaugaggguagauugagaagaggucucccaccacccugccaggauccagccauauguaaguucuaggagcucugugauacugggaggaaaccccagccaggaacagaggcagagugccuccccccacacucccaaaauccacgauguaaaagcuuaggccuucucccagccacugcuccuacuuucuuaccuuggggguaguauggcauucaagauuucuucugccugcuuuguaggaucugggacacagggaguugaggggagcuuggucuuggguggcuguggggcugaaccugaagguccaggcugcugggggcugacuuucaguagccgagccugagaugaaggcacaggugagggcaggaaauuguucaggagcucagcuccacacauccccaaccuguauauugcuccaggucuucugcacagcccuccccucuuccuagccuacuuugggucggucuucucagcagaaauuaugucacagagcugaaggaggccaugaagucuggccccaacucaaugcuugaacagguguuucuggcgcaugugcuuucacaccucuggugauggggaaaucacuaccuagucaucuguucuuggacccgcguaccauuaagaagagugagccccauccaucucccugugaccuccuuccccauccuaaaucugcccucuggggucacacccaacaucugggcuuccuauacaauccucucacccuccuucucugacuucccaauucccuuuacucccagucgcugcaauccccgucccuugagauuccugacccuccaugcgggaaugugucuuucccuaucggaguuucgaggcuccuuugucucccgagcccccgucuuuaccuuggggcuccguuucuccguguuccggcucaccagcacuggggugucguacuugagcaaagagucugcgggcggaaucauggcggaggcgagaguagcaacccagcagcugcccuguccagugugggccuuguuugccgucaccauggaaaccgcccccucacucccgcccccgcgcuucuuggccugggcggagcuucgaaguggggcggggccaacagccggcaaguuucauucugugccuccugggcagaaaccucuugugccugacuucuuaggccuucugcucaccgguucgucccuguacucuuggaggcgaggaaaacggcaguucgagucccuaugcuccgucuagcuagcgauuugaagugggcagaucaccuuugccaugcuccaauuuugucaccugaaaaacaggagucaucuccugacuucucaugaaggguuaagggacaauucccaaaggaagucaucuggaguuccuagguuuuuugaagguuuuuuuuguuguuguaguuguucccaaaauguguucauugagauuguuucccacucaucuugauucagagugcuuuuagugcugcuuccuccugaaggaacauccuucuguaagccuuacuuuuccuccuguaggcuggcagaggacaguggagcagccaacacacaaaacugccguuugugcauggcuaaagacuguggugauuuuauagcauccugggcauuucacauccaugaaguaggaauuggggcucugcaccaggcguuucuucuuguguuuccucuucuccucuucuggggagggaugaaggagauccuuugcgagaggcauguucucguggguaggucgucaccgcaagaaagggcuuguuuugauuuuuaaauugagacggagucucucucuguugcccaggcugaagugcaguggcgugaucucggcucacugcaaccuccgccucccggguucaaacgauucuccugcuucagccuucugaguagcugggacuacaggcgcgugcccccaugcccggcuaaauuuuguauuuuuaguagagacgggguuucaccacguuggccaggcuggucucgaacuccugaccucgugguccgccugccucggccucccaaagugcugggauuacaggcgugagccaccgcgcccagccugaaguauuuuucuaauuaaauggagaaaugacaaaguaggagccaaugggaaaccuccccuuugcccccugaagauucgcucaaaaaucaauucacaaaaggcagauuaauuggagaaaaggcauacaaauguauuuaaaauguauacacggggagaaucacaguaugauuacccaccccgaaaaggguucagaagcuuauauacccuccugguaaaacagguuugugagggugggagaaggaggaauucuguucagggauuacuaggcagaaugaaugaauaagggaacagagauaaauuuguaaauaguuuuuuguguuuuuuuuuuuguuuugguuugguuuuuuugaagacagggucucacucuguagcccuggcuggagugcaguggugccaucacggcucacugcagccuccaacuccugggcucaagcgauccuccugucucugcugggaccacaggcacgagccacuagccccugccaaauuuaauuuuuuuguagagacagucuugcuauguuaggcaguuuggucucaaacuccuggcuucaagcgauuuuccugccuuggccucccaaagcgccggaauuacaggcugcagccaccgugcucggcuguaaauagcuacuuuugacaguauaagggucucuggucaggugugauuacauucuuggguggagaagaaagaaacaauuauuccuuuugguagucuggaucuuaggcagauaaagaccugugcuuugggagagaugaugggcacuggaaaggaacauugaggcuucuucaguucagcuugucagugagccguauuuugggguuuugguuucugagccccaacagcauugcagaaaguucaggaaauagaagaggaaaagcuaaugauuugaaaagcuaaugauuugcccauggguuaucaucucugauugcauuuccauuucuuccucccuucuauuuccaaauguaaauguaauuauaguuugcacacaauuuuguauccugcuuuaucguuaacaagucaggguuuuuaaaguuuguaaaugguuuacuaauggccacauaacacccauuaauuuggcuaacuucccuacugcugguauuuacauuguuuccacguuuuguaauuacuaauaauguggcaacaaacagccuugagagguuugcuuuuucccaguuuuuguuguuguuuguuuuugagacaucucgcucuguugcccaggcuggagugcaguggugagaucccugcucacugcaaccugcgccuccaguucaagugauucauuugccucagccucccgaguaacugggauugcaggugcgcgccaccacacccggcuaauuuuuguauuuuuaguagagacgggguuuugccauguuggccaggcuguucucuaacuccugaccucagugauccgucagccucggccucccaaaguucugggauuacaggcgugagccaccacucccagccagaaguuuguuuuugaaacuugaaacucccgccacccaagccugucgcugcggccacacccacuagggaguagucacguguuuaaccuuugccgcgaggauuucugggagccug

SEQ ID NO: 14116 - RNA, 17873 nt, Homo sapiens
cggaaguccaggaguuaaacucgucauuuccuccagcuagaggagcucaacugaucuguuuucuuucgcccagccaaaaucacagaaugaaggcggugaagagcgaacgggagcgagggagccggcgaagacaccgggacggggacguggugcugccggcgggggugguggugaagcaggagcgucucagcccagaagucgcaccucccgcccaccgccguccggaccacuccggugguagcccgucuccgccgaccagcgagccggcccgcucgggccaccgcgggaaccgagcccgaggaguuagccgguaagugggggagcaguccaggauggacauuggguugggcucauucagaaaggcgggcagggcuagcguccgaaacagguuuugaauggugggcgcagcagcccggacuuaauccugaggggcuguugagagugauccagucgugcuuguguuaugcuugcucugucacuugcauuauagcucgguguucaacgccuaaugacuaaccggcaggaucccacuccuucauucuuguguuccuagcacuucgaagaguguggcccaacagauagcacugauaaucuguuaaauuggauugagauuuuccccaucccucccacaaauggagugugggcguugucuuuccgguuaccugccagaaagguuuucacaucgaggucuaagcgagcuaccuaacagaaacuggggaaaaaaaaaaaguuacuucuugcuagacucauuuauuuaugcauucauucaccauaguuuuacugagugccuauuaaguguuaaagacugcccuagguauuggggcugcaagggugauucaguuagaugaucuucaccgaugccaaauuggcuaugcucuaacccugagacaugauaaaaaaauaaacaaaauaguuucaguuaguaacaaguauuauugauagauuaaaacaguaaugugauagugagagauuggagagaagagggaggaggacucucuaaagaggugccauuugagcccagaccugacugauaagaaugauccaaccucuuaaagauccaggcagaggaaacaacaucugcaaagaaccugaaguagaaugaauuaugauugaaaugggaaaaagccagugucgguggauuauaguggucaagaaggugggugguaggaaugagauggcacagggaggaaguagaaccacaggauggagggauuguuauugaugguagggguguugguagugaaggauaaagagucaagggugacuuacggauggugaugccaaucagcgagauggcaaggaguaggagaggaaagguuuuugaaggguugggaauuaagaguuauguuaccuaagugagaagguucaguagacaguugucuaugugaguauggaaugcaagggagauguuagggcuaggaaagugaaccucgugacuccuuuaaugugaccggcagagaccuucacaaaugcgguguuuguguuaguagguaagccugauacuggaagcuaauuuuuaugggggaagggaaauugcgauaaaauccuguguaccaugcucugaauagguccccacccaaaaagaaaaacaaggccucagggagaagaagcaagucuccucgcaguaagagaaaccgaaguccucaccacucaacagucaaagugaagcagguaaguggauugggguguuuugauggguccaaauugagagccuuuuccuaucacagcuaaagaggaauguguguguguguugugugugugcacacaugugcacguacgcucgccuacaucucuacuuguaccuccgaugggcuuuucugaaaacuggcuguauuuauuuuuucugcuuguuugcuuaaauuaaacuuuuuauuuugagauuauuauugguucacaugcaguugucagaaauaauucagggagauauacucuuccugguuucucccagugguaacaucuauucauaacagaacugugguacaauaucaucaucagaauauugacaucgauauagucaagauaacauuuccuucaccgcaaggaauaccucguguuguccuuuuguagccaaacccacuuaucucccacuuuuauccuuccuuaacuucugucaacuucuaaucuguucuucauuucuauaauuuugucauuucaagaauguuauguaaauggaaucauacaguauguaaccuuuaggauugucuuuucucacucagcagaauccuuuggagauugauucagguugcaucucucaguaguuuguuccauuucauugcugagugguauccaaauggcauggauuuagccacuuacucauuaaagaacaucuggguuguuuccauuuuuuggcuauuacacauaaagcugcuauauagacauuuguguacagguuuuuaugugaacguuaagaguucauuucucugggauaaaugcucaggaguacaauugcuggauuguacgguaguugcagguuuaauucuuuuaagaaauugccagacuguuuuccagaguggcuguauuaguuuaccuagggccaccauaaugaaauaccauagaguagguggcuuaaacaacagaaauucauuuucuuguaguuauggggcuaaaagucaaaaauuaggguguuagcagguuuggaaucuccugaaaaaaaauccucuguccuuggauugcagauggcuaccucuuugcuauauccucaaaugaucuuucuucuguccuguugucuuuucucagccauauuggauuagggcccuacccucauuuuaacuuaaccagcucuuuaaagaccucaucuccaaaaaguuauuaauacauucugagguacuuggguuugguacuuuaacaugcuaauuuuggaggguacaauuuaguccguaauaguggcuguaucauuuuauauucccaccagcaauguaugaaugauccgguuucccuguaucuuuaucagcauuucaaguuaucacuuuauuuuagccauucugauaggcguguagugguauuucauugugauuuuaauuugcguuuuccuuuuuuuuuuuuuuuugagacagagucuggcucugucacccaggcuggagugcaguggcacgaucucggcucacugcgaccuccgccuucugaguucaaacgauucuccugccucagcuucccguaauuugcauuuuccuaauggcuuaugauauuggacaucuuuucuuugugugucagugugugugugugugugugugugugugugugucacccaggcuggagugcaauggcgugaucuuggcucacugcaaucuccccuucccagguucaagugauucuccugccucagccuccugaguagcugggauuacagaugcccaccaccacgcccagcuaauuuuuuguauuuuuaguacagaaaggguuucacuauguuggccaggcuggucucaaacuucugaccucgugaucugccugccucggccucccgaagugcugggauuacaagcgugagccacugcaccuggccuuggacgucuuuucaugugcuuauuugccaucuauauguaucuucucaggugcaaugucucaugucuuuugccuguuuauuuuuuauuuuuuauuuuuuauuuuuugagacggaguuucacucuuguugcccaggcuggaguguaauggcgcgaucucagcucauugcaaccucagccucccagguucaagggauucuccugccucagccucccaaguagcugagauuacaggcucgugccaccaugcccagcuaauuuuuguauuuuuaguagagaugggguuucgucauuuugaccaggcugguccugaacuccugaccucuggugauucaccugccucagccucccaaagugcugggauuacagcaaagugagccaccaugcccagcuaucuuuugccuguuuucuaauacuauuauuugcuuuuuuacuguuuaguguuuaagaauucuuuuuauauuguggauacuagcccuuuggggauaaaugguuuacaaauauuuuuucccagucuguagcugucuucauuuucuuaacaggguuuaucucagagcaaaaguuuuuaauuucaaugaaguccagcuuaucuguuuuuccuuuuauggauugugcuuuugaugucauggcuaagaacuuuuugccuagcccuagaucucugaaauuuucuccuaaauuuuuuuucuuaaaaguccaugaucugcuuucaguuucuuuucaggguuucaggguuuuuguuuuguuuuguuuuguuuuguuuuguuuuuguuuuuuuugccuaugaauguccacuugcaucaacaccauuuguugaaaagaccaucuuuccuccaaugaauuacuuuugcucuuuugucaaaaaucaguugggcauauuugugugggucuauuucuggaaucucuguucuguuucauuugucagugucugucacucugccaauaccacacagucuugauuacuauagcuauauaauaagucuugaaauuguauggacugauuuuucccauuguagucuucuuuauaaaaauugcuuuagcuauucagcuucuuuuuucauccauguaaguuuuagaacaaucuugccucuauuuuuaaaaagucugggccggucacagcgacucaugccuguaaucccaacacuuugggaggcugaggugggcagaucacuugagcucaggagcuccagaccagccugggcaacauggugaaacccaucuguacaaaaaauacaaaaauuaguugggcgugguggcaugccuguggucccagcuacucaggaggcugaguagcuccugagugggaggauuacuugagccuaggagguugaggcugcggugaacagugaucauaccacugcacuccagccugggcgacagagugagaucugaaagaaaagucuugcuaggauuuugauaggauuuguguuaaacuggcguuugggggcaauaauugacuuuuuacuauguuaaaucuucuaauccaugaacauuguguaucuccccuuuuauuuagaucaucuuugauaucuuuuaucagugguuguaguuuucagcuuauaaauccuauacauauuucuuuguggaaugauuauaaaggguauuuuaaaugaguguccaaauguucauuguuacuauauagaaauauaauucauuuuuguguguuuaucuucauccuauauccuugcugaacuaauguauucuaguuuuuuuuuuuuuuuaagauuacuugggauuuucuacguagacaaucauaucuacaaauagggacaguuuuauuucuuccuuuacaaucugaaugcauuuuauuuccuuuuguuguuugcauuaguccguuuucaugcuguugauaaagacauacccgagacccggcgauuuacaaaagaaagagguuuaauggacuuacaguuccacauggcuggagaggccucacaaucauggugggaagcaaggaggagcaaaucacacggauggcgucaggcaaggagagauaaaagaguaaugagagcagacacucuugccuuauucucaauuuugagggaugagaauucagucgucuuuuuuuuuuuuuuuucuuuuuuuuuugagacggagucucguucuguugcccaggcuggaguggcgcaaucucugcucacugcagccuccgccuccuggguucaagggauucuccugccucagccucccaaguaacugggauuagagucugggccgaucacaguggcucaugccuguaaucccagcacuuugggaggccgaggcggguggaucaccugaggucaggagaccagccuggccaacauggugaaacuucgucucuacuaaaaauacaaaaauuagcugggugugguggugggcgcguguaaucccagcuacuugggaggcugaggcaggagaaucacuugaaccugggaggcggggauuacagugagccaagaucgcaccacugcacuccagccugggugacagagcaagacuguuuuaaaaaaaaaagcaaauuuuaaaagacaaauaacaguauaacaacuauuuauauagcauuuacguuguauuagguauuauaaauaaccuagugaugauuuaaaguauacagaaggauauucacagauuuuuauauaaggaacuugagcauccuaagauaucuuuuuuuuuuuuuuuuuuuuuuugauauggagucucgcugcguugcccaggcuggagugcaguggugcgaucucggcuuacugcaagcuccgccucccgggguucacgccauucuccugccucagccuccugaguagcugggacuacaggcgcccgccaccaugccuggcuaauuuuuuuguauuuuuuuuuuaguagagacaggguuucacuauguuagccaggauggucuccaucuccugaccucguaauccaccugccuuggccucccaaagugcugggauuacaggcaugagucacugcaccuggcccugagauaaucuuuuuuauccacuggggauccuggaaccaaucuccugaggauaccaaaugauuacuuuauucuuuucucaaccucugaaccaccauuuuguguuuuuuuuugguuguuguuguuguuuguuuggugaaguguugcucuguugcccaggcuagagugcaguagugugaucuuggcucacugcaaucuuugccuccuggguucaagcgauucucgugccucaaccuccccaguagcuaggauuacaggcacgugccaccaugcccggcuaauuuuuguauuuuuaguagagacgggguuucaccauguuggccaggcuggucucaaacuccugaccucaagugauccaccugccucagccucccaaagugcugggauuacagauaugaaccaccguacccaacugaaccaccauuuucgaaacaaauguauugauuacaugcucauuguaauaauacagagguauguaaaauauaaaaugagaguaugguuuacuucucucguccccaaaauugcaccaccuccucaaccaaaaaaccuccaccucacuugccagagguaaucacuaugauauagacucucuguccaucaucacauggccuucucccaugaaucucucuaucucuucucuuccaaggucaccagucacgugggauuaaugaccuauauuacuucaguaugaccuuaauuuauuacaucugcagugacccucuuucuaaauaacggagagauaaacauuugagacucaccugcauauagguguauguaaaguauuaggauuagaugaaaauuacuaaggaaaugacuguagauagaagaacaaccaacaaaggacugaauccaggggcgauccagugugaagaaauugcagugacaucagcaaagaagacuggaaagaaagagaagcaagagaaucugguaacuugaagccauuagaaggaaguguguugaggauagagugauuaacucuguuagaugcugcugauaguuaagugaaaugaagacugagaauuggccacuggauuuagcaacauggaggucacuggugaucuugaccagcaauuuuaguggaguaauaagggugagaccugauuggagggguucaagggaagacagaggagaggaauugggaacugaauuuuuaaaaacaauacuuuuucuuucuuucuuucucuuuuuuuuugaaacagagucucacuccgucacccaggcuggagugcaguggugcaaucuuggcucacugcaaccuccacuucuggcguucaagugauucuucugccccagccucccaaguagcugggacuguaggcacgugccaccacauccagcuaauuuuuguauuuuuaguagagaugggauuucaccauguuggccaggcuggucuugaaucccugaccucaagugauccacccaccucagccucccaaagugcuagaauuacagacauaagccaccacacccggccguuauggcuuauuauaaugacucuuaauaagggauaaaggacaugaugagauuaguccuggugaacucaaggcagauagcaguggcaagcuuguaaauguuuuggaguaggaagggugguugucugaggcucucucuugaugcaugucugugcuaggcuaggaagucuagaaaaacugagucccacucuaagcaagcagccccucacuugagcccuguguauggcagggagcggggggggggggggucuuagucccagugcuuccacuuuuaggguauugcgaauaaugcugcaaugaacauggaugcucaaguaucuauuugagacccugcuuucauuuguuugggauauccagaaaugggauugcuggaucauauggcgauucuauuuuuaaauuuuuuauggaaccacuguacuguuuuccgcacuaacuauaccauuuuacauucccaccagcaguguacaaggguucugauuuuuccacaucuuugccaauacuuguuauuuucaguuuuuugauaguagccauccuaauggguguggagucaccuaaauuuuuaguuuuuaauuuuauuuuuauuauuauuuuuagagagggcggcgggugggucucacuauguuacccaggcuggucucgaacuccuggacgcaagugauccacccgccucggccuuccaaagugcugggauuacaggugggagccacugcguccugccugccuaaucauuuuuauuauuauuauguauuuuuuaaauuaggggccaugcuaauuuuugugucauucuaauuuucucccuaaucauuuugaaagucucuuacugcucucugcuuuaaaauuuuuaaccuuaauuaucuguaaacauuuuuguaccuuaccuaguccauaacaagaaguuuuuucuuuguuuuuuuuuuuuuuuuggugggggcgggggguaccaaauuucuuuauuugaaggaaugguacaaaucagcuuaaguggauguuuugguacaacuuauagaaaagguaaaggagaccccaacaugcaugcacugccuuggugaccagggaagucaccccauggcuauggggaaauuagccuaaggcuuagcuuucauuaucacugucuccccggggugugcuugucagagaaauauucugccaagccagauucgggugcccucaucuugcgcaaguuggucacauggucacccaauucuugauggauuuccccugcucauucagguaauguguuucagugaagucacacaaauggggguaauuuugucgguggccaguuugugcaguuccaguagugacugauucccaaguuuuuccaaauguaaugcaugcuccaucgcauucagccugcucucccagucaucauggucugguuucuugaagucccgaaggaagaagauucagccaccucauugguucugcagcuucaucaguuucuuggcauguucccucuccucaugagauuggugaagaaaguauuuggcaaaguucuucaaagccacaucauuguggucaaaguaguaagacauggacagguagauguaggaggcauagagcuccacguugaucuggcgguugauggcgguaguucuggcgcaccugcgagggggacgcgcagucgucauggugguggccacgguggcugugcggcgguggcugcacggcgcuggaguggcggcgggggccuugggacagucagagggcccagugaagagguaacagagggcuagcuaugggcggccagccggagugggguacgagugccugguuccguccaagcacuguugaaccaggaaacuccagggacuuuccgcaaagaacgucucauuuuuuucuuuuugaaacaagaauacacaacaacauuuuuguacaugaaugaaguccuuggggaucuacaucuauaagacuuguuucuuucuuucuuuuuuuuuuuuuuuuuuugagacagagucucauucuguccacccaggcuggagugcaguggcgugaucucggcucacugcaaccuccgcccuccgaguucaagugauucuccugccucagccucccaaguagcugggauuacaggcgccugccaccgcgcccuucuaauuuuuuguauuuuuaguacagacaggguuucaccaucuuggccaggcuggucuugaacuccugaccuugugauccacccaccucagccucccaaagugcuaggauugcaggcgugagccacuucgcccggccucuuguuucuuuuuuuuuuuugagacggagucucucuuugucguucaggcuacaaugcaguggcuccaucucuguucacugcaaccuccacuucuggguucaagugauucuccugccucagccucccgaguagcuggauuacaggcaugcgcuaccacaccuggcuaauuuuugcauuuuuaguagagacgguuucaccauguugaccaggcuggucuugaacuccugaccgaccucaagugaccugcccccccccuugcccucccaaagugcugggauuacaggcgugagccaccaugcccagccuauaagacuuguuucugcugccucucaugcucaguggcuuguuuccauuuccuugugugugucuaguauucuuuaguauuugagcuuaugcuuagggcucaaaucuuuuuuuuuuuuuuaccccccuuuggagauuuuuuuucucauuggagauuuugccuugcuuauugaaagcccaacagugcauuaaaaauuuaauaaguaucuaguuaaauuauagugggaacaucucuccaaguagcucaucugccaagucuauauauagaaauauguggucuuauugugaaacuugccccuucucuuuuuuccccucccauuuaacaauauauuagauaucuuucuaugucauuaucucauucuuuuucauggcugugaaguauuccuuuguaugaauagauaauaauuuaaccauucuaccauugcaggacauuagguuguuuccaguuuuuuuuuuaaauuacgaaauuacaguaaacacauucauauguaugucuuugugcguuucugcuaguauuucuguaggauugauuucuauaaguggcauuagugguugaugagauuuugauuaaauaaugucaaauugaccuaaauaggcuaugcuaguuuauaccuguaccagcaguggcugaaaauacccauuuuuccuguaccuucuuuuuugacucuagauauuauugaucuuuuuaauuuuacuaauuaaggagagaaaauucauauuucuuuuagaauuugaugcuuugguuauuaggguaagcauaucuucauguauuuauuggacauguaauucuuuuuuuuuuuuuuucaagacagggucucuguugccaaggcuggacugcagugguaugaucauagcucacuucagccucgaccuccugggcucaagugaucaucccaccucaaauuccgaaauagcugagauuacaggugcaugcugucgugccuggcuaauuuuuguauuuuuuguagaaaugggguuuugccauguugcccugagcuuaagcaguucuccugccuuggcuucccaaagugcugggauuacaggcgugacccacugugcccggcccuuggacauuuauuucuucugaaaauuguucauuuuucuguucuuuuuuuauuuuugagacagagucuugcucugucauccaggcuguagugcagugguggaaucuuggcuuacugcaaucucugccucccaggcucaagcgauccucccaccucagcuuuccgaguagcugggacuacaggcaugcaccacugugcccagcuaauuuuuguauuuuuaguagagacagaguuucgccauguugcccaggcuggucucaaauuccugggcucaagcgauccaucgccuuggccucccaaagugcugggauuacaagugugagccacuggcaccugaccauuuaucaguuucucuguugaauuauuucuuauugauauauuaauaugcaguagucuccccuuaucugugguuucacuuucugcaucugaaaauauuaaauggaaaacuccagaaaaaaacaacucauaaaauuuaaauuggucacuauccugagucacuugguauaaacuucugcugucccacgaggaacgugaauccuuccuuugucugguguaucugugcuguaugcgcuaccugccuguccaucacuuaguagccauccugauuuucagaaaacuguugcaguuugcagugcuuggauucaaguaaccuuuauuuuauuuaguaguggccccaaaaugcaauaguagugauuuuggcaauuaggaaugcuaaagagaagcuguaaagugcuuccuuuaaacgaaaaguugaaaguucucaacuuaaagaaauuaaaacaaaaaaaaacuuuucaaaucauauauugaaguugcuaagaucgauaguaagaaugaaucuucuauugugaaauuguggagaaggaaaaagaaauucaugcuaguuuugcuguuguaccucauacuguaaaaguuauagccacaguucacaagugcuuaguuaagauggaaaaggcauuacauuuauggguggaagacaugaacagaaauguguugcauuugauggcagucagguucgguacuauccgugguuucagccauccaccauacuuaaaauguaucccccugggacuacuguaugguuuguguugcaaacauuuucuaccaggcugaauuuuuuuuuuuuuuuuuuuugagaaggaguuucacucuuguugcccaggcuggaguguaauggcgugaucucggcucacugcaaccucugccucccagguucaagcgauucuccugccuuagccuccugaguagcuaggauuacaggcaugugccaccacaccuggcuaauuuuguauuuuuaguagagacaggguuucaucauguuggucaggcuggucuggaacuccugaccucaggugauccacccgccucggucucccaaagugcugggauuacaggcuugagccaccaugccuggccuaggcugauuuucauugcuaucuuuuucaagaaaucaugguauguuucuccauuucuucacaucuuuaaaaaacauuuauuuuaaugaauuuuuacagauuucuucuuauaugucuuucauguuucuuaaguuuauuucuagguauugaauuuuuuuuuuaacuauggaaguaggauuuaaaaacuuacuauuauauuuucacuuuuggcaugagagaaagcuaguuucuuucuuuacauaucuuguaccugacuacuuaacucuuaguucuauuuucuguauauucuucccuguaaguuugcccauaguuaccuuuguucugaaaaggagggaauuauuuuuccuucuccuuucuggacuaaauagucucuuguuuuuagggcuguggaccuggacuugugcuauuagggcuauaguugaauagcagcaugggauaucaucuuuguggccuugcgagggaacauaaccaccagacauaaucuuauuucugugggaaauguuguucuaaaugccaaaguccaaauuacaagacuuuuugcaugcacuucguucaaaaagaacaagauuugggcugccuuuagauugugcacugcguuuaaauuacagaaucuguuugaauuuuaggagcgugaggaucauccccggagaggacgggaggaucggcagcacagggaaccaucagaacaggaacacaggagagcuaggaacagugaccgggacagacaccggggccauucccaccaaaggagaacgucuaacgagaggccugggagugggcagggucagggacgggaucgagacacucagaaccugcaggcucaggaagaagagcgggaguuuuauaaugccaggcgacgggagcaucgccagaggaaugacguuggugguggcggcagugagucucaggaguugguuccucggccugguggcaacaacaaagaaaaagaggugcccgcuaaagaaaaaccaagcuuugaacuuucuggggcacuucuugaggacaccaacacuuuccgggguguagucauuaaauauagugagcccccagaagcacguauccccaaaaaacgguggcgucucuacccauuuaaaaaugaugaggugcuuccagucauguacauacaucgacagagugcguaccuacugggucgacaccgccgcauugcagacauuccaauugaucacccgucuuguucaaagcagcaugcggucuuucaauaucgguaaguaacauggaggaagaaacuguaaugugagcagaaacaaucacucaguuaggauuacuaagauuuuuguucauguuuaugcagaagaaucccauaccccucauauguuaucuaaagaguauuguuaaucuaacugcccuuuaaauaauugcuuacauauuuauaagaacauuaaacuuuuaaucuauuuuuuauuuuuuugugacaaggucucacucugucacccagucuagagugcaguggagcaaacacagcucacuccagcggcaaccuccugggcucaaaugauugucuccugccucggccuccugaguaacugggaccacaggcgugugccucugugcccagcuaauuuugaaacuggaucuugauagcuugcaugggacaucugugaugauucucacaacaauccugugagaaggauaggauagauuuuuuguuuuuugagacggagucucguucugugcccaggcuggagugcaguggcgcgaucucaacucacugcaaccucugcaucccggguucaagugauuccccugccucagccucccgagcagcugagaguacaggcacacaccagcacacccagcuaauuuuuguauuuuuaguagagacgggguuucauuguauuggccaggcuggucucgaacuccugaccucgugauccgccugccuuggccuuccaaagugcugagauuacaggugugagccacugcggcuggcccguuuuguuuguuuguuuuuuaacauggucuccugacuucgaauggacacguauuuguauccccauuugacagaugagaagacugaagcccagcaaaaccaagugacuugccuaacaaaugaucacuauaguacagugguccccaaccuuuuuggcaccaaggaccaguuucauggaagacaguuuuuccauggaaccgggggaauucgggauaauucaagugcauuacauuuauugugcacuuuauuuucuaauacuaucacauuguaauauauaauguaauaauuauacaacucaccauaaucuagaaucaguggaagcccugagcuuguuuuccuccagcuugauggucccaucugggggugaugggugacagugacagaucaggcauuagauucucguaaggagcgcgcaaccuagaucccaccugugcacaguucacaauaggguucaugcuccuacgagacucuaaugccacugcugaucugacaggaggcggagcucaggcaaugauaauucaagugauggggagcagcugaaaauauagaugaaguuuggcucgcuugccugcuugcccgcugcucaccucuugcugugugguccgguuccuaacaggccacggacugguaccaguccauggcccaggagcuggggaccccugccauaguagaacucuggcucaaauauagcucccuugacucugaaguccaagugcacuguuuuuucccauuuggacaggaacuaaaauauauugaaauauagguuaaagaaacauuauguugauuauaaacaacagaaaaaaauguauuuucuuaaccacagcaagagacauuggauucugcauuuccaccuuuugaucuaccauggauucuccccaccuuccagcaacucauucucaccuuuuuuuuuuuuuuuuuuuuugagacagagucucgcucuguugcccaggcuggagugcaguggcgugaucucggcucacugcaaccucugccuccuggguucacgccauucucgugccucaaccucccaaguagcuggcuccacaggcgcccgccaccauaccugccuaauuuuuuuguauuuuuaguagagacgggguuucaccauguuagccaggauggucuccaucuccugaccucgugauccgcccgucucggccucccaaagugcugggauuacaggcgugagccaccgcgcccgguccauucucaccuuuucuaaguauauuuaaacuuccaauuuuccuucccagggccaugcuuuccccuugauuucuuugauucccuagaauuuuaacuugaauugugcucaagccagguuauuuacgucaucuaggcuaucuuagcaaagagcuuuagagaagcuggaugaucugaggcagaaguuugcucacagguuucuccuuuuuuucugcuaggcuuguggaauauacccgugcugauggcacaguuggccgaagagugaagcccuacaucauugaccuuggcucaggcaauggaaccuucuuaaacaacaaacguauugagccacagagauacuaugaacuaaaagaaaaggauguacucaaauuuggauucaguagcagagaauacgucuugcuccaugagucgucggacacuucugaaauagacaggaaagaugacgaggaugaggaggaggaggaagaagugucugacagcuagcaaacuaagaacccaaacuauugauacacgguuuccuucuuggaagucuuugauugacucagagagcacuauggugguggguccagcacuauggugcucucuguaaugccucuuacugccuuaagucuuuccucuguugcugaccagauuguguuaccauuugaauacacugacuaauguuuguuaaacuuuuucuguggcaccuuggccacaugccugcaggcauuuguuuucagaacagucucaccaauuacaacacaccguguuuuaguagaaguguugugguuuuaguuggugcuuucagaacugcugccuaggaaacuauaaacccuugguuaaggggaaaucauggcuuguucucuuuguacaguuacuuuauuuauauagguguuaagcuuuguggaccagguguuuuucuuuuggggcgaaccccugagcagagaaucuuacuaggcuuugguuaucaccaaaacaaccuccaguauauaccaaagcuuugacuuguuugagcucuugagcuuagaaguugauuuugcacuuauuuuuuuggggggugggaauguacugcagucaguaaacauuauugacuguuuaacuuaaacagaugcuuuauggcaccugcucaagcccgugacuguacagaaggauccugguugcuaccagugggugcugauucagcaucacaagugacugaaauuggcuguggaucuguucuuugugaaagaauuccugauuucuccauggagcauguacacaacaauuuugaucauauuaacuguacuucaguuuugcauuuuuauucaaauguuaucucuuuuuuucuuugagaaauaaacugucacugaugugacagcguucuuucuuuauucuaauaacauguauagaucuaaagcagguuguguuguuuacauguuucuacacauuucauccuuuaaaaaguuguugagagagguuguauuuaccuucccaagguuggaaagcaggggaauuucccaguguccuaguuuuccaccagaggaauauguguaaguagcaaaguauuugcugcuuacauauaguguguauguauguauauauguaaauuguguguuaaagagcugauacugauuuucauaugacaauguuaggcaaaggccucccugcauuugaagagcagguuuucauuuauauguauuuuugggauaaaaaaauaaaauuuguaaauauagccccauuucaaagaguaaugcuuuccuagcguagaggaccuuguguucauaggucuguuugcugcuaauggagccuucugucaguacuuuugagaua

SEQ ID NO: 14117 - RNA, 484 nt, Homo sapiens
uuuuguuuuuuuguuuuuguuuuuguuuuuugcgggcaugaggggcugguggugagaaagccagcugacucuuuauugcuuugggggcagggggcucaggagcucuugguggcgcggguccgcuuccgcuucaccaucacaggcuucuggcugcacaggauggcgcugacccugcggauggcugccaugcgcaggucggggcgguacuuguucuugaggaucaugugucugaugcugcugagcgugacgccagcauucuuguugauggugguccgcgcguaggagguggcaggcuucggcuggccggaucucugcuucgugaccaccaccacaccuuuguccucggcugccggcuccacgcccacagucuuguggugaaucagcccguuguagcggaaggagcuggggccuucaaguuacugggcuuggugcuguaggucggcauaguccucuugaucagaaacuggagcaguucugcacgacc

SEQ ID NO: 14118 - RNA, 5576 nt, Homo sapiens
cauaugucacauaccaacccagacacaaacauacuuuugccugcaggcagagauacagagagcugcguagcacagaggugcauggaaacagcuugacagaaacagauccaaaauuuuagacugcacauagaggagcacacauguggacucucacagacacaggucugugccacaugaacugaggcacugaggcacacaacacacguagucauacaagcacacuguagcacacaccgauauucccguggauggcaggcauuaaacaugcucaugcacucccagcaaugcugcacauaaauaagcuaccugugcaaacagucacugacauacaccccuugaagaaacaggaauacaacccacagaaacucaauauugcugauggucuucaaaucucggccaaggcagugggcaaauucuggccucaucuucaccucucagcccaaucacacauggcugaucacaucccuguucuggccugguucuccuugcugacuucaccuccaggagaccccucaaugggcucgagcuucagacccuucucucucugcccccuuaccccagauguucggucucauccacuucuggggugguaaauccaucuuaugugguaaggacucucaaauaucauuuucagccagauuccuggggguucuacuugcauugccaacaccugcaccuggauaucuaauggacauuucaagucuaaccuaucuacagugaaacugacuacccccaaaccugcuuccccacaugggcuuuccucaggugccccagcccaguaugaaaguguucuaaacuccucucucccucacauucaaguccagugcaggaacucccuucagaacaccaccugagucugagcccucucgccucuccaccggccccgcccucacuggcuuggacagcugccagccuacucaccacccucccugcuccccuucuugcccacaguggcccacccuacacugagccaccacagggaucuuuccaaaaugugucacagggccaugacacuccccugcucaacgcuccaggagcuccccaccacacuuacauuaaaaaccaagcuccuggccgggcacgguggcucacaccuguaauuccagcacuuuggaggccaaggugggcagaucaccugaggucagaaguucgagaccagccugaccaacauggagaaaccccaucucuacuaaaaauacaaaauuagcagggugugguugugcaugccuguaaucccagcuacucgggaggcugaggcaggagaaucacucgaauccgggagacagagguugcagugagcagagaucgcgccuuuguacuccagccugggcaacaagagugaaacuccgucucaaaaaaaaaaaaaagaaagaaagaaagaaaaagcucaucaacaaggccaucgagucccugcacgggcagccccugccacucuccccugcacccacacaccaucugcguggcuuucuucccuuggagggagguaucccaagcauguucuuacuccugcccagacacucuccccagauccuggcacagcugccuccuccuuaggauucaggucucacuguggaugucccugugagagccacucccagguguuguccaucgcauuacccuauccugucaugccccccagcacuuagaagcaucugagauuaucuucuauuguuucuccaauuuagugucagcuccaugagggcaaggauuugugucuguucuguuuauuguuaaauccccauuaaaacuauuccucagggcugggcgcgguggcucacgcccguaaucccugcacuuugggaggucaaggcagguggaucacgaggucagcagaucgagaccauccuggcuaacauggugaaacccggucucuacuaaaaauacaaaaaauuagccaggcgugguggcaggcgccuguagucccagcuacuugggaagcugaggcaggagaauggcaugaaccugggaggcagagcuugcagugagccgagaucgcgccacugcacuccagccugggugacagagcgagacuccgucucaaaaacaaaaacaaacaacaaaaaaaaaacugucccucaguauucucaggggauuggcuccaugaccucccucccauagacaccaaaauccaaggauccucaaguccuugauguaaaauaaauugguucaguauuugcauuuaaccuauacacauccuccuguauacuuuaaaucaucucuugauuacuuauaauaucuaauauaauguaaccgcuaugaaaauacacuauuggccggcaugauggcucacacuuguaaucccagcacuuugggaggcugagguggguggaucacuugagcccaggaguucaagaccagccugggcaacauggcaaaaccccaucucuacaaaaauuagccaggcaugguggugcacgccuguggucccucccagcuacuugggagaaugagaugggaggcucacuugagcccaggagguaaagguugugaaugagcugagauagcaccucuguacuccagccugggugacagagugagacccugucucaaagaaaaaaaauuaaauauaucuauuguuuaggaaauaaugauaagaaaaaaagucuguacauguucagcacagaugcaauuuugguuuugaauauuuuugaugcaaaguugguuaaacccacagaugcuguggacuagacuaggaagugcuaggcauacacaguauuuguugacuaguggcugcacagauuuauauacagacauacccgcccccacaacaauacucaaauacaucacauuaauagacaaauauacagaugugggcaaaaauaccugcccgcacauucacagaacacacuaaacagucacaaagacacccaggagucccuuuuccauccccauaggagucaguccuaguccucccccaucuagaucugcccucuacuugaacccagucucgggacugggggaguaggggucugcagcccggacagggagagggucgcuggcccacaggccucaggcagcgccuucagcuaugucugcaauuuccucucccccuuuccuccuccucucuaaggcucccgccaaggcggccucccccucauucuagcuccagcaagggaggggagguccaugaugggggggccccguggagacagggcagaaggaagccccccgccacacacacugaucacacaccacauugcaugcacaagcccaggugggaaaugcgugugugagcacaggcagguuuagccuuggggugggggacgggauggggugggaucugccacaagccgccacaagcugcuuggugcacaagagcgcaggagcucgcaggcacagaggccccacgcuggggucugcgagacugcuggccgggcccuggcucaaagcuggaguccaacaaucauuaacccugcgugacuagaccagagcucggccaggggacacauucaagccugggcccuggaaggagggguggacaguccccucccuuccaguccagcaugggucuggggaagagaagcagcuuugccuggaaggggccuccuaggagggggagcggugguuucuagcucaggcuuuaggaucagagagcagcagauucaaauccugacgguuuugguaaagucaauucaaucucuccaagacuccguuuauuugaucugcgaaguggggauaaugguaucacgucgcaggguugucaggcggaguaagugaaagaaccuguccaagguuuagcccuuggcccgcacgcaggcagagcuccagccucucuguuguugcuguuaguggccugggggcgggucccugccgcggccuccccggcgguuuccugugggggacggacggcccgcgggccgggcucucccuccucccggcugcccgcuccucuccccuuccucucccagcccuuuuccuccccgccuccccgcccgccccgccccgccccgucccuccucuuuccucggaggaaacuuuccgccggcuggucccucgguccgugucccgcccgugcugccgcggccugggagcccagcggggccggaggggcggcgggacccgagcgggcgggggcggccggacccaguguaugcggccgcgggacgcgcuggggccgggcagccgggaagcggggcgcugacggugagugggccuggccccgggccgguggguccccgcggggcggccgggcgaggagagaggcagcuucccuucccggagcccgccuggggcguggaggcucagcgucccuauccuccaucccgccccgggacggcggaaccgggccucagcuggggaccucaccagggggcggggccucccgcgguccccggcgcugcucccaggacuggaggggcguccgcgcccgggagagggguuccccccgacagggccccgggccgccacgaaguuagggaagcgcucucuccaggguggaaccugggcccgcggcucccgggagaggagcugcccgcggaaggggucggggugggcuccaggcugggagaaggaucugacuuugcugaccucgcaggcugguaggggagcugccccccagagcagcauggaugccccgcgaagggacauggaguugcucagcaacagccuggcugccuacgcgcacauccgcggugagggcgggcgccggaagacugggggccugaacccuucccugaccaccauccccuucccuccccagcgccuuguccguccccuccgccccgcuccccgcccucuugcccgcuggcgguucccuaaugcccuucgaguagggguuacaggccucgcccccacaccuagaaccuggggucuuucggaagugggacaacccccacccguccgggccucuccgugacccccgcccugugccccgcagccaaccccgagagcuucggccucuacuucgugcugggcgucugcuucggccugcugcucacccucugccugcucgucaucagcaucucgugggcgccccgcccgcggccccggggcccggcucagcgccgggacccccgcagcagcacccuggagcccgaggacgacgacgaggacgaggaggacacggugacucggcugggccccgacgacacgcugccgggccccgagcuguccgcagagccggacgggccccucaacgucaacgucuucacgucggcggaggagcuggagcgggcgcagcggcuggaggagcgcgaacggauccugcgggagaucuggcgcaccgggcagccggaccugcugggcacaggcacgcuggggcccagccccacggccacgggcacccugggccgcaugcacuauuacugaugggccccggcucccgcugcaaggcgcucgggguaccggaccugcacaugagcucagagcuaccccacaccuucggacugccucggcccccacagcucccaggugcuacugggcguggaccgccacccccugagaggcucccuuccccaguccugccagaagaccccgggggcggggagggggcagcaugcaggguccccacucccucucuggggucgaugaagaggugaagugaccaaaugaaagaaagcugcauucucagugacuca

SEQ ID NO: 14119 - RNA, 24712 nt, Homo sapiens
gauuggcagaauuauucuuuauuucuggagacauuuaaucagaugcaguaacacugauuccaggcgagggcagggggcauggguaccccugaagcaaccaguauccuguggcccaaggugucccccauccccagaccugggaucccccucaguuacaguuaaauagagagaggaagaucuccccagggggcuuuggggggagggucugccuccugcacccacccucuccacgcagaggagucugagcacaagcuauuuacaguauucacauccacuguaccccaccaaaucaaggcaaauacuacagguggccccuccccaagggaagaggccagagaggcugugaguguauauguguguaugggggagaagggaugucugcgcgugcgagcacacgaaugcacugaggggcagaucuggcuccggccaaagagacaucagucuauaaggugcagauuaaaaacaacagagaggacccacccccaggggcccaggccacuuccaucuuuguucugucuuuuucuccuccagacauccugguaggugaugcagaggagcccucacaacugugcccggauccaaggcaaacccucuuaaaggacuucuggggaaaaacaggaagggaaacagucagggcaaacagcacucaagcccagauagcugggggucuucaggguggagcaggagagggugccuggcagagccagaagagaaggcagggcugaggaguacagggaaggcugcugggaggaauggagcuggguccaggaaucaggagaucuaccugugaccugcggggacugcaccacagcuuucuugaggaaggcuucugccucugcaaagggcaggagugucucugguguucggcucagacucuuguccccagaggguccguugguggagaagccauucuccuggugugcugggagaggcugcaggccauucaccagggacgcuggcaacuccuugcuugggagacuguggaugcagaggccaaggcucagcaccucaccucccaggaaagcccaggccaccccgcagcuccagcugcagucugccucccugcucagggacccugggauuggaagcugguaccuccacugaggcuccugugggaugggcuccucuuucugcacagccuccuucugcagcccuggggaccgagccuccacagcuuucacaggcucugucacagggaaagaggggccaucagccaggggcuggcaagagaggugaggauggaggaggaggaggauggcaaagggaagggaggcgagaggaaugggggcuuuaccugggcuggaaccguuggcguuggccuccuugcuguccugcuucugcuuugaagaggaagagcagucaggcucaagggacagccggccccagccacuucggacugaguucggcccuccccuugcccgggccgcagcggccucccugacagccucgcucuccguggccauggaugccuuuccgcagccuccuuuucacacccugccccccacgcccagcacugcccuucgggggaauucugaccuugguuucagaaacuucugacuuccgaguccucuucaugaucuccuccagacgcuguuuggaggccgcagaucaguuaggcucgagccccgccccuaauccuaaaccucccaccagccagacccggccucggagucuuagggccucccagcucauagcagcccucuccaggacaggaacuggaauuugccccagcgcuuucccguccuguccgcucuaagcccaggccccgcccaccuggcccgcccugcccaggccccgcccacaaauccccgcccagguccgcacaccuuucugcgcucuugccgcucuugcuccugcugcuggaagugcuuuucccgcuccagacgcugccgcuccgccucuucccgcgaccgagcuucggccuccucuuucugccaaagacccccaugagcguggggcacuugacuccagccuucccucccggcccgcggcgcccgcgcccagccgcuucccgcccgccgggggcaccugcuucugcagccgcuccugcuccuccugcucggccugcgccuucucucgugccuccugcuccucccgccuccgggccuccgccucccgcuccgcccgggccucggccucccgugccagcugcuccucucgcauucgccugggggacggagcaaacggcucaggcucggccucugcuucuucuccagcgcccacgagggcccccucaguccccgaggcgcacucacuugucccuuucugccugcagccuccgcuccugcuccucgcgcucccgcugcucccgggccuggcgccgcuucucagccaagagccgaguggcuucuucucggucuguggugccggccauugguuugcuaggggucaccgggggagcaggggcugggggugaggucaagacagcagcgucuggagggggauccgggaucaggcgucagcacacccacgcagacaccgccgucaucucccagcggccuguguucugggccugggacugcugagggcaggagucuccucuuuccaugucccacucccaguccucaggcaucucuggcggcccacacccccacacaggagaagcuggcuucucucgcucggcccaccccuccccucucuucauuccuaccuguaggggucuccgcggggggcugcuccuucuggggcggggcuggggugggcgagggcgccggcgaaggugccggugaggcuggggcugcugacuccuucucguuacuggcccugcgcuugcucuggcucuuguccucgggcccugcggcgcuggggcucuccuuugccuccuccuuccuccgaacccgccccuugggggaugcaguggugccucggggggacgguggcuuuggaggcagaguguggccuggcccugggcuggggcagggggaggcaggccugugccaggauguggagggagaggauggccuggccuuggauuuggggcuaagagaaaagggaaaagggaaggguuaggagacacacacacccacacgcugagaacuuguuccuuccucugggaggugcccccucccccaggcuacaucagcgccgccccccgcccccuugcucucacagaaacacaccauucccuuuuagagcauacaccccaguuuguaaugacauguuucugugggauucuuugauuauuguaugucccccgccaauagccuguaagcuuaauaagagaaaaaaccaugcuuggguuagcucagcaacguguccucagcacccugagugcuaccugacagguccauucauucagcagguuuuguuguuguuguuguuguuguuuuuaagacagaaucuggcugacccccaggcuggagugcaguggcaucaucauacauagcucacuacagccucgaccuccugggcucaagcaauccuccccuuggccucccaaagugcugggauuacgggcgugaggcacuacccuggcccuucaguagguauucacugagugguuaccaggugccaggcacuauuuuagguguugggguacuucaguaaccaaaacacuuaaaaaaacaaaaacaaaaacgaacaaaaagaaaaauggaggcugggcgggguggcuuacacucacacauguaaucccagcacuuugggaggccaaggcggguggaucaccuaagcucaagaguucaagaucagccuggacaacguagcgaaacccccacucuaccaaaaauacaaaaaauuagccgagcgugguggcgcgccuguagccccagccacuuggaaggcugaggugggaggauagccugagccugggaggucaaggcugcagugagccgagauugugccacugcacuccagccugggugacagagggagauccugucucaaacaaaacagagagaaucugcccucagggaaguugcauucuagaggugguugcccaacaaauauuugugggugaugaauaaaugacccggugaggggcagggucccucgcaccgcccgcgcccaccugagcucagaggcggugcuggcagagaggcgggcacguggggaggcgggcagcgacuggcgcuucuugaggcugcgcucccgggcuagggcacucuucuccuucucguuuucccgcuccuuguccuucuucuccuuuuucugcaccuggcagggaaggaggaacggaagaggagaguagaggucagcagcgcccgcguaccccaguuccaggcugccuguccccaccugcgcggccacucgagccaguagagccacucaccggcgaggccuccggccggcggcgcaccggagcggggcugcccccggcguugggcuugcggcgcuccccgcgcucaccggcgggggcgcagcggugcacgcuucgggugacgcugcacggcgucagggggcuggcggaggccgagcgcgggcacaccggcacggcugcagagggaugagugcggucggguugcggcccgcgcgccaggcuggccccugcccggccccacguggggccucucccagggucgcagccccuacccuggucccggccguugcggggcagugugaccgcgcugcgacuccgagcaaggaaggagagagugggcgucaucagacgauccacgaugcugcucucccaugcgcucagcugcaggcugcgaucuggggguagaaggccaggcgaagccggucaccgugggggccguaggaggcaggaagaggcaagggagcagaccaggcaccauccccaugccaaggccaaggcuucucacccgggaguccucuccccacaaucacaccggggccacacuuguccucccuaugaucuggacuuccacuacagacccaggcaaccagacacuucccagggcaacauccugcaucggaugaggguccccgccuacaacgcuccccaggugaaggggcccugaacggcgcauauaggaaggagccauccaggauuggaagaaaacccaauugcccucugccaugucccaguguaaggucuugccccuccugcugucagagggcugacccagccgaggcugucccauggauucaggacagugaggguccuugugcuccucugacccagcuuuuagcaguccugugccagggagaggcugcuagggugccugccugcccuaggccacccugcucuguccccucagcugcugggcuauuuuuaagccucagucaggugggguugguacagcagcugauuugguugcuaggcaacaaagcagccaaacaaaugcaagagaaacuuauaaauaacucccaccauggcuccuucacauaugagcaccagggcauggugggaaugcaggggcuaugccaccuugguuggcucaacucugggaccagccaaggccaugacuggggcucugaagacagagagggcaggauugcaugggcccucuaggguggagccagaaugagggaccccuccaccccacagcacccaggccagucugacacauggggacaaugccaccuggcuaagguuggcccagaccagcuggcugugguugcagaaaaggcugccugccuguccccacccccagccaccaccuccaacuugcucuugaggcuccugccaggcuuccugcccucugcggcauugugcuuugucucuguucuccucuccuacagggcaaccucuguccucaggguccagacccauaugccggcucccccgaggggcacagagcccuggguaagguagaguggggauggggaccuggaguaugugagggcuccagggaccugguguucuugcugagcucuggaggaggcuuggugggagcuacaaggggcucuggagggggaagggcugggccuucucuuacuucuacugggggaguuccagagcguggcagaggacuuugagagccgcuuguugauuauagaguccacguguuugggcagguuaacugccgacacggagcaccugcucccaccuggagggggaaaagacacggcauuagggccgggcccggcaggagccaguggggggcaccgaggccuuccaugcaggaugcuccgagggcggggugggagagggaggagugggcaggcuaggaugaggagcaggaggcagccuuggcccugggagagggaggguggggggguaggugaccagagacaaccuggguugggggagccgacggagaaggaacaaagggaggagaugaguaaaacuagagaaacuacagcuuuccuggccagaccaaggaagccauuccuuacggcugaguacugcaaccccuccccauaaccacccagcauuagcacuugcugacacugcccagccaagacguuuggauacaacacccccguacugggauaaaugcaaaaacccuccuaaacaggaccuacacagucacagucacuugcacaaauccacguguucauccagaaucacaaaaagacaugcagacacaggcauauagaguggcagauacuucggcaugcacacaugugugcagacaugcacagggacagagacacaaacacuaacagauagugugucagacccagaugcacacaagccacaaacagaucgaagcaaccucaucaugacauuuguagcagcucacauuuguugaugcuuaccaugugccagguacuguguggggcaccacacacaugugaccucauuugauccuucaaacaucuaucuaccaccucaggggcaaguaguaucacuauccccaguuuauagaugaagaaagugagacuucgagaaguuaaagguuacgcugcaagugccagagcuggaacccaagucugucugacuuaggagcccucacugagguacacaaggucacaaacacgccaaggcaaacacauauuaagacacacaaugcacggguccaggagcacauaaacagaagauacacagcuagaaauacugaaacuugccauugcauaaagacauccaagcacagugguacauacaugccagcaaagaaucagaccaaaauccaugguggcccuacgcggagaaaacucagagacaaaaaucuaccuuccgagacaaggagugacaguuucuuuaagauccagugucuguaggucauuaaagucuuuuauguaucaacaacuaauaauaauugacaggcgcaaagaaggcuaauccuaaaaugacagagguuugaagagcaaaccaaauggagagaauccaucucugauuugauaguggaaguccuugggaagggacaguuuggcuuacagaccauucuagaagacacaagucacauaaagcaaggcacaccugcugcagggagccaccagcuuuuuguagggaaguuguucccuucccuuacuugccaucccagccuugcccacccacuccccagccccuccagccuacucacuggucuuauguccuggagagcuguggugcagggccccugcccaggaccagcgcugcugccggauuucggcccacgucuucuucacugaccguuggauggcugcuucauagcgcuccugggggaagguggggagaagagagagauguggacucagaacauucaucgaauuugggauagaggcccuucuuccuccugugacaaugccucccccacucccuucccuuggagucuuuuccugacucauugcagguaaccaagguuaccaaauccuugcuaugauuaaggaccaagaucccuuucaacuuguucuuggggagcuuuucacuguuccugagucauuuccugagugcaugaguugauucucugaggauuggguggacucccccuaccuggggcucccaggcaaggccacaucucaggcacugaggguccugaccuuggggcuauguguucccucuagccugaggcccucccagguagggccagguggccauuuccuucauuuccucaccagcacucaagcuagggcuuuacccaugucacagagcuaggcacgcucacacagaugcauaccugcauacauacagacacaugggguacauguacgaacacagguacugacaguaaacaguuacaggggccuacaguggcacauucagaagcaaaugugccugcaguuguacaggugcccagauauucuaacacagggacacaacuguagaugugaacacaaauaggaccacauagacacagauaaggcagagccgugaacauggauguguguacacacugcaccaguaugcagacggugagcacacguguacauggauucacggagacccaucccgcaccuuguuuuucucgagcuucugccgcugccguuccuccagggcugcacggcguugcucggcuuuaagacguugcuccuccagccggcgccggcgcuccuggagcugcuucucccgcagcgccuuggccuucuccuccuucuccagccacacugccuucuuggccgcuguggacaaaggagcccaguggcgugugugaaggguucugcagaaggccugggccaaggacauuuccuccaaguggccagcccugcuacccaugcccugggugggucuuucucccgccugcuuagguggagcuuucagucugagacaacccccucaaauugagaggcuuacugaagacaggacucaggagaggccuauuucuccuccauuggccuuaugggcucucagggcugaaggagaaaugaaugcuugagugcaagauccccaucugaccuggggggccuaccagacagauguccacauacugugauuaagagcaugggauuugggguggcaggaggcuucugggucugaaugucagcuacucuacuagcuguguggcuuaagcaaaugauuucaucucucugagccucuguuuccuccucaaaauggguugaggauuaaauuagauguguguccugcucuuagcacagugcacauaauuaaguguugcagaaguguugguuuuuuuuuuuuuuuuuuuuuuuugagacggaguuuugcucuuguugcccagacuggagugcaauggcacaaucucggcucaccacaaccuccgccucccagguucaagcaguucuccuaucucagucucccgaguagcugggauuacagggaugugccaccaugccuggcuaauuuuuuguauuuuuaguagagacaggguuucuccacauuggucaggcuagucucaaacuccugaccucaggugauucgcccgccucggccucccaaagugcugggauuacaggcgugagccacugcgccccagccuguugguguuauuaauaggaugcugaugaugacgaugaagaagaugaugaggcuuccugcucacucacccagguacuuggcccgcucuucucgccgcuccuuugccagcuugugucucucuccugccuucuucaccucugagcagagggaacaagaacagacaggucaaaaggcuguccccaaagaggagucagccucagaucccucccuccgggccucaccccauccuuucuuuaucuccucuagggcaaacaggacucuuucaguuggcaugauccagggccaggacccugagccaagagguuuaggcccaggccggggucauuacacacaccuugcuuggugggagggcugucggaggcuggcacugcuguuggagauggcuggcugcuccuucgaggaggucuggcaucccgugggcccauggcuggugggguggguccucugcucuuugcuucagaggaaggggacucuuccugcgggggggcuggccuaggcccgaccugcccugaggggcucucugguuccagugggagcugcuuagagcuaguggcauucuucauggcaggagggguguccgggggagugucggggaccagggcugacauuggugguggugggggggaagggucaccuucuggagaaggucuuggcucuggggggguccuggcgaccacagcugaaagaccaacacaagagaggagagaggucagauugcucaucugugccaucagccccauauguggcccucucccuuguucaaccgacuucuucauucacuuauguuugaguuauuucuaugugccgggcccuguuccagauacucaugauauaauggugagaaaauagccaugaucccugccucuguggcgcuuacccucuagcagggcagacagacaaauagcuaggcaacuacaguagagaauaaauacuaugucuggggcagcaaagcagagauaguuaaccuauauggggagggcuugcugaagaaguaacaaccaagcugagauccgaaggauaagcuggagucagcaaagcaaggaggagagguguuggcagagaagaguauaugcgaaggggcagaauggagcaggguguguuggaaaagcugagaacaagcuuguagcacuuauucgugcaccaaaugcacugauuguuuccaugucugccucccucuccuuucugcuuuacuucugggugacugugcccaacccaaggucuguucacagagggugccagugcugggcacaugggacugaccaagaggaaggacguaaguaugggcucuaguggaaugcuuugcugugaagauuccauuggcaacaagcuacguccacuuuauaaucuuuuuuccccaagccacaccgaaauuucugcuuuuaagacaugacuauuguaggaauccuguaaaagacaucgaagugaaguaagggagccacacgauuugacauauacacauguggggcaauugagagacaggcuucagagucagucagaugaggaagaugggaagagagggcuuguuuccccagcagacaaccauggacaagccagucaaccucucucagccucagguuuuuuuguuuuguuuuguuuuguuuccccccaagucuacuugcugcuagugaauuuuucaagggucuaguuaguuccuuuaagucucuuuuuuuaaauuuuuauuuuuuaagagauagggucuugcuauguggcccaggcuggauucaaacuccugaguucaagagauccuucugccucagucucccaaguagcugggauuacaggcccaugccuggcucagccucaguuuugauaccuguaaaauggggauaacaagcccaagcuaguagggaaugucagcaaggugccuggcacuauccacaugccagccagcaaacagcacucccuguuggucuuaugaagccuccuggucucccaaacagaagcuucuguauguugagcccuggugccaucugcugcuaccauccaggcacugaggagaucaaugggaacacagcuaccaacuugcuuagggagcagggccggcaucugugggaagcuucaucuaaggaaacauuuuucuuuuuuuuuuuuuuugagacggagucucgcucugucaccccggcuggagugcaguggcgcaaucugggcucaccgcaagcuccgccuccuggguucaccccauucuccugccucagcuucccgaguaacugggacuacaggcgcccgccaccacgccuggcuaauuuuuuguauuuuuaguagagacgggguuucacgguguuagccaggauggucucaauuuccugaccucaugauccgcccgccucagccucccgaagugcugggauuacaggcgugagccacugcccaccgcgcccggccuuuuuuuuuuuuuuucaagacagagccuugcucuguugcccaggcuggagugcauuggcacgaucucggcucacugcaaccucugccuuccaaguucaagugauuauccugccucagccucccaaguagcugggauuacaggcaccugccaccacgcccagcuaauuuuuguauuuuuaguagagacggcguuucaccauguuggccaggcuggucucgaacucccgacuucagguggucugcccgucucgaccucccaaagugcugggauuacaggcaugagccacugcacccggccuuauauguuauuaguuuuaauccucacugacaauaguuaugaaggaguccucauauagaugaggacaguaaaguaaaaaaagaugaagcaaaaaaaagagguaauuugagaucauucagcuggucagucagggagccuggacuuggacccaguagccaucaucagagccuguccuuacccauuauacccuccugccuuguugaaggcaauaugagggaauagguguuacgcaauaaauuaucugaggcucacacuauuuuccgccucauuccuucccauccagcuugcuaggauccaggcaagagccccagcugaggcccugucuuccccauuaccccuccaacuccaccaacuccaccaacuccuaggcuacaugacaagccacccaucucuucccauaccagcaggagacggcugccuggucacugcuaaucuauuucccagccaacugcaaacuccuuuaccaauuccaguagucaacaaaaccaguuacucacucuagugagugcuuacuacucacuaacaguggugcacccuguguccucgcaauucugagaggcagagauucuuauccccauuauacaaguguggcaaccaaggcccaaccugcaaagugauccacacagagucauagaacuaguauguggcagaguugggcuuuuuuuuuuuuuuuccugagauggagucucacucuguugccaggcuggagugcaguggugcgaucucggcucacugcaaccucugccucccagguucaagcaauucuccugccucagccuccagaguagcugggacaacaggcaggcaccaccacacccagcuaauuuuuguauuuuuaguagagacgggguuucaccauguuggccaggcuggucuccaucucuugaccucgugauccgcccuccucagccucccaaagugcugggauuacaggcgugagccaccgcacccagccuagaguugggauuugaacucaggacugucugaagccaaagccuggguguguaaguauuaagcuugaagguugagggugaggucuguuuauugccauucuccaagcaccugugcgugcugcagguguugcaaggaaaacugguaggcggguguuugucuacaccuaggcaaaucacacccaccaggcaagacagucagugaguccccagcaagguccugacucgcuaugugaaaggaggcugggaggagguagaggagugaggcuuggaagaaccugcacccaggcaucagaugcaguggagcagaaaggucacaggcuucagagucugacaggccugacugaggaccucggcucccggcgaaccucgggcaagcccugagccuguguaaccacaguucccucauggaguuguuggcacacauggggaguugguacagacggguacaucaucgguggcaccuggcaggggcuugguaagcagcaccugccccgaagaauauauccacgucuccucaucucugccaggaggaaaugcuucagccaggccuuacccccacugcucugcaacauugcacuucucaaggacacccgugaccuccaugcugcuaaauccagcaggcaguuuuccaucccucaucuuccuuggccacuaugcagcugcaucugccacaguugauuucugacugcuccuugaaacacugucuucaccuggcuuugaagacagcacauucuccuaguuuuccuucuaccuugcugacugucauuucucagucaucuuugcugauccugccugaacuucccaaccucucagcgcuggagugcccuagggcugaguggaggaccucauuuauuuucuauccacacgcacucccuuggugaccucauccagacucacagauuuaaauaccaucacugcugacgacaaccaaauuugugucuccagcccaggccucucccuugaggucuaguuucacucaugcaacucccagcugcuugacaccccugugugucucaaagaugcccccaauuuaacacaucccaaacugagcugcugaucuucccccaaaagccugcuucuccccauuuuccccaucucaguuaaugacaacuacaucacaccucaugucuaaucucucagcaaauccuucugccuuuaucuucaaaacagaucucaaaucuaaucauuucucacugucuccacuucuaucacuuggaucagagcuacuaucagcucugauaaaagacucccugcuccagucuuuguucccccugggucuuuucucaacacaguagccagagugauucuguuuaaaaauaagucagauuggccgggugcgguggcucacgccuguaaucccagcacuuugggaggccaaggcaggcagaucacgaggucaggagaucgagaccauccuggccaacacggugaaaccccgucuguacuaaaaacacaaaaaauuagccaggcaugguggcaggcgccuguagucccagguacacaggaggcugaggcaggagaauugcuugaaccagggagguggagcuugcaguaagccaagauagcgccacugcacuccagccugggugacagaaggagacucugucucaaaaaaaaaaaaaaaaaaggucagaucacgucacuccucugacaaaauccugcaaugauuccucauuugaggggaagaaaaagccaaagucaucaugauagccuauuaaggacuccccaggauccugaccucuucgaccuugucuccucuucucccccugcucaguuuuucagccacugucccuuaaggguguuggggagauuucugccucagggcuuuguacugaggaaacaauauuuccucaguggcuguuucucugccuugaauucucugcccccagauucugcgugccucguucccuccccuccuucaggucuuuauuuugaugucacuuuuaaauggagccuucccuuagccccuauuuaaaacuacaaacugggcugggagcgguggcucacgccuguaaucccagcaccuugggaggccaaggcagguggaucaccugaggucaggaguucgagaccagccuggccacaauggcgaaaucccgucuacuaaaaaacacaaaaauuagcugggugugguagcaugugccuguaaucccagcuacucgggaggcugaggcuggugaaucacuugaacccaggaggcagaggaugcggugagccaagaucgugccacugcacuccagccuggaugacagagugagacuccgucuccaaaaaaaaaaaaaaaaaagcuacaaacugcaggcguggugcgguggcuuaugccuguaaucccaacacuuugggagacccagacaggaggaucccuuaaggccaggaguuugagaucagccuggacaacauagugagauuccaucucuaaaaaaauuuuuuuaaauuacccaggcaucaugacaugcugaaauagagacugagguuacagugaacuaugagcaugcugcuguacuccagccugggugacaaagcaaaacccugucucuaaaaaaaaaaaaaaagaaaaagaaaaaaaagaaaaauuuuaaauaaaauuaaauaaaggccaggcaagguggcucacaccuguaaucccagcaauuugggagacugaggugggaggaucacuugaggccaggagcuugagaacagccugggcaacacagccagacccuaucucaacuaaaaaauaaaaaacagcugggcaugguggugcacaccuguagucucagcuaguuaggaugcuaaggcaggaggauaccuugagcccaggaguuugaggcuacagugagcgaugauuauaccacuguauaccagcuugggcaacagaguaagaugcugucucagaaaaagaaaaaaaauuaaauaaaacuacaaacugcaguugaagucucccucccaguuccaacuagauuuuucuuuccaagucuucuuuuucuccauaggcauuaacaccauuuuaagucucccacugcuagaauauaaucucuaugagggcacaaauuuuugccuauuuuguuagcuggucuaucucuagggccaacagagccuggcacauaggugcuccauaacuauuuguugaaugaagaaaugaaugaacuacacccaggcagauaucaucaucaccaucaucgcucucaccuggaugacuacaaaguccucucacugcucgccuguacccauucccacucucugcuccacugagcagccagagcaaaugcaaaucugaucacggugcucuuugccacuugaaacuugucaguggcuuccccuucuugaacucacccuacuaguccaguauaauaguauaaucugaaguuccugacucccucccccuacuucuuggaucuccucuccuacccugcuccccgcuugcucucugaacuccagccacacugaccuuccuuuaaugcugaugaccauccacacucccuccugccacagggccuuugcacauacucucuuuucuuagcuaacuccuauuugcccuacauauguuaguucagucaucacuuccucauggaagccuuccuuggcuucucugauuaggauaaauucccuuguuguauauagucaugguuucaugugccuuuggaacacugucacuguuaugauuuuaaacuuccuugcaugguucuuuccuuauugucagccuccuccuagaaggugagggagccccacaagagcuggccaugucuacuuugcucacugcugcaucaccagcagcuaccacagugccaaguauacggagauagucauaaaauauuugaauaaacaguauaacacaaauaaagugcuauacuaugaggcugcccuagccuaaagcauauagaagauuuuuacucuaauaaagaguagaucuaggcugggcgcaguggcucacgccuguaaucccagcacuuugggaggccaaggagagcagaucguuugagcccaggaguucgggagcagccugggcaaauggcaaaaccccaugucuacuaaaacuacaaaaauuagcugggcgugguugugcacaccuguagucccagcuacuugggaggcugagagaagaaucccuugaacccagagguggaagcugcagugaucugagacugcacuacugcacuccagccugggcgacagaaucagaugcugucuccaaaaaaaaaaaaaaaaaaaaaaaaaaagaaaaaaaguauauaucuauguggcaacuuauagcaaaaagauaaacauuugaagagaagcaaaacaacuccaucucaauaguguuugggcagcuuccuggacuaagccacacagguagaaguuaauaaaaauaauaaugaguguuuacuccagcagcucaacaagaaaaacuucucaagaggcaaacaagaaguuuggaacuccucuugugaccuggcacacuauugacccugaauacaaauauuuucuucacaauuaugccaacccugaugaaaugucauuggcacaguguuauggagcaaaucacauuaagccaaaacuccuugguuaguuaucuauacaguaugguuaaucuauuuaugaucauucucauuuuuaaccaucaaauaugauccuucggcuacuuaauuuuaucuuauuuuuggucuaugccagauugugagguuuugccacuguugguuuuauuuugcuacacuaauaucuaccagaaguauuuguuaagaaugagauaagagacaaauaauuuguauuuauuucuuggcacaaagagcauuagcagggcaaaagugcagugguggguugcauuguggggucaaaaaguccugucuuccuaagagcuccaagaggggcugugccuggggucugcagaaagaucagggccaagucccucagagagacugucacaugucucagaauacuaacaccccaucuccacccucugagagcuggcaguccuuuccuuuugucucucccuccucccaccccaacaacucuuguugggccaaauauuccucucacaacacugauaacucagucuagcuuuucuguuugccugccacccccugcccuugucagugugagagcuuaucaagagaagaaacucagucuuaguccuuuuugcagccccagagucuuauacaggaccugccuggcacagagugggaguucugugucuguuuaaugaauguccgauggguggguggguggcuggguauguagauauguggguggggguacuguagaaagcuaccuagcuaguguguauuuagacccucaagcugcuccaaagcuuagucucucuaaacacuaaaugucauguucaucucagaaccugcauguccccagccaguuuccaggcccaaacuaauuuacugaagcucuaacauaaaccaagcacuuucccuaucccauuugauccugaugacaauccuaaaaggaaaguucuaugauggcccccauuucacaggugagagaauuuacucagacagauuaaguggauuguucaugccagugucagagguaggauuugaauccagaguugucugaugacaaaacccuuaaaacccuuaugucaugcuguuucugguaggcagucacauuaccccgcccugaagcuccugcguguucucugaagaaggaagugauuccgugguucccccagggagacuucccccacaaaagugaagggugcagguggggcaagcaggcacugagcucagagcacaggaauguagggaaggcaggcuccugcccaggcuggcucccaagaggcgggaagugagguaggggagaacagcccaccuccaggggcagcgagagggagugccugggugagggcugguuguggcguggggggugcacagacagcaccucaggcaggaagcaugggagaggcagaggcacgaggccgagagaagacagaacagagaucagcaccucuagcaagagcccuccuggcccucacugcagauuccuaggugacaacacuagagcaggcgaagacagaggcaggcagagggcagagacacaugggagacagacgugcacacaacagagacagacaccagacaauguaaacagggccugcacaauggcgagagacaagacauauucuccucucucucucacacacacacacacacacacacacacacacacauacacacacacacaugcagaggaaacagacuuacugggauucaaaacucuacacauaucugagacacacagauguacccacagaguacggggccagguaccuccucuaagaaacagacaaagccucagagacacacacagcacacagagacacaauguccccggaauauuuauacagcgucauccaggucacuucugcuccuucugagcaaauuauuucccuaggcccagagaaaguccgauuaacaggagcaacagcuaaugcuuuugucaggcacagcuaaacacauuaaacucauuaguucauuuaaccuuugccauaauccuaugagguagauauuauuaccccauuuuacaaacgaggaaacagguucagagauuaagacacuuacuuaagcuccacagcuagugaguagcaaagcugggguuuggacccaaucagcaugacggucuuuacccugccugcaucccaguggggacagccuccuggguucccucuccuggagagaucugggcugggagaauaggaggucaguagaaagggcaaacucuggggaaugccuaauuguggggccgggagaggagggacccuuagggggcagcauuaucccuggccuggacagagcuaagccggcuccgagagggagugcccuaggagagggcagcgugcuccagcaguugggcaguggggcacugggaccaggccaccggcuucugugggugauaaagccgggaacccgacugagacuacagaucugaaggagcucucuggcccggcuggcggccauuguucccagccuccaaucaggagcacccacuuccuguuauuuuaggcggcaggaaaugaccccaucccgcagccugggccccaccacaucccucccucagccccagcagggcugcccaggcuguugcccagaugcugaaggcagaggcccaaccucaggccaaggccuggagaugcccccccagcuggacuauuaccaccaccuggguccggggccuuccuccugguucaacugcuuaggcuccaaccuggcaggcuucccagaggacccugggcucugcuggggcuaccucugccagccagggaaaagauuaugggguccccaagaccaagaugcccacacaggccagucacgggagggaagcaggccagaccuugucacuggauagcuuagccaugauaauucagcuuagagguuuagggcacagacuucagagucagacagauuugaguucaaauccugccucugccaguugcuagcugugugacuuuagguaagugauuucaucucucugagccucaucuguaaaauggggauaaugcuagucccuacucaugagacuguggugaggaacaaaugagacaaugcccgugacaugcugagcauugugccuggcacagagaaggcccuuaaugaauaggagauaauaagucagagauaauuaaugggaaauaacuugguucaccggggagucucuaccuggcucacaucaucucuuacaacugcugaggagcgcuaguaagggcagcaguaccauguucccuacacccucccaggcucucugcucccuucagggcagagcugcagcugagaagugguggaggaaacacugaaggcugugccccugggugccaggcagagauaccaccagccaacaaagcugcauuaucugggucuggcuaguuggcucccucacuagccccaaggcccagcagggaccuaaggacaugggucccagcugcccuguggccuaacuuccagccugggucagaccugagaccugaccugauggcccucaaguauggccauucuagucugggcccagcuuucagucccuucccucagcccuuccccacuaucauguuaggaaaggggaccugagcuggccuaguaucccuuccaccucauuugcauaugcgugacugcacauuaggggcucauuagaggccucauuauugggcccaccagcccaggaagggacuaggaagcugucauugggaggugccagccagcuggcugcuggauguauggccacagcccacugcgccagucucaccaacgucuacucauccuuucagauccaccucaaaugcugccuccuccgugaagccuuccacaagcacagcccacugcacacuaacaccauuauaccugguuucccugcagugaacacaucugccuuccucgccgcguuaagagcuccccaagagucaaaacuccgucugauucacuucucugccguccacauagacuacaccgagcuggcauaagguggggcaucagcaugggugugcuggauagccgguugcaccuguuucuugggucuucucuccuguucccacuguuccacuucagguauggggccccuccguucccuggauacacccuagcucaugucugccuagaacuccccucuccgcugccuucuuguccuauacuuaccuccuacaauucuaaucaaucacaucucaggcuucugacggaauuaaaaauaaugacaaaaaacaaauagcuaggcugggggugguggcucacgccuguaaucccagcgcuuugggaggccaaggugggaagaucacgaggucaggaguucgagaccagcccggccaauguggcaaaacccugucucuacuaaaaauacaaaaauuagccgggcgcgguggcaggcgccuguaaucccagcuacucgggaggcugaggcaagagaaucgcuugaaccugggaggcggagguugcagugugccgagaucguggcauugcacuccagccugggugacaagagcaagacucugucucaaaauaaauaaauaaauaaauaaauaaauaaauaaauaacaaauggcuagcacuuauugggcacuggcuaugugccagggccuagucuaaguguuuucuguuuucaucuaauuuaaggaugccaaugucucuaugagauaauuucuagcauuauucucauuuuacagaugagcaaacuuaagacuuagguuaagcaacuuacugaggucacacagagguaaguuacgaaguggagacuuaaacuguuuaauuccaaaaucuacacucuuaaacaaaucgacuuccaauuccugcucccacccuccccuauauuucauaccucccugcuggcaccgguugcagaagcauaaccacaauaaugguaauaacacuuuauugcaggugucuggugucugcgugccagauuccuugaguuaaaucaucucuaacccucacauuaaccccacaagguugacaacacugccccuauuuuccaggggcagaaacuguggcuccaggagguaagucacuugcuccaguccaguagccaguacauggcuaacugggauuuccauccagguuuucugaccugaaagugguccccacacuuguccucuacuccacaccacccccuguuacugcucaguguccaagugcaaaaaggaacucagagggagcaggguucgugucacaugcucucggagugucaggcccaugccucagacuaucacagggcacaugcugugagcacauuuacucccagaaagccccacagaggacuccugucaccuuugacuauucuguguggggaacugccaccauccugauccagguucucaugugacuccaucuagaucccuguguauagaagaguccucucaaugcaagaagccuauaugcagucugcccaccggccccugacgcagcccuccccgcccaccgaacauccccccugccccuaggagagccaagcaucucacccaugcucucauauucagucuaggcauccuacccaaguauccuaauuauaaacuagccaccagcucaggcucuguaucccagucaccacccccauucaggcccccaacuauccagugccagaggcccucaggugcagagggccaguaagcugagguuggacucaggcugggccucccuggguguccccucucagguucagccaaaccaggacagacccagccacccuuguuuccagcccagccuacaagccuccugaaacccaccagucugaugguagccuccccucccuguucucccaggucccacacccagacaguccccuagaagcauccucgcuggcauggggaggagcccacccacagcccauuggccccaccuuauccugggcucuccgcacccacacgaacuguuucauccugugcccacaccccaaggggcagggaggugacaggauuaggcucaggacuccauggggguguggggauggggccaccuccccccugagucaaugggaacagaacuugggucuucaauaaucauguucuucccuccccuuccaggaagaaagagaaaucgccucccuccaaaaccaagcccaaccagaaaccuguccccacccccucaucagcugcucccagauccgaaugggauuugcagaaguccugagcacuggugguugguggggugagggaggggaggggagcuuugguggucuaaggugugggcagaaagagagaaaaaaagagaguaaggggggagguaucaaagccucaggcuggggaaugauguggcagguccagggagugccggcuuggagccuuuaccucauucucuagugggagauuggggcccagagaggcugggaaggagggcaggcaggagaagcagauuuacuucugucccccuccuccccgaaucaggcugggugggcuccagaguaggccuggcugcaggggaggcggcccacuccccagcucccgcccucaccccaaacaaugccgccucccccucccccucgccuuuauccggcggguuacuuggcagcagcggcuagagaccucccucucuccuccccucccuccuuuccccuccccgccggcccgcagcagcaacaggcccuuugcgcggcagcuggacggauggggugggggcgaggucugggccagggccugaggguacgggcacuaaggccgaggcgucgguaugcagggcccaggccugagaauauggacccccgacacacucaggcuggggucacaugugccacgggggauggggaaggggacggaagcccuagcucaguagaagaggaucuucaaggcccggggugaaucgggaagggacgugggggcggggaagcugagauggcacuaagcuggggcagaagggucaccccaacaacucccgcgcggggucccugcggcucccgacgcccgaugcguccggcacccggggugggggagggggcagcugucagaggaugcaucgcgagccuggagccgccgccgccgcagccuuuauuuuuaaacuuccaaguggucagagggcgcggcagcggagggguccccgcccagccggccggccucauccucggccgcccugcagccccuccaucuacccccaucucgccuccgcguggcucccggcauaccugggggugcgcccgcccccagcuccgcacgcgggccgcucuccauggcugcggcgucacugggggucucggggucucagcggcggcggcggcggcggccaguggccaggacaggggucccgcggcgcaucacgcccggcccggcccggcccggcaaguagcgacucggaggcgggggcgcuccggggaaggucgaggcagguggcccgcgagucucggaggugccggucgcccggggucucucggcugcggucgcgaacccguuccccgcccggcgccggcccagucccggccucggcccaacccuauuguaccgcccgggcu

SEQ ID NO: 14120 - RNA, 5332 nt, Homo sapiens
cacucaccccaaguuggagguucuaugguuuuguacuuuaagcuggugguauaauugucaagcauguaaauucuggcauucuuccugguacugcuagagcauuguuauuucuaugcauggggguaagaaggcucagagaaggauccuggcggauaccccagugagaaaucgucaguggcagccaguguguacauacguggaccuagcauuccucuggaggccaaguguuguaaauuggccuguggcuaucaucuggcagacucccuugggaaagagccagccagccccaugcuucuuuucagcagcaaggguuagggagguugguugaacuugaagagcagauuggacauggagcagauuuugaccaguugaaauaagacauaaauuuaugacuccgagugaggcagaaauaaagaacuuagcagggggaauaggaggaggaugauuauggcaaauuuugcuauaaacuuuaguuuuagaaaagauugauauugaaaagccuucaggauuugccugugguugcuacucaaguuaaaaagacugggagccugcauuguuugguccuggagcucaagguuuucagugaaggcuuguccuggcaccucugggcauuccuuuucauuacugguugagcauccuuccuucugcucugucaauuggcaaaauaugcuggagcacauucuggacuagcaguugccuugggguagucaggcuggguauuuguuugguaucucuugguguagcagaccccagaaucucauggcaauuaggauuugguggcuaaacgaaagaguuagugcaaggaaaagccuaguuggaauuucugagucugggccauccuuaagcugcugucuacugccugaaugggaaguaaugucgaauuggaaaauuagcucaccauuuuuguucuagcuuugcagacauuuauuccucugaugauaggcugagaaaugccuaggccggcuuagaaggcacacagcaugacagaaguacuccuucaaagcagcugugucaagaaggaagagcuggaaaaguggauuugcuggggaauuagaugcauuuaguuuuccacuuacgcacaacugccuucuccaguauaucauaccaagguuuuuuaggccuuuguggcuuacccugcaggaacauacuguguccuguuguucuggacuguagcaucuucaccaccauccucuuggcaaugguuuuuuguuugggguuuuuuuuuuuuuuuuuuuggacaaaguauaauaauauugagggaccuuucuagggagccuuugguccuuuguccccauuuuccaaagggagggaacuuuccucuuaaaagagacagugggaacuuuuagccagguuuuuggaaaaggccugugggcuauuaaugagagugagcugcaaaaggaggaaggguuuguuuggguacuuugaaguacuuagcuagguguuuucuacaguaucuuauauaauugcaucuuacagcaucuuuacaugcgaaauaguuuaucaguuaucuucaauugcauauuacaaaauucugauuaaauuuuucuuaaauaagaaaacuaucauuucauaugacaagaaauccuaauuuaauguuacuccaagguugguuaauucaguggcucagugauaacaccaaagacucaguuucuugaaauuuuuuugcucugccauccuccauguuuauccucacgccaguucgccucauggucccaauauggcuacuguaauucugggaaggaaaugcugacagaaccgugucuggcaaaagagagacagauuuuucuguguccuucuaaagcaaggaagucuuccccuggaagcuccaacagauacggccucauggcuuugcuagaaaugggucaucucacuccugucauuggcaaagcaaguaagaucauccaucaggaguggcuuagauuaaugaauuauccuuugagucguguagacuagaaaguucagucaugucuacuagcaagaaaggagauaagggcuguuggauaagcagcaucuggucucaaagguacuucaacuuuuacagaugagaaacaugaaucagagugacuuucccaggcucacagcaaguaagagagggccuucaguguuagcugugucugucccuaaagcccauguuuuauauuguaucuugcuagaguauaaaguaacuuacuuucuaccuuguagaaacugauggucuaggagaagagauuugaacucaggugcccaguugacucuaaucuuggcccaugugagaggauuguacucaguugcucuccucauccagugauguuucuugucuaacacaagaagccuaggaguagaaaguccuaagcagaguagaauaauagcggcagcagggagggaagugugaacugugugucccugagccugacuuacugggcagggacaugacacuuaaagcggcagcuggccacucugucuuuccugcaugcacugaguauuugguagcucauuagugaccagugauauugaucaucuuuucaugugcucacuuacuauccccauaucuuuguuguuugcaucuuuuacccauuguauuuguuguuuuugagacagugucucacucugucacccaggcuggagugcagucucaugaucgcggcucacugcaguuucugccuccugggcucaagcaauccucccaccucagccuccugaguagcugggcuuacaggcgcacaccaccaugcccagcuaauuaaaaaaaaaauuuuuuuuguagcaguucggucucauuaguauugcccaggcuggccucucuuagcuucaagcuauccucccgccucggccucccaaagugcuggaauuacaggcauaagccacaagccacugggcccagccucuuuuaccuguuucaaaauugaguuuuauugaguuguaagaguucuuuauucauuuuaaacacaaguccuuuguuggauauaucuuuuacaucuauuuuucccagucuguggcuugccuuuucauuuugaagagcaaaaguuuaaaauuuugugaauuuauuaaagcuccguuuguugcuuuuuucuguucuaguuuauacuuuuguaucauauuuuaggaaauuuugcacuggguauuugauggcuccugaggagguucaacuuucagagcgcacugauuucucugcaccugagauuuuguacuauuucuguauuucuuucuucucagaacaaccagugucaccagguaugagggcagaguuuuagcuuguuugcugagccccauucuugaagcucauuuauuuauucaccuaucuguccaucaauccaacaaauauacugaaugcugcuaugugccagguacuggcacuguucuagguacuggggcaaugacaguuaagauaauacccaaugacccugcucuguacccuuaagagcagacucaguugggaaugaguuauccaaauauaggguguacauguagucaggagagagccucauacagcuuugccuuuggcagaauccuucaaaccucuuugucuuccuacuucuugauauuacaaaucaugagccuuucacaugcauugacucuaaagagguggguuccuggauagcagaaguagauaggaaggcaucauugacauuuacugagauggauugaaucagaggguguaaauucugcuccaucaauguugaaaaagacuagcccaccccaaagguuuaucacugucaccaugucuaaugucuauucuggaagaagcugaagaagucugccuuuguuuagggaaccgguuccagaaucagagggguugaggauauaaaagacccuugcacaagaguugguauuuacccugucagaugcugcuaccaagauuuggauuguguacagucgaggauuaaaaaugacuuuuaagaugcaguguuucaucuggugacauuuaauuugauauuuuaaaauuggggaggguauuuucagccauggggguagggaugugaaagaagaagaaaguaagaauuggagucagaugugguuuugagucccauacauuuauuguuuaauauuauaugguaaguacuuuaaaaugguaaauaguaaauacuuguguuauucacuaacauuuggggaggauuuucucugugcuuuauguauauuaccuaaccuuacaaacuguguaagguacaugcuguucucucaauuuuucagauaagaaaauugaagcccagagagaucaagugacugauccaaagucccacagugaggggaacugaagauaggauauucuuucuccuuuuccucuuuaaaaaauuauuuugauuaaaaaaaaccguauuacugaagcauagggacauggggagaaauuaugaaugauuccucagccugaauaaaauaguauguuucauuaaggcaacaaauauuuauuaaggaccuaauauuugccugacauucaagugagguggggggcacacaaguaguaaauaaauaacagacugggcaaagggcuaccaaggcaauacuguaguagacuaacaggugccccaccauagaugggugguccggaaaaggcgucucagaugucuuucguugagacgcaaaaaaaagcugugggguagggcguaaggggaggguggagaagagagagaggguuccuggccaagggaaccaaaagcagagaagcuccaagucagaaaaaagcagcgguuggcccguugggagaauuggaagccaaccaguauagcuguagcacaggcggggcccauuuacgccgugcguuuucacccuggaaaggaguuuggguuuucaagugugacgaggcgcuauuaaagaguuuuaaacauggaaauuacucgaucugauguuuguguaguguccuguuuguuagucaucuuuuccaaacuauaauacauuuuuuuuuuccuaaaaauggucguuaaagcagccuaggacuuaggucaauugcgguggucacuugaccgccugugaggaggcggcgcgugggguggaucggacugggcguggcgggggcucaggaaggaggguggcccuaccccagcgggcucggcucggggccuccgcggcaguucgggguccuucacccgccggcuccagguaggcuacuccucagguaagccccgccgccagccgcgacgucgucgcagacaggcaccgcccccacucgugcggcgcgaguaguccugccccuccgcguugucuccggccggcacggcccggcgggguacggccgagcccgccgcauguggcccggcucccggacaccuccccggcguccuccgcgccggccgcuccugccccgacgucgcuccggcacggcucggggcccagaggcgaggcgaggacgccgggcaagcca

SEQ ID NO: 14121 - RNA, 362 nt, Homo sapiens
aaacucaagauuuuauugucuucauaauaaaagaugacacuuagaacuggaucacuuggcccuuucucuucuuaucuccucccaguucaaaaugcuugcaucuuuuaauagccagcauucucuuagaucugcaguugggcucaacgcacucaagccuuagcacaaucuucuuuguaguuuuagccuuuuuccggaaaaucggcuuaguuugcccaccauagccacucugcuuccugucauaacgccgcuuucccugggcguacagagaauccuugcccuucuuguacugugucacuuuaugggguuggugcuugccacacuucuuacagaaaguccggcggguuuuagggacguuaaccaug

SEQ ID NO: 14122 - RNA, 4193 nt, Homo sapiens
gggacaguccccuauguccucuguccccauccccaccaucaucuucaucacuacuccugguucccuuuccugauaccaguucuccacacacugccaaaauugcagccaaaauuccauggcaggccagagcagccacuaaaccuccuacaaguaaagccaacaucagggacaauagccucagcugagcaagucuggguuaagugagggaaagggaaaggagagguggccugggaaaucccaggagaaugggucagccacaaccuucagauaaaugacagcaugcuagcccucugucuccagggaacagugggacccaguggagaagaaaggcugggguaggccaugaggaacacaagguguggguggacacccacagugcagcuggauauguauuugcacacaccugcucaugagucugccuacaaacacacaugcuccuaacauacaccucccaugccuguggccaaacaugugcaccccugcacacacaagggcuuccucacauacaccuaauacaagccugcacacucaaacucacucauagacacacacaucuucugccuauacauccucacucaugcgcauauacacacacugcuggguaccugucuacacaugcacauaccgaguuccucauucuuacauacuacacacacacacauauguucacucuuacaugcucacauauaggucugcagauaaauuagcuguguguacacaugugcacacagcacacuuaagcucauuuauacaugcuuauucacacaugccuacacacaccagccuacauguuagcacauacacacucaugccuaccugcaaucaugccagcaaauuauguacuuacuagugcgccucacacaugccugcaaauauauacauauacccuugcacacuuguggaggcacacccuuaggccugguccuggggccuggauggugcugcccucugcuggagacagcgaauaagcuccuuccgguugucuaggauggugucgaagcucuccugcagucgggccugcuggucaaucaacugaugcugcaggccccggauccacuggagcagugccaggcgacgguacaucaccaagugcacguggugcuuuuccuucuccugcucuuuguagcgcuccuggacuuguaagugcugcacagccugggccacugagggcagaaggggaucgggagggccagggccucgcggggucccacaggcaggcucaggacugcugcuacggcugucaaugcucagggaacugcuggcauagccguuguccuccagaggggagcagacugugccagcaccacccaucuucucaggcucagccccgggaaucucugcccccucuggggggcugcgcaccccuuccucaggggauccaggggccuggaaggcuugguugucagagggugacucagaggagcuccuccucaggauagguuccacucugccuggcaucccaugccaauucucguuagcauccuuggcacuugccaugaaguuggaguugcugucugguuggagcucgggcugacauaauccaggaggugggucccccaggaauuggccccccucagcuagcccuggcuggauggcgaacaucuagccuguaaagggaaagcaggagaccgagucacaguaggacaggguggggugccugaagucagggcaacuuagcugcagggacaaggcugcaagcaagagccuggccacucccugucaagcccuuucucuugacucugguaacacuucccuucgugguuuucguccucccugucuaccuguucauucucagucuccugcaaaggguuuuuccuccguccucagagccaggcugucuucugauuuugugcauuucucuccagaggaccucauucucugcuguagcuucaaagaccaucauaugcuggugacucucagaucugucuucagcccagauccaacugcuauccaacccugcaaccaaccauagucuccucaaauucuacauaaccaguccaggcaugguggcucauaccuguaaucccagcacuuugggaggccgaggcaggcagaucaccugaggucaggaguucgagacuagacuggccaacauggugaaaccccaucucuacuaaaaauacaaaaauuagccaggcauggugacaggcaccuguaaucccagcuauuugggaggcugaggcaggggaaucacuugaacccaggaggcagagguuucagugagccgagauugcgccacugcacuccagccugggugacagagugacaucaucccccuccaccaccgccccccgccaaaauucuacauaaccaaacaagcucuccuucaguauccucagcaagauggcucuguacuccauccagaaagcugagagcauccugggguccucacuauccuuccuucucccaucucauuaauaaccacauucugaccauucuuccucuuccaggccauuucugaccuggauuauugccucggccuuuucacugaucucucugccuccaguuaaaaauguaaauuucacuugucaccacuccuaaugcccucccugaauuccugcuaaaccucuaccuggccuacaacacccuguuugaucuggccccugcucaccccuccauaccugccucuugccacucugccccucccaucauagcaaacugcccagagaucucaaaacacaccauuguuuuucuuacaguauuccuuuggccuacaauauccuuccucuccccuccccucaaagcuccucccuucuccacccagcaaauuccuuuuuguacuucaaaauuagcuguaauauccccauguuuccauguccccaugucucugaagccgucuugauacugccccaaucaauauuacauaaacaagcacgguuaguuaugccuuccucuggguccccacugcgcuggguauacacugucuuauccaacuuugcauccgucccuggcauacauggucgacgaucagugaaugucuauucaacuggcauuuuugguuugugguaaugaucuuguaauagcaguuuguaaucuggcuuggaccuccuguauauauccuccaucauauuccccagagucagccagcauagagcccugaaccaggcugucugugcauacagguacuugcuaagugagugaaugggagaagagacugcagugaauuuccaugcucaggaauccacucuugacuccccagggcuggaagagcuggguucuggaagagcuggguuugguucccuuuccuaccccagccagggagccccgccuuccccagugacaagcuuuucuucugagccugcccccuucccucccaaugccucuggaacacagccacuaucuugcgguccccgucccuagcuugcuccauucugaggcccuggagggagggcauaccacaccacucuucucuccuccauaaccugcuucuaaccaaaauuaggauuugaacugacaaagggauucuacugaccaaacagcacugggauuagaacaauugaagagcaugaagaggaaggguauuguaaguggagccggcacuggaaggcgcuccauagguggcauggacccuccccacccccagcaaugggcagagaaguccuggggagaaggguguaggaacaguucguuucuaaucgcccucuaagcaaggcuugugggaaggugccuagagaucuccccucgccccaauuuuuuauuuuuccuauacuuggauggggccgugaaggaagcugggaugggguggggguggcgcuagggaucacaggguucucagagauaguaaaaugagaaccccgacacgccaggacuaggucuccgcccaaacaggaggcagccuccuuuucuggccuugcgggagugggagaccaccccaggagacagagaccauccuucccuagucuccucgaaggaggccacugugacuccccgcuucccgcggcugagccccaagccccaccccgccucgggccccagacucggacucacggcguagaggcgcccgcuccggcgcgucuggcucuggcuccgcccggcccugguggugucuagucccugggcuggggguuccucggccugggcgucuccgcgguccaggcgugggugcggggcucccgggcagcgcgcccagccccagucccggacugcggagucaggcggcgucugcgcagcagggcggagcgaccggucccacg

SEQ ID NO: 14123 - RNA, 38417 nt, Homo sapiens
ggaagucgugcugcaggcgucgcgccaaucuucgcucugaggugcugucucaccggugagaccuggaagcgggcgagucucgugcugugucggaccugcagccccuggccuuccgccaccauggaguaccucaucgguauccaaggccccgacuauguucuugucgccuccgaccggguggccgccagcaauauuguccagaugaaggacggugagaggaagcaggggaggcccggccaggccugggguguaggagcggccagaaggaguuugucggggguugaauaaguaccagggaggaucugagagauggaagccggccugcccugcccguacuuauuuuauuuauuuauuuauuuuuucgagagggguuucgcucuuguuguccaggccggagugcaauggcgcgaucucggcuuagcacagucuuugucucccggguucaagcgauucucgugccucagccucccgaguagcugggaacagauaugcgccaccacgccuggcuaauuuuuguauuauuaguagagauguggauuucuccauauuggucaggcuggucucgaacucccgaccucaggagauccgcccgucucggccuuccaaagugcugggauuacaggcgaaacaggcagacaggucugggaccuuggcauuugcuccuccagggcuccugggucagugcucugcucuggccuucgcuaaaugcuucuugcuuggugagaguugccuaaagggaaucaguuuauaaauguuuaagcgccugcccagagccuggcucucuagauccccgaaucucugauaaguuuccuggugucgcuaguaaugagguuaguuuguuggcggcauaaggugggauccugaggagagugagacugugggacuggcucucuagauccccgaaucucugauaaguuuccuggugucgcuaguaaugagguuaguuuguuggcggcauaaggugggauccuggggagagugagacugugggaccagaagcuuggcauuuuccuucuucccguggcucccgauucuucuuuuccaguuuuccagagcaauggcugccagguuuuccuuauauuuaaguaguuaauggaguuaagagauuggagcccugucauuuauuugccuuaugaguuuguauaaguuauuuugcagugcccagauuuccucaucuuuaagauuagcaauaccaaacucacaaacuugucgggaggauuuaguaaaugaguuaugugcaaauccuuagcacuaggcagguacuuaauaauacuaaguguacguaggugcccaaacauauuugucaaaugaccauuaagucaucugaaccaaagcuuaauacuuuuucaacaguagcacgucuuugaucaguuaaggaaaacaaacuuagauucugcagaaaaacaaccaaaaucuucuuaaaauuauguauugaguaauuuaguauagauaguauaguauaguauaguauaguauaguauaguauaguauauuauaguacuuaggggcaaaaugucuggacucacugcauagguugaacccagguucugccacuugugaccuuaagcaaauuucucuaacuccgugcccuagagcuaacaucuauaaggugguaauguaauagcaccuaucucaaaagguuaaugaauuaauguaaaucacuuaacauagcaccuuauacuuuaugaaauucuaugauuaguuuguagaaguuuuguuuguaagccaguccuuccaaaggagugaauuuguuuugagaguaaauuuguccauuauuuugaauacuaaggucuuugacaagcaagugauuuuaacauuaagucaugucuagguagaacaauaaucauuaucuuuacaggucuuuuguuucaucccaaauguaugugaaaucacauugaaaaguagaaugugcuuuaagccuacuuauguacacaguacuuuuagucauuauaggggaugcaguauauuacuuauaacccauagaagaguccaagacauuaagaaaacaaggaaauaaaugcugcaagaugauuuuauauaauaaaagaaguauuacuaguuaguaguagguugguuuuuaaauuaaugaguucaagagcaaauccuaagaguaauaaaagaaagauaacuaugguaugggagaaagaugaauuugaguuaguucuugaaaaauaauuggaaauaguugcacucugcacauuccaauuuucccuauagucuuuucugguauaaaacaaauuauaauagaaauuuuaguauuguaugaugacuuuuuuauuuauuuuauuuauuuauuuuugagacagagucucgcucugucacccaggcuggagugcaauggcgcgaucucggcucacugcaaccuccaccuccuggguucaagcgauucuccugccucggccuuccaaguagcugggauuacaggcgcccgucaccaugcccagcuaauuuuuguauuuuuaguagaaacgggguuucaccaguuuggccaggcuggucucaaacuccugaccucaggugauccaccugccuccgccucccaaagugcugggauuacaggcgugagccaccgugcccagccgucugaugacuuuuuucuaaucauucauuucacgauggagcuuguuuagaguaggcaagaaugcugaaaaaauaguaaccuucugggacuccuuucuccaaguauaaaaugauaauacaacuuccaaucaauuguccaguaugucacuuuguaaaaacauuuugauacuauagaguagacauuugcugaggauugccaccuuauuaagugguauaacuuuugguuugcuuauaugccgcauuucaugucucuuuucucuuggccuauguagaauugcuuuuaaguuacucggaguacuccagcccacacagaauucucucuuuucugaauuccuauagcauguauaauccgaacuacauuaucuaacacugaguaucauaauauuggacauguauagaauucauuaguuuuucucacuugugaguuagacagggguaagucauauuauuaacauuucacacauuuggaaauaacauuucacacaucuggaaacuggggcuuagagaggacaaguaauuugccgaaguucagagugccaaguccacaucauaaccaaggucucuuggauucuaguucaguugguuuuccacaguaugacaugcuaauguuguucauuuuguuggccauuuguuucauguauguggaucucguaaguuccucgucaagaaucagaaauuccccagagcuacacaggcaguuuccuguacaacucaggggucucuaaguaucuaucucuuguguuuuuauuaaauauguugcccucugcuacucauuggacauauucaguguuuaaaaaacauuuuuggccuuguauuaagcuaauuuuaaaguugaacagguuacugccuaggauuuuagccuuucuucuaagugugacauaaguucuuuguaaacaagcucccccuucaaauaaaaauaucuuuuuucuuauuauaaaaauaaugcgaacuuauugaauaaugcuuucuuauaaaagugaggcauguuaaguauagaaguuuuaggaaaaaccaacaagcaaaagaaggaaacgaaaacugcccauacucuuaccacuggcaagcacuuagaauauacccuucugcuccuuuuucuuugcauagauaauauaagugaauguuuuucguuuauuaacaaguuugcaaacuaacaaucuuuaaaucuagccugcauaacaaauaaaaguguguuuguuuaggaguuuugaggcaauuugauauuaucuacaggugcauuuuguguguuuuuucccuccaagucuaagaagccauauuacugguaucuacaacucugaaacacuuguaaaguauuugacaguagcauuuuguucuuuaaauccuauuaaaggauuuuggcauuucagaagcuuucaaacaggaaacgugucucccagggaggauuauucagcacuauuugaaaaaugaaaagugaaagugaaagugagauaggaagauuuaggccuuuucugaagcugcagacugaauguggaguuuucuuccuuaggcaauaacuguaaccugaauauuuauuuaucugucuaaucugaaugacucugguucagcuagauaagauuagaguauuaggauuuuugugagguauuuuaaauagcuuacugucaaaauauucacuagaauuuuugcuuuggcaaucauuuuaauuuucucuuuuucuuuggaaguggaauuuguuuacuuuuuaaagugauuaauauucucaguugauuuucuauucuuucuugaaaugguuccuuaauuuuaauuauagcaccaguccuuuucauauaugcuuuuguauguguauaaauauaauaacuaacauuuguaguuguggaaacauuuuagggcuuuguuaucaugagccuaaagauaaucgccauuggcuggauuccuucaguuucuucugucguucuguuccuugcauuucaaaugccuuuaaaugcuuuaaauuguauuuucaauugguagcuuucauguauauucuccaaccgaaauuggcauuacacaauaugcugaugguuuaacaugaagagugaaagagaaaaauugauaccauuaccuauuaaaaucuucuaaaagcaauaauuaguuaaauuauucaauauacagucgucccuugguaucuguagggauugguuccagaaccccugcagauacccaaauccauagaugcuuaaaguccauuauauacaugguauaguauuugcauauuaccuaugcagguacuccuguguacuucaaaucaucucuagauuauuuauaauacuuaauaugacauaagugcuauguaaauaguuguuauaccauauuguuuagggaauaaugaccagaaaaaaagucaguacauguucaggauagaugcaagcauccauuuuuuuuuuuuucugaauaauuuugauccauaguuuguugaauuguggauucagaauccauguauauggaaggccaacuguaguaauuaauaaaccuguuuaugguuacauaaauaaugacggucaaugucuguuaaggcaguuucuaacacaguuuucuucuuugagcagaucaugacaagauguuuaagaugagugaaaagauauuacuccuguguguuggagaggcuggagacacuguacaguuugcagaauauauucagaaaaacgugcaacuuuauaagaugcgaaaugguggguaagacuuacaguuuuaguuggcauaugaguuuacuagggcugccauuacuaaagucacagacuggguggcuuaaacaacagaaauguauuuucucacaguucuagauguuagaagucaaagauuaagguguuggcagcguugauuucugaggccucucuccuuggcuugcagauagccaucuucucccugugucuucacgugauuuuucucuuuguacuauauccaaauuuucucuucuaagaauaccagucauguugaauuaggaacucauuuuaauuuaauaaccucuuaaggaucccuucuccaaauacagucacauacuaaaguacuagggauuaagacuucaacauaugaauuuuugguggacaaaauucagccuauaacaauugguuugucuuuaaauuugaacugaaaaauaauauucuuuaagacuuauguggucauauuuucuuuuuuuuuuuuuuuuuuuuuuuugagacggagucucgcucuguugcccaggcuggagugcaauggcgcgaucucugcuuacugcaaccuccgccucccagguucaagcgauucuccugucucagccuccugaguagcugggacuacaggcacgcaccaccacguccagcuaauuuuuguauuuuuaguagagacaggguuucaccacguugaccaggauggucuccaucucuugaccuugugaucugcccaccucggccucccaaagugcugggauuacaggcgugagccaccacgcccagcccauauuuucauuagaguuuucuguguuuaagaaguugucuagacccuaaagauucuaauccuucauaaaagauuuucuacaaaaauccuagagcagagaacuguuguaacacugauagcugauagauaaaacuaacaccaucggccugguaugauggcucaugccuguaaucccagcaauuggggaggacaaggugggaggaucacuugagaccaggaguuuaagacuagccugagcaauguagugacaccucaucucuacaaaaaaaaaaaaaauuuuuuuuuuuuuugagauggaguuucacucuuguuguccaggcuggagugcaguggcacaaucucggcucaccgcaaccucugccuuccagguucaagcaauccuccugccucagccucccaaguagcugggauuacaggcaugugccaccacgccuggcuaauuuuguauuuuuaguagagacaggguuucuccauguuggucaggcuggucucaaacucaugaccucagaugaucugcccaccucggccucccaaaguucugggauuacaggugugagccaccacgcccggccuucuacaaaaaaguuuuuaaaaauuagcugagugugguggcaugcaccuauagcccuagcuacucaggaggcugaggcaggaagaucguuugagcccaggaggucgaggcugcagugaguuaugauugugccacuguacucuggaaggcagcaagacucugucucuaaaaaaaauuuuuuuaaaccaaccaaaaaaaaaaaaacccaacaccaucuuggagguagggaugguaguaucagacuuuuuaaguguuagauaucucagaggaugugguuugaguuuaaaaguaucugaaccuggccaggcacaguggcuagcaccuguaaucccagcacuuuugagaggcugagaugggaggaucacuugaggucaggaguuugaaaccagccuaggcaacaaagcaagacccuggcucuauaaaaaauaaaaauauuuaccugggugcaguggugcacacccauagucccagcuacucaggaagcugaagugggaagaucacuugagcccaggaguucaaggucucagugagccaugauagugccacugcacuccagccugugcgacagagugagacccugucucaaaacaaagaaacaaaaaaaucugaaucucagcgucaaaaaaccuaaguaaaccuuggcuuuacuauuuuuuaugugauaagucauuuaucuucucugggacuuuauuuuccuuaucucugaaaugaauuauaauacuaaugaauaauacauaugaaaauauuuuguaaaccuaaagcauuguguaacuaacuauaaguauuuacugugccauaaaaggguucugccuuacucucugguagguuuccuucuagagagauaauuaagacuuuugugaaguauuuugugagcucucucuggggcuaaugaacucuuauccacugggaaaaccucccuagcaaacgauacuagccacuaggccucugauccaggaauguuuguagugguggucuggcagagaaaaccuuauuuccacuuaccucacaguucaauaacaacguuauacacugcacugguauaauauggagcuaugaaggaaguuaauuugaauauacuugcauguguaaaaugaccaaagaucuauucacauaguuugggcaguggauuuagcauuuguauucaauuccauaaauacuuuugagggccucuucuaugguaagcauucugcuuaauacuuaagagaauucaaagaugaauaaggcuuaguccugacauucaggaacauaaaguacaugguacuuagguuuaugcagguuuagaauauuucaagaauucugcuuuuuuuuccagugguuccacuuuuugccugcauaacaaaugaaguaugucaguaaugcuucugaaguccaguagguacuguaugacuucacuggcuguccugagagagggagaagagugaacaagaguagcaagaguuguuuguuacuggguuuuagggucuaaagucagugcacagacaaaaacuguguuugguuaaaauugcccuuaaagacccuuaaauuaccugccaaguacaguuuuguguauguaacucuauauaguaauucuuauauaaguuaaagaacugagcuaaaauaagggaaagaaagagaaaaucuauaugcagauaaucaggcaugacuuuucugccuuuaggauaauggucagaucuucagugguguuuaggggguuaaguaaagaauugaauaguauucccacuugucuagguuccuucuuuuuuuuuuuuuuucuuuuuugagucagggucucguucuguugcucagauuggagugcaguggugcagucucagcccacugcaacuuccagcuccugggugcaagugauucucgugccucagccuccugaguaguugggauuauaggcaugcaccgccaugccuggcuaauuuuuuguauuuuaaguagagacagaguuucgcuaugguggccaggcuggucuuaaacuccuguccccaggugauccacccaccugggccucccaaaguguucugggauuacaggugugagccacugugccuggccucuuuuuuuaaauuauuauuauuauuuuuguuguuguuguugagacagggucucacuccugucgccugggcuggagugcaguggcacaaucauggcucauugcagccucgaauucccaggcucaggugauccuuccaccucagccucccaacuaccugggaaaacaggugugcaccaccaccccuggcuaauuuuuauauuuuuaguagagacgggguuucaucauguugcccagaauggucuuaaacuccugggcucgagugaucugccugccuccgcuucccaaagugcugugauuacaggcaugagccacugcaccuggccaaggauugcuuucauuaugauuuaauaugcacuaauagacuugugaggauaaaguacaauaauacaugugaaaacacucagcauagacccugaaacauaguugcugcucaauaaauauuuguuaggauuugaaucugaaucucuccuaauuugacagugguauuugaaauguuguaagcaauuacuuaaccacacugcugugugucuuuccauacugacauuuucugugugggcccacugaguuauggaucauucuugugccuuuuggcacuggucccauucuacagggggauuaagcuccaaagugaaugcguuauuacaugcacaccugaugcuauuccucuggguuguaccuuuguugguaugacaacuuuuauuuuugaaguuuuaacacuugagauacucuauuuuuaaaaauacugcagaaugauggaaauguucuuuuucuguggcuuauacuuuugaaagucauauuauacuucuuaauaaaguaacauuuaaaauauuuuuuuaauaaacuaugacucugagguaguccuaacuucuagccucucuuuucccaauauccuuuuuguuccuguuuucguuuuuuuagagacagggucuugcucugucacccaugcuguagugcaguggcacagucauaacucacuugaacuucuggggucaauugauccucuccacucagccuccuaaguagcugggauuacaggcauguaccaccaugccuagaaauuuaaaaaaaaauuuuuuuuagagaugggggucucacuauguugcccaggcuagucucaaacuccugggcucaagcgaucuucccaccuuggcuucccaaagcucuaggauuacaggcaugagccacugugacuggcccccaauauccuuuuuaaaauaaacuuuuaaaagauuggcaucuaagacgccuuucuuuuuuuuucacuucuuguguauucguguuccuuuccuucuacggcagaaaccacaguguguugaugaaugaauaguuuaagcaaggcugcuagaaguuucauuccacuauagaacugguucuguuuguggccaagaauugcugucaguacuaaccagcuauuucauagcuguugcaugaggaaagggacuagaguaggauuguaccccucagucuaugcuuuguuuacucugaguguacaaaagauggugggcuuuaggaacagggguagugaauaauuuggggcacuguuauuccuucugcuuuacuuuaaguaugacucuuuaucucuucuaccaggauaugaauugucucccacggcagcagcuaacuucacacgccgaaaccuggcugacugucuucggagucggguaaguaauauaucagacauuguuagauagagcagaaaaauccuuugugcuucuuuuauauucucauuauacaugaguaguauuuuugcccuuuuuuggccuuccagaaccccuccuguugcuacuuguucauucuuaaguccaaugucuuugugcacaguuguuauuaauagguacagcccaaagggcaaauauucauucccagagaauugguugggacacaccaauaugaaggccugugacaacuuacccuuuuuuuuucccccuaaaaacuauuuuuuagagcaguguuagguucacagcaaaauugagaagaaguauaaagauuucccacauuccuccucacccacauguauagcauuccccauuaucagcaucuuccaccagggugauacauugucacaaaugaugagccuauauugacaguaaucacccagguccauaguuuacauuaggguuuacuuuugcuguuguggauguuauggguuuggacaaauguauaaugacauguaucuaccauuacaggauacagaguauuuucacugcccuaaaaauccuuuguacucuacuuauucauccuucuccauccccacaacuccugacaaccacucaucuuuuuacuuucuccaugguuuugccuuucccaucaugucauauaguuggaaucauggauuaugcagccuuuucagauuggcuucuuuuauuugguaauacacguuuaagguuacccuaugucuuuucauggcuugauagcucauuucuuuuuaacauugaaaaauacuccauugucuagauauacuacagguuauuuauccauucaccuacugaaggacaucuugguugcuuccaaguuuuggcaauaugaauaaagcuaauguauacauccaugugcagguuuuuguuugaacauaaguuuuuuuuugcguaaauaccaaggagugugauugcuggaucauauaguaagaguacguuuaguuuuuucaaaguguuuuuguaacaaaccauauuacuuaauaccugugacugaaagucucuauguguuagugaaaguagaacuuugaaaauaauaauucagauuauuuuuauuuuuauuuuuuugagauggaguuucacucuuguugcccaaacuagagugcaauggugcaaucuuggcuuacuggaaccucugccuccuggguucaagugauucuccugccuccauuucccaaguagcugggauuacaggcaugcaccaccacgcccagcuaauuuuguauuuuuagcagacacgggguuucuccauguuggucaggugucaggcuggucucgaacuccugaucucaggugaucugcccgccuuggccucccaaagugcugggauuacaggcgcgagccaccgcaccuggccgguaauguggauuuuuaucucgagauugcuuaucuguguuucucuuuuuuucuuuuucuuuuuucuuuuuuuuuuugagacggggucucacuccaguugcccaggcuggaguguaguggugugaucucagcuuacugaagccucaacuucccggguucaggugauucucccaccucagccucccaaguagcugggacuacaggugugcaccaccacaucuggcuaauuuuuuguauuuuuaguggaggcaggauuucaccauguggcccaggcuggucuugaacuccuggacucaagcaaucugcuggccuuggccuuucagggugcugggauuauaggaaugagccacucacuguaccuggcguacuuaccuguguuuuucuaugacuuuuucccaaagcauacagcauuguuccuccuuacuuauucuagccuuguugcuauucuagagcugucuccauuucaucgacagcauguuaaaagaugcaacacuaaguuaaggauugaaugcauuaaagauuguguaggaugugcuaggaaaguucauaugguugcuaaagguguguguuauucccuucccacagggacuaaauaaauagagccuuaccacgugaucucacccccugugccuguuuacuuaucuaugaaauggagauaacuuccuaaccccacaggggugccaggaaaaugaaugcuuguaaaucauaauauuuaacauucaugugacuuuugcccaaagcauuuugcuuaauaauuuaaucuacucacuauuccacugagaaagauagucucuaucacugagaugaagugaaaggcauaaagugucaaagggacuagcuccaggucacacagcaggucagacaaagcuaaaauaauggugccauaauuauuugacuauucugccuuugguucuucaguaguguuucuagaacacugaugcuauucauauuuuuauuaugguuugaguuuucaucuguacuugcuuaaaauaacaaguuacuuuuuuuaaaguuacuuacuacagaucuauaaagcaguuuauuuucuagugccuaauaaucuuugacugauaauuucucaauaaauaguaccucucagugcuagcuuugaccaagggcuuguacaaucugagggaucaugaaguuugaagagaagcuagagacauguaggauugagaggaggaggcaaauuuacauacauuguuuuguccugggugaaagaucaguagucuuuucuuuaaaaaaaaaaaaaaaaauauauauauauauauauauauauauauauauauauuuuuuuuuuuuuuuuuuucuuccaagaaagucauugucaccaaguggucuuuucuucacuccuccuugagaaaggaaaaugggucagauauuaguuuuucugucacccagaaguuccugugguguucagcauuuuaugacuugccauguacgauguuccucugacuuaucaggcagaaccggaguaagaauuccagcuuugggcacaauaaauacugugucauaaauaucacagacauuaagugaauuaagcuccuuuuuggaauugagauaagaauggcagugugcuucaugcaaaugcagugaaucugguuuaaucuucuccuagcagaaauguuugaugucuuaacaaauaucccuuguagacagugacauggggcucugguaaauauugacuaccucugccugagcuuuuccaguagguccaaucucugcucccccaucuccuuaucaaaauagauucuuaguucuaaaauaugaauuuauauuuuagucgucuuauucugggaagagagaugauaguuugucaguguuccuaauaagugcaaagucaccaaauuuaguauauuuauauggucacaccaguuggcagaugugacucauuuugggucagccaguuaccauguauaacuucugugucuguagcucaaauuguuugauuucuaauuugcucuguguauguguggugguuugguugggaggacauuuacuaccacugaguauauaaugaaucuuacauaaacugguucauuaaaauguaggcaauuuagcauugugguuaagagcauagucucuggaauuggacuaccuggguuugaauauuugcuuacugacuuacuagcuggaugucuuuggacaaauucuaagcuuaauuucccuacuuaccaauuucaaaaaguuauuaugaagauuaaauaagguaauaaugcaaagcucuuacuuuuuuuuugagacaggaucucacucugucaucuaggcuggagugcagugguaugaccacagcucucugcagccccuugaccuuucaggcccagaugauccuuccaccucagccucccuggcagcugggacuguaggugcauaccacuaugccuggcuaauuuuuuguagagaugggguuucuccauguugccaggcuggucccgaacuccugggcucaagcaauccucccgcuucugcuucccaaagugcuaggauuacaggcaugagccaccaugcccagcccacuuguguuuuuaugcugcgauugcuguuuggucaaagaagcaauuuaauggcuauaaguuaguuuuucgugagggaucauuuguugugcuuuuuuuuuuuuuuuuuuuuuuuugagauagggucucgcucugucaccuaagagguggcacagucacagcucacugcagccucaaccucccgggcucaaacaauacucccacuucagccucccaaauagcuggaacuacaggcgccaagccaccaugcugguauugauagggaaaauagaaguaaaauaacauugaacauauauuaugugcuaggauuuuucuagaucuacacaguccaguaugguagccaacuagccacauggggcuauuuaaauuuaaguuaauuaaaauuaaauaaaacuuaaaauucaguuucugguggaaaaucuccugguagacuuugccugaaugcuaaaucaacuuuuguucuuaaaaaaaaaaauucuguuccucagucacagccacauuucagguacccaauagccacaacuauuguauuagacaucacagaucuggaacauauccaucaucauagaaguucucuuggacagugcuauucuaaauacuuacauauguaucuguuauuaaguauccuuauuaugacaccauaagauguguguuauccccauuuuacuuacaaggauguuaaguauuucucuuagauauguuuccaaagcacauauauacuauguuaaagguuaagauuccagcuucaaauaucaaacucuuucauggugucuucuuuauuaauuaguggacuaauguacaaguguauuugugcauuuagggaaacaugaaauguucaguuuuguuaaaaugucgaaauugcacauaguauuauauagauaaguuugaauauauguccauuguagguuuucaauaaguguuugcugaaaaagugucauccagcuaggucuauauauucugcugagaauauuaauuaugcauuuauacacuggaagggaauucuuaaugaauggaauaccggaagaaguauucuuaauaaauggauguuaauuuguauaggaauuaaaggcaugaaaucaucagaagacgaaaaaagacagauggggaaaaaauucagaagccuucaguuuaguuguuuauuuaaaugcuuguauacauuuaagauggucucuucuuguugguuagaccccaaagagcagaaaaagggcuuauacuaugcucaaggcuugcuuucuucggccaggcacaguggcucaugccgguaauccuagcacuuugggaggccaagauggacagaucaguugagcccaggaguucaagaccagccuggccaacauggugaaaccccaucucuacuaaaaauacaaaaaauuagccagaugugguggcacacaccuguaaucccaguuacucaggaggcugacgcaggagaauagcuugaacccagaagguggagguugcagugagcugagaucaugccacugcacuccagccugggugacagagcaagacucugucuaaaaaaaaggcuuccuuucucaaauucuccuuacaguuugacuaaugucagaggaugaugaguuauggggcuauuucuuuucuuuuuuuuuuuugagacggagucucacugugucacccaggcuggagugcaggggcacgaucucggcucacugcaagcuccaccucccggguucaugccauucuccugccucagccuccugaguagcugggacuacaggcgcccgucaccaugccuggcuacuuuuuuguauuuuuaguagagacgggguuucaccauguugaccaggauggucucgaucucuugaccucgugguccacccgccuuggccucccaaagugcuaggauuacaggcaugagccaccaugcccagccuauuucuuacuuaaaaugaauuauguggcauauuugauguagcccaucugaaugcccuaaaauuaucuccauuuaacagauagagagacagguauaaaccaggcaaaucugguguccuugggaacgugaaauuuuguggcaaggcuuagaguaggaugcuggccuccaugauguguaaucgucggguuucacugccacacuggccaaagaguuuucauuagaacuuuuuccgaaguguuucaugagccuuugguaauuuaucuuuuuaccuauuuauuuguaaaugcuuagcaaguaaacaguagaaauaauaaguugaaaagauauccagccugauguagugguuuucaaacuuuauucugugaagcugcuucaggauacucaccaaggaagaccagugugcaaugcuuuuuuuuuuuugagguggaguuucgcucugucacccaggcuggagugcaguggcaugaucucagcacacugcaaccuccaccuuccaguuucaagugauucuucuuccucagccucccgaauagcugggacuacaggcgugcaccaccaugccuggcuaauuuguguauuuuuaguagagacgggguuucaucguguuagccaggauggucucgaucuccugaccucgugauccacccgccucggccucccaaagugcugggauuacaggcgugagccaccgugccuggcguuuuuuuguuuuuguuuuuguuuuuuuugagacagagucuugcucucucacccagucuggaaugcagugguguaaucucggcucacugcaaccucugccuccuggguuugagcaauucuccugcaucagccuccugaguagcugggauuacaggcaugcaucaccaugccuggcuaauuuuuguauuuuucauagagacgggguuucaccauguuggccaggcuggucuccaacuccugaccucaagugaucugcccaccucagccucccaaaguacugggauuacaggcaugagccacugcacccagccaaguguucagcacuuuagcucugcuucauauagcucaacucagcuuuuaucuauuugauagauaggaauucuagguaaaguuuuauuugaaaaggugccaucacuguucccuuaccaccaaagagcccugcaauaggaggguuaauacuagcucugcugugaguuaguugaaaaccuugggagaaagcaagcauuugauuggaugguuuuuaggguuuguuccagcccccaaauagcaugauuuaaaaaucuuaugucaagaccacaaccagacuugaauuuuuauuuauuuauuuauuuuuuuagggaaugggaaagaauauguaggaaaggauuucaggucuuagucauuuccagcagugaccaaagcuuauccccacacucuggccuuaauucaaggcuguuuggucugguuaguaguaggcauguauagcaugcuccuguccuagaagaaaccuguugcuuugagccuucuauucugaccaugagaauuauucuucucaugccuuagguggcuggcacaaaggcaucaucuguuuauugguaucagugagguccugugaacagauggcccaggugaaacccugacuuugcaagucuugucccuuauacacuaccaaccauuuguuacaugugauugaaauaucacuaacaaggguaauuucacaugauuuuuggcaaacgugguuagcaggaugugacaugacgcagcacugccuucuuccuccaugugccaucucccuugaggccucaucuucucuacuugcccccgucucacccaugccgaggcuugccuucagcucaccugcuccagaugggcagcacagugggaggacacuggcaaaggcagauguguuuauuuuccggagacaaaauguugugcugcugcagauggcagugccuuggagcaagaggcagccuuugacacugcugccacacagccugggcaucuugacagacagagccagcuuacuuuuggugaugcggaaauucaaaaauaaaaaacgaaaaccaagauguucauuaugcagcucuuggacugucagugcaagcagcagcccuuuuagaccuggggagcaguuuucuucccuaccaaaccuuagucagcuagugagcuaacuguggauugucacuguaggccaagaguuacgugucuguucauuacuuuugucucccagccuuaacaggacauaaaguaaaaacuggaaacaaauggcuacauuuagauggauacucaguuugguucugcaaaacauauguguaucccaggucccaucucacaggagucucuuaggauuggggguggcucauguuggccccauuggagauaccgcuguucuguuuuuaguggucauuuugauuauccaaagacccagagacagaugugccuugaaguugaggugucucaauuaauaugacaacacuuugugcuuauaguguuuuucuacuaggaggaguaagcauucugacagcugcccuuuuaagcaguaugcguaugcauuaguuaaagcuugacuaaguccauuaggaagacaaagacuggcuguugaaucauuacacuuacuaggauccuaaaaaaaauaacuugggaagauuauuugaaaguuacuggcuuuaucaggaaauuuuuuuuucuuuuucuuucuuuuuuuuuuuuuuuaaaugugcuguuuuuccuagcccuagcuaguuaggaguuugcagguguaaaguccucccccuccccuucccugucucucuccaggggguuguaugugagaagguguugcuuucucacucagagagcauauaugugcuacccuguuggaugccugcugcgagcccagagaacccccgugcucauugaauggaauaagccuauuggauggcuggaauuuugcagccccauaaugccaacuuuucacuuaaagcaucuuuccuauccacaaugggagugaagcaguauauguacuuggucuagauuuauauuguuuuaaaacucgugucuuaaaaauuuugugauuuccuauuaagguuugguuuaagccuaaggcaggauagugcugugucugcuuaguaggaaugugcuuuuacuuuuaaaauguuuacuauuagaagugcagauuuacccccaacuuuuaagauugcuuuaaaucacuugccccagucuggguaggcauaggugugggcaugcccucccacauacucacagauacaaacacacacaauauccuggcaucuuggugccucuuuuuaccugcccuggcccaagaucauguaggaauaugaauuuaggggcugaucucaacaaccucaugagguuuucuuuacucucucccaaaaaacaguuaccuaaaaugaagggcagugggaaggcuuuucacaaggggaaagguggauuuuucuauuucuugaccugagagguuguuacguguauauuuacuauguucauucgcuauaccauguauauuuuaugcuuuuuuuuuucuucuuuuugagacauagucucgcucugucgcccaggcuggagugcaguggugcugucuaggcucacugcauccucugccuccuggguucaggcaauucuccugccucagccucccgaguagcugggccuacaggcacaugccaccauaccuagcuaauuuuuguauuuuuaguagagaugggguuucacuguguuggccaggcucccgaccuugugaugcaucugccuuggccucccaaagugcugggauuacaggcaugagccacuacgcuuggccuauuuuaugcauuuuuauguguaugaguuauuucauaaaaagcuauaagaaaaugaaaaggaagacuaaaagggugggaaaacauauuacuuuuuaaccuaaaaaugaaaaaaaaagggccagauuuaccauuacuuuugaauguagacaacagagcaaauaggauuaacugauuggaaagaagaaaggagauaauagucucugagucuuuguaaacugaaaugauccagcagaauucuacacuuccuuuucugacgcuuccugauggaugugguuucuuacagccaggauguuccauaccugcugauauucauucagccagucuccagccugcauuguccuuggggcugaggaaacaaaggugcacaccucaaugugggccuucagauggagaaauggaggaguaaacagucaauugcacugcagagugacaagugcuaagauagccauauacacaggguacucugggagcacagagccuaaccugagccucaaaggacuugcugucaugaaugcaaagaugaaacaaaagggcaaacugaaagcacagaccaagguguuugagaguauguuagguuaggcacagugauuuguuaacaguagucaaggcagggauaaauacuucucugggccuccucauaaguucaucuguugugggauacuguguacaaaauagggcucuacugauuaaaaacaaauauaaauauauauauuuauuuauuuauuuuauacuacauacauaaaaucgauaaucuaaagucagccgggcacaguggcucacaccuguaaucccagcacuuugggaggccaaggcagguggaucaccugaggccaggaguucgagaccagccuggccaacauggugaaacccccgucucugcuaaaaauacaaaaauuagcugggcauggugacaggugucuguaguccuagguacucgggaggccaaggcaggagaaucgcuugaacccaggaggcagagggguuuuuuuguuuuuuuuuugagacagucuugccuugucgcccaggcuggagugcaguggcgcagucuuggcucacugcaagcucugccucccggguucacgccauucuccugccucagccuccugaguagcugggacuacaggcacccgaggaggcagagguuuuaaugagccaagauugugccacugcacuccagccugggugacagagcgagacucugucucuaaauaaauaaauaaauacaagcagugggccucucuggaagccuguuggcuaagaggguguuagcaugaucagaugagauugguaagaucauuagcucguuggcuguucuuugauggagcauuuggggaaagaaugaaggaagcggggagaccaaugaggggccugcaugucaguuaaagccguagcaauaacuuuuguuggaucuggggugcuaauggggaacaugguucuaauagaagggcuccuaaauagucuuuuccucagaauuuccuuaauacucuauggauaucugaaaacauauaccaucauauauaguccuaacuacucuuuucuagaagaccaucuuauuuauuagcucagagagaugaaucagcuuugauguucagaauucauagauuagauauucaugggcaugcuuagcaugcacaacuuaauauaugccuuguagugugcaagcguguagcaaagcaugguuucugcauuugagauuuuuaaaaacugacuuaacgguauauggaaucuuaaauuuuccuagaaucugccagcucaugaaaaaaaaagaauucaaguguccuuguugcaaacaugguguugguuuuaucauugcacaaucagcaauuuuauuuugacguuauuuggggggaagcaguauuuuugauuagcaaguaaaauuaauguagaaaacaaauacuguguuaacuauuugguauaauaaggcaucugugccauguugcauuucaacucauuaaauuucuaaacuucuaauuacgauaaguuacaacuguaauaggaaaaccaaucaaacuuggagucauugauagcuuuagagaaguaaaauuuauaguaacuuuggaauuacugaggagaccuuuaaaaucuaauuuaguuaaaaauugaaauauacacaauauuuaaauuuuuuugguuguaaaauucacauuuauugggcaccuacuacuuagcaagucuucuuccaggaacuuuaacacgagugagcacuugaauuccucacagcucugucaagcaagcaguacuguccuccacauuacagauggggcacucaagacuccaaguggccuaucucaaguaacacaacuguaaggugauaaagccacauucgauuuucauugcuuugucacagaaguacaugccuaucuuauaugacuuauggcauuuaaaagcagaguuuauccaaguaguaauuuaaaggauguuuuucuuuuaaaguuuaaaauauugguuguaaaugcagcaacauuccugagcuuaaguucaagaacucaaccguuauaugaguuuuuaccaguguauuaagcaaaaacauuugaacaugagcuaauuguuauuaaaggaaaacaaagacaauuuuuauauuuuuauuuuggaucugccagcaucaaacagguauaccaaauauacuuucggagaaugaccuaaggcaaggaaaagaaaaaggaaaaaauuguuuagacagucucauuuucagagcaguguuucuuuuauuuugucuugguccucuggaagugaaagguuugcuuuguuugaggcacacuugccuccuuauuucccaguauaguaugagaauuuauaaacgugggccaguuuguuuuuuagugcuacaaaaaauaaaugcauuuggaacaggaaagaacaagaaagucagguguuuaacuuuuuguuugugaagcucauuauaguauucugauuuugaucaguuuacauuuguacuuuuuuuccgucacaagauuaagagaaaauuguuuucaacuuccaauuccauaccuucuccacucugaguggcaacuguagauaacaggacccuaaccggcccuggguucucucucgcaccucugcuuuugucauuccagcacuuugcuagucuucccccuugaaugcaccaacauccuaacguggcucgcucuucaguuccaguuaaacucagcguuuaucagggaaguuuuuucuguauuugcucccccaccccccaccacauaugucacccucaauuucuuauggcaacuuagguauaccuuugccauagugucccguuguaaucauuuucuuuacuuucuuccaugugcgagugugagacuguauguguucauaugaaugaaacucuucacuggcuggcucuucauucagucucaugaccuggguuauacacuauuuucucuucccaucugucuuuggacaacugugcuuaagcucauuagguccaaauugagcucuuuucaguuggacugccacugucccccuuauugagaguccucacucuucuuucucccucaccucuucuacuguuaugaaguuccaucauuucuaccuucuaaauauaucucauauuucauaccucucucuccgcccccucuacuuuuuccuuaguuugguccucaucgucugucuagaguagacuauuguagauccucuaaccauccgcccuuccucucaguccuaaucccggucuaucuuucauguaacugucaauuaccauccuaaaauggcaaucuguuuuguauuuccuuucuaaaagucuucuauuuaagagaagcagggaaaauggcugggacaucaggguuccuuggcaccaauuaaccaaugugcuaugucaugaaaaaaggcuuggaucagcagagggauggaaguggcaaauguucacugguugcuguaugguuuacauacuaauguaaauauucuuuaggaggccagugacagugucaucccaguuucucucccuacuuccugcugaagucaccuaauucuccagguguaugugucccauguucaccaguauccagacauuccauauuccucuguuucuuugucuucacguauacuguuuccucuaucuggaguccuuccuauccacaucuaccuuaugagugccuuccagauccagacucccaucuucaucaugucgcaugaugcuucucauacaauaaaugcuaaauaaacauuuauugaacuuauucacauuccaaauguggaaaugaaguuaguugggacaucugcccauuuaauaauuauucuauguuguagucccagggaacucauggaauuugguugaaggcuuuuauaaacuguguauuuuuuacuuaaagcuaaaagagauugaaucuacacauggguuuccuuaaaaaggaauauagccaagaggauuaaagucaggguacaaggccgggcaugaugggucaugccgguaaucccagcacuuugggaggccgagguagauggaucacuugaggucaggaguucgagaccagccaggccaacacggugaaacccugucucuacuaaaaauacaaaauuagccuggcgugguggcgugcgccuguuauaccagcuacuccagaggcugaggcaggaaaaccacuugaacccgggagguggagguugcagugagccgagaucaugccacuguacucuagccugggcaacagaacaaaacucugucucaaaaaaaaagucaggguauaaaugauuccauauugcuuagguaguucucuacccgcuuccccauccauagaaccauagucuuuuagagcuaggaaagguacuaggucacaauaauuggaaguugcugaaaucuuugagauuuuuuuagguguuugaaauaguggauuccaauucacauaugaaguccuucuuuaauuaaaauagcaaaauugaaauugagauuuuaaaauuauaccaccaaacccacccaaaaaagauagcuagugaauuuuuuuaguuauggcaaacaaaguccagaguucagaacauuaguguaagaaaauaacaauugauucauuuuauuuauuagugaaauugaaaaauuggggauuggcaaagcaguuaagguguugguaaucuaucaucauggguauuuauugaacuaccacauaguuuuagauccuauagaggagucguaauuguaugauauuuuaaacuugcuguuuuaaaacuuaaaauauuagguagacauggaggcacccaccuguagucccagcuacuugggaagcuaagguaggauucccuugagcccaggaguuugaggcuauagugugcugugauugcaccuguggauagccacugcacuugcuugggcaaaauagcaagaccuugucucccaaaauaaacaaacaaaauccuuaaaauguuauuggucauauaaagaugugauaagugaaauagagagcaguagaugcuaguaugcaaaauagugcauucugaaauauaugagugugaaacugcauuuacauaccaaaucauauuuuuacacuaauuuccauuuuguggaggcagcaugauuuccuggaaaagcauguaggacuugcaguugggaggccugaauucuggaccugacccuugaugcuaauuaccugugugguuuagggcaaguuacuguuuccucuuugaaguuuaguccccacauuuguaaaagggauacuggguaaacuaguugagguuuucuauccuaucuaagucuguaaauugcauuuucaugaaauccucucagugcuaaagauggaauuuuaggcaguuuugacaauccccuggacuaaaagaaauagcagauguacuguuccuuucaaaguccagucucuguuuaguauauuuagaagucuguuuaugaaaacacucaucucuagacaaacucauuugucucauuggugguucugcaucuucuuccaaauuacugaccucacacacugcuuagcauuccaaggugcaacacaucaaaaaagaaauugcaccauucuccaaagcaccucacucauagcagugucgucccauucaauuagagguggcaaaggcuggccuggcuccaaaggaagacugucaauuccucucuuuuucuguguccacgcuuggcaggaugcuuccucacgcccaccucucucccccuugcugugacuuuagcuuccgccagaugucacaccgcugcuugucaccgcucagacucuugucgcugauuuuguuguuucaguguauuuaucacaaccauucucuuuagcuguaaaauuuauggaauuucacgcucuuaguuacuacaguguuucuuuuucauaagagagggaauauacaaggagucauaugcacaagaguuggagggaagggaacacuuaaucuaacuuaaguaaaguuugccugugugcagugcacacucgccacccccaaauguagaagaguccaaaguggcacugagcucaguucugugggacucagaugcucagaaguuuuuaagaagucuauuucagucucggaaagaaguacauaagagaugugcuuaucagccaauuccccugucuucuuaaauuugaucuuuuaguaaccaacaaaaguuggacaauuuuauuggcucucuguagcccacuucuugaucuuacuaucuagucaaaucuguugauaaugcagucaaauccuaaaagugguggugguaguguugugguaauagucaaucugcauuauuacaauauaucaggcauugcacugagcacuuuacauguauuuaucuaaaccuuaccacaaccuuauaaugauggguacuuuuauuauccuuauuauacagaugaagaaaucucaaaaugaccuaaaugcacuucacugugaaaauaaacucauguacucauuaaaggaggaaaagauacauuugucuaguuucguccucaccccacccucacugccuucuauuaagaggcaaaauuuuggugguaccucaugcuagaagcugaaguucauucugaauucccaggcugguucauuuaaaauuuuuucuuuguauaucaauuagacacaacuuuaaacauguugguguuugcauugcagaccauugauggugauugccaagaccuuuggguagagaguaucuuagcuaaauguuuggguucacuuggaugaauguuuggauauuuagguuaauucaauacuauauauaauguucagucuuagcuuaugguguggaagaagccuagucuuguauguugcaguucuuccccuuggggaccucaaaacuuugucuuacuacuuagacuuacuaucuaaacaauuagaauaguggagacaaccaaaggcuagauuauaucauguacagaauagagauuucauuuuaaaagauucuugguaaucuuugcgaaggauuacuuuguaagagauucuuugucaagaggaucacuggcagugcucucauuauugauuaauguuuucauuuccccagauaauuaggcaaauccuuaaguauguaacaucauggggaacuaagggaacugaugaaaaacugucuagaaaguagcuuuaccacucagaguagacacauuuggaagggaagaaaugacaugguuagggaggguugaccaugaaguagauaugcucuacgugucuaguacaaaugcuugugacacugaacaccauuacccuagggccccuggaaagagucccaggaaugagagaggaggaaacucauuuacugacugcuuuucuaccaugugucaggcacugugcugggcacuaacauccuuccauaucccuuuaugaagacacauaggaauuucccucguaucucagugccagaaguaguugggcuucuccugaguacuugcauuguuuauagagucuuuacuguuucgggcauuacacuuauuauccacaugcauuaucuuuuggaauccucacugcagcaacccuuuuguaguagggaucaucccauguuuuaaaugagaaauuaaaauucagagagauuaaaugacuaacuuuucuaaagucacagcccaacucuuucuuauuuauuuaugcuauuggucuccucuuuguucaguucugaaugccuggccuguauccuaagcuuuucuuuacuuagcacccugugucuagagggagguagaaagagaaggacccaagccuagcaaaaagcaacaauagauguacauucauggagaugcuggcaguugacuuaaacuugaaccacuucucagaaguagcacuuauugcuuucucacauuuguuuagugacuuuucuuuuuauuugguagaaauagggucuuacucuguugcuagucagucuguaguacaguggggggaucauaguucacuguaugccggggcuuaaggauccuccugccucagccuuccaaguagcccccuaaccuagauuuuuuuuuuuuuuucccauagagacagggucuugccaucuugccuacacuggucuugaacuccuaggcucaagcaguccucucaccuuggccucccaaagugcgggauuacaggcaugggccacugugcucagccaagccagagaucuuugguggagcauugucagaagaauuuuacaaacugcaaguuguugcacagauguauugauuuaauuagucuagauaacaccauuuauuuaugcuuaagcaucucacacaugcaaaaguugguaauucaaagucacacaauaauuugugaguuaucuucaauaccaggaguuguagcuucugaauaccaacuuugguaaguauaugugugcgucagaugccuaagcaugaguaaaugauacuauauagaccaauuaagugauggaguuugcuucugaaauucuguugacauccuauuucaucuaaaauuuucugguaguggauuuuaaauaacauuuauuguucuaaacaauuuaaucucauaguauggacaagaucuucauugaagacaaaacaucuggguucuaacaaggccucuuugaguaucugggggaauacuuaauauaccauugcaacuugaugaaauugucuuggcuaaguauacagugaguguucuggcuaguuaguagagaagaguagagauuauccucuuagcaaaaagauuuaacuuacuuugugauagguaaaagacuguauuauuaauucucuuggggagggauaccaguuucucuuugcuauucugccucuuuuccucccucuuucucucuucuaauuuuaacuguaagaacaccaagguauucuaugucugccagauuuugcaguacuguuuucacacuuauauauaacuaauagcauuuuuaaaaucuguagcuaauuuaagcagguuuguuguuguuuaaagugauaagcuuucaaaaagagacugggauguaguuauguaguaggaauuuugguagcaucuuuucuuccagaguuuggguuguuuuaccguuauuauuuuuucucauuauauuuccuagaagauagaaaggagaaagauuaauuaacccaguuuuacauguuaaaaaaaaaaaaacccagaagcucauagggguuaaguuuuuugccuaaggucagcuuuacuaagaagguacucagaaugcacagagaauuccagagcuuggcagagugccgcacgcuacucauugggaaauacaauaggcagauaauuauuuucucagaagucuugacugcuggucaacuuauuucucucugggacuacccacuguccuaucacuaaaacagaaacuuauuuggaggugaggacuacucuguaaucuccaggcgauguuaggaacccuuucuacuuagcacagcuggcuuagaauuccaaguaaguauauaauaugaguuucaugcuaggcacgguggcucaagacugucaucccagcacuuugggaggccaagguggaaggauuacuugagccuagaaguugaaggccagccugggcaacauagugagaccccaucucucucucucucucucuccuuuuuuuuuuggagauagagucuugcucuauugcccaggcuggaguggugcaguagcacuaucucggcucacugcagccucugccucccagguucaggcgauucucaugccucagccucccaaguagcugggauuauaggcucgugccaccacgcauggcuaauuuuuguauuuuucguagagacaauauuucaccauguuggccaggcuggucucaaacuccuaaccucaaguaaucugcccgccucggccucccaaagugcugggauuacaggcaugagccaccgugcccggccaagacuucaucucuuaaaaaaauaauaauaaaucagcagggcauggugguaggugccuauagucguagcugcucaggaggcugaggugggaaauucacuugagccuaggaguuugaggcugcagcgagcuaugauugcaccacugcacuccagccugggcgacagaacaaaagccuguuacuccccucccaaccccuccccccaaaaaaagcaaaaaccaugaguuuuuuaaggcugccaaguggccguguuaaucaguguucaaagaauguuaaaugccacuuuuaggaccauuagcuauuacacuucaugcuucauaaugaggugucucacuuacugugcguuuaauuaaauacauagacaaauuuagggauggggacauauccaugggcaaggccugcuuacuacccgcugaagcaaaggcaagaggagaaacacauccugcagagaaaaagaaagccauauaaaauggaagucccaccccugaugccugggggcauagacagacugaauuuaacaugguaaauggcgcagcugguguagaaaaaaaaaaucauccauuuggagaugaagagcaacgcagacucagucaugguucucuauaaaacuuauguuuuuagauuugcagguaauacaaagaaaggauaccuauaaauccaaguuauaauuauuuuuuguugcuuuuuauuugucucaaaauuacuuuucaguuaagucuggugauuugauuuaaauauuugagacuuauggccgggcgcaguggcucacgccuguaaucccagcacuuugggaggccgaggcgggcggaucacgaggucaggaguucgagaccaaccuggccaacaugaugaagcccugucucuacuaaaaauacgaaaauuagccgggugugguggagggcgccugucaucccagcuacuugggaggcugaggcaggagaaucgcuugaaccugggagguagagguugcggugagccaagaucgcaccauugcucuccagccugggggacaagagccagacuccgucucaaaaaaacaaaaaaacaacaacaaagaaagagacuuacuaucccucccuaccucaugaguuguuucuuuucucucucuuucucuuuuuuuuugaacccaggcuggaguucaguggcacagucauggcucaugguagcccugaccuccuugguucaagugauccucccaccuuagccuccugaguagcugggaccacaggugcgcgccaucaugcccggcuaauuuuuuaguuuuuuuguagaaaccaagucccacuguguuaccuaggcuggucugaaacuccugggcucaagcaagccucccaccucagcuucccaaagugcugagauuauaccugugagcuacugugcccagcuauaaguuguuucuuuaguagugggcaugcaguuuaccauuugggauugguccagaugcccagacugaguuuguuuauuucauuugaugugguuggagcaucugcuuuuuucagucaguggccuggcauucucagaauuguucguugguuucaacaauuaggaaugacaaaagagcaccuaugcuuugccuuugcagugcuugcaaaauuuuuuuuuauuuuaaauuuuugugcguucaucguauguguguauauauauauuggguauaugggauauuuugauacaggcauacaauguguaauaaucacaucaggguaaaugggguaucucucaccucaaucauuucuccuuugugugacagacaacccaauuauacucuuuuaguuauuuuaaaauauacaguuaagcuauuauuaacuauagucacucuguuuugcuaucaaauacuuuuugaagaagugcuuuuauacagguucucauccauagacuuuaagaagauggcagcuuuuucauauaccuuaaagugcuccaaaugcccuuccuuucaaagagaacaagcugacgucccuugaccuguuaccauacuccagguccucuagauuucccuacauuuuuacuuucauugugauuuacucaguugcugcuaauauuuucuuucucaugaagagucagaauauucucauuugccaugggaagagauguugguguucugcuuuaguuaucacuuugccauaucuuuucuuugcagaccccauaucaugugaaccuccuccuggcuggcuaugaugagcaugaagggccagcgcuguauuacauggacuaccuggcagccuuggccaaggccccuuuugcagcccacggcuauggugccuuccugacucucaguauccucgaccgauacuacacaccgaguaaguauuaauacucuagggagggagcaguggcagagcccugcccucagcugcuucccagguuuguccacucuuggaguuggguggccagggcuugaauaggauggauccuaagaagcauaaccagguuccccucuggaagcugcacucuucugucagucaguagggucuuccaaaagcugauguaaguucuauuuuuugccauucaaaaugagauaguacauaucucuagagcuggguuuuguuuugaaggaggauuggaauagaugucacagugaauaaaacauuuuuauuggguucuaaaauccuucauuucuaagaguucaaguuuuuucacuuauuuugcuuugccuagauuuuuggcaucucaguaaagaaugaguggguaaagcaaguagcuguauauuuguuuggaacuugcaaggaugaacagguccccagcaugacaacugaagguuucuuugcuuaaacaucaaagcuuucuaaggcuacaaaucugagccuucccuugguugucaccuaauggcugccuccucuugaaagaaaaagccgucgcucuacuuguccguaaagcgucaguuuggcaaaacuucagauacagggaugcuuuuuuaaaauuuuauuuuuuaauugacaaauaauaauuguacauauauucauagaguacaucaugauguuucaauacauguaauguaaacagaucaugguaguuaguauauugaucaucucaaacauuuaucauuuuguguugggaacauuuaguauccuccuucuagcuauuugaaacuauauauuguuagccauaguaauuuuacagugguauagaacaauagaacuuauuccucugucuauccauaauuuucuaucuuuuuuuuuuuuuugaggcagagucucccucugucgcccaggcuggagugcaguggagugaucucggcucacagcaaccuccgccucccagguucaagcaauucucgugccucagccucccaaguagaugggauuacaggcgugugccaccacgccuggcuaguuuuuguauuuuuuguagagaugggguuucaccauguuggccaggcugguccagaacuccugacuucaagugauccacccgccuugcccucccaaaguguugggauuacaggcgugagccaccguguccugccaauuucguaucuuuuaacaaaugucccccaucccuuacagaggauuucucagccucuaguauccucuauucuacuuuuuacuucuaugagaucagcuuuuuuagcuucuacauaugagugagaacgugcaguguuuuaacuuuguucuuggcuuauuucacuuagcagaauaccguccaguuccauucauguugaaugacaguauuuccuuuuuuauggaugaauaguauuucaugguguauauauaccacauuuucuuuauccauugaucuguucucggacaccuagguugguuccauaucuuggcuauugugaauaguguugcaguaaacacuggggugcaauauuuccccagugauauaaugauuucauccaauauaaugauuuccuuucuuuuggauaaauucccaguagugggauugccagaucauaugguaguucuauuuguaguuuuuugagggaccgccauacuguccucccuaguggcuauacuaguuugcauuccuaccaacaguguauaaagaauuuccuuuucucuacauccuugccagcauuuguuguuuuuugucuuuuugauaauagcuauuccuaacugggaugagguguuaccucauugugguuuugauuugcauuucugugaugauuagugauguugagaauuuuuuccauauauuuguuggccauuuguaugucuuuugaaaugucuguugagaugauaugcccauuuuuuaaugaauuuuuguucucuauugagauauuucgguuccuuauauuuucuggauauuaacucccuguuggaugaguaguuugcauguauuuucucccauucuguagguugccuuuucacucuuguuuccuuugcugugcagaagcauuuuaguuugauguaauccuguuuguuuauuuuugcuuuuguugccuguguucaugagauuauucauaaaaucuuuuuccagaucaguguccugaggcuuuuucccuguguuuucuucuaguuucuggucuuaaauugaggucuuugauccauuuugaguugaauuuuguauaggguaagaggugagggucugguuucauucuucuguguauggauauccaguuuuucuagcaccauuuauugaagagacagacuguccuuuccccaaugaguguucuugguaccuucaucaaaagucaaauguagauauguggcuuaauuucuuaauuucucuauucuguuuaauuggucuaugugucuauuuuuaugccaguagcauacuguuuugguuacuacaacuuugugauauauuuugaagucugguagugguaucaacuaccagauuuguucuuuuuguucaggauugcuuuagcuauucagagucuuuugugguuccuuacaaaucuuaggauuuuuuuccauaauucugugaggcaugucauuggcauuuugauagggauugcauugaauauauaaauuucuuuggguaguguugucaucuucauaauauuaauucuucugauccaugagcaugagauguauuuccauucgcuuguauccucuucagcuuauuucaucaguguuuuauaguuuucguuauagaggucuuucaucuccuugguuaaauuuauuccuagguauuuuauuuucuuugauuuuugugucuauuguaaaugggauugccuucuugauuucuuuuucagcuaguuuguguauagaaauacugauuuuuguauauuaauuuuguauccugcaacuuuauggaauucauuuaucagaugugagaguuuucugguggggucuuuagguuuuucuauauagaagaucaugucaucugcaaauagggacauuugacuuccugcuuuccaauugggguacucuauuuccuccccuugccuaagugcucugguuaggacuuccuagacacagggaugcuuuugugcuaaguuccaucuucugaccccaguccuaaccucgacuuuagccucugugggcaguggguacuuuggaauucuuagcuuuuacagacuauagaugaagcacagauaaccacuucucuccuuacauuccauucuucacugucaguaucguaagaaucuggcauguucauucuuuuuuggugcugcccucucgcucaaccuuagccacgcuagagcuccaggccacauccugaaaagaauuagccuggccucccagugacuuucuugauuuggcaucugucaguaauacagcugauuugcccaccaaaauaacuacuagccaccccugaagccugagugcauaacaugucgucccaguuugccacgcccacagacaguuccuuuggcuccuauuuggggagagucucagccccauccuaugaauucucuucccauuguuaaacagagacccagcugggaaaacaaggcugaaauucugaccccaucgucucuuucccugauuugcagcugacuggggcagauggaauugauucaaacccuggacuaagggggagugaaagggguggguuaugauaaagagagacaggcugcuggacuucuucagaggugggcccuggccaggggaggcagaauuccuucaugcucacccuuuacuguagcaaaucaauuugcaauggcuuauagcugcuggagcacugggucuggggcccccccagcugcauguggaguaaguugauugcaggcuagaaggcaaagcauuuuuugccuuuuacguuuguguggcacugagaccugaagaagccagauuuggaacuuaaucaaaagcuucugagaguuggauauaaugacagcaccggaaguauuuggucucuguguucucuuucagcuaucucacgugagagggcaguggaacuccuuaggaaaugucuggaggaggugaguaguucccauaggauccugaaaggaauguuugucucucuguuugccaguguuguuccuguuccucaguuauauuuuuucagauuuuugccagaagguguaauacauacccacuaaccagaugugaaguugcuaccagggauagaguuugguguggauagcaagcucacuuuucucucacagauuaccuccucaaugucaguuuuauaauuuaauucuuucugguuuauccaaaccagugguucucaaauuuuaguguguguaaguaucaccugggaaaccuguuaaacagauugccaucucugccccaacccucaauucugaguccacuguucugagguacaaacugggaagcucugcuuuaacuggcagucccaggugauuuuccuacaggugguaacugaggcuguacuugaagaacuucugcucuagacuuuauuuuuuuauuugagacggaguuucgcuuuuguugcccaggcuggagugcaguggcacgauuucagcucacugcaaccuccgccucuggguucaagcaauucucuugccuuagccucccgaguagcugggauuacaguugcccaccaccaugcccggcuaguuuuuuguauuuuuaguagagacaggguuucaccauguuggccaggcuggucuugaacuccugaccucaggugauccgccugccucggccucccaaagugcugggauuacaggcaugagccaccacgcccaucccugcccuagacuuuauaccugcucuguucuugugccaccuguaauugccauacugccugcucccuuaauagugcucgagucuuuguaaucugugagaaaaagccuccccuaagaauucaggaggaccauagaaagcaacuaggaagcuuugggcagaaggggagaguagacuuuggcuugcgaggacaggauuacagaacacacccuuucuaacacuacuccuuagagucuaaggcuuuggguauagauggagaaugggggaauggggaggucaaaaaccagccacauuaguuuuuuucauucuuuuacuguuccuguggcuuaaggaugaacuugaccucgugguuuaguaagagaguaggaagauaagagcaggagcguugggaguaaugucaguuugcuucuuacacaaaccuuuuguuuucaguccacagugcccaccccaccccccgcuuuuuuuuuuuuuuuuuaagagauggaucucacuuuguugcccaggcuggaguggagugcaguggcaccaucauagcucacugcagccuggauuucuggaacucaagcgauccucccaaguagcugagacuacagacaggcaccaccaugcccagcucauuuuauuuuuaagagauggggucuugcuauguuaccuaggcuggucuugaacuccugggcucaagauauucuuccaccucaaccucccaauuacaggccugagccacagcuccuggccucugcuucguucugaggacaaucacucuuuguuagcuuauuaucuugagacauuuuaagagagacgucuguguuuaccagacugauggguaacagacuauggggaacagaacacuggauugucucauucuuucgucagcugacugaccagagacaggcucuuaguugcaccucccaguucagccucccugccucccagucauccuccagcugcuguuuggguacccucuaccacuagaguacuagugcccuacugccaacugccuccaguagaauaucaguuccacaaaagcagggauuuuuguuugcuuguauccccagugucuagaacagagccuggcacauagaacuuaguaaucauuuguugacugauuuccuccaugucucucugcagcuccagaaacgcuucauccugaaucugccaaccuucaguguucgaaucauugacaaaaauggcauccaugaccuggauaacauuuccuuccccaaacagggcuccuaacaucauguccucccucccacuugccagggaacuuuuuuuugaugggcuccuuuauuuuuuucuacucuuuucaggcgcacucuugauaaaugguuaauucagaauaaaggugacuauggauauaauugagc

SEQ ID NO: 14124 - RNA, 38417 nt, Homo sapiens
gcucaauuauauccauagucaccuuuauucugaauuaaccauuuaucaagagugcgccugaaaagaguagaaaaaaauaaaggagcccaucaaaaaaaaguucccuggcaagugggagggaggacaugauguuaggagcccuguuuggggaaggaaauguuauccaggucauggaugccauuuuugucaaugauucgaacacugaagguuggcagauucaggaugaagcguuucuggagcugcagagagacauggaggaaaucagucaacaaaugauuacuaaguucuaugugccaggcucuguucuagacacuggggauacaagcaaacaaaaaucccugcuuuuguggaacugauauucuacuggaggcaguuggcaguagggcacuaguacucuagugguagaggguacccaaacagcagcuggaggaugacugggaggcagggaggcugaacugggaggugcaacuaagagccugucucuggucagucagcugacgaaagaaugagacaauccaguguucuguuccccauagucuguuacccaucagucugguaaacacagacgucucucuuaaaaugucucaagauaauaagcuaacaaagagugauuguccucagaacgaagcagaggccaggagcuguggcucaggccuguaauugggagguugagguggaagaauaucuugagcccaggaguucaagaccagccuagguaacauagcaagaccccaucucuuaaaaauaaaaugagcugggcaugguggugccugucuguagucucagcuacuugggaggaucgcuugaguuccagaaauccaggcugcagugagcuaugauggugccacugcacuccacuccagccugggcaacaaagugagauccaucucuuaaaaaaaaaaaaaaaaagcgggggguggggugggcacuguggacugaaaacaaaagguuuguguaagaagcaaacugacauuacucccaacgcuccugcucuuaucuuccuacucucuuacuaaaccacgaggucaaguucauccuuaagccacaggaacaguaaaagaaugaaaaaaacuaauguggcugguuuuugaccuccccauucccccauucuccaucuauacccaaagccuuagacucuaaggaguaguguuagaaaggguguguucuguaauccuguccucgcaagccaaagucuacucuccccuucugcccaaagcuuccuaguugcuuucuaugguccuccugaauucuuaggggaggcuuuuucucacagauuacaaagacucgagcacuauuaagggagcaggcaguauggcaauuacagguggcacaagaacagagcagguauaaagucuagggcagggaugggcgugguggcucaugccuguaaucccagcacuuugggaggccgaggcaggcggaucaccugaggucaggaguucaagaccagccuggccaacauggugaaacccugucucuacuaaaaauacaaaaaacuagccgggcaugguggugggcaacuguaaucccagcuacucgggaggcuaaggcaagagaauugcuugaacccagaggcggagguugcagugagcugaaaucgugccacugcacuccagccugggcaacaaaagcgaaacuccgucucaaauaaaaaaauaaagucuagagcagaaguucuucaaguacagccucaguuaccaccuguaggaaaaucaccugggacugccaguuaaagcagagcuucccaguuuguaccucagaacaguggacucagaauugaggguuggggcagagauggcaaucuguuuaacagguuucccaggugauacuuacacacacuaaaauuugagaaccacugguuuggauaaaccagaaagaauuaaauuauaaaacugacauugaggagguaaucugugagagaaaagugagcuugcuauccacaccaaacucuaucccugguagcaacuucacaucugguuaguggguauguauuacaccuucuggcaaaaaucugaaaaaauauaacugaggaacaggaacaacacuggcaaacagagagacaaacauuccuuucaggauccuaugggaacuacucaccuccuccagacauuuccuaaggaguuccacugcccucucacgugagauagcugaaagagaacacagagaccaaauacuuccggugcugucauuauauccaacucucagaagcuuuugauuaaguuccaaaucuggcuucuucaggucucagugccacacaaacguaaaaggcaaaaaaugcuuugccuucuagccugcaaucaacuuacuccacaugcagcugggggggccccagacccagugcuccagcagcuauaagccauugcaaauugauuugcuacaguaaagggugagcaugaaggaauucugccuccccuggccagggcccaccucugaagaaguccagcagccugucucucuuuaucauaacccaccccuuucacucccccuuaguccaggguuugaaucaauuccaucugccccagucagcugcaaaucagggaaagagacgauggggucagaauuucagccuuguuuucccagcugggucucuguuuaacaaugggaagagaauucauaggauggggcugagacucuccccaaauaggagccaaaggaacugucugugggcguggcaaacugggacgacauguuaugcacucaggcuucagggguggcuaguaguuauuuuggugggcaaaucagcuguauuacugacagaugccaaaucaagaaagucacugggaggccaggcuaauucuuuucaggauguggccuggagcucuagcguggcuaagguugagcgagagggcagcaccaaaaaagaaugaacaugccagauucuuacgauacugacagugaagaauggaauguaaggagagaagugguuaucugugcuucaucuauagucuguaaaagcuaagaauuccaaaguacccacugcccacagaggcuaaagucgagguuaggacuggggucagaagauggaacuuagcacaaaagcaucccugugucuaggaaguccuaaccagagcacuuaggcaaggggaggaaauagaguaccccaauuggaaagcaggaagucaaaugucccuauuugcagaugacaugaucuucuauauagaaaaaccuaaagaccccaccagaaaacucucacaucugauaaaugaauuccauaaaguugcaggauacaaaauuaauauacaaaaaucaguauuucuauacacaaacuagcugaaaaagaaaucaagaaggcaaucccauuuacaauagacacaaaaaucaaagaaaauaaaauaccuaggaauaaauuuaaccaaggagaugaaagaccucuauaacgaaaacuauaaaacacugaugaaauaagcugaagaggauacaagcgaauggaaauacaucucaugcucauggaucagaagaauuaauauuaugaagaugacaacacuacccaaagaaauuuauauauucaaugcaaucccuaucaaaaugccaaugacaugccucacagaauuauggaaaaaaauccuaagauuuguaaggaaccacaaaagacucugaauagcuaaagcaauccugaacaaaaagaacaaaucugguaguugauaccacuaccagacuucaaaauauaucacaaaguuguaguaaccaaaacaguaugcuacuggcauaaaaauagacacauagaccaauuaaacagaauagagaaauuaagaaauuaagccacauaucuacauuugacuuuugaugaagguaccaagaacacucauuggggaaaggacagucugucucuucaauaaauggugcuagaaaaacuggauauccauacacagaagaaugaaaccagacccucaccucuuacccuauacaaaauucaacucaaaauggaucaaagaccucaauuuaagaccagaaacuagaagaaaacacagggaaaaagccucaggacacugaucuggaaaaagauuuuaugaauaaucucaugaacacaggcaacaaaagcaaaaauaaacaaacaggauuacaucaaacuaaaaugcuucugcacagcaaaggaaacaagagugaaaaggcaaccuacagaaugggagaaaauacaugcaaacuacucauccaacagggaguuaauauccagaaaauauaaggaaccgaaauaucucaauagagaacaaaaauucauuaaaaaaugggcauaucaucucaacagacauuucaaaagacauacaaauggccaacaaauauauggaaaaaauucucaacaucacuaaucaucacagaaaugcaaaucaaaaccacaaugagguaacaccucaucccaguuaggaauagcuauuaucaaaaagacaaaaaacaacaaaugcuggcaaggauguagagaaaaggaaauucuuuauacacuguugguaggaaugcaaacuaguauagccacuagggaggacaguauggcggucccucaaaaaacuacaaauagaacuaccauaugaucuggcaaucccacuacugggaauuuauccaaaagaaaggaaaucauuauauuggaugaaaucauuauaucacuggggaaauauugcaccccaguguuuacugcaacacuauucacaauagccaagauauggaaccaaccuagguguccgagaacagaucaauggauaaagaaaaugugguauauauacaccaugaaauacuauucauccauaaaaaaggaaauacugucauucaacaugaauggaacuggacgguauucugcuaagugaaauaagccaagaacaaaguuaaaacacugcacguucucacucauauguagaagcuaaaaaagcugaucucauagaaguaaaaaguagaauagaggauacuagaggcugagaaauccucuguaagggaugggggacauuuguuaaaagauacgaaauuggcaggacacgguggcucacgccuguaaucccaacacuuugggagggcaaggcggguggaucacuugaagucaggaguucuggaccagccuggccaacauggugaaaccccaucucuacaaaaaauacaaaaacuagccaggcgugguggcacacgccuguaaucccaucuacuugggaggcugaggcacgagaauugcuugaaccugggaggcggagguugcugugagccgagaucacuccacugcacuccagccugggcgacagagggagacucugccucaaaaaaaaaaaaaagauagaaaauuauggauagacagaggaauaaguucuauuguucuauaccacuguaaaauuacuauggcuaacaauauauaguuucaaauagcuagaaggaggauacuaaauguucccaacacaaaaugauaaauguuugagaugaucaauauacuaacuaccaugaucuguuuacauuacauguauugaaacaucaugauguacucuaugaauauauguacaauuauuauuugucaauuaaaaaauaaaauuuuaaaaaagcaucccuguaucugaaguuuugccaaacugacgcuuuacggacaaguagagcgacggcuuuuucuuucaagaggaggcagccauuaggugacaaccaagggaaggcucagauuuguagccuuagaaagcuuugauguuuaagcaaagaaaccuucaguugucaugcuggggaccuguucauccuugcaaguuccaaacaaauauacagcuacuugcuuuacccacucauucuuuacugagaugccaaaaaucuaggcaaagcaaaauaagugaaaaaacuugaacucuuagaaaugaaggauuuuagaacccaauaaaaauguuuuauucacugugacaucuauuccaauccuccuucaaaacaaaacccagcucuagagauauguacuaucucauuuugaauggcaaaaaauagaacuuacaucagcuuuuggaagacccuacugacugacagaagagugcagcuuccagaggggaaccugguuaugcuucuuaggauccauccuauucaagcccuggccacccaacuccaagaguggacaaaccugggaagcagcugagggcagggcucugccacugcucccucccuagaguauuaauacuuacucgguguguaguaucggucgaggauacugagagucaggaaggcaccauagccgugggcugcaaaaggggccuuggccaaggcugccagguaguccauguaauacagcgcuggcccuucaugcucaucauagccagccaggaggagguucacaugauauggggucugcaaagaaaagauauggcaaagugauaacuaaagcagaacaccaacaucucuucccauggcaaaugagaauauucugacucuucaugagaaagaaaauauuagcagcaacugaguaaaucacaaugaaaguaaaaauguagggaaaucuagaggaccuggaguaugguaacaggucaagggacgucagcuuguucucuuugaaaggaagggcauuuggagcacuuuaagguauaugaaaaagcugccaucuucuuaaagucuauggaugagaaccuguauaaaagcacuucuucaaaaaguauuugauagcaaaacagagugacuauaguuaauaauagcuuaacuguauauuuuaaaauaacuaaaagaguauaauuggguugucugucacacaaaggagaaaugauugaggugagagauaccccauuuacccugaugugauuauuacacauuguaugccuguaucaaaauaucccauauacccaauauauauauacacacauacgaugaacgcacaaaaauuuaaaauaaaaaaaaauuuugcaagcacugcaaaggcaaagcauaggugcucuuuugucauuccuaauuguugaaaccaacgaacaauucugagaaugccaggccacugacugaaaaaagcagaugcuccaaccacaucaaaugaaauaaacaaacucagucugggcaucuggaccaaucccaaaugguaaacugcaugcccacuacuaaagaaacaacuuauagcugggcacaguagcucacagguauaaucucagcacuuugggaagcugaggugggaggcuugcuugagcccaggaguuucagaccagccuagguaacacagugggacuugguuucuacaaaaaaacuaaaaaauuagccgggcaugauggcgcgcaccuguggucccagcuacucaggaggcuaaggugggaggaucacuugaaccaaggaggucagggcuaccaugagccaugacugugccacugaacuccagccuggguucaaaaaaaaagagaaagagagagaaaagaaacaacucaugagguagggagggauaguaagucucuuucuuuguuguuguuuuuuuguuuuuuugagacggagucuggcucuugucccccaggcuggagagcaauggugcgaucuuggcucaccgcaaccucuaccucccagguucaagcgauucuccugccucagccucccaaguagcugggaugacaggcgcccuccaccacacccggcuaauuuucguauuuuuaguagagacagggcuucaucauguuggccagguuggucucgaacuccugaccucgugauccgcccgccucggccucccaaagugcugggauuacaggcgugagccacugcgcccggccauaagucucaaauauuuaaaucaaaucaccagacuuaacugaaaaguaauuuugagacaaauaaaaagcaacaaaaaauaauuauaacuuggauuuauagguauccuuucuuuguauuaccugcaaaucuaaaaacauaaguuuuauagagaaccaugacugagucugcguugcucuucaucuccaaauggaugauuuuuuuuuucuacaccagcugcgccauuuaccauguuaaauucagucugucuaugcccccaggcaucaggggugggacuuccauuuuauauggcuuucuuuuucucugcaggauguguuucuccucuugccuuugcuucagcggguaguaagcaggccuugcccauggauauguccccaucccuaaauuugucuauguauuuaauuaaacgcacaguaagugagacaccucauuaugaagcaugaaguguaauagcuaaugguccuaaaaguggcauuuaacauucuuugaacacugauuaacacggccacuuggcagccuuaaaaaacucaugguuuuugcuuuuuuuggggggagggguugggaggggaguaacaggcuuuuguucugucgcccaggcuggagugcaguggugcaaucauagcucgcugcagccucaaacuccuaggcucaagugaauuucccaccucagccuccugagcagcuacgacuauaggcaccuaccaccaugcccugcugauuuauuauuauuuuuuuaagagaugaagucuuggccgggcacgguggcucaugccuguaaucccagcacuuugggaggccgaggcgggcagauuacuugagguuaggaguuugagaccagccuggccaacauggugaaauauugucucuacgaaaaauacaaaaauuagccaugcgugguggcacgagccuauaaucccagcuacuugggaggcugaggcaugagaaucgccugaaccugggaggcagaggcugcagugagccgagauagugcuacugcaccacuccagccugggcaauagagcaagacucuaucuccaaaaaaaaaaggagagagagagagagagagauggggucucacuauguugcccaggcuggccuucaacuucuaggcucaaguaauccuuccaccuuggccucccaaagugcugggaugacagucuugagccaccgugccuagcaugaaacucauauuauauacuuacuuggaauucuaagccagcugugcuaaguagaaaggguuccuaacaucgccuggagauuacagaguaguccucaccuccaaauaaguuucuguuuuagugauaggacaguggguagucccagagagaaauaaguugaccagcagucaagacuucugagaaaauaauuaucugccuauuguauuucccaaugaguagcgugcggcacucugccaagcucuggaauucucugugcauucugaguaccuucuuaguaaagcugaccuuaggcaaaaaacuuaaccccuaugagcuucuggguuuuuuuuuuuuuaacauguaaaacuggguuaauuaaucuuucuccuuucuaucuucuaggaaauauaaugagaaaaaauaauaacgguaaaacaacccaaacucuggaagaaaagaugcuaccaaaauuccuacuacauaacuacaucccagucucuuuuugaaagcuuaucacuuuaaacaacaacaaaccugcuuaaauuagcuacagauuuuaaaaaugcuauuaguuauauauaagugugaaaacaguacugcaaaaucuggcagacauagaauaccuugguguucuuacaguuaaaauuagaagagagaaagagggaggaaaagaggcagaauagcaaagagaaacugguaucccuccccaagagaauuaauaauacagucuuuuaccuaucacaaaguaaguuaaaucuuuuugcuaagaggauaaucucuacucuucucuacuaacuagccagaacacucacuguauacuuagccaagacaauuucaucaaguugcaaugguauauuaaguauucccccagauacucaaagaggccuuguuagaacccagauguuuugucuucaaugaagaucuuguccauacuaugagauuaaauuguuuagaacaauaaauguuauuuaaaauccacuaccagaaaauuuuagaugaaauaggaugucaacagaauuucagaagcaaacuccaucacuuaauuggucuauauaguaucauuuacucaugcuuaggcaucugacgcacacauauacuuaccaaaguugguauucagaagcuacaacuccugguauugaagauaacucacaaauuauugugugacuuugaauuaccaacuuuugcaugugugagaugcuuaagcauaaauaaaugguguuaucuagacuaauuaaaucaauacaucugugcaacaacuugcaguuuguaaaauucuucugacaaugcuccaccaaagaucucuggcuuggcugagcacaguggcccaugccuguaaucccgcacuuugggaggccaaggugagaggacugcuugagccuaggaguucaagaccaguguaggcaagauggcaagacccugucucuaugggaaaaaaaaaaaaaaaucuagguuagggggcuacuuggaaggcugaggcaggaggauccuuaagccccggcauacagugaacuaugauccccccacuguacuacagacugacuagcaacagaguaagacccuauuucuaccaaauaaaaagaaaagucacuaaacaaaugugagaaagcaauaagugcuacuucugagaagugguucaaguuuaagucaacugccagcaucuccaugaauguacaucuauuguugcuuuuugcuaggcuuggguccuucucuuucuaccucccucuagacacagggugcuaaguaaagaaaagcuuaggauacaggccaggcauucagaacugaacaaagaggagaccaauagcauaaauaaauaagaaagaguugggcugugacuuuagaaaaguuagucauuuaaucucucugaauuuuaauuucucauuuaaaacaugggaugaucccuacuacaaaaggguugcugcagugaggauuccaaaagauaaugcauguggauaauaaguguaaugcccgaaacaguaaagacucuauaaacaaugcaaguacucaggagaagcccaacuacuucuggcacugagauacgagggaaauuccuaugugucuucauaaagggauauggaaggauguuagugcccagcacagugccugacacaugguagaaaagcagucaguaaaugaguuuccuccucucucauuccugggacucuuuccaggggcccuaggguaaugguguucagugucacaagcauuuguacuagacacguagagcauaucuacuucauggucaacccucccuaaccaugucauuucuucccuuccaaaugugucuacucugagugguaaagcuacuuucuagacaguuuuucaucaguucccuuaguuccccaugauguuacauacuuaaggauuugccuaauuaucuggggaaaugaaaacauuaaucaauaaugagagcacugccagugauccucuugacaaagaaucucuuacaaaguaauccuucgcaaagauuaccaagaaucuuuuaaaaugaaaucucuauucuguacaugauauaaucuagccuuugguugucuccacuauucuaauuguuuagauaguaagucuaaguaguaagacaaaguuuugagguccccaaggggaagaacugcaacauacaagacuaggcuucuuccacaccauaagcuaagacugaacauuauauauaguauugaauuaaccuaaauauccaaacauucauccaagugaacccaaacauuuagcuaagauacucucuacccaaaggucuuggcaaucaccaucaauggucugcaaugcaaacaccaacauguuuaaaguugugucuaauugauauacaaagaaaaaauuuuaaaugaaccagccugggaauucagaaugaacuucagcuucuagcaugagguaccaccaaaauuuugccucuuaauagaaggcagugaggguggggugaggacgaaacuagacaaauguaucuuuuccuccuuuaaugaguacaugaguuuauuuucacagugaagugcauuuaggucauuuugagauuucuucaucuguauaauaaggauaauaaaaguacccaucauuauaagguugugguaagguuuagauaaauacauguaaagugcucagugcaaugccugauauauuguaauaaugcagauugacuauuaccacaacacuaccaccaccacuuuuaggauuugacugcauuaucaacagauuugacuagauaguaagaucaagaagugggcuacagagagccaauaaaauuguccaacuuuuguugguuacuaaaagaucaaauuuaagaagacaggggaauuggcugauaagcacaucucuuauguacuucuuuccgagacugaaauagacuucuuaaaaacuucugagcaucugagucccacagaacugagcucagugccacuuuggacucuucuacauuuggggguggcgagugugcacugcacacaggcaaacuuuacuuaaguuagauuaaguguucccuucccuccaacucuugugcauaugacuccuuguauauucccucucuuaugaaaaagaaacacuguaguaacuaagagcgugaaauuccauaaauuuuacagcuaaagagaaugguugugauaaauacacugaaacaacaaaaucagcgacaagagucugagcggugacaagcagcggugugacaucuggcggaagcuaaagucacagcaagggggagagaggugggcgugaggaagcauccugccaagcguggacacagaaaaagagaggaauugacagucuuccuuuggagccaggccagccuuugccaccucuaauugaaugggacgacacugcuaugagugaggugcuuuggagaauggugcaauuucuuuuuugauguguugcaccuuggaaugcuaagcagugugugaggucaguaauuuggaagaagaugcagaaccaccaaugagacaaaugaguuugucuagagaugaguguuuucauaaacagacuucuaaauauacuaaacagagacuggacuuugaaaggaacaguacaucugcuauuucuuuuaguccaggggauugucaaaacugccuaaaauuccaucuuuagcacugagaggauuucaugaaaaugcaauuuacagacuuagauaggauagaaaaccucaacuaguuuacccaguaucccuuuuacaaauguggggacuaaacuucaaagaggaaacaguaacuugcccuaaaccacacagguaauuagcaucaagggucagguccagaauucaggccucccaacugcaaguccuacaugcuuuuccaggaaaucaugcugccuccacaaaauggaaauuaguguaaaaauaugauuugguauguaaaugcaguuucacacucauauauuucagaaugcacuauuuugcauacuagcaucuacugcucucuauuucacuuaucacaucuuuauaugaccaauaacauuuuaaggauuuuguuuguuuauuuugggagacaaggucuugcuauuuugcccaagcaagugcaguggcuauccacaggugcaaucacagcacacuauagccucaaacuccugggcucaagggaauccuaccuuagcuucccaaguagcugggacuacaggugggugccuccaugucuaccuaauauuuuaaguuuuaaaacagcaaguuuaaaauaucauacaauuacgacuccucuauaggaucuaaaacuaugugguaguucaauaaauacccaugaugauagauuaccaacaccuuaacugcuuugccaauccccaauuuuucaauuucacuaauaaauaaaaugaaucaauuguuauuuucuuacacuaauguucugaacucuggacuuuguuugccauaacuaaaaaaauucacuagcuaucuuuuuuggguggguuuggugguauaauuuuaaaaucucaauuucaauuuugcuauuuuaauuaaagaaggacuucauaugugaauuggaauccacuauuucaaacaccuaaaaaaaucucaaagauuucagcaacuuccaauuauugugaccuaguaccuuuccuagcucuaaaagacuaugguucuauggauggggaagcggguagagaacuaccuaagcaauauggaaucauuuauacccugacuuuuuuuuugagacagaguuuuguucuguugcccaggcuagaguacaguggcaugaucucggcucacugcaaccuccaccucccggguucaagugguuuuccugccucagccucuggaguagcugguauaacaggcgcacgccaccacgccaggcuaauuuuguauuuuuaguagagacaggguuucaccguguuggccuggcuggucucgaacuccugaccucaagugauccaucuaccucggccucccaaagugcugggauuaccggcaugacccaucaugcccggccuuguacccugacuuuaauccucuuggcuauauuccuuuuuaaggaaacccauguguagauucaaucucuuuuagcuuuaaguaaaaaauacacaguuuauaaaagccuucaaccaaauuccaugaguucccugggacuacaacauagaauaauuauuaaaugggcagaugucccaacuaacuucauuuccacauuuggaaugugaauaaguucaauaaauguuuauuuagcauuuauuguaugagaagcaucaugcgacaugaugaagaugggagucuggaucuggaaggcacucauaagguagauguggauaggaaggacuccagauagaggaaacaguauacgugaagacaaagaaacagaggaauauggaaugucuggauacuggugaacaugggacacauacaccuggagaauuaggugacuucagcaggaaguagggagagaaacugggaugacacugucacuggccuccuaaagaauauuuacauuaguauguaaaccauacagcaaccagugaacauuugccacuuccaucccucugcugauccaagccuuuuuucaugacauagcacauugguuaauuggugccaaggaacccugaugucccagccauuuucccugcuucucuuaaauagaagacuuuuagaaaggaaauacaaaacagauugccauuuuaggaugguaauugacaguuacaugaaagauagaccgggauuaggacugagaggaagggcggaugguuagaggaucuacaauagucuacucuagacagacgaugaggaccaaacuaaggaaaaaguagagggggcggagagagagguaugaaauaugagauauauuuagaagguagaaaugauggaacuucauaacaguagaagaggugagggagaaagaagagugaggacucucaauaagggggacaguggcaguccaacugaaaagagcucaauuuggaccuaaugagcuuaagcacaguuguccaaagacagaugggaagagaaaauaguguauaacccaggucaugagacugaaugaagagccagccagugaagaguuucauucauaugaacacauacagucucacacucgcacauggaagaaaguaaagaaaaugauuacaacgggacacuauggcaaagguauaccuaaguugccauaagaaauugagggugacauaugugguggggggugggggagcaaauacagaaaaaacuucccugauaaacgcugaguuuaacuggaacugaagagcgagccacguuaggauguuggugcauucaagggggaagacuagcaaagugcuggaaugacaaaagcagaggugcgagagagaacccagggccgguuaggguccuguuaucuacaguugccacucagaguggagaagguauggaauuggaaguugaaaacaauuuucucuuaaucuugugacggaaaaaaaguacaaauguaaacugaucaaaaucagaauacuauaaugagcuucacaaacaaaaaguuaaacaccugacuuucuuguucuuuccuguuccaaaugcauuuauuuuuuguagcacuaaaaaacaaacuggcccacguuuauaaauucucauacuauacugggaaauaaggaggcaagugugccucaaacaaagcaaaccuuucacuuccagaggaccaagacaaaauaaaagaaacacugcucugaaaaugagacugucuaaacaauuuuuuccuuuuucuuuuccuugccuuaggucauucuccgaaaguauauuugguauaccuguuugaugcuggcagauccaaaauaaaaauauaaaaauugucuuuguuuuccuuuaauaacaauuagcucauguucaaauguuuuugcuuaauacacugguaaaaacucauauaacgguugaguucuugaacuuaagcucaggaauguugcugcauuuacaaccaauauuuuaaacuuuaaaagaaaaacauccuuuaaauuacuacuuggauaaacucugcuuuuaaaugccauaagucauauaagauaggcauguacuucugugacaaagcaaugaaaaucgaauguggcuuuaucaccuuacaguuguguuacuugagauaggccacuuggagucuugagugccccaucuguaauguggaggacaguacugcuugcuugacagagcugugaggaauucaagugcucacucguguuaaaguuccuggaagaagacuugcuaaguaguaggugcccaauaaaugugaauuuuacaaccaaaaaaauuuaaauauuguguauauuucaauuuuuaacuaaauuagauuuuaaaggucuccucaguaauuccaaaguuacuauaaauuuuacuucucuaaagcuaucaaugacuccaaguuugauugguuuuccuauuacaguuguaacuuaucguaauuagaaguuuagaaauuuaaugaguugaaaugcaacauggcacagaugccuuauuauaccaaauaguuaacacaguauuuguuuucuacauuaauuuuacuugcuaaucaaaaauacugcuuccccccaaauaacgucaaaauaaaauugcugauugugcaaugauaaaaccaacaccauguuugcaacaaggacacuugaauucuuuuuuuuucaugagcuggcagauucuaggaaaauuuaagauuccauauaccguuaagucaguuuuuaaaaaucucaaaugcagaaaccaugcuuugcuacacgcuugcacacuacaaggcauauauuaaguugugcaugcuaagcaugcccaugaauaucuaaucuaugaauucugaacaucaaagcugauucaucucucugagcuaauaaauaagauggucuucuagaaaagaguaguuaggacuauauaugaugguauauguuuucagauauccauagaguauuaaggaaauucugaggaaaagacuauuuaggagcccuucuauuagaaccauguuccccauuagcaccccagauccaacaaaaguuauugcuacggcuuuaacugacaugcaggccccucauuggucuccccgcuuccuucauucuuuccccaaaugcuccaucaaagaacagccaacgagcuaaugaucuuaccaaucucaucugaucaugcuaacacccucuuagccaacaggcuuccagagaggcccacugcuuguauuuauuuauuuauuuagagacagagucucgcucugucacccaggcuggagugcaguggcacaaucuuggcucauuaaaaccucugccuccucgggugccuguagucccagcuacucaggaggcugaggcaggagaauggcgugaacccgggaggcagagcuugcagugagccaagacugcgccacugcacuccagccugggcgacaaggcaagacugucucaaaaaaaaaacaaaaaaaccccucugccuccuggguucaagcgauucuccugccuuggccucccgaguaccuaggacuacagacaccugucaccaugcccagcuaauuuuuguauuuuuagcagagacggggguuucaccauguuggccaggcuggucucgaacuccuggccucaggugauccaccugccuuggccucccaaagugcugggauuacaggugugagccacugugcccggcugacuuuagauuaucgauuuuauguauguaguauaaaauaaauaaauaaauauauauauuuauauuuguuuuuaaucaguagagcccuauuuuguacacaguaucccacaacagaugaacuuaugaggaggcccagagaaguauuuaucccugccuugacuacuguuaacaaaucacugugccuaaccuaacauacucucaaacaccuuggucugugcuuucaguuugcccuuuuguuucaucuuugcauucaugacagcaaguccuuugaggcucagguuaggcucugugcucccagaguacccuguguauauggcuaucuuagcacuugucacucugcagugcaauugacuguuuacuccuccauuucuccaucugaaggcccacauugaggugugcaccuuuguuuccucagccccaaggacaaugcaggcuggagacuggcugaaugaauaucagcagguauggaacauccuggcuguaagaaaccacauccaucaggaagcgucagaaaaggaaguguagaauucugcuggaucauuucaguuuacaaagacucagagacuauuaucuccuuucuucuuuccaaucaguuaauccuauuugcucuguugucuacauucaaaaguaaugguaaaucuggcccuuuuuuuuucauuuuuagguuaaaaaguaauauguuuucccacccuuuuagucuuccuuuucauuuucuuauagcuuuuuaugaaauaacucauacacauaaaaaugcauaaaauaggccaagcguaguggcucaugccuguaaucccagcacuuugggaggccaaggcagaugcaucacaaggucgggagccuggccaacacagugaaaccccaucucuacuaaaaauacaaaaauuagcuagguaugguggcaugugccuguaggcccagcuacucgggaggcugaggcaggagaauugccugaacccaggaggcagaggaugcagugagccuagacagcaccacugcacuccagccugggcgacagagcgagacuaugucucaaaaagaagaaaaaaaaaagcauaaaauauacaugguauagcgaaugaacauaguaaauauacacguaacaaccucucaggucaagaaauagaaaaauccaccuuuccccuugugaaaagccuucccacugcccuucauuuuagguaacuguuuuuugggagagaguaaagaaaaccucaugagguuguugagaucagccccuaaauucauauuccuacaugaucuugggccagggcagguaaaaagaggcaccaagaugccaggauauuguguguguuuguaucugugaguaugugggagggcaugcccacaccuaugccuacccagacuggggcaagugauuuaaagcaaucuuaaaaguuggggguaaaucugcacuucuaauaguaaacauuuuaaaaguaaaagcacauuccuacuaagcagacacagcacuauccugccuuaggcuuaaaccaaaccuuaauaggaaaucacaaaauuuuuaagacacgaguuuuaaaacaauauaaaucuagaccaaguacauauacugcuucacucccauuguggauaggaaagaugcuuuaagugaaaaguuggcauuauggggcugcaaaauuccagccauccaauaggcuuauuccauucaaugagcacggggguucucugggcucgcagcaggcauccaacaggguagcacauauaugcucucugagugagaaagcaacaccuucucacauacaacccccuggagagagacagggaaggggagggggaggacuuuacaccugcaaacuccuaacuagcuagggcuaggaaaaacagcacauuuaaaaaaaaaaaaaaagaaagaaaaagaaaaaaaaauuuccugauaaagccaguaacuuucaaauaaucuucccaaguuauuuuuuuuaggauccuaguaaguguaaugauucaacagccagucuuugucuuccuaauggacuuagucaagcuuuaacuaaugcauacgcauacugcuuaaaagggcagcugucagaaugcuuacuccuccuaguagaaaaacacuauaagcacaaaguguugucauauuaauugagacaccucaacuucaaggcacaucugucucugggucuuuggauaaucaaaaugaccacuaaaaacagaacagcgguaucuccaauggggccaacaugagccacccccaauccuaagagacuccugugagaugggaccugggauacacauauguuuugcagaaccaaacugaguauccaucuaaauguagccauuuguuuccaguuuuuacuuuauguccuguuaaggcugggagacaaaaguaaugaacagacacguaacucuuggccuacagugacaauccacaguuagcucacuagcugacuaagguuugguagggaagaaaacugcuccccaggucuaaaagggcugcugcuugcacugacaguccaagagcugcauaaugaacaucuugguuuucguuuuuuauuuuugaauuuccgcaucaccaaaaguaagcuggcucugucugucaagaugcccaggcuguguggcagcagugucaaaggcugccucuugcuccaaggcacugccaucugcagcagcacaacauuuugucuccggaaaauaaacacaucugccuuugccaguguccucccacugugcugcccaucuggagcaggugagcugaaggcaagccucggcaugggugagacgggggcaaguagagaagaugaggccucaagggagauggcacauggaggaagaaggcagugcugcgucaugucacauccugcuaaccacguuugccaaaaaucaugugaaauuacccuuguuagugauauuucaaucacauguaacaaaugguugguaguguauaagggacaagacuugcaaagucaggguuucaccugggccaucuguucacaggaccucacugauaccaauaaacagaugaugccuuugugccagccaccuaaggcaugagaagaauaauucucauggucagaauagaaggcucaaagcaacagguuucuucuaggacaggagcaugcuauacaugccuacuacuaaccagaccaaacagccuugaauuaaggccagaguguggggauaagcuuuggucacugcuggaaaugacuaagaccugaaauccuuuccuacauauucuuucccauucccuaaaaaaauaaauaaauaaauaaaaauucaagucugguuguggucuugacauaagauuuuuaaaucaugcuauuugggggcuggaacaaacccuaaaaaccauccaaucaaaugcuugcuuucucccaagguuuucaacuaacucacagcagagcuaguauuaacccuccuauugcagggcucuuuggugguaagggaacagugauggcaccuuuucaaauaaaacuuuaccuagaauuccuaucuaucaaauagauaaaagcugaguugagcuauaugaagcagagcuaaagugcugaacacuuggcugggugcaguggcucaugccuguaaucccaguacuuugggaggcugaggugggcagaucacuugaggucaggaguuggagaccagccuggccaacauggugaaaccccgucucuaugaaaaauacaaaaauuagccaggcauggugaugcaugccuguaaucccagcuacucaggaggcugaugcaggagaauugcucaaacccaggaggcagagguugcagugagccgagauuacaccacugcauuccagacugggugagagagcaagacucugucucaaaaaaaacaaaaacaaaaacaaaaaaacgccaggcacgguggcucacgccuguaaucccagcacuuugggaggccgaggcggguggaucacgaggucaggagaucgagaccauccuggcuaacacgaugaaaccccgucucuacuaaaaauacacaaauuagccaggcaugguggugcacgccuguagucccagcuauucgggaggcugaggaagaagaaucacuugaaacuggaagguggagguugcagugugcugagaucaugccacugcacuccagccugggugacagagcgaaacuccaccucaaaaaaaaaaaagcauugcacacuggucuuccuuggugaguauccugaagcagcuucacagaauaaaguuugaaaaccacuacaucaggcuggauaucuuuucaacuuauuauuucuacuguuuacuugcuaagcauuuacaaauaaauagguaaaaagauaaauuaccaaaggcucaugaaacacuucggaaaaaguucuaaugaaaacucuuuggccaguguggcagugaaacccgacgauuacacaucauggaggccagcauccuacucuaagccuugccacaaaauuucacguucccaaggacaccagauuugccugguuuauaccugucucucuaucuguuaaauggagauaauuuuagggcauucagaugggcuacaucaaauaugccacauaauucauuuuaaguaagaaauaggcugggcaugguggcucaugccuguaauccuagcacuuugggaggccaaggcggguggaccacgaggucaagagaucgagaccauccuggucaacauggugaaaccccgucucuacuaaaaauacaaaaaaguagccaggcauggugacgggcgccuguagucccagcuacucaggaggcugaggcaggagaauggcaugaacccgggagguggagcuugcagugagccgagaucgugccccugcacuccagccugggugacacagugagacuccgucucaaaaaaaaaaaagaaaagaaauagccccauaacucaucauccucugacauuagucaaacuguaaggagaauuugagaaaggaagccuuuuuuuuagacagagucuugcucugucacccaggcuggagugcaguggcaugaucucagcucacugcaaccuccaccuucuggguucaagcuauucuccugcgucagccuccugaguaacugggauuacaggugugugccaccacaucuggcuaauuuuuuguauuuuuaguagagaugggguuucaccauguuggccaggcuggucuugaacuccugggcucaacugaucuguccaucuuggccucccaaagugcuaggauuaccggcaugagccacugugccuggccgaagaaagcaagccuugagcauaguauaagcccuuuuucugcucuuuggggucuaaccaacaagaagagaccaucuuaaauguauacaagcauuuaaauaaacaacuaaacugaaggcuucugaauuuuuuccccaucugucuuuuuucgucuucugaugauuucaugccuuuaauuccuauacaaauuaacauccauuuauuaagaauacuucuuccgguauuccauucauuaagaauucccuuccaguguauaaaugcauaauuaauauucucagcagaauauauagaccuagcuggaugacacuuuuucagcaaacacuuauugaaaaccuacaauggacauauauucaaacuuaucuauauaauacuaugugcaauuucgacauuuuaacaaaacugaacauuucauguuucccuaaaugcacaaauacacuuguacauuaguccacuaauuaauaaagaagacaccaugaaagaguuugauauuugaagcuggaaucuuaaccuuuaacauaguauauaugugcuuuggaaacauaucuaagagaaauacuuaacauccuuguaaguaaaauggggauaacacacaucuuauggugucauaauaaggauacuuaauaacagauacauauguaaguauuuagaauagcacuguccaagagaacuucuaugaugauggauauguuccagaucugugaugucuaauacaauaguuguggcuauuggguaccugaaauguggcugugacugaggaacagaauuuuuuuuuuuaagaacaaaaguugauuuagcauucaggcaaagucuaccaggagauuuuccaccagaaacugaauuuuaaguuuuauuuaauuuuaauuaacuuaaauuuaaauagccccauguggcuaguuggcuaccauacuggacuguguagaucuagaaaaauccuagcacauaauauauguucaauguuauuuuacuucuauuuucccuaucaauaccagcaugguggcuuggcgccuguaguuccagcuauuugggaggcugaagugggaguauuguuugagcccgggagguugaggcugcagugagcugugacugugccaccucuuaggugacagagcgagacccuaucucaaaaaaaaaaaaaaaaaaaaaaaagcacaacaaaugaucccucacgaaaaacuaacuuauagccauuaaauugcuucuuugaccaaacagcaaucgcagcauaaaaacacaagugggcugggcaugguggcucaugccuguaauccuagcacuuugggaagcagaagcgggaggauugcuugagcccaggaguucgggaccagccuggcaacauggagaaaccccaucucuacaaaaaauuagccaggcauagugguaugcaccuacagucccagcugccagggaggcugagguggaaggaucaucugggccugaaaggucaaggggcugcagagagcuguggucauaccacugcacuccagccuagaugacagagugagauccugucucaaaaaaaaaguaagagcuuugcauuauuaccuuauuuaaucuucauaauaacuuuuugaaauugguaaguagggaaauuaagcuuagaauuuguccaaagacauccagcuaguaagucaguaagcaaauauucaaacccagguaguccaauuccagagacuaugcucuuaaccacaaugcuaaauugccuacauuuuaaugaaccaguuuauguaagauucauuauauacucagugguaguaaauguccucccaaccaaaccaccacacauacacagagcaaauuagaaaucaaacaauuugagcuacagacacagaaguuauacaugguaacuggcugacccaaaaugagucacaucugccaacuggugugaccauauaaauauacuaaauuuggugacuuugcacuuauuaggaacacugacaaacuaucaucucucuucccagaauaagacgacuaaaauauaaauucauauuuuagaacuaagaaucuauuuugauaaggagaugggggagcagagauuggaccuacuggaaaagcucaggcagagguagucaauauuuaccagagccccaugucacugucuacaagggauauuuguuaagacaucaaacauuucugcuaggagaagauuaaaccagauucacugcauuugcaugaagcacacugccauucuuaucucaauuccaaaaaggagcuuaauucacuuaaugucugugauauuuaugacacaguauuuauugugcccaaagcuggaauucuuacuccgguucugccugauaagucagaggaacaucguacauggcaagucauaaaaugcugaacaccacaggaacuucugggugacagaaaaacuaauaucugacccauuuuccuuucucaaggaggagugaagaaaagaccacuuggugacaaugacuuucuuggaagaaaaaaaaaaaaaaaaaaauauauauauauauauauauauauauauauauauauuuuuuuuuuuuuuuuuaaagaaaagacuacugaucuuucacccaggacaaaacaauguauguaaauuugccuccuccucucaauccuacaugucucuagcuucucuucaaacuucaugaucccucagauuguacaagcccuuggucaaagcuagcacugagagguacuauuuauugagaaauuaucagucaaagauuauuaggcacuagaaaauaaacugcuuuauagaucuguaguaaguaacuuuaaaaaaaguaacuuguuauuuuaagcaaguacagaugaaaacucaaaccauaauaaaaauaugaauagcaucaguguucuagaaacacuacugaagaaccaaaggcagaauagucaaauaauuauggcaccauuauuuuagcuuugucugaccugcugugugaccuggagcuagucccuuugacacuuuaugccuuucacuucaucucagugauagagacuaucuuucucaguggaauagugaguagauuaaauuauuaagcaaaaugcuuugggcaaaagucacaugaauguuaaauauuaugauuuacaagcauucauuuuccuggcaccccugugggguuaggaaguuaucuccauuucauagauaaguaaacaggcacagggggugagaucacgugguaaggcucuauuuauuuagucccugugggaagggaauaacacacaccuuuagcaaccauaugaacuuuccuagcacauccuacacaaucuuuaaugcauucaauccuuaacuuaguguugcaucuuuuaacaugcugucgaugaaauggagacagcucuagaauagcaacaaggcuagaauaaguaaggaggaacaaugcuguaugcuuugggaaaaagucauagaaaaacacagguaaguacgccagguacagugaguggcucauuccuauaaucccagcacccugaaaggccaaggccagcagauugcuugaguccaggaguucaagaccagccugggccacauggugaaauccugccuccacuaaaaauacaaaaaauuagccagaugugguggugcacaccuguagucccagcuacuugggaggcugaggugggagaaucaccugaacccgggaaguugaggcuucaguaagcugagaucacaccacuacacuccagccugggcaacuggagugagaccccgucucaaaaaaaaaaagaaaaaagaaaaagaaaaaaagagaaacacagauaagcaaucucgagauaaaaauccacauuaccggccaggugcgguggcucgcgccuguaaucccagcacuuugggaggccaaggcgggcagaucaccugagaucaggaguucgagaccagccugacaccugaccaacauggagaaaccccgugucugcuaaaaauacaaaauuagcugggcgugguggugcaugccuguaaucccagcuacuugggaaauggaggcaggagaaucacuugaacccaggaggcagagguuccaguaagccaagauugcaccauugcacucuaguuugggcaacaagagugaaacuccaucucaaaaaaauaaaaauaaaaauaaucugaauuauuauuuucaaaguucuacuuucacuaacacauagagacuuucagucacagguauuaaguaauaugguuuguuacaaaaacacuuugaaaaaacuaaacguacucuuacuauaugauccagcaaucacacuccuugguauuuacgcaaaaaaaaacuuauguucaaacaaaaaccugcacauggauguauacauuagcuuuauucauauugccaaaacuuggaagcaaccaagauguccuucaguaggugaauggauaaauaaccuguaguauaucuagacaauggaguauuuuucaauguuaaaaagaaaugagcuaucaagccaugaaaagacauaggguaaccuuaaacguguauuaccaaauaaaagaagccaaucugaaaaggcugcauaauccaugauuccaacuauaugacaugaugggaaaggcaaaaccauggagaaaguaaaaagaugagugguugucaggaguuguggggauggagaaggaugaauaaguagaguacaaaggauuuuuagggcagugaaaauacucuguauccuguaaugguagauacaugucauuauacauuuguccaaacccauaacauccacaacagcaaaaguaaacccuaauguaaacuauggaccugggugauuacugucaauauaggcucaucauuugugacaauguaucacccugguggaagaugcugauaauggggaaugcuauacaugugggugaggaggaaugugggaaaucuuuauacuucuucucaauuuugcugugaaccuaacacugcucuaaaaaauaguuuuuagggggaaaaaaaaaggguaaguugucacaggccuucauauuggugugucccaaccaauucucugggaaugaauauuugcccuuugggcuguaccuauuaauaacaacugugcacaaagacauuggacuuaagaaugaacaaguagcaacaggagggguucuggaaggccaaaaaagggcaaaaauacuacucauguauaaugagaauauaaaagaagcacaaaggauuuuucugcucuaucuaacaaugucugauauauuacuuacccgacuccgaagacagucagccagguuucggcgugugaaguuagcugcugccgugggagacaauucauauccugguagaagagauaaagagucauacuuaaaguaaagcagaaggaauaacagugccccaaauuauucacuaccccuguuccuaaagcccaccaucuuuuguacacucagaguaaacaaagcauagacugagggguacaauccuacucuagucccuuuccucaugcaacagcuaugaaauagcugguuaguacugacagcaauucuuggccacaaacagaaccaguucuauaguggaaugaaacuucuagcagccuugcuuaaacuauucauucaucaacacacugugguuucugccguagaaggaaaggaacacgaauacacaagaagugaaaaaaaaagaaaggcgucuuagaugccaaucuuuuaaaaguuuauuuuaaaaaggauauugggggccagucacaguggcucaugccuguaauccuagagcuuugggaagccaaggugggaagaucgcuugagcccaggaguuugagacuagccugggcaacauagugagacccccaucucuaaaaaaaauuuuuuuuuaaauuucuaggcauggugguacaugccuguaaucccagcuacuuaggaggcugaguggagaggaucaauugaccccagaaguucaagugaguuaugacugugccacugcacuacagcaugggugacagagcaagacccugucucuaaaaaaacgaaaacaggaacaaaaaggauauugggaaaagagaggcuagaaguuaggacuaccucagagucauaguuuauuaaaaaaauauuuuaaauguuacuuuauuaagaaguauaauaugacuuucaaaaguauaagccacagaaaaagaacauuuccaucauucugcaguauuuuuaaaaauagaguaucucaaguguuaaaacuucaaaaauaaaaguugucauaccaacaaagguacaacccagaggaauagcaucaggugugcauguaauaacgcauucacuuuggagcuuaaucccccuguagaaugggaccagugccaaaaggcacaagaaugauccauaacucagugggcccacacagaaaaugucaguauggaaagacacacagcagugugguuaaguaauugcuuacaacauuucaaauaccacugucaaauuaggagagauucagauucaaauccuaacaaauauuuauugagcagcaacuauguuucagggucuaugcugaguguuuucacauguauuauuguacuuuauccucacaagucuauuagugcauauuaaaucauaaugaaagcaauccuuggccaggugcaguggcucaugccuguaaucacagcacuuugggaagcggaggcaggcagaucacucgagcccaggaguuuaagaccauucugggcaacaugaugaaaccccgucucuacuaaaaauauaaaaauuagccaggggugguggugcacaccuguuuucccagguaguugggaggcugagguggaaggaucaccugagccugggaauucgaggcugcaaugagccaugauugugccacugcacuccagcccaggcgacaggagugagacccugucucaacaacaacaacaaaaauaauaauaauaauuuaaaaaaagaggccaggcacaguggcucacaccuguaaucccagaacacuuugggaggcccagguggguggaucaccuggggacaggaguuuaagaccagccuggccaccauagcgaaacucugucucuacuuaaaauacaaaaaauuagccaggcauggcggugcaugccuauaaucccaacuacucaggaggcugaggcacgagaaucacuugcacccaggagcuggaaguugcagugggcugagacugcaccacugcacuccaaucugagcaacagaacgagacccugacucaaaaaagaaaaaaaaaaaaaaagaaggaaccuagacaagugggaauacuauucaauucuuuacuuaacccccuaaacaccacugaagaucugaccauuauccuaaaggcagaaaagucaugccugauuaucugcauauagauuuucucuuucuuucccuuauuuuagcucaguucuuuaacuuauauaagaauuacuauauagaguuacauacacaaaacuguacuuggcagguaauuuaagggucuuuaagggcaauuuuaaccaaacacaguuuuugucugugcacugacuuuagacccuaaaacccaguaacaaacaacucuugcuacucuuguucacucuucucccucucucaggacagccagugaagucauacaguaccuacuggacuucagaagcauuacugacauacuucauuuguuaugcaggcaaaaaguggaaccacuggaaaaaaaagcagaauucuugaaauauucuaaaccugcauaaaccuaaguaccauguacuuuauguuccugaaugucaggacuaagccuuauucaucuuugaauucucuuaaguauuaagcagaaugcuuaccauagaagaggcccucaaaaguauuuauggaauugaauacaaaugcuaaauccacugcccaaacuaugugaauagaucuuuggucauuuuacacaugcaaguauauucaaauuaacuuccuucauagcuccauauuauaccagugcaguguauaacguuguuauugaacugugagguaaguggaaauaagguuuucucugccagaccaccacuacaaacauuccuggaucagaggccuaguggcuaguaucguuugcuagggagguuuucccaguggauaagaguucauuagccccagagagagcucacaaaauacuucacaaaagucuuaauuaucucucuagaaggaaaccuaccagagaguaaggcagaacccuuuuauggcacaguaaauacuuauaguuaguuacacaaugcuuuagguuuacaaaauauuuucauauguauuauucauuaguauuauaauucauuucagagauaaggaaaauaaagucccagagaagauaaaugacuuaucacauaaaaaauaguaaagccaagguuuacuuagguuuuuugacgcugagauucagauuuuuuuguuucuuuguuuugagacagggucucacucugucgcacaggcuggagugcaguggcacuaucauggcucacugagaccuugaacuccugggcucaagugaucuucccacuucagcuuccugaguagcugggacuaugggugugcaccacugcacccagguaaauauuuuuauuuuuuauagagccagggucuugcuuuguugccuaggcugguuucaaacuccugaccucaagugauccucccaucucagccucucaaaagugcugggauuacaggugcuagccacugugccuggccagguucagauacuuuuaaacucaaaccacauccucugagauaucuaacacuuaaaaagucugauacuaccaucccuaccuccaagaugguguuggguuuuuuuuuuuuugguugguuuaaaaaaauuuuuuuuagagacagagucuugcugccuuccagaguacaguggcacaaucauaacucacugcagccucgaccuccugggcucaaacgaucuuccugccucagccuccugaguagcuagggcuauaggugcaugccaccacacucagcuaauuuuuaaaaacuuuuuuguagaaggccgggcgugguggcucacaccuguaaucccagaacuuugggaggccgaggugggcagaucaucugaggucaugaguuugagaccagccugaccaacauggagaaacccugucucuacuaaaaauacaaaauuagccaggcgugguggcacaugccuguaaucccagcuacuugggaggcugaggcaggaggauugcuugaaccuggaaggcagagguugcggugagccgagauugugccacugcacuccagccuggacaacaagagugaaacuccaucucaaaaaaaaaaaaaauuuuuuuuuuuuuuguagagaugaggugucacuacauugcucaggcuagucuuaaacuccuggucucaagugauccucccaccuuguccuccccaauugcugggauuacaggcaugagccaucauaccaggccgaugguguuaguuuuaucuaucagcuaucaguguuacaacaguucucugcucuaggauuuuuguagaaaaucuuuuaugaaggauuagaaucuuuagggucuagacaacuucuuaaacacagaaaacucuaaugaaaauaugggcugggcgugguggcucacgccuguaaucccagcacuuugggaggccgaggugggcagaucacaaggucaagagauggagaccauccuggucaacguggugaaacccugucucuacuaaaaauacaaaaauuagcuggacgugguggugcgugccuguagucccagcuacucaggaggcugagacaggagaaucgcuugaaccugggaggcggagguugcaguaagcagagaucgcgccauugcacuccagccugggcaacagagcgagacuccgucucaaaaaaaaaaaaaaaaaaaaaaaagaaaauaugaccacauaagucuuaaagaauauuauuuuucaguucaaauuuaaagacaaaccaauuguuauaggcugaauuuuguccaccaaaaauucauauguugaagucuuaaucccuaguacuuuaguaugugacuguauuuggagaagggauccuuaagagguuauuaaauuaaaaugaguuccuaauucaacaugacugguauucuuagaagagaaaauuuggauauaguacaaagagaaaaaucacgugaagacacagggagaagauggcuaucugcaagccaaggagagaggccucagaaaucaacgcugccaacaccuuaaucuuugacuucuaacaucuagaacugugagaaaauacauuucuguuguuuaagccacccagucugugacuuuaguaauggcagcccuaguaaacucauaugccaacuaaaacuguaagucuuacccaccauuucgcaucuuauaaaguugcacguuuuucugaauauauucugcaaacuguacagugucuccagccucuccaacacacaggaguaauaucuuuucacucaucuuaaacaucuugucaugaucugcucaaagaagaaaacuguguuagaaacugccuuaacagacauugaccgucauuauuuauguaaccauaaacagguuuauuaauuacuacaguuggccuuccauauacauggauucugaauccacaauucaacaaacuauggaucaaaauuauucagaaaaaaaaaaaaauggaugcuugcaucuauccugaacauguacugacuuuuuuucuggucauuauucccuaaacaauaugguauaacaacuauuuacauagcacuuaugucauauuaaguauuauaaauaaucuagagaugauuugaaguacacaggaguaccugcauagguaauaugcaaauacuauaccauguauauaauggacuuuaagcaucuauggauuuggguaucugcagggguucuggaaccaaucccuacagauaccaagggacgacuguauauugaauaauuuaacuaauuauugcuuuuagaagauuuuaauagguaaugguaucaauuuuucucuuucacucuucauguuaaaccaucagcauauuguguaaugccaauuucgguuggagaauauacaugaaagcuaccaauugaaaauacaauuuaaagcauuuaaaggcauuugaaaugcaaggaacagaacgacagaagaaacugaaggaauccagccaauggcgauuaucuuuaggcucaugauaacaaagcccuaaaauguuuccacaacuacaaauguuaguuauuauauuuauacacauacaaaagcauauaugaaaaggacuggugcuauaauuaaaauuaaggaaccauuucaagaaagaauagaaaaucaacugagaauauuaaucacuuuaaaaaguaaacaaauuccacuuccaaagaaaaagagaaaauuaaaaugauugccaaagcaaaaauucuagugaauauuuugacaguaagcuauuuaaaauaccucacaaaaauccuaauacucuaaucuuaucuagcugaaccagagucauucagauuagacagauaaauaaauauucagguuacaguuauugccuaaggaagaaaacuccacauucagucugcagcuucagaaaaggccuaaaucuuccuaucucacuuucacuuucacuuuucauuuuucaaauagugcugaauaauccucccugggagacacguuuccuguuugaaagcuucugaaaugccaaaauccuuuaauaggauuuaaagaacaaaaugcuacugucaaauacuuuacaaguguuucagaguuguagauaccaguaauauggcuucuuagacuuggagggaaaaaacacacaaaaugcaccuguagauaauaucaaauugccucaaaacuccuaaacaaacacacuuuuauuuguuaugcaggcuagauuuaaagauuguuaguuugcaaacuuguuaauaaacgaaaaacauucacuuauauuaucuaugcaaagaaaaaggagcagaaggguauauucuaagugcuugccagugguaagaguaugggcaguuuucguuuccuucuuuugcuuguugguuuuuccuaaaacuucuauacuuaacaugccucacuuuuauaagaaagcauuauucaauaaguucgcauuauuuuuauaauaagaaaaaagauauuuuuauuugaagggggagcuuguuuacaaagaacuuaugucacacuuagaagaaaggcuaaaauccuaggcaguaaccuguucaacuuuaaaauuagcuuaauacaaggccaaaaauguuuuuuaaacacugaauauguccaaugaguagcagagggcaacauauuuaauaaaaacacaagagauagauacuuagagaccccugaguuguacaggaaacugccuguguagcucuggggaauuucugauucuugacgaggaacuuacgagauccacauacaugaaacaaauggccaacaaaaugaacaacauuagcaugucauacuguggaaaaccaacugaacuagaauccaagagaccuugguuaugauguggacuuggcacucugaacuucggcaaauuacuuguccucucuaagccccaguuuccagaugugugaaauguuauuuccaaaugugugaaauguuaauaauaugacuuaccccugucuaacucacaagugagaaaaacuaaugaauucuauacauguccaauauuaugauacucaguguuagauaauguaguucggauuauacaugcuauaggaauucagaaaagagagaauucugugugggcuggaguacuccgaguaacuuaaaagcaauucuacauaggccaagagaaaagagacaugaaaugcggcauauaagcaaaccaaaaguuauaccacuuaauaagguggcaauccucagcaaaugucuacucuauaguaucaaaauguuuuuacaaagugacauacuggacaauugauuggaaguuguauuaucauuuuauacuuggagaaaggagucccagaagguuacuauuuuuucagcauucuugccuacucuaaacaagcuccaucgugaaaugaaugauuagaaaaaagucaucagacggcugggcacgguggcucacgccuguaaucccagcacuuugggaggcggaggcagguggaucaccugaggucaggaguuugagaccagccuggccaaacuggugaaaccccguuucuacuaaaaauacaaaaauuagcugggcauggugacgggcgccuguaaucccagcuacuuggaaggccgaggcaggagaaucgcuugaacccaggagguggagguugcagugagccgagaucgcgccauugcacuccagccugggugacagagcgagacucugucucaaaaauaaauaaauaaaauaaauaaaaaagucaucauacaauacuaaaauuucuauuauaauuuguuuuauaccagaaaagacuauagggaaaauuggaaugugcagagugcaacuauuuccaauuauuuuucaagaacuaacucaaauucaucuuucucccauaccauaguuaucuuucuuuuauuacucuuaggauuugcucuugaacucauuaauuuaaaaaccaaccuacuacuaacuaguaauacuucuuuuauuauauaaaaucaucuugcagcauuuauuuccuuguuuucuuaaugucuuggacucuucuauggguuauaaguaauauacugcauccccuauaaugacuaaaaguacuguguacauaaguaggcuuaaagcacauucuacuuuucaaugugauuucacauacauuugggaugaaacaaaagaccuguaaagauaaugauuauuguucuaccuagacaugacuuaauguuaaaaucacuugcuugucaaagaccuuaguauucaaaauaauggacaaauuuacucucaaaacaaauucacuccuuuggaaggacuggcuuacaaacaaaacuucuacaaacuaaucauagaauuucauaaaguauaaggugcuauguuaagugauuuacauuaauucauuaaccuuuugagauaggugcuauuacauuaccaccuuauagauguuagcucuagggcacggaguuagagaaauuugcuuaaggucacaaguggcagaaccuggguucaaccuaugcagugaguccagacauuuugccccuaaguacuauaauauacuauacuauacuauacuauacuauacuauacuauacuaucuauacuaaauuacucaauacauaauuuuaagaagauuuugguuguuuuucugcagaaucuaaguuuguuuuccuuaacugaucaaagacgugcuacuguugaaaaaguauuaagcuuugguucagaugacuuaauggucauuugacaaauauguuugggcaccuacguacacuuaguauuauuaaguaccugccuagugcuaaggauuugcacauaacucauuuacuaaauccucccgacaaguuugugaguuugguauugcuaaucuuaaagaugaggaaaucugggcacugcaaaauaacuuauacaaacucauaaggcaaauaaaugacagggcuccaaucucuuaacuccauuaacuacuuaaauauaaggaaaaccuggcagccauugcucuggaaaacuggaaaagaagaaucgggagccacgggaagaaggaaaaugccaagcuucuggucccacagucucacucuccccaggaucccaccuuaugccgccaacaaacuaaccucauuacuagcgacaccaggaaacuuaucagagauucggggaucuagagagccagucccacagucucacucuccucaggaucccaccuuaugccgccaacaaacuaaccucauuacuagcgacaccaggaaacuuaucagagauucggggaucuagagagccaggcucugggcaggcgcuuaaacauuuauaaacugauucccuuuaggcaacucucaccaagcaagaagcauuuagcgaaggccagagcagagcacugacccaggagcccuggaggagcaaaugccaaggucccagaccugucugccuguuucgccuguaaucccagcacuuuggaaggccgagacgggcggaucuccugaggucgggaguucgagaccagccugaccaauauggagaaauccacaucucuacuaauaauacaaaaauuagccaggcgugguggcgcauaucuguucccagcuacucgggaggcugaggcacgagaaucgcuugaacccgggagacaaagacugugcuaagccgagaucgcgccauugcacuccggccuggacaacaagagcgaaaccccucucgaaaaaauaaauaaauaaauaaaauaaguacgggcagggcaggccggcuuccaucucucagauccucccugguacuuauucaacccccgacaaacuccuucuggccgcuccuacaccccaggccuggccgggccuccccugcuuccucucaccguccuucaucuggacaauauugcuggcggccacccggucggaggcgacaagaacauagucggggccuuggauaccgaugagguacuccaugguggcggaaggccaggggcugcagguccgacacagcacgagacucgcccgcuuccaggucucaccggugagacagcaccucagagcgaagauuggcgcgacgccugcagcacgacuucc

SEQ ID NO: 14125 - RNA, 80679 nt, Homo sapiens
aaauguucuuuucucauuuucucccaaagcuuucuaagaguucaccuagugaacccaguaaugcuguugcuaguaguaguacggaacagccaagcguuucaccaucuucaucaguauucagucagcaugcaauugguuccaguacagaaguacaaaaagacaauaugaaaucuaugaaaauaagugaugaacuaugucacccaaaauguacauccaaaguacaaaaaguuaaagguaaaucacgaaguauuaaaaaaucuuguugugcagauuuugaguguuuggaaaacaguaaaaaagauguggcauucuguuauucaugccaguuguucugccaaaaauauuuuagcuguggaagagagucauuugcaacccacggaacuucuaauuggaaaaaaacccuggaaaaauucagaaagcaugaaaaaagugaaaugcauuugaagucauuggaauuuuggagagaauaccaauuuugugauggagcugucagugacgauuuaucuauucauucgaaacagauugagggaaauaaaaaguaccuaaagcuuauaauugaaaauauuuuauuucuuggaaagcaguguuuacccuuaagaggaaacgaccagucaguuucaucugugaauaaaggcaauuuuuuagaauuguuagaaaugagagcaaaagauaaaggagaagaaacauuucgacuuaugaauucacaaguugacuucuauaacaguacacaaauucaaagugauauuaucgaaauaauaaagacugaaauguugcaggauauugugaaugagaucaaugacuccucagcauuuucaaucauaugugaugagacaaucaauagugccaugaaagaacagcuuucaauuuguguaagauacccacaaaaaucaucaaaggcuaucuuaauuaaggaaagauucuuggguuuuguugauacugaggagaugacugggacccacuuacauaggacuaucaaaacuuaucugcagcaaauuggaguugauauggauaaaauacauggccaggccuaugauagcaccacuaauuugaagauaaaauuuaauaaaauagcagcagaauucaagaaagaagaaccaagagcuuuauacauacauuguuaugcacacuuuuuggauuuaucaauaauuagguuuuguaaagaaguaaaagaacuccgaagugcucuaaaaacucucaguucuuuguucaacacuauuuguaugucuggggaaauguuggcaaauuuucgaaacauuuauaggcuaagucaaaacaaaacaugcaagaaacauauaucacaaucauguuggacaguccaugaucguacauuacuaucugugauugacagucuuccagagauuauugaaacauuggaaguuauagcaagccauucuucaaauacaaguuucgccgaugaauugagucauuugcugacauugguuuccaaauuugaauuugucuuuuguuugaaauuccuguaucgagugcugaguguuacaggaauucuuuccaaagagcuucaaaauaaaaccauagacauuuuuucuuugucuucaaaaauagaagcaauuuuggaauguuuaucaucugaaagaaaugacguauacuuuaaaacaaucugggauggaacagaggaaauaugucaaaaaauaaccuguaaagguuuuaaaguugaaaaaccuucucuucagaaaagaagaaaaauucagaaaucaguagaucuuggcaauucagauaauauguuuuuuccuacuucaacagaagaacaauauaaaauuaauaucuauuaccaaggauuagauacuauauuacaaaauuuaaaguuauguuuuucggaguuugauuauugcaaaauaaagcaaauuucagaacuguuauuuaaauggaaugaaccauuaaaugaaacaacagcaaaacauguucaggaauuuuauaaacuugaugaggacauuaucccagaacuuagauuuuaucgacauuaugcaaagcuuaacuuugucauagaugauaguugcauaaacuucgucagucucggcuguuuguuuauucagcauggucuucacaguaauauuccuugucucucaaagcuauuauauauugcuuugucuuggccaauuacuucagcaaguacugagaacucauuuucuacccugccucgucuuaagacauauuuauguaauaccaugggacaagagaagcuuacuggcccagcccuaauggcuguugagcaggaguugguaaauaaacuaauggagccugaaagacucaaugaaauuguggaaaaguuuaucagucagaugaaagaaauauaauacaugcucauuugaacuuaccuaaaagacuuguauuuccauugggauguuuucauuucaaaauuguucaaaauucaaaagacacagaacgauaaacagugaagucuccuucccuccuuuagaacucauuuucucuucccaaaaaguguuaucuuuuccuuaaauaucccucuagagguauuuuuccuaagugguauuguacgguguauacuguucuucagcuugucuucucuguguaacauauuuuugagauugucccaugucguuacaugaagaguuucuugauucuuggucuauaauugcagauguuauuguaugaauguaccauaauauauuugagcagucccugcugacauuuuuuuccuaaccuuuugcuauuauaaauaaugauucauuuuauaaccuuuuauauaggucacauugcacaugagugaguuuacuguaagcuggaaaucuaaaguuagaauuacuagguuaagauaugugcauuuuuacuuuugauagauauuggcaaguugccaucuauaaggauugugccaguuuacagucccacccacaaugcaugagagugccuauuaaaucuuuguaaguguuaucaaauguuuugaucuuuccuaaucucuuacuuuaaaaauggcguuuuaaucucaguagaauuuuguauauucacuuaagaauaagguuggggacugggcguggugguucacaccuauaaucucagcccuuugagggccuacacaggaaggaagaucgcuugaggccacgaguucaagaugagguuggcaacauaguaagaccucaucacuacaauuuuuuuuuuuuuaaauuagugaagugugguacugcacacccgaagucccagcuacuugggaggcugaggcaggaggauugcuuaagcccagaaauuugaggcugcagugagccaugauugcaccacuaugcuccagagucuaggcaacagagugagaccuuaucucuuuaaaacaaacaagaaugaaguuagguaucuguuuauuuguuugagccauuuguauuuccuuuuuuguagacuguccuguuuaaacguuaaaaucacugcugugguuuugauuuauacaucucagcuggauggcacaauaaauuauuaagccauguuaugaaaauauaacuauauuuaaguaaccugcaaagaaaagacuauuucuuuauacuucaaaaaaguuuuguuuuuguuuugagauggaguuuugcucuuguugcccagacuggagugcaaugguaugaucucggcucacugcaaccuccgccucccagguucaagugauuguccugccucagccucccaaguagcugggaugacaggcgcacgccaccacgccuggcuaauuuuuguauuuuuaguagagaugggguuucaccauguuagccaggcuggucuugaacuccugacgucagguaauacgcccaccugggccucccaaagugcugggauuauggcauaagccaccacgcccagccagaaaaguuuaaauaacaaagaaaaugugauauucaaagauuugaaagaauuaagugguauauauaucuaggccuggaauuuuuuuuuuuuuuuuuuuuuuuuuugagacggagucucgcucugucgcccaggcgggagugcuguggcgcgaucuccgcucacugcaagcuccgccuuccggguucacgccauucuccugccucagccucccgaguagcugggacuacaggcgcccgccacugugcccggcuaauuuuuuguauuuuuaguagagacgggguuucaccguggucucgaucuccugaccucgugauccgcccgccucggccucccaaagugcugggauuacaggcgugagccaccgcgcccggccuuuuuuuuuuuuuuaaagacuauuucucuggcacuuuucuccagcuguuucucccuuacccucucaucaauuuugauaacuuguacuuuuucuaggagaacaucuauuucauugaggcuuucuuucaaaugcauuugccuagaguuguagaaaauauucucaguaucuucuauauaccuguuuuacuuucuuucuuucauuuuuuaagacggagucucgcucuguugcccaggcuggaguguacgguggcgugauauuggcucacugcaaccuccaccucgcggguucaagugauucuccugccucagcuucccaaguauaugggauuacaggugcccaccaccacgccuggcucauuuuuuuguauuuuuaguagagaugggguuucaccauguuggccaggcuggucucgaacuccugaccucaggugauccacccaccuuggccucccaaagugcugggauuacaggcauaagccaccaugcccggcccuaauuuauugauuuccaccuuaaaaaagagaaaacaggccuggcgcaguggcucacacuuguaaucacaguacuuugggaggccgaggcgggcagaucacuugaggucgggaguucaagaccagccugacuaacauggagaaaccccgucucuacuaaaacuauaaaauuagccgggcgugguggcacaugccuguaauaccagcuacucgggaggcugagacgggagaauagcuugaaccccaaaggcugugguugcagugagcugagaucgugcaauugcacucuagucugggcaacaagagagaaacuccguuucaaaaaagagagaaaauaggcuggggacgguagcucacgccuauaaucccaacacuuugggaggcuaaggcaggcggaucacaaggucaagaauucaagaccagccuggccaacauggugaaaccccaucucuacuaaaaauacaaaaaaaaugagccaggugugguggugggugccuguaauuccagcuacucaggaggcuaaggcaggagaaucacuugaacccaggaggcagagguugcagugagccaagaucgugccauugcacuccagccugggcgacaagagugaaacuccgucucaaaaaaaaaaaaaaaaaagaaaauagaaguuaacucuaguauugaauguguguugcauauauuuucauucuuuuaauggaagugcuuaaggcuaugaacuuuccucuaaagucagcuuggucaaccauguguuuuuucauuuucaucauuuucuagcuguuuuuaguuguaguuucuaucuugucauaaaaucaagaaguugggccaggcaugguggcucacgccuguaaucccagcacuuugggaggccgaggugggcggaucacgaggucaggagaucgagaccauggugaaaccccgucucuacuaaaaaaaauuagccaggcgcaguggugggugccuguagucccagcuacuggggaggcugaggcaggagaauggcgugaacccgggaggcggagcuugcagugagccgggaucgcaccacagcacuccagccugggccacagagcaagacuccaucucaaaaaaaaaaucgagguugguguucuuguuuucauuuucaaguguuuguuuucuauucuuguagucuauuauacagccaauaauguaaaaaauaaacuuacauuaaguauaacagcuaucuugguugaaugccuauuagccuauuaaguaaccuaguacuucccucaguguuuuacauauauuauuucauuuaguucucauaacaaccuauuauuuuacagaagaaacuaaaaaaacacauuauggauuacacaacuaauaggggugaaacuggauuuguacccagguagucugacuccaaagcccaugcugucaaucaccaugcucuacuaccucuuagacaaccauuaucacuuauaaauauuccuaaauaaaagauuaucagaaguccauuaaaaaauagauggcugggcaugguggcucacaccuguaaucccaauacuuugggaggccgaggcagguggaucaccugaggccacgaguucaagaccagucugaccaauauggugagaccccaucucuacuaaaaauacaaaaaaaugagccaggcaugguggugcacaccuguauucccagcuacuugggaggcugagacgggaaucgcuugaacgugagaggcagagguugcagugagccaagauugcgcuacugcacuccagccuaggcaacagagugagacucugucacagaaaaaaaaaaaagucagaaauaguugugucauuuuuguuaaucuccccaaaucccuucauaaaaacagcaacuaggagaguuaaagcagaaauccaugcacagcaucuacugcuaaucuuugugacaagguaucuccacaaucccaaaauaugaucagauagugacaaaagcagcuauaagaucugcuugggacaucuguguggaaagccguggaggaaaggcaaugggacaucugauggcauuaagaauaggagagcccucaagucaacauguuuucacuggaaagcaugguaggccaaaaauaaaauuuaaaaaauuggaaccaggugugguaccucacgccuguaaucccaacuguuugggaggcagagacagugaaucaccugaggucaggaguuugaaaccagccaggccaacuggugaaaccccaucucuacuaauaauacaaaaaugagccaggcguggugguggcaggcaccuguaauccaaguuacuugggaggcugaggcaggagaaucgcuugaacccaggaggugaagguuggagugagcugagauccugccacugcacuccagccugggcaacagaaccaaugagacucccaucucaaaaaaaaaaaaaaaaauucuagcaacagucaaaacacagaagguuucuauagacuccaauuugcccgugaguuuguggggauggugcuaaguucugaagauguaguggucuagguucucaugaacucuugaaacuaacaaauuugagcuucauuccaaaacaaaaccccucugagguuguagauuccaaauugagcaggacagugacaauaagagguaaaagaaagaaaagguauagacagaagugagagagaagcagaggaaacaucucaaaguauuaggcuauuuuagucacuuucugaaaauaauagaacuucaugagccuugaggcuagaaaagcuauucugucgugucucucccaauaaguacaggaaaaugcauuucacgugaaaguaagcaacagaaaaagauuaugaaauauaauacaaaauugcauagaaaacagcaaaguaaaucccuaccaaacaggugaaaauuaacaugauguuucaaaacaagcuaaaagcgccugggcaacauagugagaccccgucucugcaaaaaauaaaaaaagcuggacgugguggcucgcaccuguagucccagcuacuuagaaggcaaacgugggaggauugcuugagcccaggaggucgaggcuguagugagcugugacuguaccacugcacuccagccuggaugauagaguaagacacugucucaauaaauaaauuuuuaaaaauauggggccggagcgauggccugggucuggagcccgcggccuccaccgcccacaauaacaacaacguguagggagcagccgcggccagagccggagcaggggccagaguugcggcuagaguagggccugcgcguuugagugacugagaguugccccugccugagaccucaaacuccaggcggaagcgcuaucgguuggcugagcagccguagcccgccgcacggcgacccccaggcccagacagcggggcggaggucucguaggcgcgggacuggcuucucucaggaugagcccuuagagccgggcuccggaucuuucucagccucgggccccuuucacuuucaggacagaggccagagaacggugaucaucacacaccccagccggcuuccuggccugggcauuuucuccgcggccaagcaguguugggguuguagcugcugggagcucccuccugccgccaccucuucugcuaggaagggacugacgcguucccacguucuugcucugcaccuccccacucuucccacucaagaauaaguuucucggccgggcgcgguggcucacaccuguaaucccagcacuuugggaggccgaggcaggcgaaucacgaggucaggagaucgagaccauacuggccaacacagugaaaccccgucucuacuaaaaauacaaaaacauuagccgggcgugguggcaggcgccuguagucccagcuacucaggaggcugaggcaggagaauggugugaaccagggaggcggagcuugcagugaguggagaucgugccacugcacuccagccugggcgacagagcgagacuccgucucaaagaaaaaauaaauaaauaaauaaauaaauaaguuucucuucccucuccauugaaaauucugccccggagguccaaaacaucuauuuugugugcccuuccccagcuccuggagcagcacccuuagaaguauugccuacucaucagggcugagaauccuucauuuuugacuuggcuuuuuucgcccuuugggagauaaaggucccuuuccacccucuuuacuaacgcucugcccaccagcccuuauccuuggggucaucagcuccuuggccauuucuaugugacuucccccacccaucugaguuccagcuuccucugggcuccaaucuccagucccuggcggagugacuagggggcucuggcccaggauccccaacccuggaaggcagcucuaacgcaggaagagaauugggcgucgggugcgcaccuggcagcucaggagucggggcuccacucaccccacacaagaagaugaaaaugcccaaagagcucaauguauugauugguuuggcuggggacagccagagaaagaagcccaagcagucaccgccugcuucgcccugagccuccugacuuagacucugaguccagcuccaaggaggaagaggaauucggugugguuggaaaucgcucucgcuuugccaagggaggcuauugacgaugcugcaagaucugcuauccgcucugugguuuugucacccucucugccuguguuguggccuguguuggcuugguguggaugcagguugcucucaaggaggaucuggaugcccucaaggaaaaauuucgaacaauggaaucuaaucagaaaagcucauuccaggaaauccccaaacuuaaugaagaacuauucagcaagcaaaaaaaacuugagaagauugaaucuggagagaugaguuugaacaaagucuggauaaacaucacggaaaugaauaagcagugcagggucgggucaugaguggccagagccuauccuggcagcguagagugcaaagcgggaaccaauccuggacaggaagccaucccaucgcagggcuuacucauacacacgcucacacucagacugggaccauuuacgcaugccaacuaaccaaacaugcacaguuuugugaugugggaguaccuggagaaaacccacgccaacauggggagaacaugcaaacagacaguggcccggccaggagucagauuuuuuucuccucaauguuauaaccaaaugacguugaacaaaacauuauucaaggaccugcuguaaauaggaaaguuuacuucuguccuagggcuucaucuaugaagcuggaagagauugcacugaaacccuuuccauuucagcaucaacaugccuucaaagauucugggacugacuuaugaagccagccugauaacagaggacuucucugcgagcacagguccagaagcauggguggugggaaagcagaaacuuguguuguuuccuaagggagcucucugagugguuuucuaaaauuaauguuacacaucucugauggucuauucaagucagaggcaucuguccuaaaccaaaauagguagaaaaauaaaaguaucugggcaugguggcucacgccuguaaucccagcacuuuggcaggccgaggugggcagaucacccaaggucaggaguuugagaccagccuggccaacagggcaaaacccucaucuacuaaaaauaaaaaaaauuagccaggccugguggcauguaccuguaaucccagauacuccagaggcugaggcacgagaauugcuugaacccagcggcagaguucggcagugagccgagaucacgccacugcacuccagccugggugacagagcaagacuccaucucaauuuaaaaaaauuaauucauuaauuaaaacauaaaaguaauauuuaaccauaaaaaaaaaauuuuuuaaauuguccauuucuccaucucaaaaaaauaaaaaauucuaauuuuccuuuugauuccuccuuuaugaguuauuuaaauguauauugauuaugaagggauacugaaaucuccaaacuuaauuaugaacuucucuauuuuuccugcaguucuagcaguuuuggcuuuguguauuuugaaucuuuauuaagugugcaguguuuagaacagguaugucuuuuuguuuauuuguuuuuugagauggagucucacucuaucgcccacgcuggagugcaguggcacaaucuuggcucacugcaaccuccaccuccuggguucaagcgauucuccugccucagcuuccugaguagcugggauuacaggcacgcaccgucacgcccagcuaaauuuuguauuuuuaguagagaugggguuucaccauguuggcuagguuggucucgaacuccugaccucaggugauccacccacccaccucagccucccaaaugcugggauaacaggcgugagccacugcgcccagccaacauuauuauuauuauuuggagacagggucuugcucuaucacccauccuggaguacagaggcaugaucauggcucacugcagccucaaccuucuggacucaagugauccucccuucucagccuccuaucuaggucuauaggcaugugccaccaugccuggcuaauuuuuaaacuuuuguaaagacggggucucacuggguugcaucggcuagccucaaaguccuggccucacguaauccucccaccuuggccucccaaaacaugggauuauagguaugagccacuguccccuauuauaaggguacacaccuaauuauuauauuaucaaaauauaagccuauuuuaauuuaugucuauuuuuauauuuaagguggccuuuauguagguggcauaugauugggucuuuuuuuauucaguaugaucugacaaucuuugguuuuucauugggguauuuagaccauuuauaucuaauguggccaggcaugguggcucaugccuguaaucccaggacuucaggaggccaaggugggcagaucccuugagcucaggaguucaagacuguccugggcaacauagugagaucuagucucugcaaaaaaaauaagcaaaaaauuaucugggugugguggcaugcacuguagucccaccuacuugggaggcuaaggugggagggucgcuugagcuugggaggucaaggcugcagugagccaagauugugucacugcacuccagccugggugacagagcaagaugcugucccaaaaaaaaaaaugugguuauuaauaugaucaaguucaaaucuaccaucuuuuuuuuuuugagacggaguuucacucuuaucacccaagcuggagugcaaugguguggucucggcucacugcaaccucugccucagccuccugaguagcugggauuauaggcaugcaccacaaaucccagcuaauuuugugguuuuuuaguagagaugggguuucacuauguuggccagucuggacuugaacuccugaccucaggugaucugccugccucagccucccaaagugcgagauuacaggcguaagccacugcaccuggcucaaaucuaccauuuuacuauuuguuuucuauucgaccaaugugucuuuguuccccuuucucucucucucucucucucucuuuuuuuuuuuuuuuccuuucuggccgggcacgauggcucaagccuguaaucccagcacuuucggaggcugaggcggguggaucaugaggucaagagaucaagaccauccuggccaacauggugaaaccccccgucucuacuaaaacuacaaaaaauuagcugggcgugguggcgugugccuguagucccagcuacuugggaggcugaggcaggagaaucacuugaacccgggagacggagguugcagugagcugagauuguggcacuguacuccagccuagugacagagcgagacuccaucuccaaaaauaaauaaauauauuuaucgccuuucuuaucauuaguauaacacuucauuuuguuuguuuguuuguuuuauaagugguugcuuucagguauguaguauacauauucaccuucaauugauauuacacuacuucacguauaggaugagacuccuguaccaauauacuuccacuucugccgucccaacuuuugaacucaucauacaauacuucuacauauguuauaacucccauaacucauuuuuuuugcuuuaagcaauuaucuuuuaaagacauguaaauaauuuuuuaaauagucuuuuauguuaacccucauaguuacuuuuuuuuuuaaauugagacagucucacucuguuccccaggcuggagugcaguggcucaaucucggcucacugcaaccuccauuuccugggcucaagugauccuccugccucagccucccaaguagcugggacuauaggcaugugccaccaugcugggcuaauuuuuuuuuuuuuugagacggagucccacucugucaccaggcugcagugcaguggcgugaucucagcucacugcaaccucugccucccagauucaagcaauucuccugccucagccuccugaguaacuaggauuacaaucaugagcuaccacgcucagcuacuuuguguauuuuuaguagagacagaguuuugccauauuggucaggcuggucuugaacuccugaccucagguuaucugcccgccucggccucccaaagugcuaggaauacaggcuugagccacugcaaauggccugcauuuuguuuugaaagauauuuuugcuggguauagaauuagagguuaauaguuguuuucuuuucuuucaguacuuugaaggaguuuacuaccucugcuugcauuauuuucuuuaagaacuuggcugucauucuuaucuuuauucucuacaugcugugccuuuuuucucugucugcuuuuucuauuucuuuuuuuuuuuggaaacggagcuuugcucuuaucgcccaggcuagaguacaauagcacgauaucggcucacugcaaccucugccucccagguucaagcgauucuccugccucagccucccaaguagcugggaugacaggugcuagccaccacaccuggcuaauuuuguauuuuuaguagagacaggguuucaccauguuggccagacuggucuugagcuccugaccucagaugauccaucuggcugcuuauuaaaaaaauaccguuuccauucacaguauguaaaagaagaacugaaauguccuggggaaguagaugcuucaaaucucccuguccacugguuccagggccuggggaaguucuuucuuuguuuaaaucucagcucuuccuguugccuaugauauuccuuauuguucaguccucuaaggaggcuguacagcaguucuguauccccuuuucuuuguuuaauauaauauccuuucagagauaaaaugacaauuccauuuccccccaaccuguuuuuggagacagagucuugcucugucacccaggcuggagugccguggugcaaucuuggcuuauugcaaccucugccucccaagcucaagcaauucucaugccucagccucccaaguagcugggacuauaggcucaugccacaacaccuggcuaauuuuuauauuuuuaguagagacaggguuuugccauguugcuuaggcuggucuugaacuccugaccucaagugauccacccugcuagaccucccaaagugcugggauuacaggcaugagccacugcaccuggccagaaagcucauuuuuagaagguugugaagucucauguccuauaaagacaaaauagaggaggaagggagaaaacaacaaacaaagaacaauccugaaaaaucaauauaggccacaauacucugaagucaauacaucaguaggcagguaugaaagcugcuuaucuauguaaauagguuguuguuauuuucuucugaaauuuaaguugucuagcuucaguucgcagggcuuuaagaaagcacagcuuaggccaggcucagugacucacgucuguaauccuagcacuuugggagguugaggugggcagaucaccuaagguugggaguucacaaccagccugacaaacauggagaaacuccaucucuacuaaaaauacaaaauuagcugggcaugguggugcaugccuguaaucccaguuacucgggaggcuaaggcaggagaaucguuugaacuugggaggcggagguugcggugagccgagaucgugccauugcacuccagccugggcaacaagagcgaaacucucucaaaaaagaaaagaaaagaaagcacagcuugauuuucagugacuccaaauuagggaaaauggagaaaaaggaggagaaaaaaaauuaaaaauaauauuuugcaggcucguagccaagacaauuagaauucgguccaaaguguagaaaaaaauaaaaauugguaaacauuaggcaagacuagaaucuaacaacagguguacuaaaguuuuugaaacauaauuuuucucucuccaguuucccauuuuuacuaaagacaaaucaugguaggacugauuugcuuuauuauacuuggccugauuauuuguauacacugcagcaagaacaauuauuuuuuuccauaggcuuuuaaaguggcuuugauggaacuuuguucaguagaaggaaucucagauaagacuuuuuuaaaggugagcccagccaugcauuuguaucaucaaauaccuacgaguugggugaauucgucuccucugagguuccaagauauaucuggggcuccugggccugucagaaagugacauucuuuacuuaccacaggucaggaacccuguacagggacuguguagaugaaaguaugaggccaguuuuuuccaaggggcuuuuauuggcuacauaagucacguucaauuccuuaaaggaaagcacaccauucaagucaaagccuugguaaaauauccaguuucuccaacuguguccuguuacaaaugaaaacagauuuuuuuuuuuuuugagauggagucuugcacugucgcccaggcuggagugcaguggcacgaucucggcucacugcaagcuccaccuccccgguucaugccauccuccugccucagccucccaaguagcugggacuacagucacccgccacugcaccuggcuaauuuuuuguauuuuuaguagagacaggguuucaccauagccaggauggucucgaucuucugaccucaugauuugcccgccucagccucccaaagugcugggauuacaggcaugagccaccacacccagucaaaaacagauucuuauugcacuuaugcaaacaauuguauugucauaaguuaagaauacucacaaauaguuuccaaauucuguagaaaucagguagagagagacaaauaugcuccuaauuuuguucauaggaguauacuuuacucgauuguuaaaagcuguaaauagcuuaaaagaaaaauuuuacuacuaugaaaaaaaaaagaaucagcaacguuuuuuguuugguugguuuuuuuuguuuuuuguuuuuuguuuuugaggugaaguuuugcucuuauugcccaggcuagagugcaguggcacaaucucggcucacugcaaccuccaccuuccaguuucaagagauucuccugcugggauuacaggugugagccaaugcacccagccaucacacacacaucuuggauguuagcuuuuaauuaagcugacuuuuaaccauugagcuccuuuaaaaaaaauuuuuuuuaaccucauuaccauauuucagcuaggacaacuugcugcuauuucagaaguacagcuauugcucuuucaguuuggccuggcuggcaaaaacaugaccuuguuauguaaauaaaccccuuaguagucaaaauaaaaaaaucuuuccucuuuuuuuuuuuccuuuugcuggcuguuuuuucucccccaccauaccaccuuuguguggggggguuggggggagaauuuaaccauuucagggccuuguuccccauaauuuggaacuuuccuuuggauuugaucaagucagauaaaguuggucaaacccaaugggaaaaggaccaaagcaccaacaaaaauggacacaaacaacaacaaaaaacaguuaagcaaaacaaacaaccccacaacuuauauggauuacugagugcucuaauaguaaagagaaauuaagaccagcugguuguuaacuuuagccuagacaaaaucccaauucagcuacuuacuuagggaugggucucaggcugaagacugcucucuaccauccuagaagcaggaaaacaaaaaaaaaaacucaccuucccuauuggaagcaagcucaaacccggcaaaggaguuaaccuguuuuccaucaucauggaagcuggaaaauuugccuuccuuguuggaagcaagugaaacugaaaaaaaaaaaaaaaaaaaaaaggaaguuguacagcaaaaucaacuuuagaucucaaccaaaucuugggaaaucagggauucucuggaggaggugauccaggccucagcaaguuguccuauuuguuugagccauaaagauagcucaagcugguaccaagcacugauaggagguuugucaaggucaggggcaccuccacucagaaucccuucaugguuaccaaaacgugaacccugaaaaucugagacagaucucaguuaauuuugaaaguuuauuuugccaaaguugaggacgcaugccugugacacagccucagaaaguccugaugacaugugcccaagguggucagagcacagcuugguuuuauacauuuuagagagacaugagacagcaaucaacauauguaaaaugaauauugguuugggucagaaaggugcgacaacucgaagcaaaagcaggacaacucgauguggggaggggccuuccaggucauagguagauaagagacaaaugguugcauuccuuugaguuucugaucagccucuccaaaagaggcaguuagauaugcauuuaucucagugagcagaggggugacuuugaauagaaugggaggcagguuugcccucagcagcucccagcuugacuuuucccuguagcucagugauuuuggggacccaagauauuuuccuuccacacccuguuaacacugagcugagagagguuccggcacccaccaugguuauuccaaauucccaacacccacaaacauaugagcucucuccuauaacucuucacacucuguauacaucacaauuauaacauuagcacguuguauuguaauuauuugcauguaugccugcccucuaaucuccuuaagguguugggggagcucuucuuuuauugaguguuuuuuuuuuuuaacuugccacuuuaaccauuugaaguauacaguucaguggcauuaauuacauucacaauauuauccaaccaucacuucaauccauuuacacauuuuuuuaucaccccaaacagaaaucucccauucauaccuaccgcaacaucugauaaugucuugucuuucugucucuaugaauuugucuguagcaggacgagccgcaaacaaaacuccucagacaccgaguuaaagaaggaagggguuuauucggccaggggcaucagcaagacuccuguaucaagagacaagcuccccaagugagcaauuccugucccuuuuaagagcucacaacucuaagggggugcaugugagagggucgugaucgauugagcaagcaggggguacaagacugggggcugcaugcaccaguaauuagaugggaacaaaacaggauagggauuuucacagugcuuuucuauacaauguaaucuauagauaacauaaccgauuaggucaggggucgaucuuuaacuaccaagcccaggguuuggcgccgggcugucugcuuguggauuucauuucugccuuuuaguuuuuacuuuuucuuucuuuggaggcagaaauugggcauaagacaauaugagggguggucuccucccuuauuuccccccuuugagacucucacucaacagugggaguucucacuuucauuuuuacuaccuaugucuucuugcaagacagauugauagugauucauauaguacacuugugcugaagcauuuuggugaacuaagguagcaaugaagcuuuuuaucauuugaagaaguacagguagcaaacaagggagcaguaagcagguuucuauuacuauuauaacucuuuuuuauaagaguuuaaaauuuuuuuuuagcgcugggaaccauuuucuaaacuuggcccuaggaucaaauccaugccacacuugcacgggcacaugagccagucuugucaucucucuaacuaugucuucaacuacuugccuuugauuaucuauguguaggcagcaauuaguaagguuauauuuccuacagaccucuccuucagcugcuaacaaguaguugagagcuaaucuauuuugauagauagcguuucucaucugaguuucuugcagggccagaauagucaaggcucugccgguuuuauuagugauuauuuuuaagacagcuuguaacugucaggccucugagcccaagcuaagccaucguauccccugugauaugaucgugguaaaguguugggaugacaaaaauuuuuggggguuguauggagagauaaugggcaauguuucucagggcugcuucgagcaggauuaggggcagagugggaacuuagagugggagagauuaagcugaaggaagauuuugugguaaagggugauauugugggacuguuagaagaaacauuugucauuuagaauuauuggugauggccuggauaugguuuuguaugaacugaaaaacuaaacacaauaagagaagaagaaaaacagguauuaaaggucuaagaauugggaggacccaggacaucuaauuagagugccuaaggagauucagcauaguccugccagcaaagauuauuuauuuacuucaagauuuaagaguggcaguuuggggauagcaccaggagauaucagcugugauggcuuggagaaauaguguaaaccggcaguguaaacaagagcagggcauguaugaguaguugagaagagugaauaggaauaugacuagacagaagauaguagggaugacaaguuuuugggggcacaguccaaguuggucuggugucuggaaugagacuggggcuuaauaaaaaggagcgucuauacaggaacucaaaugggcuguacccuguagcauuccaaggacaggccugaauucugagaagggaaagugguaaaaguauuguccaguccuuuuuaaguugguggcugagcuuggugagguguguuuuuaaaagaccauuaguccguucuaccuucccugaagacugaagaccguaagggauauaaagguuucacugaauacuaagagccugaaaaaaugcuuggcugauuugacuaauaaaggccggucugcuaucagacuguauagaggugggaaggccaaaccgaggaauuaugucugacagaagggaagaaaugacugcgguggucuucuuagacccuguaggaaaggccucuacccauccagugaaagugucuacccagacuaagagguauuuuaguuuucugacucgaggcaugugaguaaagucaauaugccaguccugggcaggggcaaaucccagagcuugauguguaggaaagggaggaggccugaacaaucccugagggguaguagaauagcaaauggcacacugagaagugauuuccuugaggauagauuuccaggauggaaaggaaaugagagguucuaagagaugggcuagcggcucauaaccuacauggaagagguuaugaaaugguaacagaauagaaugggacugugaggcuggaaggagauauuuuccuuggucuaagaaccauuugccuugugugggaagagacugauagguggaaguuucagcgggggaguaggugggagugacugaggugaaggagaaaaacuggcgugagggacagaaguuggaaagcuagcugcuugucuagccaccuuaccagcauaagcguugucuagagcaaugggaucugaugccuuuugauggccuuugcagugaaugacuccagcuuccuuuggaaguaaagcggccuugagcagaguuuuuauuaaagaggcauuaaugauggaggacccuugaguagugaggaaaccucuuucagccuauauaacagcaugcuggugcagaauaugaaagacauauuuagaaucacuauaaauauugacgcguaguccuuuugcaagagugagggcuugaguuaaggcaacuaguucggcuugcugagagguaguggaggggggcagagugguagccucaaugauagauguggaagauacuauagcauagccugccuuugcuggugaguggcgauuaggccuagcagaacugccaucaauaaacuaaaugugaucagggugaggaacaggaaagaaggaaauauggggaaauggggugaaugucagguggaucagagagauacagucaugagacagucaugagggucaggugugguauccagaauaaugugggaggccggauugaaguccaggccaggaacaaugguaauugugagagacucaacaaagagugaguacagcugaaggagccagggagcagaaaguauaugugucaggugugaggaagaaaauagauuuugggaguuaugagaacuguagagaaugaguugagcauaguuugugauuuugagggccucuaaaaguauuagggcagcagcagcugaugcacggagacaugauggccagccuaaaacaguagggucaaguuguuuggacaaaaaggcuacaggacgcgaucccgguccuuguguaagaauuccgacugcacagcccugcacuucagcuguguguaaugaaaaggguugggaugagucagggagagcuaggguggggccagucucuaaagcugucuucauggaauggaaagaggagugggaaaaggauuuaggaucuauggggucagcuagguuuccuuuugugaguuuauauaaugguuuuguuaggauggcaaaaccagguguccaaaggugaaaguauccaaccaugcccaggaaggaaaggaguuguuguuuuguagaagggguugggguuugagagaucaguuggacaugaucagcagggagagcacguguguuuuuaugagaauuaugccaagauagguaacagaugaggaagaaauuugggcuugacugaaguaaugggggcugucugugaggacuugcggcaguacagcccagguaauuugcugaaccugaugggugucagggucaguccaagugaaagcaaagaaaggcugggaugagggguguaggggaauagugaaaaaagcaucuuuaagaucaagaacagaauagugaguaguggaggaagguauugaggacaaaaguguguacggguugggcaccacaggguagauaggcaaaacaauuugguugauaaggcacagauccugaacuaaucuguaagacuuguccgguuuuuggacagguaaaauaggggaauuguaaggagaguuuauagguuuuagaagcccaugcuguagcaggcgagugauaacaggcuuuaauccuuuuaaagcgugcugugggaugggauauuggcauugagcgagguaagcaugauuagguuuuaaugggaugguaaggggugcaugaucaguugcuaaggagggaguagagaugucuuauacuuguggguuaagguggggagauacaaggggaggaugugaaggaggcuuugaacugggggaaaaggcggcaaugagguguggcuguagccuaggaacagucagggaagcagauaauuuaguuaaagugucucggccuaauaagggaacugggcagguggggauaauuaaaaggagugcuuaaaagaguauugucuaaguuggcaccagaguuggagaguuuuaagagguuuagaagccuggccaucaauacccacaacaguuauggaggcaagagaaacaggcccuugaaaagaagguaauguggaguggguagcuuccguauugauuaagaaggggacggacuuacccuccaugugagaguuacccgaaacucggcguccgugcugguuuagggggcuucugaggaaaucaggcagugucagucuucagcugcuaagccgagaagaucugggaaggagucagucagagagccuugggccagaguuccaggggcucugggaguggcugacaggugaguugaacagucugauuuucaguggggucccacacagaugggacguggcuuaggaggaaucccgggcugcgggcauuccuuggccugguggccagauuucuggcacuucuagcaagcuccugggggaggagguucuggaggaaugccuggcugcugcgguucagguguuuggaaguucuugugugcuggagauguggcugggguuugucucacaguggaggcaaggaauugcaacuuuuuucuauuauuguacaacuugaaggcgagguuaauuaaguccugucgugggguuugagggcuggaauuuaauuuuuggagcuuuauuuaaagucgggaguggauuggguaauaaaauguauauugaggauaagacggccuuuugaccuuuuagggucuagggcuguaaagcgucucaggguugcugccaaacgagccaugaacugggcugggcuuuucauacuugaugaaaaagggccuaaacgcuaacugauuuucggagagguuggauaaagaaaaaggagcauuaaccuugaguaugccuuuagcuccagccaccuuuuuaagaagaaauugcugggcaggugggagaaggcuaguugaggaacgaaacuguaagccggaccaggugugaggaggggaggugauaaaaggauuauaggguggaggagcggaggcugaggaagaauugggacguggcucggccuggcgaggaggggagaggucagaugggucuguagaaaaggaagauuagaaagacucagcaaugcuugggguugggacugaggggacaggcgggagggaaagaaggaggauuugggaugagucgcauugggaacagugacuagggagggaacaauguguaaaagaaugccuggaugucagggaccucagaccguuugcccauuuuaugauaagaauuaucuagaucuuuaggauggaaaaaucgaaagugcuguuuucuggcuauuuggaacuacugucaaguuuguauuggggucaagcgggauuguagaagaaaauaaggcauuuagguuuuaggucaggugugaguugaagagguuuuaaguucuugagaacacaggcgaagggagaagagagaggaauggaggguggaaguuugcccauagugaaggaggcaagcugagagaaaagagagaguagagacacagagggcagggguucggggguucuuaugcucuagaaaagugggaaagggguugggucauggaaauaagggguuggagcacagagauaagagguugggguguggaaauaagggauuggggcaaagagauaagagguuggggcauggaaauaagggauuggggugcagagauaaggggucagggcauggaaauaagggaucagugugcagagauaagggguugggggguucuugccucccagaaaaguggagaagggguagagacauggagagguguugggggguccuugccccccagaaaagcgguacuugccgcuaagggugaaggaccaaggcagguguccccgcguggucagacaccucugaaacaugagugaauaaacagagaggcaucccugcaaugauuaaacaccaagggaaggcugccuucccgaguccaugaccggcgucggaguuuuggguccacagauaaaacauguuuccuuugucuguaccagaaaaugaaaugaauugaaauuaagagaagggagagauugaaggcugacaccaagauugaaaggagaaaaugguugagggauagugagggagguuggagaagagaguaagaagaggccacuuacccgauuuaaaauuggugagauguuccuugggcuggugggucugaggacccaaggucuuagguggaucuuuuucacggagcaaagagcaggaggacaggggauuguucucccaagggaggucccccgauccgagucacggcaccaaauuucaugcacguccaugugaagagacuaccaaauaggauuugugugagcaauaaagcuuuuaaucaccugggugcaggcaggcugagucugaaaagagagucaguggagggagauagggguggggcuguuuuauaagauauggguagguaaaggaaaauuacagucaaagggggguuguucucuggcaggcaggagugggggggucacaaggugcucaguaggggagcuuuugagccaggaugagccaggagaaggaauuucacaagauaaugucaucaguuaagguaggaacaggcuauuuucauuucuuuuguggugggaugucaucauuuaaggcaggaaccggcuaucuggauguguaugugcaggucacaagggauaugauggcuuagcuugggcucagaggccugacaguuacauuguuccuuaguacaggaagggccuuuuuuuccuuucugaagguggacuggauccuuuucauuuuuuuuuuuaaucuaaguggccuaaaugacacaaaaccaguauuuacauuuauuuccacacaguccuaauuuaugacagauguacuuauuuucugccauauagccucuuuucuaauuaggagaaccacaacuuauuccuaacuuauuacuauuaaugacagcacaggcaucaaauuuuaaggugauuuguuugggcaccccuuuuucuucuguuuugccuaacacuuuauucauaucguuuuugagcccccaccaguccucagucuuuaaucuuauuuuuaaaacuguggucaugggaggcucagaugggucauaacauccaucagguuggucauuuccugggcuacaugccuuguauagaauaacauuauacaaacaaguucuuuucagaguuccaguacacuuauaauaaccauaauaucauaggaccauagcaaccuuuuguccuaccucagugacuugauguauacacugggaacaguccucagucugaggaaggucaguugaaguccuuacuguaaaaguucaaauuuuaaggaaaaugagucccgugaugaguuuucucaugcuucggucgugcguccgggugugacuggagcagggcuuguugucuucuucagagucacuuugcagggguuggcgaagcugcuccuguccauguaccacucacagucuacugauguuuaaggauggucucggagguugggccugcuagaauaaacugaguccaacaccucuacacaguuauguucaacugggcucucugauaccgggagcaagguggugggguuuaggguguugcaaacuucaaugguuauguggggauuuucacauagcaagcuuugguacuuguuaaucuagcauuuguuaaccaaugauguccuuugguagucauuaaaguuaccacagcaugggggacauuuauauucagguuuugccuaaugguuaguuuaucugcuucuugugcuuugugcuaacagggucacugcugcuagggcccuuagaccugggggccagccuuuggaaaccuugucugguuguuuugagagauaggccacuggccuuggccagugccccacagucugaguuaaaacugccauuuuuucuuuuucugacauauagaguguaaagaguuuugucaggucagguagccucagggcuggggccgacgugaguuuuuuuuuuaacucaugaaaaucucguugcuguugguuguaauagauguaguuuaucuaaucuacauuuuuauugacugucaccuaccaaaauguugacucaaaucuugcagcuauuugauuucaagcuuuaaauugaucugguauuccucaugggacuccaauugcaucuaaauagaugugagagucgaaagacccauaaggggcuucucucgcuuuacgaugcuuuauuuuuuuccuucugguugauguaaugccagggugaaagggauagccaauuggacuaaaguacaagugccacuccaguuauuuggcagagugcccaguaaagguccaccacaauaccaccacacauccgcuuggggaugaacaagggcugacugauugauaauuucuugaaaauucuuaagcucacugcaucccuucaggucuccaaggaaugcuaaauuuccucccugucgugagagacacaaagugaacuuaguguugggagacggaggcuggauggcccucaggggcugacccacagggugccggacuuugguauauagcagagagagcuuggcacgacuuauuacuccaggcuguagaauccuggaaagagcuaccauguagcccacaccuggucaacuggaagaccaccuuaguggaaaggggacaaucugggccucuggccugccaugugcacaagcaaaacaauuguuuuuguuuaacaugcagauggaauauuggaucuauuuuaaccaggcauuugcaucuugguauccugucuuaauugcuaaaguuuaagucuuuaacuucuaugauccucuaguaaaaugaauguaugguuuuaggaaauuacaaaaaccgguuggggcaguccauccuugcccuuuagugguccacagaauguuggaccaacuauggcaugaaagcucuacaucggggggcaagacuccugguuggcacuggggucuuuaucgaaaucuccucggauuaaaugguccuaguuuacuaaugcccagucugaggagaggcaggagagacagaaguaccuuucugaaguagaaagcugucuuugacuuggcaaguccucacagguuauaacaaggcaagcauuaaaugcaauaguuugaggugaaauugacuugguuauguuaauaacuagauggucagcaauagaaugaggaaagaagaaagaguaauagaauagaugaaaagaguuaaauuuugcuuagcuuuaguuugguaggguuuuccccugggacuauggcccacgacucuggaagugaugguguuuucuugacucgggugugaugaguccauucuuuuuuuuuuuuuuuuuuuggcuguacaaacagcagucucaguggcuagcagcacaagguaggguccuucccaggcuggcucgaguuuuucuucuuuccacccuuugaugagaaugugaucuucaggcuggugcugguuuaccggaaauucuaggagugguacaugugcuaaaagacuuuuaguuuuugagagaaaggaaaguggaagauaaaugaaguauauaauuuuuaagaaauugaccuuuuggggccgggcgcaguggcucacgccuguaaucccagcacuuugggaggcugaggugggcagaucaccugaggucaggaguucgagaccagccugaccaacauggagaaaccccaucucuacuaaacauacaaaguuagcugggcauaguggugcaugucuguaaucucagcuacucaggaggcugaggcaggagaauugcuugaacccgggaggcggagguugccguaagccaagauugcgccauugcacuccagccugggcaacaagagugaaacucugucucaaaaaaaaaaaaaaaaaaaagaaagaaauugaccuuuguuuuaaauguggggaccuuggcaguggacuuuauauuccuuagugccuuuuuacugagaaaaauguuuauuacuuuuuaaaccaaagaaagccaaauaccauuuuacacuuaacagugcuucucgugugauuuuuauaccagauaagcuaaauuuuauuuuuauauuaguguguuauuaauguuaaacuuaauuuuaauaaaaccuuguagacauauuuaucuaauuuuuaauguuugaccauaagguaagauuuuauagacucuuuuuaaccuuuuauuguagcaggacgagccacagacaaaacuccucagacacugaauuaaagaaggaagagguuuuuauucggccaggagcauugucagacucgugucuuaagagccgagcuccccgaaaaagaaauucuuggccuuuuuaaagguuuacaacuuuaagggguccacguguaagggucgugguacaucaagcaagcaugggaaacaugacugggggcuauaugcaucagcuaacagaacaaaaaguuuuacaaugcuuuuuuucauacagugucugaaauuuacagacaacacaaguaguuuaggucagggguugagguuaucauuauuacuuuuuuuaacuccuaaggccgggugguggugccaagguugucuggcuguuuaucuuacuuuuguuuuuuuuccaacuuuuuguuuuucucuccuccugucuugcgaacuaggcaagguggggagaggagggcagcaggaguaguaguggucuccuuccuuaucucccccuuugagaauuuucacuaaucagugggaguucuuuuauuuuuacuuuuugagucuuuuugugagacagagugauaguauuuuauguaauauacuuguguugaaguuuucugcugaaccaugguagcuacaaaaccuuuuaucauuugaaggagcaaauauaauauacaggggagcagcaagcaaguuccuauuacuaguaauacacuuacaaugaggguuuuaaauuuucuuacagcuggaaacuauguucuaaaugaacaccuaggaucagaccuguguuaaaccuguauaugcacauguaccaacuuugucaugccuuaagcagguuaguucuuuuuacugugucuuaaaagcuuuuuccuagugaguaacaugguauuuuuuaauaauagaaguuuuaagagccagaugcuugaacuuguggcaucuguuuggggaaagagcuaguuaaaguuaucuugaggcauuaacucuuuugcuucucaaggccauuggucucuuauguuagccuuuuuauaaacauaacaugaagaaacaucuaggcagcuagcaauguuuucagccagcugagcaaauagguuuuuucuguuuuugcuaaaggaggagguucugguaacuucugguuuauauguuuaaagaaugacugaaagacucagaauuguuacugggcuggacaggucuggguuuccuaaguaguauguguacaguggggacaccuuauauagguguuucuucuaacaugguuauggggguuaacaacaacaaaacaauguacagcauauucguauccagcaaggacaaaagagguccuuaccugggaaaaagguugaauacagcgaccgaacaauaggaaaacaguuaguauuacaggaaaacuauuagucuuaagauuuuuaacuacauuuacuugcucgaugaguccucaagcuucggccgugcguagacuggucagccuccggagugaccagagcagggcugucguccucagcagcagcuuggucucgucucaggaucagccagguugggugaucugcauccugcuggcugguccacuuguccugagcugccaguguuagcugacugugauggauccaagacacaacaccugcaacuuuaacagcagugggaguggacaagguuacaguauaggguccauccuauauggguccuagaaaaauuugauuuuacuuuuuuacuuuaaacagagucacuagauuuaaaggggugucaggcuuauaggcauuuuuauuuauuuaauuaugaacacuuuguauggcuauuuuuaaagccugcauuugcuuuuuuaagguuaauuccuguaguuucuggaggucaccuuuaauuugaccuaugauuuggggguggccgacugaacaaaaucuuauagggcaaauaccuuguuuguuugggggugcaccugacucggaggaggaccauaggcaaaaaccugauuuuaucuuacaugaauuuccuggcaauauuuuuuucaguagcugcucaaguguccaguucaugcuuuccaccuuuucuugaacuuuguggcugauggguuguguuuaacuuccauuuuauuuuuaacagccuuguuaaaucuuguacuauuucaacuacaaaugcuggccuauugucugacuuuaaaguuagaaguagucuaaaccuggggauaaugucuuuuaacaguacuuuaguuacuucuuguaauuuuuuuuguccugguggggaaaacuuuaacuuacccugaaaaggugcaaacaagcacuagcauguaccgauagccuccagcacggggcaguucuguaaagucuacaagcaaguucucacaagguauggcucuuucuccuguuuaaguuucuuagaggagggguucuuccccccuccacuuuguaacucuaucuagugcuuaaccuucagugagaaauuggaauccagauacagcagaaucugcugcuuuuaacuuuuguugugaccaugggcuccuaggagccuaaugagaaggugccuagucugcccuagucuuuacauucuuuaguuccugucagccugaucaggucaguauuuuguuccuccaaggugcggcggcccucggcccucuuugccuuguggccuuggccauuuccuuuauugccuuuugaauauuuaccguuuuaguguccuuucuuuuugcaucucgcacauuaaucucucucuagccuuguccggcucuugaauccuugccuaacuugacuucuuucacgucuacauccacguccacauccucucacauugcuaauuuuucuuuguauaagagcuguugcuaacagauuggcuuuuuuacuuaagucuuuguuuuuuuuuuuucuuucugaguuauccuacuccuacggccagcugguggggccaggcaacagcacgggcccugccccugcgcacugcggucugucucuccuguuuccuucugauucucuuuuucacacuuacucucagucuuuuuuuuuuuucuuuugcucuuuccuaguuuuguuccuuggucacaguuaacauacaccuugguggccacuuuuauagacuaggugguauucaugccugcagcuucugcuugauguuacccugggcuugcuuuacaaaugaaguauucacuauauacugauuuucagcggccucaggguuaaaugggguguaaagccagaaugcuuuauagagucucuuauaaaacugacuuaggcucuugucagcuccuugaaaaauuucugaaaucuuuuuuauauuacuugcuuuuuucuaccaacucuuagccucugcagaagugcuucucaguaccucugcaaacgcugaagcugaguugcauucucuggguuuuuuuccccuuuuuccuagaguaacaggcucuuuuuuuaauauaauuuuucaugcacuuagaggguuaaacaggcauaccgagagucaguguaaauguuuacagucuuaccuucacugaguucuaaggacugaauuaaagcaaucagcucagcuuaacgacaguguccaggguuaccaccgcauauucugcacaucucucuccuuguggguugaugaagcuguucccguccacguauagcucccaguuuacugaugcccaaggcugguccuggaggucaggucugcuagaguaaacuugaguccaacaccucuacacaguuaugcucgacagggcucuagcugccaggagcaagguggaggguucaggguauuuccaguuuaguagaucaaugguugaaaagggcugauagaugaaagucuguugcccccccagaugugggccuggucauuauaauagacagguccucgcgucucccugagaggcauuugcauagcucgagcaagaccagaucugagagggcccacuugacuaucuugacuuccuuccucggccucucgaggcuccgauccuccccuuugaggugagaccuggggcauguuagcuccugaaucucauuucugagggggcuguuggccucgguaaagggggauaggcugggacauauggagaaagaauuucuauuaucucuggcagcuccugcaaaacuggcuucuguugcuguuucugggacucccuuuuuaacuccaugucugcuggcgaagcugcucuuacuuuuacuuuuggcuuuuuuugcaauaagcuguuaaacagggcuaaauuuaugcccauuuugucuauauuauauuuaaccaugagucaauauaaaguaauuugaucuagguacacuggcuguccuccaaccccugucaccaccuuaaauacauggccaauuguucccugucuauaguuccuucggugggccauccaacaccaaaagagggcaauucuaauuuacacagaguucuuagccucuagggguuaacuuaacucuauaaucuccugcaaaacccuucuuaagguucuguaaccugcauuuuaauggaauaaguuuugaugauuugaugacuuuccuuuuauuuuucuuuuugaaaauuuuuuuuaacacaguucuuaguggaguaggcuuacuuugugucugaccuauuuuucucuugagacaaaacaacauucacacuacaagaaggaaaggauaaaaggucacucacucaucuaauucacacuaaaucaaaaugaaaacuaaaaccaaaguguuguuaaaggcacaccuguucaucaagcaauuuaagccaagucaaaaucagaaccaaaaccaaagugccaauaaaggcaugucuguuuaucaagcaauucaagucaagucaaaaucaaaacuaaaaccaaaguaucaagcaauucaagucaagucaaaaacaaaaaccaaugugccgguacaggcacgccaugggugaucaggccacacuuccacucaagaggaguggcaaguuccaaagaccagucuuaccaaguuucagauguccagacuuaaagugccaguuccuucccgguguucagccacugcguugauccuccgcgggggccugcugugcgcugcucuggugagguguucaaccggggcaaaugccuacccgggagcgcucuuaggauccguguugcucaagcuggccagaguccccugcagggaugcucuacagggcagacauaagcuaacuaaggggcugccuggaccaucccuuaaucaccucgcuucccggucagggaaccaagaaauguaacaggacgagccacagacaaaacuccucagacacuggauuaaagaaggaagagguuuuuauuuggccgggagcaucagcagacucgcgucuuaagagcugagcuccccgaaaaagaaauucuuggccuuuuuaaaggcuuacaacuuuaagggguccacgugaaagggucgugauacaucaagcaagcguggaggcuacaugcaucagcuaacagaacaaaaaguuuuacaaugcuuuuuuucauacagugucuggaauuuacagaucacacaaguaguuuaggucagggguugauguuauuauuacuuuuuuuaacuccuagggucggguggugguuccaagguugucuggcuauuuaucuuacuuuuguuuuuuuccaacuuuuugcuuuuucucucuuccugucuugugaacuaggcaagguggggagaggagggcagcaggaguaguaguggucuccuuccuuacaauuuuugcuaaagagcagguuggugcuuuaagauaaaccuguuaugcuuuuacuuuaauguccaguucacagaaaaacuggaugauacuucuuuaacuuuagcuaauauguuuacacacagaauuuucuuuacaauuaacauuuuaaaacauguuuaaaccuucaaaacaguaauuuucuuuuuuuaauguagguaaaaauguacauucuuaugcuuccuuauaauccuuuuaccaaagguauauuuuacuuuucuuauacaccuugcacauaaacuguuuuuuuuuuuaauaguuuuacauucaggaggccuaguuacuuuuaaauuauacaacauuuuuugcauaaauucuuuuuuauaacauuuuucucuuucaugacuuucacagacaauucuucgacaugccucaacuuucugacuuauuacaaauauuucuuucuuuaaacaaccaguuaacuuauuucaggacaagaaucuaccauauaauacucuuuuuauauaaauuccgcccccccuuuuuuucuuucuuucuuuuuuuuuuuccuuaggauacuucuuuuuuuuuuuuuagaugaaguuuugcucuuguugcccaggcuggagugcaauggcaugaucuuggcucaccgcaaccucugccuccuggguucaacgauucuccugccccagccucccaaguagcugggacuacaggcgugcgccaccaugccuggcuaauuuuuguauuuuuaguagcgaugggguuucaccaucuuggccaggcuggucccgaacuccugaccucaugauccacccgccucagccucccaaagugcugggauuauaggcgugagccaccgcgcucggcaaggauacuucugaacuggugagguaugcucacaaugagguuuccucuaaagguuauuuuuuuuaauuuuuuguuguuagcaaagcaguugcugcuacagauugaaugcuucugggccauccguggguuaccagguuaaggauuuuugauaggaaggccucagugcuuuugggauaugcccuuguuuacacuaauaacaaagugguauuggaguguuauaguguuauggagaauaccuucaauuaucaauuauagguuuuaaauuuaccuuggcuuuuaaaggaauaagguacacuuuuuuuuuuaaacuacuucuaucucucucucucucucucucucucuuugacuuugucucucuuugacuuucuuuuugccucucuuuuucucucucucugccucuuucucucucucucuccuugacucccucuuugucugucucuuccucucucucuuugccucuuguccucucucuuuccuuuuucucucucugcuggucuuuccuugccucugccagccacuuaugcugcuguucucucaaccacuguguguuggggguggggggucuaaaaccagcuguaaccaagugucuauguacgggaacuggucuggguucccuggcuuacagguuaccuugugccauaccuuugaaacaagggaccuguccaggcuuccuucuaauggccaaccuaccucuaaugcuagccagucuaucuuacacaaaguuuuaaguuuuccuagugucauaguacuccauagucuacuuuaaauucuuuuuugaaauguuucaacauaguuucuaauagggugggcuuauuugugccugaccuaucuucuucaagacaaaacaccacgcucacaccacacgcacaccacaaaacaacggguaaaaagggcacacacacacuuuuacaguuugcaccaaaccaaaaucagaguauccagaaauccaagccaggucaaaaccaaaaccaaaguaucaagcaauccaagucaagucaaaaacaaaaaccaaagugccgguacaggcacaccgugggugaucaggccacacuuccacucaaauggagugggcaaguuucaaagacuagucuuaccaaguuuuagguguccagacuccaagugcccauuccuuccugguguucagccacugcguugaucccccacggggaccugccacacauugcucuggcgaggcgucccaccagggcaaaugccuacccaggaacgcucucaggauccacgucgcuugggcuggucuggucggagucccccgcagggauguuccacagggcaggcuuaagcugccuaagaagcugccuaaggagcugccuugaccauccaccaaucaccucgcuucugggucagggaaccaagaaauguagcaggaccagcccagacaaaacuccucagacaccaaguuaaagaaggaagggguugcggggugcgguggcuuacgccuguaaucccagcacuuugggaggcugaggcggguggaucacgaggucaggagaucaagaccauccuggcuaacacggugaaaccccaucucuacuaaaaauacaaaaaaauuagcugggcgugguggcaggcgccuguagucccagcuacucaggaggcugaggcaggagaauggcgugaacccgggaggcagagcuugcagugagccgagaucacgccacugcacuccagccugggcgacagagcgagacucugucucaaaaaaaaaaaaaaaaaaagaaggaguuuauucggccgggggcaucggcaagacuccugucucaagagccaagcuccccagugagcaaucccuuuuaggagcucacaacucuaagggggugcacaugagaggguaaugauugauugagcaagcaggggguacgugauugggggcugcaugcaccgguaauuagaucggaacaaaagaggauagggauuuucuuucuuuuuuuuuuuuuuugagauggagucucacucugucacucaggcuggagugcaguggcgugaucucagcucacugcaaccucugccugcuggguucaagcaauuuuccugccucagccucccgaguagcugggacugcaggcgcccaccaccaugcauggcuaaugcuuuuuauauuuuuauuagagacgggguuucaccaugguggccagacuggucucgaacuccugaccucgugauccacccgccuuggccucccaaagugcugggauuacaggcaugagccaccgcaccuggccaggauagggauuuucacagugcuuuucuauacaaucucuguaaucuauagauaacauaaccgauuaggucagagguugaucuuuaccaggcccaggguguggcacccggcugucugcuuguggauuucauuucugcauuuuaguuuuuacuuuuuccuucuuuggagacagaaauugggcauaagacaauaugagggguggucuccucccuuagucuguccgagagaucucauguaaguggagucauacaauauguauauuuuuuugagacagaguccugcucugucacugcaaccucugccucccaggcucaagagauucuccugccucagcuuccccaguagcugggauuacaggcaugcaccaccauuccugcuaauuuuuguauuuuuaguagagaccggguuucaccauguuggccaggcuggugucaaacuccugacuucgugaucugccugccucagccuccaaaagugcugggauuacaggcgugagccaccacacccagccuauacuauauauauauauauauauauauauauauauauuuuuuuuuuuuuuuuuuuuuuuuuuuugagaggagucucacuguugcccaggcuggagugcaguggugugaucucagcucacugcaaccucugccuccugaguucaagugauucuccaccucagccucccaaguagcuuggauuacaggcacccaccaccaugccuggcuaauuuuuuuuuuuuuuuuuuuuugguauuuuuaguagugacgggguuucaccguguugcccaggcuggucucaaacuccugaccucaggugauccacccaccucggccucccaaagugcagagguuacaagcgugagccaccauuccuagaccaauauuuguucuuuuuuuuuuucccccagucucgcucugucgcccagguuggagcgcacuggcacaaucuuggcucacugcaaccucugccucccagguucaaaugauuuuccugccucagccuccugaguaacugggacuacaggcacccgccaccacacccaacuaauuuuucauauuuuuaguagaggcgguguuucaccauguuggccaggauggucucaaucuccugaccuugugaucugcccgccucggccucccaaaguggugggauuacaggcaugagccaaagcgcccggccuccaauauuuguucuuuugugccugcuuauuucauuucauuuaguuuuuucaaaguucauccuauaucaaaacuuaauuucuuuucauggcugaauaauauuccaucauauggauauaccacauuuuguuuauucauucaucaguugauagacacuucgguuguugcccuuugguuauugugauuaaugcuuugaugaacauuggguuauaauucuuuugaacaauuugucuacuaauucuaacaucugugucuguucaggauuaguuuugauuuuuuuuuuuaaaaugggucauguuucccucuuacuuugcaugucugacaaucauuaauugaaugguagaaaugaauuuuaccuuguugcuuacuugauuuuuuuuuuuagauggagucuugcuccaucuugcccaggcuggagugcaguggugcgauauuggcucacuacagacuccaccuccuggguucaagcaauucuccuggcucagccuccugaauggcuggaacuucaagugugcaucaccacacccagcuaaucuuguauuuuuaguagagacaggguuucaccauguuagccaggcuggucucaaauuccugaccucaggugguccaccugccuuggccucccaaaaugcugggauuacaggugugagccaccgugccuggcccaauauuuucuauucuuaugcaacuucuuguucuuuguucugagauucaguuaacuuauguggaaacaguuugaucauuuuuguuacuacuuuugucauuuguccagcaggucugaaguagugcucaagcuggggcuaauuagacgaagcaagcccuaccugaguauuuucccagugccuggugaauuaugaguuuuucuagucuagcuggugagaacaggcacuauucccagucauguaugagugccaggcacuguucuccaauccauucuaaugguuuuaucucagcuucaggaaguuucucucacacaugcacugaucagcacucugcugaguauuugagggaggcccucugcagauaccuggacauuugguacaaauuuaaagaccuugauguugaaggagugagggacgugccaucccaaaagaugcuggauugguauauugauuauuucuagcugaaaacauuggugaggccagaagugguggcucacgucugcaaucccaacacuuugggaggcagaggugggcugauggcuugaggccagggguucgagaccagccuggccaacauggugaaacccugacucuacaaaaaguacaaaauuuagcuggggaugguggcaccuauaaucccagcugcuuggguggcugaggcacgagaauugcuugaacccagggagguggagguugcagugagccaagauuaaaccacuacacuccagccugggccacagagggagacugaaaacaaaaacaaaacaaaauguuggcgaaauuguaguuucgggaaaaacuagcuaaccugugccuuccagcaggcagcaagccauaaggauuccucuaggaggaguacccuccccauaccagggugagaaaauagcccucauuaucagagacacacuggggggggcugccauggaccugaauaaacauacuuaaccaaguaacucuugucuucuauuaguuuuacacccuccccuacaucgccuaaugacuccccuagaaauuuacugccccucgccagauuuucuuuguccugucauuucuucucaaauucaucauccuuugucuaaaauguauaaacacagccaggcacaguggcucaugccuguaauccagcacuuugggaggccgaggcgggaagaucacuugaggucaggagcucgagaccagccuggccaacauggugaaaccgcgucucuacuuaaaguacaaaaauuagccaggcguggugauggcugccuguagucccagcuacuugggaggcuaaggcaggagaauugcaugaacugggagacagagguugcagugagccgagauugguccacugcccuccagccugggcaacagagugagacucugucuuaaaaaaaaaaaaaaaguauaaacgcaucuugcaucuugcuuugaccacuuguucagacuucaccaucuugugaagauccccaugcacauguaaaaccaauacaauuuguaugcuuuuaucuuguuaaucugucugguaucaauuugguuuccagauccagccaaagagcccacauaauagcuaaagaggugcuggaggugaucucugguuccccuacaaagucaucauuucuuuccucaccacaagaaaaagcugaaaaaacugaaaagcaauaacucuucuuaaagccauaagaaaauugaggucacaggacaaauuguugcccccccaaacuggagagacaaaugagccgauacagaaaaacacagccuacugggggcagaagcccaggaugagaagccugcagcugaaggcaguaguaguagggacacuuuaaaccuaauuaacaaaucccuggaggcuccauguggccaagaguuaaaaacugcggauggccaggugcggugccucaugucugcaaucccagugauuugggaggcuguaggugggagaaucacuugaagccagaaguuugagaccagccugggcaacauagggagacccccaucuccacaaaaaaaaaaaaauuuuuaaucagccauauaaaccgggcgcgauggcucaugccuguaaucccagcauuuugggaggccaaggugggcagaucauuugaggucagcaguucgagaccaaccuggucaacaugaugagaccccaucuguacuaaaacuauaaaaauuauccaggcaugggcugggugccguggcucaugggcugggugccuguaaucccagcacuuugggaggccgaggcggguggcucacaaggucaggagaucgagaccauccuggcugacauggugaaacccugucucuacuaaaaauacaaaaaaauuagccaggccugguggugugcaccuguagucccagcuacucgggaggcugaggcagaagaauugagugaacccaggaggcggagcaugccgugagccgagaucgugccacugcacuccagccugggcaacagagcgagaauccgucucaagaacuaacuaacuaaauaaauaaauauaaaaauuagccaggcauaguggugugugccuguagucccagcuacucaggaggcugaagcaggagaaucgcuugaacccgggaggcagagguuguggugaaccaagaucacaccacuguacuccagcuugggcaacaaagcgagacuuugucucaaaaaaaaaaaaucagccaugcguaguggcacaggccuauagucccagcuacucaagaggcugagccaggaggaucucucaggccuaggaagucaaggcagcagugagcuaucuuugcaccacugcacuccaacuugggugauaaagugagacccugucucuaaaaaaauaaaaaaacuaaaaaguaucaaauuauacaguuuaaauauaugcauuuuauuguguaucacauaucccucaauaaauguugguagaauuagugacucacagacacuaggaauucuauagaggcucagauauaauauuucaagaacaacugacaagcaauauaagaacaucuauauauagaacaucuuguuccauauucuuguuuuuauauucauguucaauuacuuuuuaagucucauuucuuagaggcagaauucauagauuucuuagguauuuuuucccuaaaggcagagccugagauaaagacaugguugugguuguuuauuugggaagugaccccaggaaguggaagugaaggaguggagaauaugauugaaauaagaaaggggaaaaaauccaauaaaggguguuacugaaguggucaccaugcaaagaacaacugggggucgaucuuauagggacucucuaaggaaccauguagacaguacuuuggaccguccugaagagcagggagguuggggcauuuauccaccaauucccacugagaauuccccagggauauuaauucccccacacuuacaagcugugccuccaaauggcaagcaguacccccgaagcaggaaaagagauacucuaauagccuuuguuugaugugggaugaugauaaguacaugagaauuuccacacagagaucaaagcugcacucaagugagccucuuaaguggauggagcaagacuguaaaagugauuaaaagcaaggguucuggagucauuccacacugguucaaaucucauuuccaucauuuuguacuuugagccugagcaacuuuuuuuuuuuuuuuuuuuuuuuuuugagauggagucucgcucugucaccagguuggagugcaguggcgcaaucucgguucgcugcaaccucugccuccuggguucaagcgauucucgugccucagccucccgaguagcugagacuacaggcacccaccaucacaccggcuacuuuuuguauuuucaguagaaaggggguuucgccauguuggccaugcuggucucaaacuccugaccucaggugauccaccugccucggccucccaaagugcugggauuacaggcgugagccaccgcacccggccgcagagauaaauuuagauaaugcauaucaagugccuagcacaguauuugucacgugguaacaauucaauuauguauuuuauucaucagagaagauuccagguaacuuuaccucaaagggcaaaguuuccucaucacucaggauauucuuacagaauuaaucauaggcuuugaaggcaaaagcaaaucaaaggguacaaaaauuuuacugguacaaaacagaaaaaggagacugaccaaaguggcuagucugagagaaaaguagguuccuggauaaggaaaucaagcuaaguacuuuuaagacuaaucguaauucuuaaauacuauaaaagaaacacaucggccaggcuuggcagcucaugccuguaaucccagcacuuugggaggccgaggcaggaagaucaccugaugucgagaguucaagaccagccuggccaacauggcaaaaccccaucucuacuaaaaaauacaaaaauuacccaggcaugguggcaggcgccuguaaucccagcuacucgggaggcugaggcagggagaauuguuugaaccugggagguggagguugcagugagccgagaucucaccacugcacuacagacugggugacagagcgagacuccaucucaaaaaaaaaaaaaaaaacacaucaaaaaucuuuuuaaaaauuucuccuaucuguucaauuucuugagacugaaacaaaauaaaauguuauuacaaguaagauguuuccagcauauuuaagaacaaaaccauauuuaauuuucuuuaaaaaaauagggggaaaccacuuuuauaucuaguuguacuaaaauacuccauauuuaaugccaauauuaaauauaugaaaccuuauacaaccaagccuuucuggccaggcgcaguggcucaugccuguaaucccagcacuuugggaggcugaggcagguggaucaccugaggucaggaguucaagaccagccugccaacagggugaaauccccucucuacuaaaaauacaaacuaauuugccaggugugguggugcacgauuguagucccagcuacuugggagguugaagcacgagaauagcuuuaacccgggaggcagaggcuacagugagcugagaucaugcagcugcacucuagccugggagacaagagcaaaacucugucucaaaaaaaaaaaaaaaaaaaacaguaacuuucuuuuucuugaggcuuugaaaacgaccuggucuggucuuuguuaaauaaugaaugauguuuaaauaguaguugucuacaggaacgaggcauacuagaaucuucuacacuauuuuuuuuuuuuuugagacggaaucucccuccaucacccaggcugcagugaaguggcaccaucucagcucacugcaaccuccgucucccagguucaagcuauuaucuggccucagccucccaaguagcugggauuacaggcaugugccaccaugcccggcuaauuuuuuuuuuuuuuuuuuuuuuuuaguagagacgggguuucaccguguuagccaggauggucuccaucuccugacuagagacgggauuucaccauauuggccaggcuggucucgaacuccugaccuugugaucuguccaccucggccucccaaagugcugggauuacaggcgugagccaccauaccuggccuucagauguucuuucaaguagcuagucacauuauuuagccuugaagaaaauugaagcuucuagaauuuuagaaucuauaaacuccucaauuaaaaggucuuuaugaggaaaucuaagaaguuugaaagcagaaguaacauauuauucuauaaagugacauuaauucaggaauauggaaauguagaaaauuauaccuaaugcucuaagaacuacauacacagaaaugaagaaauaggucacagacuuuggaauucuguuucacucugagcagcuugggcaaauuuucuugguagaagguggugaccugcuagaugaaauuugcucaguaauccacaguauggaagagcugaaaaguccaguccuguaauaagcagugugccuaaugaaagguaauuuuacaaucaaggccaggcgcgguggcucaugccuuugggagcaugagcacuuugggagacccaggagggcaggucacuugagcucaggaauucaagaccagcccgggcaacauggugaaaccccaucucuacuaaaaaaauagaaauuagccagagguggcggugcacaccucuguaguccgagcuacuugggaggaugacguaggagaauugcuugccccgggagguugugguugcagugagcagagaucaacaauaagaaccagaaacuucaagagcuacggucagagcuuuaaaaaagcuuuauucucacuaggagaaaaaacagcauuagauagaacgugacuauuaaguauaguuucuuucuuuuauagagcuuuucaguauugaaauuuaauauuauguugaauauuauaaccaguguuuaaauuuuggacauugccaaauuuaaaauuuaaaaauagcgccgggcaugauggcucacaccuauaaucccugcacuuugggagacugagacagguggaucacuugaggucaggaguuugagaccagccugaacaacauggugaaagcccaucucuacuaaaaauaccaaaaauuagccuggugugguggcaggcgccuguaaucccagcuacuugggaggccaacacacgagaaucgcuugaacccaggaggcggagguuacagugagcucagaucacgccacugcauuccagccugggugacagggugagacucggucucaaaaaaaaaaaaaaagaaagaaaauuauuagaauacauuacauugcguagauacaaaaacuagguauuucuuuaggagacugaggcgggugggucacuugaggccaagagugcgagacuagccugggcaacguggugaaaugcugucccuacuaaagaaacaaaaauuagccgggugugguggugggcuccuguaaucccagcuacucgggaggcugagacaggagaaucguuugaacccgggaggcagagauugcagcgagcugagauugcaccacugcacuccagccugggugacagagggagacuccaucucaaaaaaaaaaaaaaaaaaacaaggaaaagaaaaagaaaagaaauaaagaaacaaacuacugauaggcauggugguucacaccuauaauccuagaacuuugggaggcugaggcaggaagauugcuugagcucaggaguuccagaccagccugggcaacauaggaagaccucaucucugcuaaaaaaaaaaaaaaaaauuuuuuuuuuuuuugagacacacucguugcccaggcuggagugcagugaugugauuucagcucacugcaaccucugccuccuggguucaagcaauucgccugcuucagccucccaaguagcugggacuacaggcacgcaccaccauuccuggcuaauuuuuuuuuuuuuuuuguauuuuuaguagagacagaguuucacuauguuggccaggauggucucgaacuccuggccuugugauuggcccugccuuggccucccacaggcugggauuacaggggugaaccaccacaccuggccugcaaaauuuuuuuuuaaauuugccagauaugguagugagcaccugcggucccagcuacuugggaggcugaggugggaggaucaccugagccugggaggucgaggcugcagugagcugugaucaugccacugcacuccagccuggguaauagagugagacugucucagaaaagaacccaacaaacuauugauacaccuaacaauguguaugacucucaaaauaaugcugagugaaagaagccaaauaaaaaaaagaggccgggugcagcggcucaugcuuguaaucccagcacuuugggaggccaagguggguggaucaugaggucaggaguucaagaucagccuggccaagauggugaaaucccaucucuauuaaaaauacaaaaauuagcugggcgugguggcuggugucuguaaucccagcuacucuggaggcugaggcagagaauugcuugaacccgggaggcagagguugcagugagcugagaucgcgccauugcauuccagccugggcaacagagggagacuccaucacacacacacacacacauacacacacacaaaacacaugucaaagauucuauucauauaaaauucuggaaaauggaaacuaaccuauagugguaaguaagcagaucagugguugccuguagauugguagaggcaaaggagggauguauagguacaggagucaaggauuacuaagggacacaaggaaacuuuuggggguggcagccauuuuaucuugauuguaaugugaaaguuguuagaauugagauuuaacacuaggagucacuaguguuuaaaaaaaaaaauagagccagggaaggcuuguaugucucauaacagaagcuaucacaaaagacccuugaaaaaacacaaccuugcaaaaaagccaucacaaacuuacacaaaaaauucaucugcaaagacaucuaccaagcaacugccuguccaaccucagccaggcaacacccuuguuaaggauuuuuauagccaaggauaucauuucaaaacaaugauguaauccucuucauuuuuuccuuugaaaaccuuucuccucugucuuuuuccuuuuucuuuuuuuuuuuuuuuuuuuugagacagagucuugcucugucacccaggcuggagugcaguggugugaucucagcucacugcaaccucugccuccuggguuugauucucccgccucagucuccccgguagcugggauuacagacaugcaccaccauccccggcuaauuuuuguauuuuuaguagagacagguuuucgccauguugaccaggcucgucucgaacuccuggccucauguaauccacccacuucagucucccaaagugcugggauugcaggcaugaaccaccgcauccagccaaaaccuuugucuuucuuuaccuauucaauacauauacauaguuuacuguggcacacauauucccauugcaaugcguaacuccugaauaaaucucuuuuucuuuuagagagccucuuucucuuuauuauuuagauugacagugguaaugaucuuauugguguauacauaugucaaacuuuaucaaguuuguacuucaaauaugugcaguuuauuguauaucaauuacuucauuuaagcuguuuuuuaaaauguucauuacguuuuccuguguaaaauggaaauucgugugacuauuuauaacuuuuuccaacuuguucugucucuguuaaaacaaaucuguuguauucagcuuccagcucagacagaaaacugguaccagauuucccuuagugcuguaaacaacuagaaaacugcaugaaguauacaaaacaacugcuguucauacaugguauauguguuugcuagagcugccauaacaaaauaccagacuaguggcuuaaaaaacagaaauaggggccaggcgcgguggcucacaccuguaaucccagcacuuugggaggcugaggcggguggaucacaaggucaggagaucgaggccauccuggcuaacaugguaaaaccccgucucuacuaaaaauacaaaaaauuaggcgggcguggugaugggcgccuguagucccaccuacucaggaggcugaggcaggagaauggcaugaaccugggaggcggagcuugcagugagccgagaucaugccacugcaccccagccugggcaacagagcgagacuccgucucaaaacaaaacaaaacacaacaaaaaaaaacagaaauaggccgggugcaguggcucacgccuguaaucccagcacuuugggaggccgaggaggagucagaucacuugaggucaggaguucgagaccagccuggccaacauggugaaacccugucucuacuaaaaauacaaaaauuagcugggcaugguggcaggcgccuguaaucccagcuacucaggagucugaggcaggagaaucgcuugaaccugggaggcagagguugcagugagcugagauugugccacugcacuccagccuaggcaaaagagugagacuccauuucagaaaaaaaaaaaaaaaaaaagccaggaguguauuuucucacaguucuugaguguagaagaucaagauggcaguguuggcagguuuaauuucuucugaggucuuucuccuuggcuugcagagggcagucuacuugcuguguccuuuccugguccucaugugguccacucauccauggugauucuuccuuuucucauaaagauauuagccguaauggaguaaggccucacccguaugccuucauuuuaccuuaauuauuucuugaaaggcccuaucuacaaauauagucacauucugagauacacuagggguuaagacuucaauuggauuuuugggggacacaauucaguccauaacacauugcaaaauaggcuauacaggauugugauucuugaaaaaaggguaguaaaugaggcaagcaccucugcacuccagccugggugaaagugaaacucaugauugucacaugcugucugccuggaagcuuuaucugauccaugguguagagaagaggacccaaacaagagcguggaguucuugcugcauugaggagacagaguucagaguuuuuuuuuuuuuuuuuuuuuagacagagucuccaguugcccaggcuggacugcaguagcagcacaaucucagcucacugcaaccuacaccuuccagguucaagugauucuccugccucagccuccuguguaacuaggauuacaggcacgcgccagcacacuuggcuaauuuuuguauauuuaguagagacggaguuucaccauguuggucagacugguuucaaauuccugaccucaggugguccacccaccucggccucccaaagugcugggauuacaggcaugagccacugagcccagccagagauuggaguuugauaaggcugaagcagcuggaacuuguggaacaaaauacuaaaaagaagggagcuauacagaaaaagaaucugcauaaaauuuauuuggaguuauuggcagaauacuaaauugugcaaguauagaacaagacuccacaaggucagagaaaaaacaacuauugaaaaaggaacaacaacuagagaguuuuauguuggacaauuccuagagcuuacaagggcuggggagacauucacauucugacuauucugaauagaagaaccuuguuauacaccuaaggcauccaguggaaauacuagaauuaggccuagagaaaaagucacuccagacuugcucuaucaaaucuaauugccugccaaaacaaaacuaauuacucuuaaaaguaagacauucgacaacaugauauucacaauguccaggaucuagugaaaaauuauuagacaugucaaggagcaggaaaaugugaaccacagcaguagaaaaaaucagcuaauagaaaaaaaaaaaaaaaggucgggcaugguggcucacaccuauaaucccagcacuuugggaggcugaggugggaggaucauuugaggucaggauuucaagaccagaguggccaacauggcaaaaucccgucucuacuaaaaauacaaaaauuagcuggccgugguggcaugcaccucuaauccuagcuacuagggaggcugaggcaggagaaucacuugaacccaggaggcagagguugcagugagccaagaucaugccacugcacuccagccugggcaacagagcaagacucccucuugaaaaaaaaauuaaaaaaaaaaaguuaaaguucuaagucaaaaaagaaaaaagaauacaauauguguuuaguuuuauaaacauaauauaguaauauauauuaauauaacuauaauaaauggauuuuaaaauauaaauauauuuuuuaaagaaaaauaaaaauaaggccaggcacgguggcucaugccuguaaucccagcucuuugggaggcugagguggguggaucaccugaggucaggaguucaagaccagccugaccaacauggugaaacccugucucaacuaaaaauacaaaaauuagccgggugugguggcaggagccuguaaucacagcuacuuggggggccgaggcaggagaaucgcuugaaucugggagguggagguugcagugagcugagauugcaccaucgcacuccagccugggggacaagagcaauaccugguuuaaaaaaaaaaaaaguaaaaauaaauccaguagagaaugacugguuaacaaugaacagcacaaaacagaauaaucagccaggugcagugaggccaagcucuguugucccagcuacuuguacuugggaggcugaggugggaggacugcuuaagcccaggaguuggaaucuagccccaucucuuaaaauuuaaaaacgaauaaucauuucuauuuguguguaucugugugugugugugugugugugugcaccccuuaagcagguaaaaauuagaaagaacaucaaaaaaacaaaaaacaagugggagggggcaagggauggugggagguuggugacggauaaaagacuacaaauaggcuacaguguauacugcucgggugaugggugcaccaaaaucucacaaaucaccacuaaagaacuuacccauguaacuaaauaccaccuguacccccaauaacuuauggaaaaauuaaaauuuuuaaaauuaaaauuuuuaaaauuuaaaaauuaaaaaaaaaaaagaacaacaaaaaacaaagaggccgggcaugguggcucaagccuauaaucucagcacuguuggaagccacgguggguggaucccuggagugcaggaguuugagaccagccuaggcaacacggagagacccuugucucuacugaaaauacaaaaaaaaaaaauagcugggugugguggugugccccuguggucccagcuacuugggggacugaggugggaggauggcuugagccugagaggcagagguugcagugaacugagauuaagccauugcacuccagccucggcaacagagcgagacucugucaaauaaaaaagaaaagaaaaagaaaacugaguaucuuaaaaguugguauuugccacuuuuuggcaucuaaugagaugacuacaugguauuuaucuuucauucuauuuaaguggcaugucacauuuauugauuugcauauguugaaccauccuugcauuccagugauacauuucucaaaagaagacaugcaaauggcuaacagauaauaaaaaaaugcucagcaucacuaaucauuagagaaaugcaaauuaaaaccacaaugagauaucaucucauacagugaucaugacuguaauccuagcacuuugggaggcugcagugggcauaucaagaggucaggagaucgagaccaucccagccaacauggugaaaccccgucucuacuaaaaauacaaaaauuaguugggugugccuguaaucccagcuacuugggaggcugaggcaggagaauugcuugaaccagggagucagagguugcagugagccgagaucacgccauugcacuccagccuggcaacaaagcgagauuccaucucaaaaaaaaaaaaaaaaggaaaacaguauggagauuuaaaaaaaaaaaauccaaacuaaaaauagaauuaucauaugauccagaaaucccacuucuggguauuaaugcaaaagacuugaaaucaguuuguuaaagggauaucugcacuccuguguucauugcagcacuauuugcaguagccaaguuauggauucaagcucugcccaucaacagaugaauggauuaaaaaaauuauagugcauauacauaauggaauacuauucaaccuuuaaaaaaagggaaauucugggccaggcacaguggcucaugccuguaaucccagcacuuugggaggccgagguggguggaucacgaagucaggagaucaagaccauccuggcuaacacaguuaaaacccugucucuacuaaaaauacaaaaaauuagccaggcgugguggugggcaccuguaguuccagagacucgggaagcugaggcaggagaauggugugaaccugagagguggauguugcagugagcugagaucgcaccacugcacuccagccugggugacagagugagacuccaucucaaaaaaaaaaaaaaaagaaaaaaagaaaauucugggccaggcgcgguggcuuacuccuguaauccuagugcuuugggaggccgagguggguggauugccugagcucaggaguuugagaccagccugggcaacacagugaaacccuguuucuacuaaaauacaaaaaauuagccgggcaugguggugugcgccuguagucccagcuacucgggaggcuuagacaggagaauggcuugaaccugugagguggagguugcagugaaccaagaucacaccacugcucuccagccuggaugacagagcaagacucugucuccaagaaagaaaaaggaaauuguggcugggugcaguggcucgugccuauaauuccaacgcuuugggaggccaaagugggcagaucacuuaaggucaggacuuugagaccagccugggcaacauggugaaaccccgucuuuacuaaaaguacaaaaauuaggccaggcgcgguggcucacgccuguaaucccagcacuuuggguggccgaggcaggcggaucacaaggucaggagauugagaccauccuggcuaacacggugaaacccuaugucuacuaaaaauacaaaaaaaauuagcuggacaugguggcaggcgccuguagucccagcuacuugggaggcugaggcaggagaauggcgugaacuugggaggcagaacuugcagugagccaagaucgcguaccacugcacuccagccugggagacacagcgagacuccaucucaaaaaaaaaaaaaagguacaaaaauuagccaggcaugguggugcacgccuguaaucccagcuauucagaggcuaaggcaggagaaucgcuugaacccaggaggcagaaguuucagagggcgaagaucacgccgcugcacuccagccugggcgacagagugagaguguaucucaaacaaaaaaaaagaaaaagaaaaaaaagagagaaagaaauucugacauuugugacgacauugauggaauuggagaacauuaugcucagugaaauaagucaggcccagaaagacaaauaccacauguucucauuuauauguggaauuuaaaaacugaacuuauagaagcagagaguagaacaguagugacagaagcuggaggaugggggaaauggggaggugauggucaaaggguauacaauuucuucgguuuuuuguuuguuucuuucuuucuuuuugagagagagucuugcucugucauccaggcuggagugcaguggcacgaucuuggcucacugcaaucucuaccucacagguucaagugauucuccugccucagccucccuaguagcugggacuacaggcauuauacaggcaugcaccaccacacccagcuaauuuuuuuguguguuuguacuuuuagcagagaugggauuucaccauguuggccaggcuggucuugaacucgugaccucaagugauccacccaccucagcuucccaaagugcugggauuacaggcaugagccacugugccuggcccaaaggguauacaauuucaaacagagagaauguuuucucuuuuuaugcguucuauugcacagccuggugaauauaguuaauaauagaguguugaaaauuucaaaauugcuaaguaaauuucaaguguucuugccacaaaaaaauguuuaguauuugaggugacggauauguuaacuagcuugauuuaauuauuucacauugcauucauaaauuguaacagcauuuuguacccuauaaauguuuuccccacacgacacccucuucacagaacucauaagucuauacaauuauaaguugucaauuuacaauuuaaaaaaagaaaaaaguuggcauuugcuauaacaaaaguacccuagaaaauaauauauauauaaaaguuggcuuuugccagucugacaaaugaagggugaagcugcagcaauauguagagaggcaaagaggaagaaaacccaagauacacucagggaaauagagaguuugggccgggcgcgguggcucacgccuauaaucccagcacuuugggaggcugaggugggcggaacaccaggucaggaguuugaaaccaggcuggccaauauggugacaccccguuuuacuaaaaauacaaaaauuagcuagaugugguggcccaugccuauaguccaagcuacucgggaggcugaugcaaaagaaucucuugaaccugggaggcggagguuacagugagccgagaucacaccacugcacuccagccugggugacagagcgagacucugucucaaaaaaaagagagaguuugguuuacauagagcauaguuuuaauggcauaaugcaagaugaacuaaagaaagaaccagauuugugugaccugauaaggaguuugaacuuuguuguacaagagaaagugauuccaagcugaagagaaaugaucaggugaguguuuuaggaaggaaacuaugucaugagcaaaaggugcaggagugaaggcagcuauggaaucaauccaaguguccauugauggaugaacagauaaagaaaauguaagauacauacacaguggaguauuauucagccuuuaaaagaaggaaauucugucaucuuugauaacauagaugaacuuggaggacauuaccugggcgaaauaagcuaggcacagaaauacaaaugucucaugaucucauucauauguggaaucuaaaaaagucaaacucauagaagcagagaguauaauggugguuaccaggggauggagggugagaaggaagauuggggagacaacaaaauuucaguuaagaggaauacauucaagaguucuacuauuguacaccauggugacuacaguugauaacaauguauugcauacuugcagauugcuaagaggaugaauguuaauuguucucauacaaauaaaugauaaguaugugaggugaugcauaugcuaauuagcucaauuugccauuccacaauguauacauauuucaaaacaucauguuguaugcuauaaauauauauaauuuuuauuugucaacagagagagagaaaaggcaggaagacugggauaagggauacugguaaaguccauugggguuauauaaacugagacacugaauucaaacugugcuggcagauacaaaaaaugcugaaguuaaagacuuuuaagaaauauaaaaggaggccgccugcgguggcucacaccuguacuuccagcacuuugggaggccaaggcagguggaucaccugaggucaggaguuugagaccagccugaccaauauggugaaacccugucucuacuaaaauuacaaaaauuagccgggcauggugacacacgccuguagucccagcuacuccggaggcugaggcaggagaaucacuugaaccugggaggcagagguugcagugagccgagaucguaccacugcacuccagccugggcgacagagcaagauucggucucaaaaaaaaaaaaaaaaaaaaguaaaagggccaggugugguggcucccaccuguaaucccaacacuuugggaggcugaggcaggaggauaacuugagcccaggaguucgagaccagccugggcagcauagugaggcccaucucuacaaaauaaaaaaauuagccaggcaugguggugcaugccuguggguccagcuacuugggggacuaaggcaggaagaucacuugagcuggggaagucgaggcugcagugagcugugauugugccacugcacugcagccugggcaacagagugagaccccugucucaaaaaauaaaaaaaaaguuugaaacagaaaauaagaaaacaaaauaaacuggguguauaucgucaggaucaucuuuaguuuuuuccaguaguccuugugguacuaccaccguuuuguuaaauucaccagccaaagguuuuuauuuugucuuaauauuugaugaaaagaaacuccugguuccaaaccaauagguaaauggagaguaccuaagacauaagauaaaauauugauaaauucucagaugcaauucuucuucuucuuuaggucuugccaagggagaagucaucacacaaauguuuuuuuacugcucaguccaaagcccucuucucagauacagacuggcuucuuuugcuccucuuuucucuugaugcaagucggcuuuccaauccauugugaucacuaccacagaaucugucauucacgugucuuuucccucgccaugccacagccucaggguagaacccuguccaaaggcaccuuccucacuguucugaaaaacaaucaccagucccuuuuccuuuaggaauugagacacaucuaaucacuuuaaggaaaaagaaaggauguaaguguuccaaucaucucagcagaguugucagacaugugagagaaguagccaucuuggacuuggacaccaacagccuucagaagacuucagaccuggccucccucugaccuggagcugccuggccaagcccagccaacccugaaaaccauaaugaguuguugucuaaagccacugaguuuagggguaguguguuaggaagcaauagauaacugaacuagagguagugcuaagaaacagacuacagcacagcagaggguaaaaccagugaggaagugauuuuaauaauccaggugcucuuguucaaggauucccacugcucuucagauaaaguucaaaauacuuagcauggccuacaaggccuuuuaugaucucacccgugccuauaagaccuuuuuuuuuuuuuaagauggagucucacucuguugcccagaauggagggcaguggcacgaucuuggcucacuguaaccuccgccucccagguucaagcaauucuccugccucagccucauaagcagcugaaauuacaggugugugccaccacgccugcuaauuuuuuuguauuuuuaguagagaugggguuuuaccauguuggccaggcuggucucgaacuccugaccucaggugaucugcgcaccucagccucccaaaguguugggauuacaggcgugagccaccacgcccagccaaggccucuucuuacaccacuccaagucuuuuuucaauaaagcuuuauuuaaauauaauucacacaucuaacaguugauccauuuauacaauucaaugguuuucaguguauucacagauaugugcauccaucaccacucaauuuuagaauauuuuauuuuauuuuuuugagauggagucucacucucuugcccaggcuggaguguaguggcuccaucuuggcucacuacaaccucaaccuccuggguucaagugauucucaugcuucagccuccuaguagcugggauuauaggcaugcaccuggcuaauuuuuguauuuuuaguagagaugggguuucaccacguuggccaggcuggucuugaacuccugaccucaggugacccacccaccucaguuucccaaaguguugggauuacaggcgugagccacugugccuggccuagaauauuuucauuaccucaaaaagaaacccugcaucauucagcuaugauacaccuauuauuccccaucacucucucggccacuuccucuaaucuacuuugucucuguagauuuccauguucuggccauuucaugugaauacaauauguggucuuuugugacuggcuucuuucacuuagcauguuuucaagcuuuacucaugcuguggcauguuaucaguacuucauuccuuguuauggauuaauaauauucuuucguacagauauacuacauuuugcucauccauucaucaguugauggacauuugcguuguuucuaccuuuuaguuauuauuauugagacagggucucgcucugccaccuaggcuggaaugagguggcacaaucacagcucaccacagccucgacuuccugggcucagguguucuggcacagugccaccaugccuagcuaauuuuuguauuuuuuguagagaugggguuucaccaugcugcccaggcuagcuacucccaaacucuggggcucaagcaacucuccugccuuggccucccaaaguauuaggauuaccgaugugagccaccaaaccuggcgcuuuuggcuauuauuaaugcugguauaaacaucugcauacaaguuauugagcaaauguuuucguuucucuugggcauuggaauugcugggucacuuggugacccuauguuuauuugccgaauugcgagacuguuucccaacauggcugcaccaguuuacauuuccaccagugauguaugaggguucccauuucugccccccgccucccccgcccaagauggagucucacucugucacucaggcuggagugcaguggcacgaucucagcucacugcaaacuccaccucccagguucaaaugauccuccugccccagccucccaagcagcugggaguacaggcaugcgccaccacaccuggcuaauuuuguauuuucaguagaguuuugccauguuggccaggcuggucucaaacuccugaccucaagugacccacccgccuuggccucccaaagugcugguuuuacaagcgugagcuaccaagccuggccuugauucuagccuaaugaguguaaaggguuuugauuggauuucccuaaugacuaauaaugucuagcaucuuuucaggagcuuauuagccacuuacuaaucuuccuugagaaauaucuauucaccuugccuuuuucgagacggagucuugcucugucgcccaggcuggagugcacaaccuccaccuccuggguucaaaugauucuccugucucagccuccugaguaccugggauuacagguaccagccaccacaccuggcuaauuuuuuguauuuuuacuagagucgggguuucacuauguuagccaggcuggucuugaacuccuggccucaagugaucugccugccuuggccucucaaagugcugggauuacaggcaucagugccuaugucuuaaguguguuuacuaaauauuauuuuuuucauuuuuuugagacagggucuugcucugucacccaggcuggagugcaguggugccauuacagcucacugcagccucagccuucugggcucaagugauccucccaccucagccuccugaauagcugggaauacaggcaggugccaccacacccaccuuauuuuuaaauuuuuuauagagucagggucuugccaugcugugcaggauggucuugaauuccuggccucaagagauccuccugccucagcuaggauuauagguaugagccaccaugcccagccaguccuaagaauucuuuauauauucuacauacaaaucccuuaucagcugcacgauuugcaaauauuuaguuuuuguucucauauuuagggcuucaauccauuuuuuaauuuuuguauauggugugagguguggucuaacuuuuuuuacauguggcuaccuaguuucccagcaccacuuguugaaaacaccauuauuucucuaucggaugauuuugguacccuuguugaaaaucagcuggccauaugcgugaguguuuauuucuggacucucaauucuauuacucuacaucuaugcuugugcuaguacaacagccuugauuaccauugcuuuguaguaaguuuugaaaucagaagugugaauucgacuuuguucaagauuuguuuccaagauuguuuuggcuauucugggucucuuacaauauucuaugugaauuucacaaucaguuuaucaauuucaagaaauuggcuaggauuaugcugaaucugcagccuagugaaguauuaccauguuaacaauguuauuauggaauauuuccccaauuauguguauucuuuccacaauuucuuuaccucugaauccuuuaguuauuucaauagugcuguuucuucaagucuguuuagaacuaaaccuguuuuagauacaaaacauuaugugcccacuauuuuguuaaaauguggacuuugccauguuuaaguucuaggcuucuccacccuuauuguuuuagaacaccugagucagguauugugucaaguacuuaacauaccaacuaaucaacaacucugcuaugcagcaauucuuguacuuaauucuacuuaucauuugagguuaaguacacuggcaacagauggccucuccuugggacuuccaucccuuucaguacuuaggcucuuucuaauuguucccuauggacuacaugaucugcaaguuaaauuuucucccugcuaucaaaaaacugcuaaucaggcucuucugauuacaugguauacuaagggaaauaucguuuuugccugugaaccuuaucacugguagagacuugaaaauaccaugugcuccuuuugcaucuuuaggcacugcuaaauguuuuugcaucacuuucuaucucaaugacccuaugaaaaagguguuuugcagaugagcaaacuacaacuaaacaaacuuacaagauaacgcagccaggcaaauugcagaaauaaugaccucacauaccccuaaccacuauaauauacuuuauauugguuuugccuugagaaccacaaggcuucagauccacaagagggaaaaccaaguauuaacagaauugagccaaacaaugacuccaagaagauucuugauuuggguguaagcugaccugauuauuuaaaaaacacaguaugaaaaaaauugaccagaucuuggucucauuccugggaguaacuguacacaacuucucaauacaaauuucauauuggccggugcgguggcucacaucuguaaucccagcacuuugggagggcgaggcggguggaucacaaugucaagagaucgacaccauccuggcuaacauuuuuagucucuacuaaaaauacaaaaaaacuagccgggugugcuggcaggugccuguagucccagcuacucgggaggcugaggcaggagaaugccaugaacccgaggaagagcuugcagugagccgagaaugcaccacugcacucuagccugggcgacagagcgagacuccaccucaaaaaaaaaaagaaaaaauauuucacgggaugaguagaugauguaccucaacucuuucuuuguggcuauuucaaauaaucucaagcaaaccugaauuuuuuucugcucaauugaagcaaaauaauuaacuuccugaaauccugcaauauuaguaaugaggccccaaauuaaaguccacaggcaaacacagcaacacaaauuaccuuuaagcaugagccucagaucucguccugaaccaaugcuuuagugagcgcuugcuuuggcagaacauacuguaaaacuggaauguuugugugaggccgggcgugguggcucacaccuguaaucccagcacuuuugggaggccgaggugggcaguucaccugaggucaggaguuugaaaccagccuggccaacguggugaaaccuagguggcauugaacguuuugagauggugccaccacgcuccagucugggcaacagagacucagucucaaaaaauaguaauaauaauaauuagugugcgagacuaacagcuuggcaaguuuuaguauaagggcuccaagagugaaggggacagauaauuuguguacaauuuuuacuaacagcuuuuaagucaguuccagauuuuuccuuacauuuagauauucucaaaaauuacccauuucacacuccauuaucaaauuuuauuugacuuugagaaauugacagcccuucguuauuacucagaccaaucaaaaacacaguagaguccucccuugucugugaggagauaacauuccaagacccccccacaguggaugcccaaaaucacaaaugguaccaaagccuagccuagccuacauggccuuuuuggauggcaaauagcauauacagcauguauaugcuguauccaacauucccaucaguauucugcccaaggugggaaggacaggaugccucucagaaaagcacacaauuuaaaaauuaauaacucugagauugugguuaaccaugguugcagauaaggggauauuacuauauuguuauuugacuauacuuacuugugaagcgaugugugacuaucucauaaacaucaucuuauaauucguacauacagaaguuggaaauacaaaaugcuaugucugaaauccaaucaagauguagguaguaauugcuaaauaacaugcuaauuuuagaaauaaaaauuacagugaaggcaaauaucuaaaauggaccauaaaaauugaucaguaacugagacugaaagcagcacugccaagucacaauaggauccugaauuauacuuaaucugguucugugucuguaauacagaccaucuuuuuuuuuuuuuaaugucacuuugaauacguugaagucagguaaauucuagaaaauaaacgaguacuaaaaaaacaaaaacaaaaccaaaggauaauuaggauaaugccuuuauuaacgagaaugaaacguucauuccuccuuccacuccuucucguugguuuucuggacacagcucaccugauccugcuaauuaaaggguaugauuacuccaaaggauacaagaaucagaguuaccaaauucucaaacauaacauuauauaacugucaagugaacuaauaccaaagaaaucuuauuaaucggccuggcgcaguggcucacgccugcaaucccagcacuuugggaggccaaggagggcggaucacagggucaggagaucaagaccacccuggcuaacauggugaaacucugucucuacuaaaaaauacaaaaaaaaauuagccaggcguguguggcgggcgccugcagucccagcuacucgggaggcugaggcaggagaauggcgugaacccaggaggcggagcuugcggugagccaagacugugcaccacugcuccagccugggcgacagagcaagacuccgucucaaaaaaaaaaaaaaaaaucuuuuaaugaaugaaagaacauggcauuaauuguaauuaacaggcagggcggaguggcucaagccuguaaucccagcacuuugggaggccaagguggacagaucaccugaggucaggaguuugagaccagccugaccaacauggucaaacccugucucuacuaaaaauacaaaaugagccgggcguggcagaacaugccuguaaucccagcuacuuggaaggcugaggcaggagaaucgcuugaacccaggagguggagguugcagugagucaaaaucaugccagugcacuacagccugggcaaaaggagcgaaacuccaucucaaaaaauaaaaaauuaaugguucccacauuaguauuguuauuuuuguaccacccaagggccuuucugaagacaguuuaacagacuaagaaucauuuaacuuaccuagaaacguugucagucugcuuguggcuucccuccuugauugacucacgcugugugaugucuugagaaguaucuauccaccuguaacaaaaaauguuaacuugcucacugcagccucaaccucccaggaucaagcgaucccucccaccucagccuccaagggagcugggaccacaggcacacaccaccacaccuggcuauauuuuuuucuguagagacauggucucacuauuuugcccaggcugggcucaagcaauccucccacuucugccucccaaagugcuaggaauauagguguaaagccaccaugccugaccuucuccuacauuuucuuaaguaaaaaaagaaucauggaguuuuagauggagucuaaaauugaauugaauauugacaauauggccuauuccccuuaagucaaguuuucuuuucuguucuucuaugaccguuauauaaccauccacuuuuuaaaaauucuauuguuugacauuuuuauaaugccucucacuugcuuucucacauacaucccuaauuuccaaacaaaaauaaagggauauuaucuuagaaacgguaaacaucucaaauaucgaaguuucacuccacauaucuaaaugaaauuauuuaaaucaaacucaaaagccuguagggguuaagauuucuaaaggaaacuuacuucaugugaaugagcacuccaauaucagccaacaucaaucauucuuaccuaaagaauaauaagaaaaaguuaauauaaaagacaaggguauaaaauaaagguuugaaaaugcuagucaacuucaaaauuuaaagaguaaaaauccagagauaaagauuggggguaaguuacagcauaaaaaaauaggaagaaacuucauggugggggggaaaucuaaaauuauucuuacauaaaauaaguagacaccugaauuagaaugaaaacuguauuuucuuuaaaauguaaaagccugacucucaguuucaccagucugagcacaaguuugacugcaacccaaaauauacuaucccuuaugugaagguaugugacaacguugaccucaccaaaugaguuuuaacaucagcucuuuuuucauaugaaagcacauacccugcuccccauucaaguaugucuuccauugucaggcaggcugaccaccuucagcaggaguccuccaagagugcccaacuccccuucccacaguacacaacgcuguaguuguuguccugcaauccuuuguauuuaccucauucuuucccaucuaaguccucacugaguuuuaaaguuagggcuggaaaagcuaugccuuacugggacagcaaggaaccaauuuuuuucugagggagaagacauucaccuucacuauaugccuggcagggccacagugcacaaaacaaagaucagccuucauucaaguuccagguuuuucuuccucccugaaugauuacugcaaaggguauaugaaguaagaguucccuguugcacauguaccauccauaagggauacuauaucguuuugcauucuuccccccauucuccacauuguccuaucuuaaguccaagcccuuuucacucucaaaaaaaaaaaaaaaaauauuuuuuucagcacugguguucaaaagcaacguuuuuaugguuaaugguuuaccagcaacuguugagauuuccaguugagucuuaaaaauugccaaucauuaucuagcagcaaugacagaugauuaggagcagucaaauccucugaauucuuucccuaauaggcagccauuugagaacugcacuagcugacaucacuaaaacauuaucagcuaaagccaaaaccaaauaaaggcccagaccaacauccuggcucucuaaaaccuguccaaaaucauuaagugaaaggcaguaaaugcaggacuguggaucaugucacugcagcugacaaugauuaacaauaggagacaugcaacccccauuaagguuaaaaguccaaaacuagucacacgcaucucuuuauuggggaaaagugagacuauuaugcauucuugguagguuugcaaccuugcaugaagagcacccauugcauuucuuucaucuuucagaaagcaccgguaucuguuccaagggccuaacaguacgaaaauacauucuggcaucacaccucugaacccaagacuguucucauuaaaaauaauuuugguuuguaacaaaauuaugaaauacaaugcaagcaccucgguauagcauuauuacugaaaccacuuaauucccagcuuuuugaguuuuuuaaaaaaacccacugcacuaagauucacaauucauugcuacauacaaauuaaagcuaguaagaacacacuaacgucacaaguuucucauucuaaagugcaaaagccuaaucaucugaaagugaacaggguaaggcaaaauuaaccccccaccccaauaaaguuccugaaguccauauauuauauaccaaguacauucucuaaaaauuguuacugacugguaagaaauagaccugaguuuuuauuucuaacacccaaucacuaaaccacggcagcaagcacuggccaccgauuuaauggauuacgacacaggaaaccccaucaggguucuauguaauuuagugauacucaugucacuaauauugagcauuauacuugaucugcauuauauuguugauaugcagaggcuaaacuagucaucauuugcucuuucaucuaucaguagaguccaaaguuguuugcuugaauggacuacauguuaaaguacaagucuguccccaccuugugaauugcuugccaacgagcaagcuuuuucuugauacacagaagaaaagucucauagucaugaaguuuucaucagcauuuaugcaaaguaaaccacuuuccaguuacagagcagaaacauuauacaugaaaacugucucucaugcaugcuagcuaaaaccaguucagagaccaagaaguugaagugaggucuggaacaacaguugaugcaaaguccuaagcaacaaaaguugugcuuuugaagacuuagguuuucuuguaaacauuuuggacuauaacaucacaucccuaaagcuaagggaaccaaauucaaaaagcuacucugaacauaugcagucauccuacagaaacgacgaugucuuaugauugggaaugauucccaacauguauucgacuguagucaagucaauguuccacaccaccuucccccagguuuagaguauagacacauuuagacaagucccauaacuugaacuauucacauuagauucccaucuaagcccaaguuaguaacaaugguguuuucaugaagcccauguuuuuaaaaauuuuaaaucgcauuacaaaaaaaccuguacuuuuaguucaacucaacuuguagaauuaccaagauugcauaaugaaauuacugauauugccgaucuaugggcaggucaguuugcuacaauagagacuaauuaucacaugcuauacgguccaugucaaggugcuaaaagcacccuaguucccaaguauaguuuaguucccucucccccacaccacugauguguuccauguuaucuucaguuacaaugcaacuaaaggaaaccacacaacugagucagauauaccaaagaaucaaguuugcacuuuuuaucugagaacugcaacagcacugaauucugccugacaaauuacagcucuaaccccacacccacacaguuuugauguaagcuagcuuuaccauacaaguguuaggugcugcacuguaauuucauugucagaaaugugaugccagaaugcccacggaauaaaaguacauacaagucaccaaguuagauuauauugcuuguuaccuaccuguaugcagucggcaaugagaaucuuggagcaagcaggaauacuacauccggguccuaauguccauugccauuugcgguacuacguuccucacaguuacgcacugcagaaaugcuggcuaaaugcaguuauguagcaggccacuacuuuaauagugcauaauugcaguccaagaacaccagaaaacauuccgccacaacuuaguggcuugcccaagaaaagccaaguaucuaaauuuuaaucugccauaauaugccacuuaaaaauugcacaggcguaacauuacaauuuccccauuuuuuagcuguuuauauuagugguacaauacaucuauaaagaguggugggguuuguaguacuucuuaugaguuuaauguucuaagcaaagaggauuaugguuucacuaacaugagccaaugggcuaugcuuauaaaauaccuauuaaauacacuggggucuuaacaauaugcaguuuuuaaagauuaggagaaguauaaaaaacaaccaguguuccucuuaaaacaaaauuaugagaaaguggagaagaggaaauggggacaagugguuucuuuaaaugaaaaaaauggcuaaaauacuucaaaaauugcuaccuccccuuucccaccccaaguuucagaucgacuuuuaggaaacuauuaagauuauuuaaauucacauuaggcuaaaaacuaucauauauacauugaagacuuauugaaagucuauuugaguaagcuuacaacccugaguacauugcuguuuuagugaugaaagucaaaugucauuugaaacuaagcaacauuauuugcuaaacaacguuuagcaacucuacaguccacaguaaggguaucaaaagccacaacuuucaggagauuauccauuagcauccuucaccacucuucaaagguacaguacuaccaaaagcuuauuuuagggggucugugccagcaucccuuauaaagaaaggcauguaaucugaaaaauaaacugaaacauuaauuuuauaggcagauuuucccauuucccgaccagcccccacccacacacauucaaaguucacccucugugggugucccauggaacaccccuuauuuucuugucuuuaguagagucccuacuauauaauucaaccaaacuguaauggauuccuuucuaaucaagacccuuguuuccguacagaaaaucucuuauguaucaccaauuaauaaccuguuuggggacaaaacuuccucacugauauaaucaugguaaaacuacucauauuuccgagugugcuggugaaugauauaaugagcauuacuuucuaaugagauucucucccuuagcacaccauguaccugucagucauacaaccaguauuuggugagaugcuuuuauacacuaguguuuacuuucagcauuauccuguuuccuaugcagaaagugcucagauuguuccaacaauaggucuccuuuuguacacaggcacaauacuaaacuucagcauguuaauaaagguuugacuuagaauuuuucuuuugccaauuagcaccaagaaaagaggugaaaaggaggaagacacauuccauaguaagaauucuacaauguacagauuugaauggaacguaacucagaacaaagccaaaccauucaauuacuuuaccuacuguuaggaagcuguuccucuaacauauuuacacugggaaaucaggcucccauuauacuaacaggcaacaauaaacaaucuacuuuaauagucaaagucucuuguucuaauggaaggggguucaaugaaguugacaauuaacugacaacaccauggaaacauuccaagccuuuauggugggaggaagggauauuuguacuguguagcaugagcaacuuucuccagauuuagugcuacaugaaaacgaaacuaugugaaaacaaguuaaauuuacaauaagaaugauuaucugcaacccuauuuguuaacaaucaccacuagcucuuagaagagaaccaauagauuuuuauaguccuauagauuuugcccaacagaaguagcacaaggagauguaaaaguuacagaguacaaauguauauauaacuaaaccuacuucaguacuaaaccuuuuuuuuuuuuugagacagagucucgcucuguuguccaggcuggagugcaguggcagucucagcucacugcaaccuccaucuccagguucaagcaauucuccuggcucagccucccgaguagcugggauuacaggcgccugccaccacgcccagcuaauuuuuuguauuuuuaguagagacgggguuucaccauguuggccaggcuggucuugaacuccugaucucaugauuugcccaccucagccucccaaagugcugggauuacaggcgugagccaccgcgcccggcccaguuacuaaaccuucuuacuuucaaguuuuguuuuuuagacuacaccccaucuuuauaaaucacuugaauacaugaaaagacuucauguuuaacaucuuuaauucaaauguaaaaguucaauacaagccauuuauagggcuugagauuuguuggucuuuuaaaaacaagaaauggggaaaugcaacaaaaugaccuuuccacuuuucaaaagcuuucaaguaaaggauagaucauagggccauaaaagauccauuuaaucaaacccacuuucacccccuaccaauugucuuacacccauuccacaaucuuaauacauauuccugaagauuuacaguucagcuuugcuuacauaaccauuuaaaaaauacuuagcaccagcgugcuuccuauaugccaaacaaaucaucaaacuacuucaauaugcauuucuucuuuuuaaaacaaagggggcaauuauuuguagaaagcaauacuuagccuccagaugcauuucccagaaauggcauaugccauucaaaggccuagacacucucaugcuuucaauguggaauacguagccuaauaugcauagaagcaugaauggcaaaguugaagaucaauauuauaacuauuuuucuauuuauuugaagcacaguaaaaaaaaaaaaauugguacacuuuggaaauucaguggcacaagguacacugccauaaacuugagggacauuauacaguaaaaaagaaaaaauaaagaaauaaaaaggaaaaaaaaauucuccuguuccaaacacugcauuacauaauuuuaccugcccaaacagaccauuuacaaauauuaggucaauaaacugcuaacauccauaaaaagauagcuuucuuacuaaaaugcaagaauuuaaaagauugguaucuaaacaaaaaaacaaaacaaacuggaaugaaagccuaaauaucacaucuaaaaucgggguuuuuuguuugggccuucguacucuucucucccucuaccauauccugcuggaguuccaggccccauuccucuaggacccuguccacccacaggccccgcaccucccugcccaaagcgcucaguacgcuauuggaacaguaauuaacaguucauuauaaguaguugauguccauguguguuaaguaaauauuuuagaagguuccguagucaacguucgucgauacaaucaccaaugagucgauccacagguaccgggaacauagaaaggaaaaaaggguaauuugaaaauuaguuuacgguaauacaugccuugugguauguucccacuugagccauucucauacaccuguuucaaagaacagaucuucccuguagugcuaaaaaauuuaagaauuagugcagaugugaaaauccauuccaaaaugaguucuaagaaauuucacaucagauuaacccacugaaaaacuugcaaacucucacuuucaacgucugaacggaaauuuaauuuccaaguaagccuaacaagcccaaccagagauucaauucacucaaugaagugacaaagaccuacucaccaguuaguggcaugugcugcuuaagaaaccuugugcuuuucaagaucuuaagacacaucugcuaaguugcagaaaucuuaaaagguugaaaguuuuaauaaaaugcuaccagacuacaaaaagaaaaagcauaagacuauagauuuagucacuuaaccggcacaguaacuugaucaaaaaaacuuauguugccaaauucucacaggcacacuaccuuccgagccaucacuauauaaccagagacaauuacguucucaguacuauucuauauuguugcaaacuaaaugaacaaaccccacccaccuucaucaguccaucuuuucccuuaggucuuugaaaagugcagacacuuugcuguaauuccauguuuuagacacuucccgaacagugaaacacgaagcuaaaguaacugcaauaaagcagugagugacuucacuauucccaucuaguuuuagguaauucuggagauagaaguuuucaauagaaacauaugugccuaaauagcagaccccucagguaugcaaacacagcagccuacacuuuuucucauuccauuuauaauagaccaguuacuaagaguauuacuccaaauaaaaaacuaaaagggcaucaggguuuaacuguuccuauacacaauuucaacauucuuuuaaacaaaauacuauugagcuacucaacaugacuaaacuuuuauccuuuguuuuucaaaaucuuauaaauuacaggguuuuuggcucauuguucuguguucuaccucuaagaacuuaaaaaaaagaaaaaguuggggcuuucauaauuauguuaauuacaccagcugagaacccaggagcuaucagcuaccuguuaucuagaauauaaaccuuuaauugugagaacauaaggucaaauuagauuuuacacauuaccuaacaaucugucuuuaggaagaauauaaaccaaaauguuacccacauacucugaaaaaucuaaagaaagcccauaguauuacauuuuacccaaccagccauuuauaauucuaacuuuaauucccaaaaagucuuagguagauuauaaacaggugaggccuuauacaaaauccuuauguuucuauuuauaaaaugaaucuuaugagcuacucacugcagcuccccuccuuugccaaaagccuguagugaacucaucacauucaacucagcuauaaaaaugcacucucuaaacccaccaaaauucaguccuaacgauuuguaaagcccuaaugcagccacucauaccaguucaacugauuguucuaagcaucugacaggcuauauucacagcugaaacaugauagcaucaagaagguucagaucaaaugcacaccauuaguaugcuuaaaaauuguugauuuuugcuacucuguagcaaaauggagaugucaguugauuuuagaagguauaccuacagacaggcccaacaggugggaaacgacgagucaaaacacucaauucccuuuucauaggauagaagccacaccaaauauaggucaaaguccuacacaucacuaaaacgugccuaaagcuucaaacuacaagucugauuccuacuuauggcaaauaccagcuuaaagaaugaguuugccauuugauuauucucacuuggauguagaauaaucagauacauuaucuagcaucuagaauuuggauuugccaugcacuagaguucaaaagcaccuaaaucuacuuauugccaaagguaauuccacauaauacuaacagcauugacuccuuguuggcaaccguuaucuguuuagguuaccacacaccgaguucuucuauguugccaaaguauuccucaauauuacauauuuauguaugaaauugguaggggaaacuaaaagagguccagucaccuacuuaaaaaaacaaaacaaaacaaaacaaacacaccuaaguugugaaaaugagaauuuccuugguacuacgucccacaggauacauuaccaugucacuucccaucauggaaccacucaugguugcugguggaacgccaggauuagcuucauaaccuaugccaccaccaccuccuagagguggaaauuucuggccuccugaaccauagggaucuagaaaacaaaaauagugguuacaacuccaccaggauacuacucucuacuuauaucauuaauuuaaauuucacacuuaccucccauguucauugcuccuccgccacccauucgcaugucucuuucccgcugcaagaaaaaaauuccuuucaauauaccugcacuauacccacagcaagcauucuuaagaacugagaaauuuucaagaguuaaauaaaaaacaugguaaaguucaaaaguucaucaugugaauuauuuuugaaaucaauauucugaaaacuaaguuagacucaauuauccaaagaccuacaaaacuuccuauucaaggccgggagcaguggcucacgccuguaaucacagcacuuuggaaggccgaggcaggcagaucaccugaggucaggaguucaagaccagccuggccaacaaggcgaaacgccauuucuacuaaaaauacaaaaauuagccgagccugauggcaggcacuuguaaucccaccuacucaagaggcugaggcaggagaaucacuugaacccagaaggcagaugcugcagugagccaagaucaagccacugcacuccagccugggugacaagagcaaaacucucuccaaaaaaaaaaccaaacaaacaaaaaaacaaaacaaaacaaaaaaaccaagaaacaaaacacaaaaaaacuuccuauucaauuaaauccucugacccauacaaggaaaucaaacauaauauacuuuguuagaaaaaaagcagaaaauaacuguaauuugauauuaaaauuuccuguaauuccuucuagguaccugcaaguucuauagacaacuccaauuggaaggcaguaaaggcugacuuacuggauccauguagcccauucggcuguaacuuuccucucuuuggcgccucauuuguucuuccaucucacguugacgaaucaucaucucuuccucucuucuacgucguuccuccucuugccuagaaauacccaucagguacauaacugaaguguuauccacaucuuuuagaauucaaugugaagaaaccuagcaguugaccuaagaacuagguuagcacuaaaaaacacaaaggcuuagagugagccuaggggcauaguacuaaagacauucuggcaaauaauguaggcuuuauuaaggauaaucuuacacuguauucgauuuuaaguguuaaaccaacacugacauauuuaaccuuuguauuuugccugacugaccugaaaaacuaaguacaucuuuucccuaaaugucagaauauaaauguuagugcauaagucaaggauuaaggccaggguugguaguucaugccuguaaucucaguacuuuaggaggccaggaguuugacaccagccuaggcaauauaggaagacuccaucuccacaaauacaaaaaaaauuaaaaaauuagcugggggugguggccugugccucuagucccagcuacucaggaggacugcuagagcugaggaguuugagacugcagugagcuaugaucaugccacugcacuucagccugggcccaucucaaaaaaggaagaaaaaaaauggccaagcguggcggcucaugccuguaauccuagcacuuugggaggcagagacagguggaucacuugagcucaggaguucaaggccagccuggccaacauggcgaaaccccguuaucuacuacaaauacaggaagaauuagccaggugucguggcgcaugccuguaaucccagcugaucgggaggcugaggcaagagaaucgcuugaacccaggaagcggagguuguggugagcugagacugcaccacugcacuccagcccgggcaacagaaugauacguuucaaagaaaaaaauaaaugaaggcuuaaaccuuaaacacaauuuuaccucaauugcauuucuuuacguuucugcauuucuugauugugaaguucuuccaugcgucuuaauucuuccugucgucucaucagaucugaacauuggaaaauauuuggauucacauuaacaagguucuaauaaggugaaaaacaauugaccuuagcaaugauguucacgcacaggucuuuuuaccuuggcgcaaaagauuugccugauguucaugauaggcaucuuccauuucacuuuccaauuugucuuuugcaucuuucauguuuuuuucaacuuguucccuuugcuguuuuuccauuucauccaaagacuuccaucgcugagaauauucguacucaaacgugccaugcugggcaaaacgaggagggguuucucucucccuaacaauacacaaaauuuuaacaugaaccgauuugugaaugcauaccagaaaauacuugcccuaguacugaucuuuuuccuguucuauuucuuguaaagaguacaaaaggcaaaaauuuuccugauucaucuauaaauaucuucacagcaaaaauacucagaacacucaguaaaagaaugcaggcacuggagauaaauccuaccuuccucguuuucuaauuguuuuccucuagccaaauuccuuaccgaggcuuauuuuuuccacccauaaaaauguacuguaggccacacgcgguggcucaccccuguaaucccugcacuuugagaggccaaggcagguggaucaccugaggucaugaguuuaagacccaucuggccaacaugaugaaaccccgucuccacuaaauauacaaaaaauuagcugggcaugguggcaggcaccuguaaucccagcuauucuggaacccugaggcaggagaaucacuugaacccgggaggcaaagauugcagugagcugaaaucacaccacugcacuccagccugggaaacaacagcgaaacuccagcucaaaaacaaaacaaaaaaaaacguacuucagccaggcacggugcaucaugccuguaucccagcacuuugagaggccgaggugggcgacucaccugaggucaggaguucgagaucagccuagucaacauggugaaagcccaucucuacuaaaaauagaaaacgagccaggcaugguggcacaugccuguaaucccagcuaccugggaggcugaggcaggagaaucgcuugaaccugggaggcagagguugcagagagcugaggucaugccacugcacucuggccugggcaacagagacucagucacacacgugacuuuaugccauuauugcagggacaaaacaggacugcaugugaauguauccaccuuagaagcaaacagcuaucugaauaacagcuucaaaucuuucucagccugagauuuuuuacuaauaagcauauccacaucaaauaauuuugcauauuuuaagcaaaauuggaaaaucacuaaaauaaauuuaaccuuuacacuugauuuaaaaacugccaaaaaaguuuaaucaaucuuacuuuugauacauuggauucuucugggcaaguuuuucaggaagaccaucuucaucaucuaguuguucaagugguuccacaaugacuggacgaggaguucuaauaacaaaaaugguuccaucuuagcuuuguuccaguuuuauugccaccauucucauauaaguugauagaaauuauuagaauaaacaagacaacuuacgucgucaguaagaaaacaccuucacugcaucguucaaaugccuuucuugcugcuggcuuagaagcaaauucaacaaugccuuucccuguagaucuuccacgaucauccacuauuacaacagcccuuucaauaggaccaaauuggcuaaaggcuucuuccaacaguucauuggaaacauaaggugaaagauuacgaacagaaagggcagcagcauguguggcaaagcgaacucgaagcugucuaccucucauggguguaucauccaguucggcuuuggcaauuucagccaaagcucuagauuccuguguaucagagacacucauguuaaugaccucaaaauuggaugaugucuacucuuaaauugucauaggccuacuuccuacucccuuucuuccuucagcucaguucgaccauuaccuuuaggcagcacccacuaacaccacuuaguuuacccaccccaccccucuuuucucuuagguagcaacaauuaugcauuauaccgcaagcauuuuuccuguaagaauggugaaaaaucuaaaagaucaauuuauccuccccaguuuaaaaaccaagccuucagcguuuguagugacaaaaaaaucccccacccuuuuuaauucuacguaaaaucaaacaauuacacucacaagcuuaauaaauccgaauccuuugccuuuguugauaaaaacuucuccugguucuccauauuuagcaaauagucuuuugaauucauccuccgugauaucagcagguagauucccaacaaacaaccgacaucgcuguguguaaguuuucucuccaggccuccucaagagagacaaauuggcuuuaaaccccuaaugaaaaaggaaagaaguuuucaaacaccagagaccucugcaagugaaaauccccaagauaguauuugcuuaucugaaaccuaucaguugccuuucuguuccguuuggucaaaaucaagguuuuacuaugugagauuucuaacaugagcacuaucuuaacauugaaaaaggagccccaucauccagaauguucgagaauagacacacuuccccaaagaguagacguccaucagcaacugucacccacauauguugagugucccuaaaaaaaucuaaauaguaugaaaauuaaaauaggaaaauaacacaaauccaaaugccacuguaaccuacacgaucugcgccugcgcuuuuauggaacuucccgguucucuccaaaccuacgccgcaugcucugcauuacgccagucccagggacaggauaccuucugcagggccgaccaccgcggccccgcgcuuccuuccgaaaggaaaccuccccuagccuuccgcccgccgggagagcaaggcccggcggcggccaaucccccgccgaccgacggccccgcaggccgccccgcccccgcagcggcgcgcgcaagcgccccuuccggcagccgacaaaauggaagcccagcgcgggggcgggggcgaggagggggccgccgccaucuuaggggagccgacgcgucgcucccauagacacucaccuccgaguccgagaucuucuccucgcugcggccgccgggcccgccgggcgggggccccuggugaugcugcuggugguagggcggguggugcuggcggcccccgcggggcuccccgccgccucgaugcggcggcuugggguggccgccaggcguacuuaggcccgggccgccaccuggcuucggcccgccaggcauuuugccgccuuugggaccacccggaccugggcccugcuuaggcccuggacccgggcccgggacugccgcgggcggaggcggcgggccuccggccugaggaggugugguagggaccccgcugcuuggcgggguggguggcggcgccccgggaggggccgaggugacugcaggcggcggggucggagucgggccuggcccggacccuggcggggcccccgagguugguggaguggcgggcggggccgagcuggaggcugguggugcgcugccuacuccgggagcggggccgggucccugagcaacgacgggcuuggaagaguccugcggcgguggcggcggcugcugcugcugaugcggcuguggaugcggcggcggcugaugcgguggcggcugcugcggcgguggcugcugcggugguggcuguugcugcuguugguguggaggcgguggcgggaucggaggcuuagggccgcucuggcccgggccaggacccauggggccgcgauucugauugaggcccaugccgggcggcggagaacggaagucguggaggccgccgcggccgccgccuccuccacgccuguggaagccaccaccgccaccgccacgacuccggaaccgaucccgagacaugucuguggucaaggggcggucgaggcaaaagcgaagaagacgcucaggaaacguggaggccaccuugcuucucacaaaauggcggaugacacaggcggcgcgccgccuuuguccucgucuuauauaggccagcuggcacggccccgccuacuccacgaucgacagcuccaauagccaauugcaauuacuaugcuugaugacacuaaguugcgaaccucugaucauuccuauuggccccugggugagaggcgggaggcauggggggacugaaguuuccaguuggccagugagcgaagaaggcguuggcuguaggccacuaugauuugcuaggagaaauuugaauggguaugccagggcaauuuucacuugcgagcaaauaaccagggcucuauccgcuccugcagagaagcguuggaggucucuuuucuuucuugauugucccuaggagcaaucuacugauauccuugcccagaaaaacagauguuuuccgauucaaaaucagaaauugagugccugcugucuacccuaccucgugccaacucaaugaaaguagagaaguaaaaucuuaccgauuuca

SEQ ID NO: 14126 - RNA, 395 nt, Homo sapiens
uuuuuuuuuuuuuuuuuuuugaaacacaaacgcuuuauuuaaaggagcaucucaguuacguguggcggacaaaaaaaaggagcagauugugacagaccauucccaucggccaaguggucgaacccgacauccaagacccagcgagcagccaagcucagcgcaaccuccgggcuucucgcucugacuccaaaagggugagcacgucgcccucgcgcacggggccuuuuacauugcggaugauggaucggcucgugucguccaugaauuccacgcgcaccugcgugcacugucccugagaaccgguccugcccaggaccuuggugacccuggccagcuugauaggcugcacacggcugguguccaugauggcggcgcggcggcggucuggcggagcg

SEQ ID NO: 14127 - RNA, 395 nt, Homo sapiens
cgcuccgccagaccgccgccgcgccgccaucauggacaccagccgugugcagccuaucaagcuggccagggucaccaagguccugggcaggaccgguucucagggacagugcacgcaggugcgcguggaauucauggacgacacgagccgauccaucauccgcaauguaaaaggccccgugcgcgagggcgacgugcucacccuuuuggagucagagcgagaagcccggagguugcgcugagcuuggcugcucgcugggucuuggaugucggguucgaccacuuggccgaugggaauggucugucacaaucugcuccuuuuuuuuguccgccacacguaacugagaugcuccuuuaaauaaagcguuuguguuucaaaaaaaaaaaaaaaaaaaa

SEQ ID NO: 14128 - RNA, 65070 nt, Homo sapiens
uucaagccaggggacugcugcaguccgcucuccgccucucggcucccgcagccuguguccgggcuccgcagccuccagcugugcuucggacagucccuuuccccccaccccgaccccgccauggcacaaucccaggcucagggcccagaggcgggcgggcacagugggcacgggcgggggcccagcacaggcggcagguacagcggggcucucccuccacacuggggaugccucggcugugcggacugugggugggggacgccugccagcggcuccgaggccgggcacagcgccccauccuggcaggggcuggggccgaagaggggggcucccugaccccaagccaggagcugaggucaggcggccgaccgggaaagcccgaaggagagucuccuaagcggacgggccugggggcugugugugacauucagggcgugacugccccucggcggggggcgagacccgguccgugaggcugagcugguccccgaccgcccgcccgccgccgggcuugggucccuguacccaggucggcugugcguggccgugacacuucgggugccuguuccuggguccccggggagggggaucucauuccugccccuacgcugggcgcccccagcaccgucgcucagcgaggugggcgcuccuccgggaccccggcggccgcccgcgggcggcgaccucggcccuccuggguccgcgcgggggcggggagcucggucccccucccucuuccucucccucucccucucccugcucggcugcccugcgcgggggcgggggcgggggcggagcgcgcgggcgggauccccccgccuccccuucccgguccccgggaaauccagccuccguggcuuggccgccucccgcucccgcgcccgcugccgcucggcgcucgcuuggggcuccgcagccggcgcggccccucagcugggggcuccgcagugccgggccccggucccugcccgccugcccaacgccgcagcgcccccggcccgggccgccggcaccauguaacccggccggagcccgagccgggccagguaagccgcggggaggaguggggacggggccgcgcucgcggcucccucugcagcgccccccaggcacggcccggcugcggccccggcgccgcccacgccccgggcuccggcgcucggcucccggccccgggaggggggaggggcugggccuccucagcugcccccgcuccugccccggccuggcugcccgcgggcccgacccgaggggcgggcaggggaccacgcggaccgcggacccacgcucccggucagggccgcggggacaggccagccccggcccagcccucgcccggcuggaggcucgggucugggagggaguagccagcugguugugggggaagucguggugcuggggagauccggagagaaguuuccucugcaggugugugaaugugagugcgugucgcugugugucugugccgagugugucacugugugggucugugggcgauugugugugccggugaguguaugccgugagugugugcgugugucacugugggcgagagugugugugcauguuaguggguguaugcagcgugaguguggagggugguacuguguaugcaucuguggacaugugagugaaugaguguguguuguccccaugugugccugugugugucugugagugugugaauggaugugugugccggcgugacugucucugugagugggucccgguaucugcccugugugacugugugugugugugugugcgugugcgcgcgcgugcguuggcugugugagagagaguguaucugagcgcgguucacucugaaucacccacaccugggcucugucccccccacuguccccccauuccuggugggauaugggacagggagaugagacuuuuccgaggucagaucauuccccacuucucuggggaccccugacccuugauucaggcaagagcuuuguggcacuccccagcuuggucucuaccuucaccuaccucagggggugcccucugggauguugcuggucguguccuuccugcaugcuaaggccccuggugggugggaggggggaucuggggcgagcuggaguaugugccugcgugugcugcuucuccuuuugggggccugggaacuugugucaucucaauaauguuucaccaagggccuuuuagagcuaggagaugaggaggccagguggaagcgucugcccuguuagucaucagagcagguggcgcucucccagacuuccaagucccaaaccuucaaguucuggguuauugguucaguccacuggcuccgggugggucuguacuaagcucuuugaaguaauaauaauaaaauaaugcccucauauuaguucagggcuuuugaaaaugcugcccucugaacucuucuuauuuccccaacagccuugggaagcaggcaggacagguaucacguuaagccauaugcaacugcaauauucaacuguuuuuauuuaaccuacaaaaacagcaauuucauaugguucaaccaaauauaaugccgauuuacagaugaagauguugaggcuugagaaaugaauugcauuuuccacaaccacacacugcuaguuagugguacagaaagaccucagcccaggucuuucagugacccaaagaacugggcugggccaagguuagagagugguacuuccuggugugcucucucugacccugggggcacugcccucuaccacugcgcagcauucccugaaugcuggggcuacuucugcacccagcugccaaugccuaaaagagugggggguggggggagaagagaggagggaggggagggagaggcuucgugaguuggcagugaaucagggucuaaaaagggagcugggagggcuaggguggcagguguuucuaaaaggaacaugaacauaggaugaacggccucacauacagcccccgcaucucccacccgccacugccccacugaucuggcaggcagggcccgcugaguuuugugccagggggcucacauccaacgagugagcuuguauguagcuguagaaugauggccaggagaggaaccuuaguauugacuugguccaaccucuucauuacaaaccggggacucugaagccccaagaagggaggggacuugcccaaggucacacaacgaauuugugaguuccuaggcuaaucuuagacgaggaacuuugcaauccuccauguugccuucuauuccugaacucuccccacccccaucagagcugaguacaggggauuuuuggaaaagaaaugaagacucaaaaagccuaaggcuguacaucuuucagcuugggacuccuugccaaagagagggcgcuacagaugucgcuggggauagggauuccuagccacacccaccaccgagguaggccaugggcuugucuugucuugauuccugcuggugaggggcuggagcugcuacaggccagacucccagacuuucucauguuaguaccugcuuucagcggcugccugacaccuaacaucaucucuuccagcugauguuggggcucgagcuggcuaagcuuguuuuccuucauccuccccaguuuccagugcauuuugccucuagcuggauagaccauuccuuaccuuauuggguuccuaaugaauagagaaacuucuggggcuugucugauuuaggaagggucuguaguuacccccaaacccuuucuaaugaaaucuuccaggagucuaggacaaaugauaaagggauuacccccauuuuacagguggggagacugaaauucagcaaggggccccguauuugguuguuuuuuaguuuuuugggggugaggugaugaagggagcaaaugaugacaaaaacuuuugccuagaggagcuuccaaagaccccuucuggucuuaccauccccacggucaggaaaccuucccagauucugauuucauucccacuugguagagucaaagcuuugucacucaguggggguuggaagaacagcugcguacccuccacuaugcaagcauuaugucuugauuuccucuuuauccacccugccccuccccagucugaaggcugcuggcucagcgggccuccugccgucuggggagucuggguuugagcuggggugaggcaguggcaccaucguuaugguaacgaggugccagcucaucauugcuaauaacuugucaggccccugggcuccaugcagcaucucuuccuaccagcccuucuucccaugucacagacagaaaaaguaaggcuuugauggaggggucugggaauaagggagucuggagaaguggguggccuugucccuggggcuguagcuggagagcugcggggaggcugcuuggaagcugguuuacacauaugguuacauaggcuugcauaugauugcgugggcuguuaacaugugaaaacacucagaacaugcuuguauaaacuuauacaggcuagcugacauguucauguguuuuuacacagcagcccacaggcaaacaugcuuccaagcaucagaacaugcuugugccugaauacugucucuaccaucugcacauaaggcacccaagaaaucuggguuuguggggguguccagguauguggguggggaucugaucuuuuucugaugcagcuucaaagugucuuguuaacaaagggacagaauggucccaggguuccuucuucuuccuuccaguuaagagcucagaguggaagugggcuggggauggugucgggggcccaagcucccagcucccaaaggccccugcuucuaugcccuuugagcucagguagccccugccccccucacugucuguucuuucucauccucuccucuuccuguguguaaauauuaaagagcugagccugcagggcugauguagacauggggagagaaugaaauuaaaaaggauucccucgcccccaucucgacacccccgccccgcagucccucgcuccugcuucuuccccucuccccucuccccuccccucacucagugcuuccacaugucucuccuccccccaguccagaugggagcuggcuccuucagaaagggggcucagaacaggguguggggagcuaccucucucugccuccccccaccacaucugucugcagggcugggagcccccacgugaguauuucuuuuauuuuugggguggugguuaagaaggaaagugguuuuuagaaccagcugugaguggcauugagaggcucugggcugaaggaaggugggugggguccucucucaagguucccucagggaagccccaugucuggguuucuuuucucucuugggacauagagggaaggugggggggggguugucaggugcccccgguggaugggagcgacagugggaggggcaggggagaggggcuucuguucuaaaggggguguguggugggguaaaccuguuccuuccuggcauccuggguuucuggcuaccggggccggcaaugucgcugggaacugucccgggugcugagugggauucggcggggauuugcuccuucggagcugucccgagugcugaaugaggcuucguucggucccgaugguggaaaggcggagggcaguggggagggcucacuagaaaaauucucccagaugacccacuuuccaagggcauggauggaaauauggauuuggaguucucccuaugguuuagguuucacaguuguuagugguauuuaggaacccuucccccaaggggccccucuccccuuuugcuguuucaguucccucucucccuuccaaaaccauuguacuguuauuaucgggguagaguuggagaaugauauugugccugugagaucucaucuccugggaacuuuuuuuuagcgcaacaagcucagagauauugauaccagccuuucaccuacugggucccagaauuucaggcucaaggugguucuggauuaagagaacgccggucuuccugguuagguguggggugguuacagcucaggaguucaggauaacuugacugacaacuugauauucccuugcccaucauacuuugggauuugggacagggacacugaaauauucugcaagccuguccuguguucugcccacugccaaaccuagcucagagcagcauuugggagagacuuuuguuggggaggaagauuuuuaagcaaaggauucaaggagugggugggguuguucagugccauggagaagagaagggggaggcuacuggagacagggcagugggaaaagaggaagaucugggggaguaaaaaauauucaaauggagggaugaggucuggguuucagucuuuaguucucuuggauaucuuucuccuuauggcuuagagucagggucauuucaaguaucuguauucuuaugcacugucuuuguaaccaugaagggaauagagcaaggaguuucuuaaggucccuucccuugucaucccagggggaugagagccaaaugucaggacaugcagaugagucuguaggggaacaacaggcaggaagggaugaugguggcuucacuucccauccccaagagcacaaucaaauauucaaaugggauccucccugugaggggaggaaggagacaguuuccagauaauacugggcaaaaauuggguguggcagggaguucaagaaaagggagagguaucuagggaucucaaacugaaccaguugaucccuucccacaugugacuuguaguucauaaggagccccucacccaucauguuuuugauguaacucaucaagaugauuccugccuucucuagcugcuugggaggagcugaguuuuccucugcugugggugcugggagguggugggugugggugugggugccuguuuggggaggggagguguuugugcuccacucagcucccuugguuacauaacagcuuugauaagacuuuacuuuggaucugcugcuacugccugaagcagucaccccuccacccccacaugaaaugcuagauguccacccccuuuucccuggccccuuagagaguccugcucuuccugauccacuguuccagcagcugcuuccuugccaggaggugucugcagcuugccucccugcucccuucccagcuucugcuuucaaaauacuugcuucuuuuguuauuugagcccaggucaccaccuuuacauuuuuaagccuccuggucuacccucucccuuguagggcccacaggcugggaagggagggauucacugaucaugaagcuccccucuagggaagaaaagggguguuuucuaggagguuuuagcacccacaguuaauuuccuuacuauuucuuccucugccccaguaacuuuuggaguuugagaguguuagaccuuuacccagaggugcugggaggaaggauuuuggccuugauauuuucucuuucuuuucuuucguucuuucuuuuuuagaguuaagggguugcauauacggggggauugucuccuggguuugaagagguacaccuacuuuauuguuacuccuacccagguugucugaggaaauacucguuucucuaggcaugggaugaggacaugacagggcccuuuuaaaaaaaaaaaugacgauuuuuucccacugagagugggugggaaugggauguguccaggaguggguauaucucauugauaacaggaacaacuuuccaaauagagaagugggagacuagcaagaggagagagcaaaugcaaacuugugauguacuuggagagaauaugaaggauagaagccaggggaggggcuggauaucucugcaagaucugggacuccaguacacaugcaugcguauuucugccugugagugaguauaugacuguguauauguacauaaguauaugugaguaugcuguguauauguguauaagcacaucuauuuguauaaguguggauguguguauauauauaugacucuauguaugcauucauguauauaugugaaugugaaggaaauuacugaauuaaaccaaugugugcaugucuguguguguguguguggugugcuuauccaguaaugccuuugugugaguguaagcaugcaugugagcauguauguggggcaugcauauacguaccguaucaaccacauaugaauauauguacacaaguugaggcaaaccugugaauaaauguaagaaagagagagaccgauucugacugaacauugggcuacccaaaagugucuucccaacagcuugagcuugaucacccugcuacuuguagcucuucuccagaaaguaggcucccugaggucucucaaauucuuauguccuugggagccaacuguucuccaucauaugaaagaaguuuguggagggaaaaccuauaaggccuuggggauagccaaguaagaaauccaggcuccaggcuguucagaugcuauggugcucagggcuguauguggggaaagaggaucagggcuuaaacauuggcauugcuacagaaguuucaaaauucaacaaguugguccuaguggaugaaagggguagugaguaagaggggggcccaagugcaugcauaagccucauacauacaagaugugacaauacacguguacagguacaugugcauauuacuugucugugccauaauaggcauauaucaacauaggugcacuuucuaacaugcacauccauuaacaaaucuacaggagugucuauaccaacacggggauuugucagcaugcacauacaugcuaacacguauacuugugaacagaauuuacagaaauaugugggcauaugcuaacacuugucugauuacaaccuauggccauauauaugugcaucucacucaucuggguuaacaauagccugcaaacauacccuuccccaucgcaagugccucacccaaugcauccauucauucaaccagcauguauuuuaugccucuaaucugccacaugcugugcugggcacuagggaugguccuugaccucagauaacuugcaaucuugggagagcaaaggaccuggaaccaaauaaggagaguguuaaggaggguagacacacauaaguguucauuggagggaguggggaccuaaagagagguagguuggcucuggagugaggaagggaaagguuugguaaaggauccauagaaggggaggcuuuugaguugagguuuaaaaguugaacaggugcuuaccaggugagcaacugugggaacagguauuucagugacaggaaauguuccagauggucuucccacuuccacccuugccagccccaccuccguagacucuuucccaaaaagcagccagaggaaaaugaggucuugccuuuccaguggcuuuccaucucacucagagugaaauccaaaguguagugcguccugagcaacgugagugcuacgugugcaaagcccccuauuaccuccuggaucucaggggccacuccuacguggguuucuuuucuguuucauaaaaagcacaguuccuuguggaggcaauugcgcuugcuuuuccccucagccugaaaugcucucuaggcaacucacuuccucacuguauccgagucuuugcucaagucacauuuuuggaaagaccuccccaacagucuaucuugaauagcccauugucauucuaucuccucacuccauuauuauuacuauuauuauuuaucucaguacuugccaccaccauuauuuuauauauuugguaaucaucccucuuuuuccacuagaauauaaacuucaugagcaugggagcuucaucuguuuuguucauugcuguaucuacaguguccagaagaguauucagcuuggaguaggcagucgauacauauuuguugaauaaagaaauuuuagcuagccggcagccagugaggagaaaggaucaaggugaacaagaugcaaggcagggagaccaguuaggaaccuguugucauagcuuuggugagcaauuaggauaagaguggccugauguagaacaccagcagugggaguggagaaaaagagacacaauguacaaacacaugcaugcacaaauguacaugcaugugcuuguacuuuaaucacaucugcuguuuuaguaggggaaggcuaaggaggaaaguaaaagugucuuuauguguaugugugguauguaugucaugaacaccucaugacaggcuggacacccuccagcuaaugccaacugcaguucucccuuccuuuuggaucuugucaccaauaucccauguauguucauuccugccagccaggcugcagagggcugccaugcggggucucugugguuccacccugucagugaugcagggcuccugccauagggaacaggaguugggagccaggucuugaacaaagggaacggucuuaggaggucagagccacagacagagacuuagagacacuuggagagaggcacguggacugugagaggaguagagagaaggggaauggcugcggagagcucagagauggagagcucaggcauggcccagacuuccugaagccagauguggugggggugggacagcauacuuaggcagcuucuaaugccuggccccaaccucuucccuucuucuccugcuccacuucugguccucuacccuggugguguggaugccuuagccaaguauggacuuaggaaugauuuguccccaggguugugaugugaauucagguauauggggagaccuggaggaagggguccccauuuguauaacacauuuuuuggucuggcaguaggggaguaauuucucugagugucucaacuuuuguucuuuucuuuucuuuucuuuugagauggggucucacucugucacccagguuggagugcaguggcaugaucucagcuuacugcaaccucugccuccugcuuucaagcgauuccccugucucagccuccugaguagcugggauuacaggcacuugccaccacgcccgacuaauuuuuguauuuuuaguagauauggggauuucaccauguuggccaggcuggucucgaacuccugaccucaagugauccgcccaccucggccucccaaagugcugggauuacagguaugagucacugcacccggccugguuguuuuccuuucucccaagagagcauggagaauugagcuuguguugcaaaaugagcaacugagguuaaaccucaggcaggaccaaucagcugcuagcauuaagagacuaaggcauaguauguggggaaagcugggaggacagcugcuaagaaaaggaggaagugggaguugggggucugccccaccccaugccacuccagggaccucugguggaggggaguggucaaggccuaagauccucuuugacacuuccucccccggaccugcaagcauggggcugggucgagaggccagugauagagccccuuccaggcucuaggggugaaggggggccucuugccucucuccucucucaucugggcuaggggccagggugcugcagccgcuccccucccaccugggcugugagcauggggguugggccgaaacagccgccagagccgcccaccugcccgcggugucauggcaacgacucugcccacguggacgaugaggaaagggaggagaagagaggagaggaggcaucacagcagacacgaggaugggaggggcucuucaggguccugcggguggaagcccccaccccucuagcuuggccccggcccuagcuccuuucaccccagauccccuggggcaggguggggcugguguuccagcucuggccucggagugugcauguccuuggauguccugaguaaugaugaccuuggcuuccugcacuguggggcccuggccaggguccuaggguauauggggcuuuggcaugcucaggcgucucccucucuccuuaccccucaagucggggauggugccuggggcugaggggauaagagcccgaccuacuucuccauuuucucacuauuuuucaaaaggaaaaugacccacuuuucagccaaucggacuggggccuguuccccggcugauuuccugagccccccugcccgggccucugccccauccucagccuauuagccacgugcuggacccacuuccuaaggguagcaggugaaccuguguggagggguccuccccugccaucugcaccaggcugagucuguucucagugaggcaggggugggccaaggccuggcugagaccacaucagcuccgcauugagcagacccccuugucugccuccacccugggcacuguaaggguccugcuugccauccccauagacccccagggcacaccucgaggugaggcaggaaggacuucggaaggguggaaggaggauucugccucuccucucucccugugucaguggaugguggcaggcugucuucccaagcugcuucauuuccacauggaaagggagccuguggcacuagagaaccaugccugucugucugucugucuguaugccuggcuggcagaguuccucugagagacccccccucugaggguucugccugugccucauuucccaagccccuccuuuucucuaggauauuggucugggccuccgagcccccucccucccucagcuauauuggccugggcuggcuuggggggugauuagggauuuaauuauuuaguuucuccagcucaguagauuaauuccauccaucacaggcaggcugagccuucuuccccucucuggacugccuggccaaccccagagagaaggagcaucauggcucaccugggccuaguacuggaucugggaacaauggauaaaguucuuguuuggggaggauuuaaugaaugaccuugagcagaugugggugccuaaaugcugugaaaugaacauguauuucugucauauggggauaaacauguggacauguauuuaagguuuuguaucugugcagcuucuaugcacacaaacaucaaagucuauuggauggauagccacgguggcucaagccuauaaucccagcacuugggaggccgaggcaggaggaucacuugagcccaggaguucaagaccagcuggggcaacauagugacacugucucuacaaaaaaauaagaaauuagccaggcacggugguacaucccuguagucccagcuaccugggaggcugaggcaggaggauugcuugagccugggaggucaaggcugcagugagccaugacagugccacugcacuccggccugggugacagagcaaaacccuaucucgaaaaaaaaaaaaaaaaaaggaaaaaggaucuaucggauggaaaugcacaugagguguaugaacccucauaggaacaaguuugugugggucuggguauacagcgugacagugacuauauagaugaggucaggugcugcguaaguuguguauggaugacugcguggcuguguaauuugccucuggcugaacaccuguuaauuugugaaugaacagucuuggggcaguguauagcuguguaugaggaagagaugacagagauggaagguuuccugaggcugagugaugagaaagggcacacugggguccaccuauuggccuccucagaccaguuuggucagggagacaugcuacuuuaaaggugcucugaggccaggcacgguggcucacgccuguaaguccaacacuuugggaagcugaggcgggcagaucacgaggucagggagaccgagaccauccaggccaacaugaugaaacccugucucuucuaacaugcaaaaaagaauuagccagacguggcggcacgggccuauagucucagcuacucgggaagcugaggcaggggaauugcuugaaccugggaggcagagguugcagugagcugagaucgugccacugcacuccagccuggcgacagagcgagucucugucucuaaauaaauaaaauaaaauaaaauaaaauaaaauaaaauaaaauaaaauaaaauaaaauaaaauaaaaaauaaaaguauucuguucagccuaggccuuggucaggccuggacccagacucagauucaaauccuucuuccaccaucuaugugaccuugggaaauuuucuuuacauuucuaagcuucaguuuccucaccuguaaaaugggaguaauaauagugccuacugcaaaggauaguugugaggauuauaugaagaaaaacaucuaaagcgcuuaacacugggucuggacaguuguagguauucaggagccuaaccuuagacuucagaguugaaaggcaccagagguugucuggucugaaauguauucaauguauucagugcuugaaugcacucuguaccauccugcaaagcaguccucaaccucugcuugcaugccucccuggacgggacacucccaccucuuuaggaaagccacaucaugcuguagcgguucuaucugcuggggaguucugguccagcugcagggagucaucgccuuccuuuucuccccuguuucucccuguuucucuaugccuuagcuguggggcacuccuugauggcucaguugcugacccugaacucacugagcaccuacuguaugccauguguguucauacagagauagauccccugaauccuggccuucaaggaacucacagcuuacaaacaacucuuuacccuacuguggggaauagagguaugagacccaagaggagcuggcaauugugguguccugggauugaugggagggcaauuuuaggggaaggccucuuggaagagaguacacccgugcagcagcagaggguuuaagguugggaggacagggguuuugcagucugagcugccuuuucuaugugcucucaugcugugucccuuagcuccuggcugucuucucugaaacccagagagagcagagguauagauauccuugaaggucaggcaggguuucaggcagagcugaggggugggaggugccacgacgugaaccuggcagucagccaaccagccagccuucgugguuggcuuccugugcuggacucuccugugggaaaggcucagaaggagggcucaggccuuguugcuagaagccccugucucagcucacacagagagcuuacgggacagugugcuaauccaggaggcugucccaagcucuggacaccaagaggggaccagaugccugggccagagaguaagaaaggucauugguauggccaggcugaguaacuccugcccaguggaccccugccaugggcuugggcuccuaccugcuauucuuugauggcccuggcaggcucagguguagagcauccuggaagcuagggcagcacgaguccaaaucacauacaaaugaaagaaggugcuuuggugcuaaagucaaaagaagccaacauauagagacauaugugcaguuucuuuggauaggucagcuuaguuacucauugccgcaagcuaaggagguagguauugugaucccauuuuacagaugagaaaacugaggcucaggcagauaacacaaauugcucaugggcauaaagguagguugugacauaauggauggagguggaugauuggcuuuccaauacccagcuaugagguugcuggcuuucccuuccagaucccuggaguuacaagagagaccacuaacccuggcuacagggguuugugggagucugcaaaucaagguccucuaguccucucaggugccaccaucuuuggcuaccaggucuuugcucugcugucuuugguacgcuuagggugugggaggucuucaaaagaagcccaggcaaacagaaauuccugcaugcgugaaaaagaugaguuuucagaccacccauuuccgauccaaaccaagucauguauggauaguuacagccuuugcccaaagcugucuagagauccucucccugucuccaagucucaugcauuuaaguaguuucucccuaguuagcaauagcuaacccuuagcacugugcuagauacuuuaccugcauuaucuuaguccuuguaacaucacaaugagaaagggacuacucuugcucccauuugaaaauggggaaacugaacuugagagaggcaaacaggcuuccuugaggccacacgucuaguaagugguggaccugggauauggacucaaaacaguuuagcuuaagacccagaagccacaguugcucaccagcugccccuaacgaggguccuagaggaguucggguccuagaggaguucugguccuagaaguccucucucucagcagugugcagucuucuccaaagaaggccccuggagacuuucaggagaggggaaaaguggaaaugauaaggcagcacagccuaagaauugguucaguugacagaaaaggaagagauagcugagaaaaggcuggaagcaguuggccaugccugcaauuagggggcaugaaggagugaggcugaucaggcugaauugugucucaaagggccuauggcagcccuggagaaggaggaggaaccuccuccaaugccuguuggguacauggcccuagcugggaagggagcuggggcccagcaagucugagugaagagaccuauguggggcugggugguagaccccgaacccugcuccugcagcccaucccugaaaguugugccucauucuuucucucugcagcauggggagggccaccuuuuuccuucuuauucucccuucucccuccacgaccuucccugagcuaugcagagggacauaucugggggagaccuagaugcaacuggaaaagaaccaucuuuaccugcuaagcagagcggcuagacaaacaucaugaacaaggcuggguauagaggcuggauuucuaauaccagauucuccaggacucuccaaagccuuugaagagaaaggaguggagguccuuucugugggccguuguacauaggagcagagugggugagggcagcaagggaaaacauucauucacagaauagguauuuuuugaacaccguuuaguggcaggcauuguucuagacacucaaaaugcugcagcacacaaacagacacagucccugcccuucuggagcuuauauucuacuauggggagacauacuauaaacacgcaauagacaaagaaaauaauuucaaagggcaaucagugcucugagggcaaugaagcaggugauauagaacauacccaggguugcagcucaacuuuaguuggagcgagugaucagguaggccucucugucucuuccgaggcagaggaagccaugggaauaucuggggcagaguguuccagcagagagaacaucaagugcaaagcccccugaggugggauuuucaaagagauuauagguaguguggguuauucacaggccgagcaccguccagugggucaggagauggauuuagacuuguaucugccuaaauggcucgaguguuuuggagcuguaaacccauuuucuguaaaauuucugcccuaagccccuaggaagaguugauuaaauaaaguaauaaagaugaaugaauaaaacggcaagccuuccuccuuccuuucuguucccccuucuuccuucuccauuuucuggggcagugaggggaaaaggaggugauuucccuugggguccuaaggagugggguuggauacaaggcaugccaagucuucagcaacagggcuggcuagugggguugagggaggccagggacuaggacaccagcccaacuacagagauccugccacaggcaucugggcaaagccagugucaaaucagucaggggggcucagucagaaauggaugcaggaagagacaaggggcugggccggagcgggcagagggaugccuauccaugggcacaguugaauaaucagggguaugagcugcaggucagaggcucuguguuagggcucccagugugaagggcuggacagagaaaccgaggcacaauccugucuauacugguugguuaacacagggagagggaguggguagacaaagccuaaaacugugggaucccagggacacacauggcuuaucacaggcauggaggagccaggccaacagcagcaaaaugaauucuaggccucacuugcuggaaguucugcuguguuggaacugguguggggaugaucucauaggcuccaggugaggggauuggauagggcugaccuucacaagggaacaacucuuaacauuuugcugcuguuuggaucgucauguccagcuuguagcucucccagacaacuuccuggggaaggagugaauuggcuaaaauuugacuuuugaagucuucaucuuggcccaaggcaucacuuugugccaaaugcugagauacuggucuuugucaaacacaccuggaucucuggguacccagauguggacaaucuagagugagaacaccuuaucuuuuccccaggugagugucuuucgucuuagauggucauccagagaaauuaagugaccuacccaauaucacacuguaaaccaauggaggaaacaaugauaaagauagcuaccguuagugagucuuuaucaugugccagggacaguucuaagggauuuauaugcuuuaccuuguuaaaccuuacaucauucauaccuuuauuauggcccuaauauuauccccauuuuacagaugaggagacagguuaagagaggugaaucaccuacccaaguacacacagccaguaagugaguggaaagggauuugagcccacagagucugaugacagaguccacaccaacaacugcuuuaaucaagagaguuugugacuugccuaggucucaagaaaggaaaaccaacugauuuggcugggcagggcccugguggagagggagagaaaacacucugacuccuucucccauuuuccuucuuuuucuggaagguaauugcuuggggcagugacaaccuccuggcgaauuacacagcugguuucccagugagauuuguaacaacaacccugccagccuggcagcccccagcaaguuccgguuuaagaaacuaauugcuggauuguguaguuggugcuaaauuggguaauuucuuggugacggcaucugugccacuucuuccauucccagauagauucgagcugcaucagagaagaauuugucacacacggcacccucccagacuccuucagucaccauuuuccagccagccauaggcuacugcaaaaguggcugcuuccgucggcccccagcuucaccauucgggcagcucucuguguccugggauaguggauggaugauuuggugcaauaaaaaugggaaaauaacaccagcacccagaauugucauaggacuucagggagcauccuuuauucuauacuaaucugaccuugggcuugguauaaacucagugcucaccacacaugggaaaaggcuaaaucacacucugguuagcucugggagauauguauggaugaggucuuuuuauuuguuuguuugcuuuaaaaaaacauauucacuuccauuacugugcccacuucagaauggcguugaauaaguuugacuucucugggcuggcaacacagacaggggaaaagcuaaggcuuuggaaucggccaacacuggauuugacuucuggcuuugacaacagcucucggugugaccuuggggagcucaguuagccucuccaaaccucaguuucuucuucuguacacuggaagguggugggggggggguggauaauaucuauccuuuggaauaguugugggaaucacauaaaauaucauaaacgaaagcaucuuguucuuuguagacucacauucacucaacaaaugccugccauaugcuaagcauuguucuagggacuggggagaauucaguggauaagauggauaaaauuccugcacuuauguggagcuuacauucuaaugggagagauggacaaucuaggagucacacaaauuuaaaaugguaacaauauaagagacagguacauggugccuugagagcaaacagcagggggaucugaccuagucagggaggccagagaaagcuuccccgaggaagcaacaacugggcugagaucugaaggguguguaggaguuagcaaggcagagguggguaggaaaagcuuucccaacagggggaauaggccccgugaugugagggaucaugggacugacaaaagacuguccuggcugccgcagagaaagcaaggggagcauguugugagaggauguuggaaaaguaggaagggccagacccugcaggccuuguuggacaagcgaaggcauuuuauccuaagaacaucaauaaaccaaugaagaguuuuaagcagagaagugacaugaugagauuugcauuuucaaaugaccauuuggauuggagcgggguaagaacggaagcagggagaccaguuaggagaagacgugcagacaugcaggcaggagaugguguucucaggaacaguuggauucguuagcagugcuuucugcugcaaauacuacaggaaaucuggccaacagugguuuaaauaaagagcgcauuccuuaucacauguagaccuggaguaaagcaacuguuaauguugguuccauggcccgaugaugccagaacugacaucucugcaguucucuaggccuuuugugguggcaagauagcggcccuagcucugguuguagucaagccaagaauaaggggaggaaagauggcacuagcaauuccuaccccuuuggucacaaaggcaaaaucuuucccagaaacccucaucaugcuuccauguguauaucauuagccaaaauggaaucauguggccucuaguuacaaaggaggccaagauaaggacaaggaggcugggaaugaauuuuagcgagucagccaacagugauuugguggauguggaauaaaaggcacaucuguuuuuuuuucuuaggaagcaaaauccauagagcauggugguggauugaauuauuagucccuuccucacuuguuuuucccucccauugauuuuguuuaguaauggagugaaggugggugauguggggggaggaaugugaucauaaagcauaauauauaggaggaagccaguuguuaauuaaauauuuucuuuagaaaauccauaaauuggauaucuccugcucccaguaauuuggauuugauuauauuguuuacuauuuggacacuggggauuuuguaaauccaaaagaaaggcuucucaugagggauuacauguauuaauguuuuagaguuuguaagagugauuuuauuauuugauaccuauugaaauccugggagauaggugagcagguguccugaggcuuagagaggguaggccgccucugcuacgucaggugucacauacguucuggucucaggacuugugcuuuuccacuauacagggcuucccuguaggaucuggguaaaggaguugaggggugaucugucuggagagcagcaauuauagggcccaucuucuccaagacaagagcaaggagaacauggauugaugccagaggggcugaaguuucauaggaucuugaugaaagcugagcagcuugccagcagcaccugugugaagcaggagacagaggggcaccugggaauguccaccccugggaaguucugugaggcucuagcuugaugucaccaugcacagagcaaaugggauagucugggcuucugccaaaguggccuuuugugcugugagucucagauauggguccugccuggggcaggaagagggaagagaaugacauggaugaaggaccaggcuuucugucuucuuuccaaggcagagagaugcuuccaggugcuuuuucaacaacuauuugagaggcuaucuugaucugauauucccucuguuuccccaaagaagggcaauggaagauaauugucaucuagagccaggcaguugguaucugugaggucacccuagucucucuuugggcaggguaaccaacagcuucuacaguccaggcuccagggugggccaggggcuggguaugucucaccuuguccucuauggaagauuucuaggaaaccacagucuucuucauugucucacauccuucagggucaggaaguucuuccugaugucugacugugccucuuccacuacuauuaaucacgcuugcaaagcuagcucuucuuccugacaucccugugucuaauaaugacaucauuagucuuccagucacggcugcugcaaacuucagagucgucuuccuuucugauuuucucucuccuauucccacuauuugccauuuccugucugccagaacucucugagccuaccccuuagaauucccuauuugcacaccucuucucccugugcuuguuguuuccuccacuggguagguucuuuuccucaucaccuauguguaugggacacacagacaucuuguacuccaucacaaacauccucuccucugagaagucuuccuugauugaccucuauugaaucuugucccauucucaucugacguagccuaacauuuugguaccucuuuccagcacagccauuuauucaucuacuuagugaguguuuauuaaggacuggcccugggcaaagcccugaguuaggugcuggagauccagagaugaauaggacuugguuccuauucugaagaagaccacauucuaggugaggagauagaaaccgaaacagacauuuucaaugcagugugauagcugcuuucauggggacacccaggguguuauaaaagcccgauaaagagcauaaccuagaauaagagcacagaaagucuuuaagggaagguggggcuuaauaugaguaaguuuuagccagggggagggcuuugagguggaugaaaggaaauucuaggaggagggaagaguuagugcaaaaauaaaguggccugaaauaacucugucacgugagagguuguuccccuguuagacuauaaaccccucgaggacagggaccacucuuaaaucaccucuauacacuucucacucucuugcuuaugguaacuguucaauaaauguuuguggaauggaaucauauuugagggcaauggaaaaaaaaagaaaaaacaacgcaguggcucagcaccauggacagaucccacagacaccugcaguuggagauaguccaaccuguaagcucauuugaauguauuugcauaaugaagccaaccucauuucccuggggguucaaaggcucugcaucaugggggauccaaucaguccugguuugggggaguugggaagggaagcugucagggccagagaccgguccucugaggacugugggaaaacgucucuccccuuuugcuuaccauccuuuucuuuuccaucaggauucagugguccugagccuucugaaguuaggcuucugccuggugguggggauccugacaucaaggaugggacacccuggauggugagugauagaagagucugggagauggggauuagacucagguucucauaccagaauaauggguuugaaucuugauucaaagugacucauccacuuacuggcuuugugaccucaacguuuugagcucaauuuucucauggguaaguguggauaauaccugcauuacaagauuucaguaagauuagagaauaucagguaugcacaauaccugguauauggcgaguacuugggaaauaguaggagaugaggggugagcaggaucuggaagaaagguggguguggggagguggugguagggagaaagagaaugaguccuggagguguugcugucuggagccuuugaggcugucaucccuccuagucagcagauggcccaggagccuggucgaggaugagggagggcaccgucugccagcuccucugucccugucccuccugcugucacucccuccugccguagcuccuauccuggcagcuccuggaguccugauuggaggcagcucuugcugagagcugaccucucuguccuguagccuuggcaagucugggaugggggccaggagcacugguuccagaguuuuuucuccaucacuuuccugccuugccuucccucuguuccugggaggaggaacuccuggguuccaaucccaguuuaggauucagaugcuacuguguguagccgcuguucuucuucuuuauggauuuuccuccuucaugauuccccuccaguggaaugggaauggaggguggggguaaaaggcaaaagggguaauuucauagggaaaauauuuggaacccggaagaggaaggaggaagagucaucucagauucuccuuauuucaguccacaggggagggagaaugagccugcagccagauggaaugcacaggguguggaaggaaggggaggaauuuuucugugggauggugcuggauauguagauuuggguccaguguucucuuuguucacagcagcugggagcugugacccugaggccuggcucuugcaacagugggguguagggcaggguuggaguagagauguggcuguggaucuauuugccuaaugccagcuuguuaaaagcuaguucaccuaaagacugguuucuuugacuauuuuaugucucccuggguaugcuuuuguuuuugguaaucuaaggacauauucacacacauacacacacaucccaaaguauaucuauauauuuacacauaaauguguauauauauguauauauaaaaauauuucuauguguauauaaaaauauauaugcauuuauaaauauuuauuaauauacauuuacaaauauaaaaacaaacaaauauauauauauauauaaauuuagaggccaggucucgcucuguugccugggcuggagugcauugguauaauacaaucauaguucacugcagcuuugagcucuugugcucaagugauccucccuucucagcuucccaaguagcugggacuacaggcauaugccaccacaucuggcuaauuuaaaaaauuguuuuguagagacagggucuugcuugguugcccagguugaucucgaacugcugggcucaagugauccuccugucuuggccucccaaagugcuagcaguacaggugugaaccacugugcccagucucuaaggacauuuaaaaacccauuugacugagggaauauccucuugugaauaaguauuuaucagauuugcaguauucauugaaugaugggauuauuuugugcccuugagugucuaugucuauuaugaccauuuaaaggacuuuuuaguccauuugugggaggguagugugauuaaucauaauaaauugauauguauuaccuaaagggauacaaggaugccuaauaaaagaugguuuuaggugaagagggcuguucaauucaaauaccuuuucucccuauuuuuccaggagguuccuggggccuggcccccaagacuaugaagagccuuugcugaggccaugagggguuaccauggcgaccgaggcagccauccccgcccagcccgcuuugcugaccaacagcauauggacgugggcccugcugccagggccccauaccugcugggcuccagggaggccuucuccaccgagccccgcuucugugccccgagagcuggccugggacacauuucuccugaagggccccugagccugagugaggggccgucgguaggcccugagggagggccagcgggggccgggguugggggggguagcagcaccuuccccaggauguacccuggccagggccccuucgacaccugugaagacugugugggccacccacagggcaagggugccccccgccugccuccuacacuccuggaucaguuugaaaagcaguugccaguucaacaagauggcuuccacacacuaccauaccagcgagggccagcaggggcagggcccgggccagcgccagggacgggcacugccccagagccccgcagugagagcccuagccgcauccggcaccugguucauucugugcagaagcucuuugccaagucccacucucuggaggcgccggggaagcgggacuauaaugggcccaaggcugagggaagagguggcucuggaggagacagcuaccccggcccgggcucuggaggcccccacaccucccaucaccaccaucaccaccaccaucaccaccaccaccagucccggcacggcaagaggagcaagagcaaggaccgcaagggggaugggcggcaccaggccaaguccacaggcugguggaguuccgaugacaacuuggacagugauagcggcuuccuggcgggugggaggcccccuggggagccugguggucccuucugccuggaggguccagauggguccuaccgggacuugagcuucaaggggcgcucgggcgggucggaaggccgcugccuugccugcacuggcauguccaugucacuggauggacagucggucaagcgaagugccuggcauaccaugauggucagccagggccgggauggauacccgggggccgggccaggcaaggggcuccuggguccggagaccaaggccaaagccaggacuuaucacuaucugcaggugaggcuuuuuugggguuggggaacagaguccuuagccuucaccagucuugucaacuagggagcaguggaaaggguugggugggagccagcugucccugugauggagggccuggguguagggaggcucugcccugccccauugggucacucugagcuccuuuggggcuucacuuuccccauuugugcaaugaaggggcccuucuguucuaaugaugugucugucccuagagauuuucccuugaccuacuguuuuggacaggcugugcugauaucugucuucggagguuggaggcauaaugaaguugagggcaggcaguagacaggauagagaggugcaccuuaguuguagcugcucucaagauugaaggucggcaguuggaaagcaguucuccugccccaaagccuucuccagcccucuuuucugcuauaauccggauggcccacauguuugaauaugaagaucaguuauuucuagaaugugccucugcugagguuugucauuccgggguaccgguggugggacagccgaagcuguggagggguccugggaguuucaugugucucauguguuuuccuaggcugggggacaaacuggguuucagcccugauacaauucaggcagggccucccgggaguggauggugcaggugauagcuggcaugcuguucucaucuugucuuaccacauuuauggucucugcaggugaggccaggaacucugauuccuacuuuuuauggagccuucaccccagccucauccagcccacaucguuuucuuaaguccugccguaauuuuaggagaaaaagucaauacaaguucuggagguccaguguauuuccgcauucgacauaguugauacagaucuauuuauucaaugagcguuuucugggugcuguggauacaaagaugaagauacagaugcugcuugugaggagcucacaguguagagugggaauagacaaggaagcagauagaauacagugugaugaggcugugauaggggagagcccugggcaucuugggaacacagaggagacaccucacugaccugggugaggaauguccccugagcugaaucucaguggaggaguugcaguuguugagugcuggcuaaacguguauugggaagagacuauacagcauguucaaagguauggagaauagaggcugugugugucuuuguggggcauuggccuugcuggguaaguugcacacaaguuagggcucuccuggagaacucaugaaggcccaagggagcacauagggccacagugcaagcaagaagggacuucuggauuggccugguuugcccccucccuggguagggaggugcucuaagcugggaacugcagggugcagggaggcagcacccauccuuucucccccauagccgauuccuugccaucccugaagacuuguugccauuucgcugcucccugcugcugcuucagggcugcccugaccucccugggggcuuccuuuuuaacaugcaccucacaguguccugcagaggagcucugcaguggcuagaaugggaacccugcaguauggccuucccaucugcuggccugccucucuccaccugccugcugcucucuguagagaauggggaaggggaaugaucccuccggucuggaguuccagggcaucugaggacugggaagucugagcccauguggggaagaaccaaagggcuauagggacccuccagacagccucgcacuccccugguacaaaagcaggggaggcuggccccaugaggccaggugucuuugcuggacucccgaucugauugucaaagcccuguuucucccacuggguaccagcuuucucuuaagccuuuuccaggaucccucuguccacucugagccccuguuucuuuauggagccucaucucuuuguuucccaucauccaaaugagcccuagccccuugaagagcccugcuccugcccguggguuccuucaagggaccccaucucauccccagagucuccaccuuuccccugaacccuaugcugucccugaggcguuaccccuuuuggagcucccaucccuaccccauuuaaccuguucuuuacacaaguguuuuaaauccucccuaccucccccaguccucucccccacgucuucacuuacaccucauuuuccgaaguguaggcugacaucacggacucccucagcuuccugacagcaucucucuagacgcauccaaauucccagccacccucguccccuuccuuggcucauaggaaaagcugggaccacccaucccaggccgauccuucuuccagggcuugaucccaucucaucaugacccccuccaucccugaacuguucucccuucugagguuuaaagacuauuuuuacuggcucuuuccaucauucugaaaacauguccaaagucgcuugcauccuaaaaaauauuucugcagccccaucccaccuuccauguccuucauaaucgaguucuuagagcauagacaccuacucuucacuucccuucaauucuccccucacuguggucugauuuccaaacucccugucauugacauguccuggcaguggccacagaugaucucuugagcgcuaucuucaaaagcuacuuuucagugccuauaauaauuguuaccauuuauugagcacuuucuauguccuggaaacucucuauuggcucauuuaucuuugccaccaacccucugauguaggcauaaguaucaugaccaacucgcagacaaggaaacugacacuuagagguuaaucuguuuugcuuaaguucaccuauccagcaagugauggggccagaauugcacauggaucuucuaauucccgagccugaguuacuaaccucugaacgcacuguggcauuugacauaaucgacuccuuuuauucuugaaaugucuccuguuucuaugacauggcauuuuccugacuucccuccuaccccucugcccacuccuucucaggugacuucacaggcuccucuuccuuucuucacagucccuuuuuaaaugucaguggaucucugcucaucucucuucuucucuccccugggcugucucauucacugcuauggauucagcugccgcccaugacucccacauguccgccuccagccccgaucuccccacugaaucccagaaccaaacauccaaccaccugcucaacaguucuaugccaagcucaaggugcucaaccccgacccuaccaccuuuccccagacuuguuucucugggguucuauggcucagugagcggcagcacccucccccagguccucagccagcagccuggcagucauccucgacuccucccgcccccucaucccccacgucuaaucaggcucacugaugcuccuuaacaccucucauuuccaucuccuccucuucccccucauugucauugucuuaauuuaggccucaucaucucuugccuggauaacagcaucagccuccuaauuggucguccucucgccacuugagccucugcccugcuccuggcccuccacaauccagccucuguuuggacugugggagagcucuuucugcaacacaaaucugaugucacuccccugcaugaagcccucuguggcuccccacagcggggaaggagagaggauuuggaauguaagcagguugaaaggaugaaggagaaggagggguagaagguugacugaggucaggugaugccugacugcugggcaugggauugacacaggucacuuuggccucugaucaucaaccgcuugacgccugccaugucacucccucagacucucuagguggcccuuaauuaagugcagaaggucuguggaggaugacgaggugucucuuguaagggacggggacagccugagacccuaccuccccuucugccucugcauguaccugagugugccuguucaagccagggcagggcaucucccacuggcaguggggaaagaguccuggccucuagauuuacuagggucaugucugagagacagagaccccuguuccugcaggugccgcaagaugacuggggggguuaccccaccgguggcaaggauggggagauccccugccgcaggaugcggagcggcagcuacaucaaagccaugggggaugaggagagcggagacucagacggcagccccaagacaucucccaaagcagucgcccgacgcuucaccacccgucgcuccuccagcguggaccaggccaggaucaaguaaggacagggagggccggggggugcggggucaggaggcugaugcuggacuccugcgggagauguguguagagugggugccagucagguaguccugcuuagguuucaacuggggugucucacuccacuccauguaaagggagggucuuggugggaguccuucucuggugccucuuugggagucucuuuacccagggucuccuaagggaucucucuuuggggguucugaggaauaggacuuacucaggggccccagugcuauuaucuccccucccccaccuccuagcaguccacuguucugacuccggaauuuugcccuuuuccagcugcugugucccaccccggauccacccccggagcuccaucccuggcuacagccguucccucaccacuggacagguagggagaggcccaguaugccuggaggaaagagugaaaaagggauucagucccaugcucagcuuaggacuuaaaaucagagggucugccuguggagagagcucaggccuggcucuggggaaacugggaaaccugccuuaggacuccuggagcugacucaggcugggagucucagagaaucacagccuuaaaacccaccaaguguccucaaagugaugagcuuguaagggcaacgccagugcccuggggcucuucacaggccugauugcucccuccuugcccccauguaaaagguaggauuggccgggugcaguggcucucgccugugaucccagcacuuugggaggccgagguggucggaucacgaggucaggagaccaagaccagccuggcuaacacggugaaaccccgucucuacuaaaaauauaaaaaauuagccaggcaugguggcgggugccuguagucccagcuacucgggaggcugaggcaggagaauggcgagaaugagccgagauggugccacugcauuccagccugggcgacacagugaggcucugucuuaaaaaaaaaaaaaaaaaaaaguagaauugauuuguacagacagggcgcaggccaagcugcagccucagacaugaucugggccugaauucugccaccuuaccccucuguccugaggaaccaccagcaagagaccuuacuuuucaacaccuccauuucucaucuuuaaaauggcaaugguuagggacaguuauuuugcagggguuuuugagaguucagugagaaaauguaugcaaacacaagguacuuggcccaaaaauggcauuuuauaaaugugaguuccauaucuaaguguagacuuuccccuuaauuagacggaagcagcagcauuuagugauuaaacacaugagaugggguugaauuccagcuuggcuacuuaccagcugacugaccuggggcaaguuacuugacuuuuuuugagccccacuuucccuuuuuaaaaauaggcaucauaauaguguucuuggcacauagccagcacucaauaaagguuagcuauuuuuacuguaugcuggggaaaaaaugcaaugcaaaagacuguccacguuggcucucauuguucacugcugcagucucucaguauuccuuuguuccauugccugaaccaggaaaucugauuggcacagcucucuuuuuacaucagaccagccuauguuguuaaacccacgaguuaaugcuuagcccucauuuuaccucacccaucagccacauguaacacaguugaagacuccuuccuuccugaaagacuuuacuugguuggcuuggaggacaccacacccucuacauucuccuagauucccucccuggcugcuuauccucagucugugucuugggugccucuauaacuccccaggaucuaaacacuggaguuuucuagggcucagucccuggacuucucucuauaccuacuccuuaggugaucuugucugggcucauggcugagagccugaugacuaccaaauguauaucuccagcccaaacucucuuguaaaugccaggcauauaugucuaacuguguauugaaaucucauucggauguuuaguagacaucucaaacuuaagauguccaaaacuaaacugcugauacacacacccuccacaauccccucccgccccuggcugccgcaguugcugcucuauccucugaauucuccauuucagauaauggcaacuuuauccuucuagaagcucugguuuaaaagccugaagucagucuugaccacuuucucucucucacaacucaccuccaauccuucagcugauccugcuggucccaccuuuaaaauauauccaggauccaaccacuccucaccaucuccacugccaccgguucuuccaggcaccauguccuuuugucuggacgauggcacugccuuguaguuggucuccuguauuugcucuugcuccacuucauccucucucauuacagcccacaugaucuuuaaaaacuauaaucacacucgcucuucuguucaaaacccucacguugcucagaguaaacaucaagaaccuaaccauggcuuucgaggccugcaugaccuggugaccucgcuggaguggagcugccucugaguuccucuccuaaggcuguuccccucccucccacuccagccacacuagacucccuagggcccuugcauuugccacuaccuuugccuggauguccccuucccagccacucccauggaucacuuccuaacuucuuucaggucuuuucccaaaugcccuaaaauuuuaauuuaacucucccuuuccaacauuuccuauuccccuucccuguacugucauuguugaggucuucucugucuucuuccuccugcucuuucuccuucuucuuagcacuuugcauuaucuaacaucacauauacuugacauauuuagccuggagguauggcuucuuauucuugcuuuauagaagaugaaauaaguuuaaagcacuagagaugucacccuauuaugucucauaauacuuuuuuccucuucagucuauuuuuuuuucguuuaguauuugccuaaaacaccuuuuuccaucuuuuacuuuaaagcuuuuugucuaugucucagguauauuuuuugaaaauaguuauagcuacauuuuaccuauauccauucugauaauugcuugagaguuuaguacauuuauauuuauugugauuacagauuaucugugauuaccccuuggccuaaaccuaggguagugugaugacccuagcccuaacccuuggguuuauuucugucaucuuauuuugugccuucuauuuaucuugccuuuggacuggugcuuuccugcuccuuugcugccuccuuuugguuugaguuuucuuuauucuucuccccaccaaaucccacacugguuuaauaguuauauauuguauuuuauucuuugugguuacccuuauaauuuucauaugcauauuugacuuaacgucugaagcugacaguuuuuucugugcuccuccuaaacaauacagagaccauaggacaguuugauuuugugugugugugugugugugugugugugugugauggagucuggcucuguugcccaggccagagugcaguggcuagaucucugcucacugcaaccuccaucucccggguucaagcgauucuccugccucagccucccgaauaacugggauuacacgugugcgccaccacaccuggcuaacuguuuuguauuuguaguagagacgggguuucacuauguuggccaggcugguucccaacuccugauaucaggugauccacucaccuuggccucccaaagugcuggguuuacagacaugagccaccacaccuggccgacauucugauuuugaugaccucuucccuucuuguucuucuuuuuuuuggcaacaaaaauuuauuuucucacaauucuggaggcuagaaaucugaccaaggugucagcuggagugguuuccacuauucaguaauuuguauuuuuauauuuuuuauguuguuguuuggagaacaaaacauuuuaaacuugaugaugcauaauucaucaauuuuucucuucuugauugugcuuugguguaaaauuuaagaaaucuuugucuaaugcaagaucacaaaaauuuacucuaauauuucuccuaagaauuuuguaguuuaacauuuauauuuagauguaugacccacuuugaguaguguguguguguguguguguguguguguguguguguguaugugugauucaaguuagggguccagcuuuauguuuuugaaugcggauauccaauuuucccagcaucauuuguugaaaaggcuuuuauguccucauugaaauuucuuggccccuuuuucaaaaccaauuuaccauaaaugcauguguuuauuaaugaaccuuaaaauuuauuccauuggucugcuugaaccuaucuuuaugcuauuaccacaugcuuugauugcuguaacugugugguaaggauugauuuugguaagcugaaauuauacaauuuuguuacuccuuuuaaagacugcuuuguguuuuguguuuccuuugcauauacacauggauuuuggguaggcuuguugauuucuauaaaaaauauaguugggaauuugaagggauugcucugaauguguagauuaauuuauggaguauuguauucuuaacaauauuaaguauuauuauccuugaauauuggauguauuuccauuuauucaguucuucuuugauuucuuucagcauuuauuuuacuuauuauuauuauuauuuuaauuuuuuuuuuuuuuugagacagucucgcucugucgcccagguaggagugcaguggcaugaucucggcucacugcaagcuccgcuuccuggguucacgccauucuucugccucagucuccggaguagcugagacuacaggcgcccgccaccacgccuggcuaauuuuuuuguauuuuuaguacagacgggguuucaccguguuagccaggaucgucucgaucuccugaccucgucauccgccugccuuggccucccaaaguucugggauuacaggcaugagccaaugcuccuggccuauuuuacuuuuaauuuuuauuauaaauugacaaauuguggguguauauauuuaugggguauaaaguaauguuaugacuuaugaauacaauauggaauaaugaaaucaagugaauugacauacccaucaccucaaauacuuaagugaucuuaggacacuuuaauuuccuugacuucuucccuucuuauguggacuuauugcccaguauuuuaguucuaccuuuuaaccugucaaauuagucucuauuauuauuguuacuuuuuauauuauuagcucuugauuguauguacucacaucucuaccuuuuuuacuccucacuuuaccuccuuacaucucauuguuuccuccuaaaguauauucuuuaguaauuuuuucagugaauaucuguuaguagcaaacuuggacuuuaacaaaaaauauauuuuacccauacuguuugauacaguuuagcuuauugugggaauucuagcuuaacauuuauuuucucuaaguguuuugaagauauucuuuugucaucugucuguuguugccguuaaggagucugcuaucauccugauugucuuuguagguaguuuuaauuucucucagguugcuguugagaucuugcuuugauuuuauuguucugcaguuuugcuaugauauauucaugugugugcuccauaggucuguggauucauguuuuucaucaauucuggaaaauucucucaugguauaguuugcauaguauaucuuuuccccauucuuuuacuuucaacuguuuguguuucagauuuaagguaugucuccuguagacagcaucuaaugguuuuuuuuuuuuuuuugcuuuaucuuaucacuaugccuuuugaaugaguguuuuuguccauucauguuuuauuuuauuuauuuaauuuguuuuugaggaagggucuugcucugucauuaagcuacaagguaguggugugaacauggcucacugcagccuugaccucccaggcucaaucaauccucccaccucaguuccccaaguagcuggaacuagagacacauaccaccaugccuggcuaauuuuuguauuucuuguagagauggggcuucacuauguugcccaggcuggucucaaaacuucugagcucaagugauccacccaccuuggccucccaaaguucugggauuacaggcaugagccaccaugccagaccuucacaucuuaaugugguuauugaugugguuggacugucauauuauuuuuugauccucuguuccuucuuuacugucuucuuuuguauuaaaucaauaaauauuuuaguguaccauuuauauuuauuuguuaauuuuuuacuauacaauuugaguuacuuucuuagugauugcacuaggaauuacaauguauaucuuagcuuaucaaaauauaauuaugguaaaauauaggagcauugcucuaauauaacucauuuucccccuuuuugcuauuacugucauauauuaccuauauauguuuuaaaccuaacacuuguuauaaaccaacauugguauuauaauaagugcuuuguguaaucuuacaucuuuuaaagaaguuaagagaggaagugaggaaaauauauuuauagaggcucuuguauuuacucacauauuuaccauuucuggugcucuuuauuucuucuucuguauuugaguuaccauuggcuauuacuuuauuuucccuuuagccugaaggacuuccauuagugcuucucauaauauaagucuccuggcaauaaauuauucagucuacauuuaucuggaaauguuuuuauuuuuacuucaucuuggaagaauaguuuugcuggauauaaaauuccuggcugacaguuauuuuucuuucagcacuuagaauauaccacuccacugccuucugguguucauuguuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccaccucggccucccaaagugcugggauuacaggcgugagccaccgcgcccggccguguguucauuguuuuugaugaaaagugaguuguuucccucuaugugaugaauuguuuuucuugugcugcuauuaagauuuucuguuuucagcuuucaacauuuugacuguaauuugugugaauauagaucucuuaguguuuaaccuacuuuagguucauugagcuucuuugaucucuaauguuuuuuguuuuuuaauuaaauuugguagguaggcacaguagugggcaccuguagcccuagccacuugggaaguggaggcaguaggauugcuuuagcccaagaguuugaccuguagugcacuauguuaugauugugccugugaauagccacugcacugaagccugggcaacauagugagaccucaucucuaaaaaaaacaaaaacaaaaaacgagaacaaaaacaaaaggaaaguuuuuggcuauugucucuccaaauauuuuuuucugcccuaucucuuccuuuuccucuuuuuuuccccuccuccuucuggaacucccaucacaugcauggugcuaugcuugauguugucccauaggccucugaggcuguguucauuucuguuuaauauuuuuucucuccauuauucauauuggauaauuuauacagauccaucuucauguuuacugaucauuuauuauggugagcuccucuacugaauuuuuaauuucaguuacccuacucuucagcuccagaauuuccauuuguuccuuuauuuaaucucucucucuuuguugugauuuguauucaugaagucauuguugucaugcuuuccuuuaaaucuuuaagcaugguuuccuuuaauucuuugauauauuuauaauagcugccuuguagucuuugucugauaaaagcaacauuuggggauaugcauaccuucuuguuuauuugcauguuucauaauuuuuuguuaaauacugaacauuuuagauaauauauuguaguaauucuagauuauguuuuccucuugaagauuguuauugcuuuguuuguuaaucccugaaugaaaucugugaaaucugucuucccuacaacauguggccucugauguuuccauucaguuuuauuuccuucuuauuuuuauuuuaagccuuguuucuuagggguuucccccauaucugcauagcuuaguguucagccagagauuuuucggagguugugcucaagaaccucaagcuaguuagacuuugugucugccuauaguucuaugugugagcuggggagggcaaaguucagguuguuuucaaaccuacccuggcuuuuacucuucaccagacucuuuuauuuccccugcacacauauauaagcuccauuggcuagggauguguggguggcucaggcuucucuggucucugcugugcauucacccagcuucgaguuaacccaagauauguggagagcuuaucaaacucccuuggucugucucacucccuggaauuuucugauaaauuccugguuaguuugccaguccauuguuuggcccaaacauugcugaaacccagccuaacagugcuucuggccuuuccuguucuugauauuauaacugacaaugccccaaauuaaguggagcccucuggcagaggcagugaagcagcugauuuuucacaggcggcaccacguuuguugaaguauugcaacugauagcauugggagccuggugaacgagagcagccucaggcaagaauacuauagagucgugcuauucuuacccaaaguccaguaauuuuuaugaauacauguuucuuuguuguaugucuuugauugauuugcagagugauaaaaugguggguuuugacaguuuguccugcuuuagagucguauuuucuucuguucucaguuuuaucuuuuaagcuuggaacuuuuaaacaucauuuaaaaguuauuuuauuuuagcuaagguagcacuggcugcuuuaacagagaaaucuugaauucucaauggcuuaacucaauaaaaguuaguuuuuguuuaugucacaauuuguauuuucuauugcuauguaaguuauccccaaauguaguaucuuuaaacaacaaauauuuauuaucucacaguuucuguggaucaggaaucugagugcagccuggcugggugcgacugggucaagugucucacaaaguugcaaucaagguguuggccaaggcugcagcaucucaaggcuucacugggugaagaucugcuuccaugcucacucacauggcuguuggcaggcuacagauccuugcuggcuacuaaccagggacaucaauuucuucuaugugagacucacuacagggcuacucacagcauagcagcuugccucccccagagcaaaggcuuugagagaaagagaauaagaaaaggugucuaagauggaagccacagucuguuuguaaccuaaucucagaagugauaucccauuguaucugccauauucuauucauuagaagugggccaauaagucugguccacacucaugagaaagggauuacacaagggugugaguuccaggagauggagaucauuaggagcuauuucagaggcugucucccacauaauacacucaccuucaauggaaauuuaucugugagaagcaugagcagcuuggguuaggagugaguuccccaggaaauauuuugcaguugcuucuguuggaauaugccugguuuggaacuauuuuaugcuaauuuuuaauuuuagggguguggcccaugaagguucaugcagauacacuguaccguggcugugugaggaccagcuuguagguacagauucuuaggggauuugccucuuuucccuucccgccaucccuguacuucagaccagcuuccuugucaucagccuguggugaugacuaauuuuuuuauucuagucuacauuuucaucaaagguuucacuuuuccuaacuuuaugcagguucuccuuuccaauuccacgcuucaugugggcccaaagccuuccuccuaugcccaaguggguguuaaaaccuaagccuuuaccaaaacgcugagaccaacagccccugcccccaccucccgccuccacugggcuguuugcagcauuggcucacacaguuaauauucugauuuuccagucuccucuuugcuuuuguccccuggggacuuaucucgcuuucuugugagcucagcuaugcauauaaagcaacauuuguuauauuucauccaauguuuugaaaugggagaguuuucuaaagguuaucuaaacuaaauaacacaaguaaaguauacacgauguugccuggcccccuguuggacccaccaacucuagucuggacaauuuccaauuagacacaaagcauuuuuacuuuaaauauuucaugagcuuggaaauggcuacugauuccagucugguuuggagaaaggcuaaggaucucaucccaagaggauucuuugacuuugagucuccuguaaauggauguugggggaagcaggguggaagucagugcagggauaauaggagcauucacaguacaauguuacaguuuuauaacuguaggauaguaaagaucaacauggguguaauauuucucugagagucucugaguccguguuucccuuguguccuggucuccuguuggaaccccagaagcuccucuuggccagcugagcuggcggguguaugaccccagggaguuguucaccuucuuuugucugccuuggauagaauugguugugaguauugccugugggugggauuucaagagcugcagaaccccagggaaagaggcacuucucauucugagugguauugucacugcgauuuaagagccucuuguugcuaauaauaguagcuauaguuuauugagcaucuacugugugccagauauuaugccuagugcuuuauacacagaagagggcuagagauacagaaauauacaacagagugagauuccuuucaucccuggugucuggacucgagaccagugugcuuucugcuaggguuagauuagcuccccugugcuccaagagggacacucugggcugcauuuguucuaauuggggagugucuugagccuagcccagaaauagcaggaguuaguucaguuccuguguuuuaggaaauacgcuggcaacuguugucuuuggugccccagaaauacagagacagaaagacugagagguagaugacagagcaucauggugaaagccacaacugucacacaaguguggcuugugucagucaaauaugagagaacuuaacuucugcggggucuuggauugauuuuccauggccugggauuuccauacacuuguaaugaagcuccuuuagaaaaagcuucaaaaaguucagacaauccuucuuuucaauuaguaggcccacauuggaaccaacgaaucuaaaucuccagcaaauuuggcucugagcuucuaagcagccaaagcaagagagguguuuuguuaaccuuggguucagauccuugggguggggccugaguuaauguagguuuaacaagcuccccaagagaaucuguugcucagucagccuuacaugggagccaggaagcaugacauuuaauuucaguuuuaucaccuaccagcugggcauccucagacaauucaccugcccucucugggucuuguuugcccauuaguagauuggaauagaaauggcucuauuugaaguagaauccagugaaaucauguuaugcuuuggaggcugaauuauggaaacacugagcugcaguuuacacauggaucaggccacuccuuugagccucuguugacugcacguaaauauaaugccgugaaucuuuccugggagaugucacaagaugcagccaugugauacuugcuguuauguuugccaugggaugcugucgaggaccuuauccaugacuucauccaauggacucuacauaaucauccacaggggaugauugucucuuagucucagggacaggaauuguugugguucucaugggcaucuggccuguguuuaccagggaggcccugagaccuucgcaugccgcuagccgagggcuuacuaugugccaguaccuguaccaaaaggcucacauguuuuucuuucaguccccucaauagcccuaugaagaugguaccauuaucacucccauuugacagcugagcaaacugaggcccccaaacuuuaacuuucccaggccauucugcuaggaagugguagagccagcacuugaaucuaggagaagucucacgcauagcccaugcaggcaacucugaggcuauacucccugaugcuuugccugcuuggaagcucaggguuaaacaugugcccaucuugagcaauguucaggacuuugucaccuguguucuggguguagcacuuaccucggguagcaccuuuuccugccuuuacuuuuucuuugcaccaguucucucuuguaaugugaaugaagcugcaaccucugugguauauuuagucuucaugugguggugugcggcacaguuccaccaacaaaauuuuuguuuugcuuuuuuucauacuuuaacuuuuuuuuuuuuuaacaccauggauucugcaccaccaaaauacgaaaaacaaaaccagaaccucauccagcaauggcuaagcuuuccucagugggggaggguagagaaggaacccacagguuaagccagaacccgagugaguggauagaagguuggggaaggcaagggccgggugcgguggcucacgccuauaaucccagcacuuugagaggccgagacgggcagauuaugaggucaggagaucgagaccauccuggcuaauacggugaaauccugucucuacuagaaauacaaaaaaauuagccgggcgucguggcaggcaccuguagucccagcuacuugggaggcugaggcaggaaaauggggugaacccgggaggcagagcuugcagugagccgagaucgcgccacugcacuccagccugggcaacugagcgagacucugucucaaaaaaaaaaaaaaaaaaaaaaaaaaaaagaaggugggggaaggcuugggacacugguagguuaauaacuuugcuccaucacuuacgcauuaguuuccauccugccaguugguauuuuauauauauauagcauauauacauguaguguauauauauaguauauauguaguauauauauaguacauguauguaguguauauauauacacagagcuuucaaucaauuuuguaauguaauggauuauaaauaauaaaagauguccuccaugaaguccccacccccauacugggcaggagggugcaugccaggucccugguccucucuguuggggucaggugagagaaacgucaggggaugggacuagguggagagaaaaacaugguggucugcagucuggagugcagccagccagacaccuggaagaggcauaggugggguggaggugggggugggggugggauauuuagaggaaagacugggccccaagacaagccuugggagcagaguggggcagagaugcccccaucuuucuuugcaaagaguuagaguuucuuuuaguucaaaugcggaagagucgccuacagccucugcagauauagagaggucuuccccuaaggcagagcaccccagggacuuccacccccucccggcaccuuauaacuguccucccgacccccugccccccagcucagcgaugaguugaaccagcagcuggaggccgugugcgggucgguguuuggggagcuggagucccaggccguggacgcccuggaccugcccggcuguuuccgcaugcggagccacagcuaccuccgggccauccaggccggcugcucucaagacgacgacugccugccccuccucgcuaccccugccgcugucucagggaggcccggcuccugugaguacaccuuccugccccuggcccggcccuaggcaggagagcgcccuggguccggguucuggccucccccucgacugugcugugacccgcgcagaucgcucgcucccggggucggaugacggggagagcguccguuggcgugugugcagcagcauguggagugcgcgccgcugcagggucccguagggccucuugagggugggagucgggcgcgggcccaggacccaggcagggccgcgagccucacccacugcgucucugcgcucgccggccacagccuucaacuucagaaaggccccgccccccaucccgccgggaagccaggccccgccccgcaucuccaucaccgcccagagcagcaccgacuccgcgcacgagagcuucacggcggccgagggccccgcccggcgcugcagcuccgccgacgggcuggacggccccgccaugggugcgcgcacacuggaguuggcgccggugccgccccgggccagccccaagccccccacacucaucaucaagaccaucccuggcagggaggagcugcggagccuggcgcggcagcggaaguggcggccguccauuggggugcagguauggaacggggaggcgcccacgagggcucugacccuggucggucggggcuggggugaggggcuggaagcggccuucuggauauaucgacauucuuucuggcuugcccugagcugcaagugaaccccgugccuggacaucgacggggcugcuccagccagcccccgcccacucccucgucccucguccuggcaccaucgccccuccugacuaauggagggcuggagggcugugcccagugguugccacuuugaggccugugaccgaccgccugggucucucaucuuguucaggcagauggucuuugcaggaccugccagcuggcuuggggcgcagccauugcuagccguucuccccgggaagggcuuucaccuuggcucgccacagccacugacuccuccacccugccaccagguggagacgaucucagauucggacaccgagaacaggagccggagggaguuccacucuauuggcgugcagguggaagaggacaagagguaaagucacggugggagugcccaggcuucgcugggagacaggaggagagagggcugcauaguguccccacuagcccagucucccugcacauccucuuuuccuggaagugagaccaagccuuuuuauagaggguggucagagcagccacaggggcuguuccauagagaugucaccagaggagucaucaaaccuagaguucuugugcccaugcccaccccaggugcucagaggcagacgggagauacacagcaguugcagggaaggagaggaugggaaagguuacauguaggugccgagcaggccuccagcaauuguccuuuccaggggaugauaggaucugccaaucccucauuacauccugugguguacaaguaugugagcucaaaaagaaacaaacgggaagauugccucucaggagccccuggcagauauaacacuccuccucacuuggcucacacaagcauuuaaccaguuggggguaccuauuacaugccugagucugugguguaccugagauaguacaauuagcagcagccacuauucuggcauuagguggccucagaaacauugacuccuuaauuuucacugaagaauuagcauugccagcucuggaggggauaccagaaagaggccucucuguuguugggugccuauggggagaaagggugucugggagcuugccaggggcuggccauaacgguuucaugguaucugagcuucccaggccauacgacuggaggaauaaaacuagugucccaggccaggugcgguggcucacgccuguaaucccagcacuuuggaaggccaggguggguggaucacuugaggccaggagcuugagaccagccuggccaacauggcaaaaccccaucucuacuaaaaauacaaaaauuagcugagcaugguggcacacuccuguagucucagcugcucgagaggcugaggcaugagaauugguugaacccaggagccugagguugcagcgagcugagauugcaccacugcacuccagccugggugacugagugagacuaucucaaaaaaaacccaaaacacaaaaaaccagugucccacuagcagugguuccucgcagcucuguucccaguugcuguccuucgcccagauuuccccagcuauuucugggauguccuugggaugucuuguguuugugccugaugaaguuuuuuugguguuccuaugggauucaccauuuuucucaacuucugauuuggcucccugaaguucugugugcuccuggggcuguaaaugccuucaucgaggguggcauaaugcugcccugguugccugcaugacuucuaaaccugcuguucaccaaacuuuuacugugccacaaagauuucagaaaaauagcauuuuauggcaaacccaauuugcaaaucugugacuugaauuauugagagaugggguaggagucauggauggaugcaacucuauguucugaauccuacccacccccaauucuagugcuaucccauggaccaccaagcccacucacucccuuuagaggcuuuuugguuccuugucuagauagguccagggggguggggguuccccacauuccuccuaauaacccuugaauccugggaagagugcugcaggccuucuagcugagacucuugcuaaaucagcaaacucuugucauugauugauugauucauucauucaucagauacuuacuaagcacguguuguaugacagcuccuaugcacuguguuaaaugcuucaggaaacaucaaagacaugacuucugcccucacagaagcuauggucuagagggaaaucaaggcaaugaauaaauaauccuugaauaaaaauaugacaacacauuaugauauaauagguagugggauuuuauugcauauuauguaggaauaugaaagaaaaaggaggagauaagagagaagaagggaccuuauuuagauuaacaggugacauuuaagcugagacuugaggauugacuaagaacucucaggugaugauuggaggaaaagcauucaggggagagggaauagcauauguggagguguuggggcaggaaagaguuugacaugcaucgggaacugaaagaagguccauguggcugguguggaguggggcaggggagugggaagggaguuaauuggagaacaggcaggggcagguuaugcagagcauggacaugauaaggaauuggaaucuaauuaugaguaaugaguagccauguaaagguuaaagaaggagugcaacaugaucuaacuuauguucaugaaagaucacaagcugcugaguggagaaugaauuugaagaaagcaauaguggaaacgagaaggcuaguuaggaggauuuuucaugauccagaagaaaggugauuguguuuugcaaugugguggcuauugugauugggauguuuuucuucuauugcauuuuacaacuaggcacugcuagugugugguagcacuguuagguuuauuuauuuuuauuuuaauuuuauuuuuuuugagauggcauuuugcucuugucguccaggcuggagugcaguggcaugaucucggcucacugcaaccucugccucccggguucacgccauucuccugcuucagccucucaaguaccugggauuacaggcacccgccaccacgccuggcuaguuuuuuguguuuucaguagagaugggguguugccauguuagccaggcuggucucaagcuccugaccucaggugaucagcccgccucggccucccaaagugcugggauuacaggcgugagcuaccacacccggccucuacuguuagguuuuguauguuuuguauguugauuuuguauucaguaacguugcugcugaauuaggucucucuuauuagucucauagguuaucugaaaaucaugaugggcuuccuauauagucaguuauuuuucugugaaugaagauauuucuuuuaaaucuguauuuucauuuauuuuucuuguaauauugcauugaauaggacuucuguucacuguucaguaguauugacuuuaguggcuauguuuuucaagaugauguuugcuacaaauuuugauggauaccauuugucagguuaaggaaauuccuuucuauuccuaguuggauaagcaucuuauuuuuauuuuuuaaaauagaaaauaugagugaaauuuuauugaauguuuucucagaaucuauuuagaugaucauagauuuuucuccuuccauguguaacauggugaauuauaugaaugaauggauuuuccauucuuucauuccugggauaaacccugcuugaucccauugucaguuuggauuaaauuuggcugugagucacagggccucaguagugucuuaaacaaguguauuuuucucucacuuaaaaaaaaaaagccagcuuagauguagggagugcagugucagaacuccaggcuccuucuauuuuguacaucacuucaugucuagggaccuuaaguucaagcucccccagucaugucugcauucugagcagugagaaggaguaaagaggaagagggaugcaguccauccuuuuuaaaaagacuuccugcaaguuacacacaaccaguuucaucacauuggcuaaaaucucaucacaugguggcaccuagcugcaagggaggcugugggguauagucuuuuagcugggaagcaauguggaggguguaaacuacauagcuaagaaucaggguucucaugacuaaagacaaagaauagcuauguggagcucuagggguuuuuguuacaguuuugcuauauuauuuuuauauacaguauuagauuuuugaacaguugcuacuuuaaaauuuuaaaucauuuagauuuaugaauguaucauaagugauauaucauaauaauuguaagccuacaauuuuuuacugcuuuucaauucagguauuagagcuaagauaggcuccuaaaaugaauuugguagguuucucuguguuuuuguucuuuggaacaauuuguguaagacaagacuuaucuauucuuuagguuugguaaagguugccuauaaaauuaucuaugccugaugccuuuuggggauaggagagacuuuuaaaacuacagcuucaguuucuuuagugauuauugaccuauucugguuuuauuuuuuuucuugaaucauuuuggugauuuauauuuuauuuaaaaaagaaacauaagaauugacaguuuucaaaguuuuuggcacaaauauucuuucucauaguauuaaaauguuaucaauauuuauugcaucucuauauugauaucucccuuugcauuucuucuucuuuuuuuuuuugagacagagucucacucuggagugcaguggugugaucuuggcucacugcaacuuccaccucccgaguagcugggauuacaggcaucugccaccaugcccggcuaauuuuuguauuuuuaguagagacggguuuucaccauguugacuaggcuggucucgaacuucugaccucaggugauccgcccgccucagccucccaaaguccugggauuacaggcgugagccacugugcuuggcucccuuuuuauuuccaauaccauguauuuaugucuuaccucucuuucuugagucagccuugccugagguuuguauauuuuauaauuaaacauauuuuuaggcuagaccuaguaacucauaccuauagucccaguacuuugggaggcugaggugggauugcuugagaucaggaguucaagaugagccugggcaacguagugagaccugaucucuacaaaaaaugcaaaaauuagcugggcaugguggcaugcaucuguaguuccagcuccuggggaagcugaggcagguggauaacuugaacccauggguuugagggugcagugaucucugaucacaccacuguacuucagccugucucugagacucugagaccuugugucaaagaaagaaaagggggggaaagaaaaaaauacauauguugaaacuuacauuuuauucgucuuugaaaaaaacuaguuuuuuguuuuggugagcaaucuuuaauauuuccuuccuucuacuuuugguuauuuucuuuugucugcuguguuugucuuucuuuaugccucuugaauucaucccuaacuuucaauauuuuuuauuuuuuaacaugugcuguuagggcuauaauuucccuuauaacuauauccuuuuauggcuauaucucauaaguuuugggaagcgguauuuuuauuguacauauugaauauguaacuuucaucuuucaucacuuuugucguaauuuccuuuuuaaccuaugaauuuuuagaauaauuuuuuuuuuuaguuuucaaaugaauuuuuuugacaagggacagccuuuucauuauugauuucuaaauuugcuacauuguggucauauuauguaccuauuauauuuauugcuuagaauuuguugagaccuccuucaucauauguauauauaucauguaucagggguccccaaaccccaggccagggacugguauuuguccauggccugucgggaaccaggcggcacagcaggaggugcgcagcaggugagugagcauuacugccugagcuccgccugcugucagaucugcgguagcauucgauucucauuggagccugaacccuauugugaacugcgugcauauguaagggaucuagguugugugcuccuuaugagaaucuaauguuugauaaucugucucccguuacccucagaugggaccgucuaguugcaggaaaacaagcucagggcucccacugauucuacauuaugaugaguugaauaauuauuuuauuauauauuacaauguaauaauaauaguagaaauaaaaugcccaauaaauguaaugugcuugaaucaucccaaaaccauccccuacuaugcccccccgcagcuucuggaauuuuuuuuuuucuuuuuuuuuuuugaggcagagucucgcucucgccccggguggagugcaguggcgcgaucucggcucacugcaagcuccgccuccuagguucacgccauucuccugccucagccucccaaguagcugggacuacaggugccugcuaccaugcccggcuaauuuuuuuuguauuuuuaguagagacgggauuucaccauguuagccaggauggucuccaucuucugaccucgugauccgcccgccucggccucccaaagugcugggauuacaggcgugagccacugcgcccacccagcuucuggaaaaauugucuuccacaaaacuagucccuggugccaaaaagguuggggacggcugucauauauggucaaauuuauaaauuauauuuuucaaauguuuaucuuuuuuuuguacauuugaucuaucaguucugagagguguguuaaaaaugucucaccaugauuguggauaugucauuuucccugguaacuuuguugauuuuuacuucaguuugagagugugcuguuuauaagcauucaagcuuaugauuguuguaucuucuugguggcuuggcucuuuuaauauuaaauaggcugcuuuucauccuuacuaauggcuuuugccuugaagucuuuuuuaccugauuuuuauugcuauggcugcuugcuuuugguuaauuuuccaauacaucuuuuuccauccuuuuauuuucaaccuuccuauauccuuauguuuuagauguguugcuuauuuuuuuauuuuuauuuuuauuuuuuugagaugagucuugcucugucacccaggcuggagugcauuggcgugaucucagcucacugcaaccucgcuuccuggguucuaguaauucuucugccucagcuaccuggguagcuggguuuacaggcaugugccaccacaccuggcuaauuuuuuuguauuuuuaggagagacaggguuucgccauguuggccaggcuggucgcgaacuccugaccuuaggugauccacccggcucagccucccaaaguguugggauuacaggagugagccacggugccuggccuauauguguugcuuauaagcgauuuauagcuagaguuuagacauauuuaauccauguauauauuuuucauuacugacuugaguuuauuucuaucaucuguuuaaaaauuuucuaguugacaugcuuuuucuuugcuuucucccuuucuuuuuaucuuauguugaacugaucaacaguaaauagaguuuacuuucucuucuucacuccacugguuuggaaguuuacauuuuaguagugauuucccuuaaacauuugacagauauacuuaauuucauauuuuccuaauaacgucuaacauuagucaguacuucuguccuucuuaggcacaaaacaagaaucuuggaacacuuuaauuuccuucuuaaguuucuccucccaucuuccauguuauguuuaucuaguaguuugauuauaccucuuaaaaagucucugugaaaucagcugcuguuguaucuuuuaugcuuuaacaguuuagauuuacauacguguuuccguaauuuguguguucacuauuguuuuuuacugcccucuucuuucuccugguucaguuuccuucaugcugaagcacugcuugaaguuuuaaaguuaauaucucccuuugaggcuugagguuucuuguguuucacagguaauacucauuugaaccccacaccuccacacaaggaagccuucauguuccgauuucccagcauccuccuuccaggccacauuccugcaucccuggcaugagcguuuugaguccaaguuugcaaaugaaacagaccuucuuggcugccgacuuugcgcacagggucucuuuccagcuccccuugcugcgcagguuuggggucucuccucucauccucccucagcguuuucauccagccucuagcauaugucuggucugaucucccugugguucacuuggcuuagacccccucucacuauauguucuuugaauuuccuuccuguuucugauaccuggacauuucucauuccuauuuucaaacccagcauuguagcaaaaacaccuuuuugauuuuuaaaaacccagcauuucuaugcguuuagggugugagugggagcuuccuaaguuaauucagucuacucuauugaucaguggucuggguaaggcugauagcaguggauacagagagaagugggccaauuugagcagcauuuuggagugaaagucagggaagggcagggacaggcagagaacguggccuuccuugcucuuguguaagugcuuggugaggucuugauguggcgggcugaggagaggacaugguguugaauaagcaucgaaagaaccaaacugccugggacaggugaucacacugggaauucagagggagugacagguggggagaggggaaaucuggcccaucucuuuggccaggcucccuggccugucugcugcaggcguccuuagucauacaccugcacaguccuuucugucccuuaugucccuggcacuuuaagucugacuccucacacaccaugccccaacuggugcauaaaagcgagccaugaauuccagcagccucgccuggccagcauucaggccuggcccgccacacacagcccagccccauuuucuuugacucucuuguccuuacugcugucucgcucaucccaguaucuguuucucucucuguaauuugguuuuaaaaauugcugagcaggaaaggucucuucucuucugccuuucaggguguucccugcucaccucuugggugaggauuuuggacuuauugucccuucugucugggaauugucugugaguccuuccaguugcccagugucagugaugacuuggcuuagaauauaaggggagggggcuggcaccccuucaguucuaucuccacugcacacccccacccccccgccaagauucaucuguccacagauauuuauuggaucuguauuauuugccaaacacugugcugggcacugaggaugcaaaggugagcagaaccagagacagcuccugcccaugcaaagcuuaccacgaaguuaaucuaagaaucucauuaaugauguagccgcugugccggcugccacaaaggagcggcaugugagccaugacaguguagacuauggggcuuugagucugccagaggggucaggcauggcuucccugggaagugacauuuggguggagauccgaaggaugaacaaaaauuaacugagugaaaaaugggagauaagguuccaggcagaaggaauagcauaugcuaaggccuuguggugagagagaacauacuuaaucaguuaccagccgugucucaacauguccuuauggcaccuguuucccuagacccagcacacucugggccaugauaaaaggaugcaucagaugucuugcugaauauuagcaaggggcccucugaagucauagaaaaugggauuuuugccuccaacucuuucuaaccauagggaucugccuguaucuuccaccucuaauuccucccagacagaccuuaucuuaaauuguaaauuuagcaaaaacaaaaccaacaacaucaacagcaaaacccaccaaaauaaagaaacaaaaaccaccaggaugcccaguuaaauuugaugaucagauaaauaaugaaugcauuuuaguaugucacaugcaauauuugggacauacucauaguaaaaacaucuguuauuuaucugaaauucaaauucaacugggaguccuauauuuuaucugacaacccuacucauaccugcuugugcccacgaagggccaccuggagaacucuguggaggaagaccugccuacccuuuccuuaacauuauggucauuucuagcuuugggaguuugggaaggguaugugcugaaagaauggccccuugaggccugggaaagaagcuuccauacccauuaaguuauauuccaagaacaguccugcaaaagcaauaagaagcugacugcccaaagcccugggcacagaugcuaccuccauuccugagccugcaaauuuaggacgguuucugacugacccucaugacuccuccugaaucucccacccuagccccaccuuggcaucccugucacagcccccaggcuggagugguggguucagugaccccugcuugauuauauguuuaggcucuuagaugccuucacacaggagcuucuauagaagcuaguuugaaggcuaugccuaguugaaaugacaccguccuucccccucccugcccacucccccucccacccuuccugccugcugccaaauacuccuggcaaaaccucuugacaacuucuggauauagagcuuuccuuggauacugugucucuugggauaauccagcuucuacccagaggcuuuuauguuaucccccagagaaucacaguagaaacucucccugaaguagaaucgcaguggaaacucucccugaaguaaccaugauaacaacuugcauuaucaucaggaauguaaucauugucaccuuggagcacucaaagggaggaggcuucugcagccacauuuaaaggcuugggagaaaauauugugaaugcauuguuacgcauuaaugacaauucacagcugaagccaguuuuuauccugugcugacagcuguugguggagaccacagcaaauacugccaaauccaaaacuaaauagcgacauaagcccuuaacuucacuauucuaaaaauucaucuguuauaguuaggaguggguuugacugugaguuauagaaaaccccccaaacaacagugauuuaaauaugauagaaguuuauuucucucuuacuuagaggaaauccagggagaguuaguugaggucugguagaugccccacagugucaggaccuggagccuucuaucuuuuccucaucccccaccccacuuagcacuucccuuuggucucauguuccagaauggcugcuugagguccagccaucaugucugcauucuggugaucgggaaggaggaagagacaaggaagggcauacccccuccuuuuaaggacacuuucuggaaguugcacaugccacuucuacuuuuaucucaugggcuagaacuuaggcacauggcuacauuuaguugguagggagauugggaaagaaucuuuauucaaaguagccauguguccagcauaaaauggugggguucuguuacuaagggggaaauggagaguggaucuuggaagacaguuaguggucucuaccauccuuccuuccaaccaaccaaccaaccaaccaaccaaccaaccaaccagugugaugaacugcccuauuuagugaggagacacuuaugcaaauaaccagccaugauacaaugugauauggaguauaaaagaguuuuguucaaagcgcugugggagaacagauggaaaugaucaacagcaaucauaauaauuaauaacuacaaugcccuagccggguucucagugcuacauuccgaugauuguguuuguccagcucccucucuuuucagugagagcugcaaaccauucuacuucucuagaauagcuaacacaaugggcaggcagggugcuguucugaguucuuuauggauauuaucucacaacaaucuuaugaacugcuacuauuaucauucucauuuacagaugggaaaaugaggcacaagccaccgagcuggguuuuggacccgggcaaggcuccagagcacacgggccuaaccgcucuguuccgcugcccccacccaaagcugcucauuuucauuccuuccccuacuccccagacaucuccagcagauaaccaccccccaucgcccacuucauugugaugauuggggucaacuggugggacuucuguccacuuccaagccaaaccccagcuuacuuagauaucuucccuugucucuuccaccagcccugccuucaucuuaggagucaaccccacuaagccucgguuuucugaucuacaaguagggcugacacuaacauccauagagugggacuguuugugaggauugagcauguuuauucauggaaagugcuucuccuggcacauacuaagugcuuagaagauguuauucuuuuuuauccauccuuauaucugguuccuccucucuucucucucuucauuucauuucucuuuacagguuguguuaauguuguauuccugcugaaacauuaucacaaauucagugauggaaaacaauacauauuuauuaucuggggucagagucucaaugggguuucaaacugggcucugggaggcucugggaagaauccauuugucaccuuuucccaguuuauagaggcuaucugcauuccuucacuugcagcuugcuucuaucuucagagccagcagugguggguugagucccuagguugcauuauuccaaccuugauucugucauuccauuuucuucucugacucuucuuccucccucuuucauuuauaaaaugugauuacaccaggauaauccaggagagucuccucuucuuaguauccuuaacuuaaucgcaucugcaaauuccuuuuugccguggaagguaacauauuccuggguucuggggaugaggauguggauuccuuugguggcuauuauucugccuacaccacagguucuuuccucuugggauacagcaagcaagaagcacccaaaacaaaauaucccucuuuaacaguacauucucuucugucuuccucccuucucagccaggcuuucugaggguugccuugacuaguuuucuccaccuccugacaaccugcugcagucugcaucugcccccacauuccaccaaacccacucuugcuuggaucacccguggcuuccagauugcaaaauccgugggcaccuuucauucuuaaccggcugcguuuuccauguuagcugcccauuccuucaugagaccuuucuguccccucucugcuuuuaugucacuuucuggugguuuucucccccuuccuuucuggcuuagucuccucuaugagcugcaccgucuccacccaccccugaaauguccguguucucccgggguuuggaucuuggauccguuguucuuuucuugggugagcuugucccacacugcugguuuuaaaugccacuugcacagggauaagcgccuccugcuugugcuguacacaucucuggcugcuggccaggagcguuggugaggacugugcuucuggucaucccaucagcuccucgacuuccuuggucuccuuugaggcagacaugugagagagcucacugaggcaguggcuugagaagcaugcagccuggggcacuugguccuucuguucccggcaguauggcuguuuccaucgcgauggaaugggauccucucaagacaucucagaggacaggcggaaggcagcgaacauggcagugccgaaggacacagcuguguuuagcaggggcgacaggaaagcacgcagguguggcagaucaucaggcacguauuuauuggagcaacccccuccuuuaccuuugugguuugcaacagcuguagcucugaaggagccacaagcuaacuagagcacaaaggcacaaaaacauucaaaguaagucaagaugcauccuaacagugcagcuagacauucaagacucucaccagaaagagaacaaucugccugaacggcagggcugccucugaagccaggagggcugcugagggaggugugguacucaggaguggucuugugggcaguggagggugaaacagguaaaacaggacuuaaggagggaauggacaaggagccaggaggaggaaggccauuucaggcagaggaguagcgugugcaaaggcuuggagucaggaucgcuuauagucgauucaaggaacaaggagaaugugggggagaugagguugaagaggaggacuguguccaggacaucagggccucagauaaugcugguacaggaagucugaacuuugucuuguugguaguagggggcuguggaaggguuuugagcaggggaaugacuuggcagagcucagcuuuaggaagacuauuccagucuuggguggacuggggagggccccagaucuuaaaauaugcaaaauauaauuuuagagagaggaacuaccuuggcaauuacuuaucuauuucuauaauuguauauauguguguauuuuuagauguauauguguguauauuuauaucuaauacauauauuuuaaauacauacacacauacacauuggaugaccuagauggagggugagugacaaaggcacacagugagaaagccagcauuagaacucagagcuaacuccuggccccgugcucuuccucugcaggguacugauggaggcagagguaucugaaaggaggccagucuaaucaucagggcagauggugaugcaaaccuugaccagggcaggacagggcagacacugaggggaagacugugugggaggcaaugaggauauguucucucuccuucucccucucuggguggggguugggacauagggcucguuggagacugcacaugagugcaucucuccuuccuggguccugcagcauccuucugggccugguuucuauggcaacaggcucccagcaggcagccugccagcuggagagaaguaggcaggcaggcagggagagaaggccugggcagcaagagaaaggcugaaguugcggggguugggagagucucuuggggagguggagggacccuagagcugggcccacaaucccuucugaccauguagggguggagguagcucaggacacacaggcuuuucuuuugugguccuugaauuuccaaaccuugaucuucuguuuaucccccaccucccacaucuccugacucccacuucuuaaaguauugccuggucccaaccucaugcaucuuaagcggccacugacuucuuuauagaaaagaacucugaauucagggaaaaaaugaaaacggccaguugacuuuuugguuugcauaagauuugcauauuauuaacucaaagacaagaaauuuccaggcccuaugucauuccugcaaacaacuuaauucagcuccacuggcacugacuuacugugucuggccaggcucugggcugagccaucggggucccuagagaaguccucccagcugcaggcccacuccaccuccagcugcuccaaggcauuucuuccugugauguucuagcagcuggugcagugggaagugcuuggacuguggagcccagcagcgcugaguccaaauccuggcucugcuacuuugaagcuggguuuacuuaguuuacucaucucuagguagagcugaggacacucuagugcagcugguguaaacuagcauagacauagaauuuguuaaaauauugaaauacuucggccaggcgugguggcucacaccuguaaucccagcacguugggaggccaaggcggguggauaaccugaggucgggaguucgagaccagccugaccaacauggagaaacccugucucuuccaaaaagagacaaaaggcgcaugccuguaaucccaguuacucgggaggcugaagcaggagaaucgcuugaacccgggaggcggagguugcggugagccgagaucgcgccauugcacuccagccugggcaacaagagcaaaacuccaucuccaaaaaaaaaaaaaaaaaaaaaaaaauugaaauaucuucugccuucacugguaaagagccaccacccuggcuccucccugaccccucuagcccaccccacaaucuagccucuccagggcacugcugcagcauuuuggucugugccugcucugccugguauaugccagcaucugcucuguccauggacugaacugguugcuaaauagcuuggauaucaccccuaucuagaggcagugcaauagguagguauauuauguacguagcuguugcaaggaccaauauauuuaaagugcauagguuaauguccaucacuuuguagguucccuuucucauucccuuccuuuuuuuugcuuggggugggggugagagcuggcaugagccugggcaaugggggaugacagccaccccucuccccaggcgagcaagguucaagcgcuccaauagugugacggcuggcgugcaggcagaccuggagcuggagggccuggcaggccuggccacgguggccacagaagacaaggcccugcaguuuggacgcuccuuccagaggcacgccucugagccccagccugggccccgggcccccaccuacucagucuuccgcacgguccacacgcagggccagugggccuaccgcgagggcuacccacugccguacgagccgccggccaccgaugggucgcccggcccugcccccgcccccacccccggcccuggggccggccgccgugacuccuggauagagcgcgguucacguagccuccccgacucaggccgcgcaucccccugcccacgcgacggcgagugguucaucaagaugcugcgggcagagguggagaagcuggagcacuggugccagcagauggagcgugaggcggaggacuaugagcuacccgaggagagugagucacggcaucggaacaaggggacucuggggaccauggccucgugugugcucaggagacccugauggggguggcuggggcugcaguguaacaggaggccccuucgguuggugccucacuggucuucugcacuggagcguggcgggucaacaucggcagcaagacaugcugggagcucuugaaagggagcagggugcacauggugcagcuuuagaggccagggcugggacugcagacacugcaggccaaagggcugggccuucuauggauggcugcuaguccaaaucaccaaguuuauggggacuaagggaacuccguucagaucuggacugguguggggauccagguggugcgaccaagauuacagagagggaggcaguucacaaugucagauccugucugaggcacagaagagggagauucagccagggagauguggcccuggcccgagggagagcauggcccuuccuguaagucagauccacugggagacacagucuuaccccagaaucucugaguugaggggacaguggcuaugaagauguguuauguacaugaaauuacuuggucauucuuaaagagccaaggagucuugcaugcacuggggagugaugaacaaagcuuagccaguggguggucauugagcuaaugcccuggccaaggcuauagggcuaggcuggggcugguuuccgucuguucucugauacgggagggagaaaggauaaagaaggaugagcacucaagaaauguaggcuguaugaaggagggaacaucagugucugaggauacagucuugguguaguggagcgagaacuuguuaggaacuugaggaugggauggggcuggggcuggaggagacugauggauacacagugccaagcaaccgaggggucagcgucauucagggcagacuucguggaggcuggggaaggagaugcaucauuucccucccugaauuuccuucugcuuucuaguccuggagaagauccgcagugcugugggcagcacacaacuucuccugucccagaagguucagcaguucuuccggcugugucagcaaagcauggugagugcccauaguaguagauccuaccagauacaugugacccagagugugugugugcuggaggugagacaggcaggugacccagagugaguguguaccagaggugagaccaggccugcaugccuucugggguagcugugagucuugugccuggagguaggaccagguguuugugcacaagaaggggaguccugggcucgcucuugucccccugucucccagcccccacccacucucccaggcugagcuuccuggcaguaaggguggauaggacuuucucuuguccuggcuggggcucagaccuccuugaccaaucacuuucccuccaucuuccucuguugcaggaucccacugcguucccugugcccaccuuccaggaccuggcggguuucugggaccuccuacagcucuccaucgaggaugugacccucaaguuccuggagcuacagcaacucaaggccaacagcuggaaacuccuggagccuaagguggggcuggggugccuucaggcaaagaggccagacucugggaaauuccccuccccagagagguggagggugggacgaacaagggggcaggggaagggauccaugggcagcaagggcagccuuggacaggugauaggugaccauccccuuccagagugaccacgcucguggccacugccgucugcuuggccccagugcucaucacugcuugagcugccagaaccccaaggcuuccucagcgcgggggagcgggguuggggggguggcggcggcugcagcuggagagagcaaaaguagaccuuacggaaggacagacuguccucaguucgggccuaggcaucgacggcagagccuugaggguccccucagccgccaggucccuggaccuugucugcgaugagggccagaggccugguaugugcacccucauugcggagccugggucgggaacucccuccuucgggucgggacccggagugaaaaaccggcucugcugcgagcuguugagaacggcgccaccagggggcgcucgaacgcgccgcgcuuugguggaaaauguggggauuugaccuugucggaacaggagcaccuggggcuucaggucacgggauccguggcggauucugagcgccaucgcguucggagccacgcggucgucagcacucugggcgcgggggugcgggggcggacaccuggguguugggaugguucggcgccccagcucagcgacgcccucugccccgcaggaggagaagaaggucccuccgccgauaccaaagaagccccugcggggccggggcgugccggugaaggagcgcucccuggacuccguggaccggcagcggcaggaagcgcgcaagcggcuccuggcggccaagcgcgccgcuuccuuccgccacagcucggccaccgagagcgccgacagcaucgagaucuacauccccgaggcccagaccaggcugugaccgguccggcccgcccagcccggcccgggcccgcgguucuccacccguacuguacacccagcgucgaggucacugugaacgcgggccgccccgugcgcccgccccaccggcaccggacgccccggcccccgggcccgucacacucucguggguuuuuuaccuuccugaucccacgcgaaggcgcccgggcugggcagggggccgugccucuccgcccugcgccccucaccuggauccccugcccaccugguccgacgcuuuguccccaccuccuccccaugggcaccaucucugccauucuuucccccacgggccaggccgggccgggucccucaucugggcucugcgucccccccucccccaccccgcggggcugggcuucguggggaucaagcuucguggcuuuuuaugaagaaucccgaacccugccuaggagcccgccccacccucccaggggcuccauccucagcccucugcccacugggcccagggaccacaguggcuggaccaacccaggaccagggcgccugggccucuccccuuucccagcggcuggggaggggagaugggggcuuccccucaccacaccuguggcuguucccacauccccuugaauaucccaggaaaaauaaaacggcagaacugcacucgagcca

SEQ ID NO: 14129 - RNA, 7984 nt, Homo sapiens
ggaagcgucugcccuguuagucaucagagcagguggcgcucucccagacuuccaagucccaaaccuucaaguucuggguuauugguucaguccacuggcuccgggugggucuguacuaagcucuuugaaguaauaauaauaaaauaaugcccucauauuaguucagggcuuuugaaaaugcugcccucugaacucuucuuauuuccccaacagccuugggaagcaggcaggacagguaucacguuaagccauaugcaacugcaauauucaacuguuuuuauuuaaccuacaaaaacagcaauuucauaugguucaaccaaauauaaugccgauuuacagaugaagauguugaggcuugagaaaugaauugcauuuuccacaaccacacacugcuaguuagugguacagaaagaccucagcccaggucuuucagugacccaaagaacugggcugggccaagguuagagagugguacuuccuggugugcucucucugacccugggggcacugcccucuaccacugcgcagcauucccugaaugcuggggcuacuucugcacccagcugccaaugccuaaaagagugggggguggggggagaagagaggagggaggggagggagaggcuucgugaguuggcagugaaucagggucuaaaaagggagcugggagggcuaggguggcagguguuucuaaaaggaacaugaacauaggaugaacggccucacauacagcccccgcaucucccacccgccacugccccacugaucuggcaggcagggcccgcugaguuuugugccagggggcucacauccaacgagugagcuuguauguagcuguagaaugauggccaggagaggaaccuuaguauugacuugguccaaccucuucauuacaaaccggggacucugaagccccaagaagggaggggacuugcccaaggucacacaacgaauuugugaguuccuaggcuaaucuuagacgaggaacuuugcaauccuccauguugccuucuauuccugaacucuccccacccccaucagagcugaguacaggggauuuuuggaaaagaaaugaagacucaaaaagccuaaggcuguacaucuuucagcuugggacuccuugccaaagagagggcgcuacagaugucgcuggggauagggauuccuagccacacccaccaccgagguaggccaugggcuugucuugucuugauuccugcuggugaggggcuggagcugcuacaggccagacucccagacuuucucauguuaguaccugcuuucagcggcugccugacaccuaacaucaucucuuccagcugauguuggggcucgagcuggcuaagcuuguuuuccuucauccuccccaguuuccagugcauuuugccucuagcuggauagaccauuccuuaccuuauuggguuccuaaugaauagagaaacuucuggggcuugucugauuuaggaagggucuguaguuacccccaaacccuuucuaaugaaaucuuccaggagucuaggacaaaugauaaagggauuacccccauuuuacagguggggagacugaaauucagcaaggggccccguauuugguuguuuuuuaguuuuuugggggugaggugaugaagggagcaaaugaugacaaaaacuuuugccuagaggagcuuccaaagaccccuucuggucuuaccauccccacggucaggaaaccuucccagauucugauuucauucccacuugguagagucaaagcuuugucacucaguggggguuggaagaacagcugcguacccuccacuaugcaagcauuaugucuugauuuccucuuuauccacccugccccuccccagucugaaggcugcuggcucagcgggccuccugccgucuggggagucuggguuugagcuggggugaggcaguggcaccaucguuaugguaacgaggugccagcucaucauugcuaauaacuugucaggccccugggcuccaugcagcaucucuuccuaccagcccuucuucccaugucacagacagaaaaaguaaggcuuugauggaggggucugggaauaagggagucuggagaaguggguggccuugucccuggggcuguagcuggagagcugcggggaggcugcuuggaagcugguuuacacauaugguuacauaggcuugcauaugauugcgugggcuguuaacaugugaaaacacucagaacaugcuuguauaaacuuauacaggcuagcugacauguucauguguuuuuacacagcagcccacaggcaaacaugcuuccaagcaucagaacaugcuugugccugaauacugucucuaccaucugcacauaaggcacccaagaaaucuggguuuguggggguguccagguauguggguggggaucugaucuuuuucugaugcagcuucaaagugucuuguuaacaaagggacagaauggucccaggguuccuucuucuuccuuccaguuaagagcucagaguggaagugggcuggggauggugucgggggcccaagcucccagcucccaaaggccccugcuucuaugcccuuugagcucagguagccccugccccccucacugucuguucuuucucauccucuccucuuccuguguguaaauauuaaagagcugagccugcagggcugauguagacauggggagagaaugaaauuaaaaaggauucccucgcccccaucucgacacccccgccccgcagucccucgcuccugcuucuuccccucuccccucuccccuccccucacucagugcuuccacaugucucuccuccccccaguccagaugggagcuggcuccuucagaaagggggcucagaacaggguguggggagcuaccucucucugccuccccccaccacaucugucugcagggcugggagcccccacgugaguauuucuuuuauuuuugggguggugguuaagaaggaaagugguuuuuagaaccagcugugaguggcauugagaggcucugggcugaaggaaggugggugggguccucucucaagguucccucagggaagccccaugucuggguuucuuuucucucuugggacauagagggaaggugggggggggguugucaggugcccccgguggaugggagcgacagugggaggggcaggggagaggggcuucuguucuaaaggggguguguggugggguaaaccuguuccuuccuggcauccuggguuucuggcuaccggggccggcaaugucgcugggaacugucccgggugcugagugggauucggcggggauuugcuccuucggagcugucccgagugcugaaugaggcuucguucggucccgaugguggaaaggcggagggcaguggggagggcucacuagaaaaauucucccagaugacccacuuuccaagggcauggauggaaauauggauuuggaguucucccuaugguuuagguuucacaguuguuagugguauuuaggaacccuucccccaaggggccccucuccccuuuugcuguuucaguucccucucucccuuccaaaaccauuguacuguuauuaucgggguagaguuggagaaugauauugugccugugagaucucaucuccugggaacuuuuuuuuagcgcaacaagcucagagauauugauaccagccuuucaccuacugggucccagaauuucaggcucaaggugguucuggauuaagagaacgccggucuuccugguuagguguggggugguuacagcucaggaguucaggauaacuugacugacaacuugauauucccuugcccaucauacuuugggauuugggacagggacacugaaauauucugcaagccuguccuguguucugcccacugccaaaccuagcucagagcagcauuugggagagacuuuuguuggggaggaagauuuuuaagcaaaggauucaaggagugggugggguuguucagugccauggagaagagaagggggaggcuacuggagacagggcagugggaaaagaggaagaucugggggaguaaaaaauauucaaauggagggaugaggucuggguuucagucuuuaguucucuuggauaucuuucuccuuauggcuuagagucagggucauuucaaguaucuguauucuuaugcacugucuuuguaaccaugaagggaauagagcaaggaguuucuuaaggucccuucccuugucaucccagggggaugagagccaaaugucaggacaugcagaugagucuguaggggaacaacaggcaggaagggaugaugguggcuucacuucccauccccaagagcacaaucaaauauucaaaugggauccucccugugaggggaggaaggagacaguuuccagauaauacugggcaaaaauuggguguggcagggaguucaagaaaagggagagguaucuagggaucucaaacugaaccaguugaucccuucccacaugugacuuguaguucauaaggagccccucacccaucauguuuuugauguaacucaucaagaugauuccugccuucucuagcugcuugggaggagcugaguuuuccucugcugugggugcugggagguggugggugugggugugggugccuguuuggggaggggagguguuugugcuccacucagcucccuugguuacauaacagcuuugauaagacuuuacuuuggaucugcugcuacugccugaagcagucaccccuccacccccacaugaaaugcuagauguccacccccuuuucccuggccccuuagagaguccugcucuuccugauccacuguuccagcagcugcuuccuugccaggaggugucugcagcuugccucccugcucccuucccagcuucugcuuucaaaauacuugcuucuuuuguuauuugagcccaggucaccaccuuuacauuuuuaagccuccuggucuacccucucccuuguagggcccacaggcugggaagggagggauucacugaucaugaagcuccccucuagggaagaaaagggguguuuucuaggagguuuuagcacccacaguuaauuuccuuacuauuucuuccucugccccaguaacuuuuggaguuugagaguguuagaccuuuacccagaggugcugggaggaaggauuuuggccuugauauuuucucuuucuuuucuuucguucuuucuuuuuuagaguuaagggguugcauauacggggggauugucuccuggguuugaagagguacaccuacuuuauuguuacuccuacccagguugucugaggaaauacucguuucucuaggcaugggaugaggacaugacagggcccuuuuaaaaaaaaaaaugacgauuuuuucccacugagagugggugggaaugggauguguccaggaguggguauaucucauugauaacaggaacaacuuuccaaauagagaagugggagacuagcaagaggagagagcaaaugcaaacuugugauguacuuggagagaauaugaaggauagaagccaggggaggggcuggauaucucugcaagaucugggacuccaguacacaugcaugcguauuucugccugugagugaguauaugacuguguauauguacauaaguauaugugaguaugcuguguauauguguauaagcacaucuauuuguauaaguguggauguguguauauauauaugacucuauguaugcauucauguauauaugugaaugugaaggaaauuacugaauuaaaccaaugugugcaugucuguguguguguguguggugugcuuauccaguaaugccuuugugugaguguaagcaugcaugugagcauguauguggggcaugcauauacguaccguaucaaccacauaugaauauauguacacaaguugaggcaaaccugugaauaaauguaagaaagagagagaccgauucugacugaacauugggcuacccaaaagugucuucccaacagcuugagcuugaucacccugcuacuuguagcucuucuccagaaaguaggcucccugaggucucucaaauucuuauguccuugggagccaacuguucuccaucauaugaaagaaguuuguggagggaaaaccuauaaggccuuggggauagccaaguaagaaauccaggcuccaggcuguucagaugcuauggugcucagggcuguauguggggaaagaggaucagggcuuaaacauuggcauugcuacagaaguuucaaaauucaacaaguugguccuaguggaugaaagggguagugaguaagaggggggcccaagugcaugcauaagccucauacauacaagaugugacaauacacguguacagguacaugugcauauuacuugucugugccauaauaggcauauaucaacauaggugcacuuucuaacaugcacauccauuaacaaaucuacaggagugucuauaccaacacggggauuugucagcaugcacauacaugcuaacacguauacuugugaacagaauuuacagaaauaugugggcauaugcuaacacuugucugauuacaaccuauggccauauauaugugcaucucacucaucuggguuaacaauagccugcaaacauacccuuccccaucgcaagugccucacccaaugcauccauucauucaaccagcauguauuuuaugccucuaaucugccacaugcugugcugggcacuagggaugguccuugaccucagauaacuugcaaucuugggagagcaaaggaccuggaaccaaauaaggagaguguuaaggaggguagacacacauaaguguucauuggagggaguggggaccuaaagagagguagguuggcucuggagugaggaagggaaagguuugguaaaggauccauagaaggggaggcuuuugaguugagguuuaaaaguugaacaggugcuuaccaggugagcaacugugggaacagguauuucagugacaggaaauguuccagauggucuucccacuuccacccuugccagccccaccuccguagacucuuucccaaaaagcagccagaggaaaaugaggucuugccuuuccaguggcuuuccaucucacucagagugaaauccaaaguguagugcguccugagcaacgugagugcuacgugugcaaagcccccuauuaccuccuggaucucaggggccacuccuacguggguuucuuuucuguuucauaaaaagcacaguuccuuguggaggcaauugcgcuugcuuuuccccucagccugaaaugcucucuaggcaacucacuuccucacuguauccgagucuuugcucaagucacauuuuuggaaagaccuccccaacagucuaucuugaauagcccauugucauucuaucuccucacuccauuauuauuacuauuauuauuuaucucaguacuugccaccaccauuauuuuauauauuugguaaucaucccucuuuuuccacuagaauauaaacuucaugagcaugggagcuucaucuguuuuguucauugcuguaucuacaguguccagaagaguauucagcuuggaguaggcagucgauacauauuuguugaauaaagaaauuuuagcuagccggcagccagugaggagaaaggaucaaggugaacaagaugcaaggcagggagaccaguuaggaaccuguugucauagcuuuggugagcaauuaggauaagaguggccugauguagaacaccagcagugggaguggagaaaaagagacacaauguacaaacacaugcaugcacaaauguacaugcaugugcuuguacuuuaaucacaucugcuguuuuaguaggggaaggcuaaggaggaaaguaaaagugucuuuauguguaugugugguauguaugucaugaacaccucaugacaggcuggacacccuccagcuaaugccaacugcaguucucccuuccuuuuggaucuugucaccaauaucccauguauguucauuccugccagccaggcugcagagggcu

SEQ ID NO: 14130 - RNA, 4810 nt, Homo sapiens
ccagugggcagggucacagggcaaggucccgcgggccgcugggugcggcgacuuccgugcucccggcgagcgggcggagagcgggggccgcacuggggagugugggcugggccgcaggugagcgcgcggucccggcgagcaggucgggucagcccaggccaguaaccucugaguuacgggaggagugaucgcuaggguccaccccggucccggccagaucugccagcuccccucucuggcggguguucuggugccaagucugggagcccagguagcccuccgcagacagggcuucucggcaccucaaugaggacggacguugaugaggccaugaaugaggugggcuagggacaggggaccgggagacucacagaagggagaaggguagccauuuggauggaccuucgccuuacuugcgcucccauuccuggacugcgcucuagugacugucagggcuaauucuuccgccuucucaggccuccuguguccuuguuaguaguucuugaauuugggacuacggcuucuggccucguugggccuccgggcccucgcacuggggcagguuucccagcagcccaguugaccuuuaccggaugcuuuuggcagacguccuccaugccgggcuggaaauaugcgucacaguguuuuucagacacuuuugccucuuucauugugauacccugccuggggacgacuaugauggagucuuuagguuuuuguaaucagcaaaggcaucuguuaugcuccugccaccuuuugggggagaguggguggaggauguugugauuuuacacuagggaguuugggcugucauucauucguucagcagaccuuuuuugggcacucugccaggcaggguaggagaggugccuggauggauagggcauaauugggccagacagacacgguucuuagccuuuuggagcuuaaagugucuugagaaacgcagacaggguaagccagcaucgugccugacacagaguaagugguuauaagugucgaauaaaggaaugaauugacuuauuugggaaugauuagaaugugagcaggacgguagcgagagacuuuaugcugcaugugagagauaguugugaacucaugcgcgauauguuuuaagacagguuuggaaaucugaacggacaguugcuauuuagggaagcauuuacuuauacagaggacuugcuuuaaagguggaaguaaaauggagaaguauuagguuugggauucuucagaggugccucuuuuaacuauuacuaugucucugaauuucauaaaucccugaguacaaucucagaguuugggaaaaggaaagcucuucuagguaaugaaaugccaggcugaugggaaaaaacuguaggaagcucucccuaaguccaggguuuggacagaaaccguauaccucugcaguguguucuucccacuagaaagaguguaggcuuugaaauuggagaggccuggguucaaaaucaguggcucuaucacuucuagugaucuuggauaaguuaacauaaugucugugagccuuuguggccuucacaagagucugggcuaauaauuccuacaucauagagguguuaugaggaucaaaugaugauuaguguguaaauugucaucauagugccuggugcugagacaauaagcgggggagucuuggagaugcugcaauuuuuuuuuuuuuuuuaaauuucaugaugcugccuuauugcagggguccuuaacccccugggccacagaccagugguggucuucagcccauuagaaacugggcugcacagcaggaggugagcggugggcaagcuggcaagcauuaccgccugagcuccaccuucugauagaucagcagcggcauuagauucucacaggagugcaaacucuauugugaacugcgcaugugagggaucuacguugugugccccuuaugagaaucuaaugccugaugaucugagcuggaacaguuucaucccgaaaccaucccucuccaacccccaucuguggaaaaauugucuuccacgaaacuggucccuggugccaaauauagauuggggaccgcugccuuauaguguuacgucuagagaacauugggauuccuucaaagagaauuggaaccaaagagagagggggagaaucaucuuauccuuggugagguuucgauuguucacuuuagaucagagauaguaguguuggagaaauaccuacaggggcauaaacagaaagaucuuuuaguggauacuuuugggcaagucucuuaacccucugauaguggguuauguaucuaccucacgugguggacaugaggauuaagagagugaguguauaugaagcaccuagcccaaggccuggcauguaagugcucaauaaaugguagcuguguuauuauaacugugaaugaucuuugauaauugauaaugguaauaaucauuugagauggaauuggccauuagagugauccaauuuguguguuuuuacauuacuuugguauugcccuacuucaauucaggaggcccugaggccauuccacuccgcuccccgccccaccccaccccaccccaccccccgggcuuguacagugauuuuucacagaaaaucuucagguucugcgguauccagaguauguauaaugauuugugauauuuucaggagcuuuuuauguaaauaugaagguauggguuugguugaagauaggauuuuuuuuuuuuucuugagacggaguuucguucugccgcccaggcuggagugcaguggcuugaucuuagcucacugcaaccuccgccucccagguucaagugauucuccugccucagccuccugaguaauggggauuacaagccucccaaaguucuggaauuacaggugugagccaccgucuuuagccaagauaggauauuuugaaaaugguuuagucagcagauuuguaaaguauagguuuguuccauuguuagaaaagccagguucagaacaggauaaaaccauuaucuauuuaccuaaaauccagaauaauuagguaaugcauuauguauuugacuguuuaaauaugcuccuuaugcuuuacaugaggaaaaggaacgacuuuucauauugugaaaccaggagauucaucguagauuguguuucauggggaaaagguggccggcugugcucauggagaaauuucauagagcagagaaaggcaucuuuuucccuucuugaaauguuggcagacuagguccuggggucaacaauaggcuugaagcucuauuagguaaggcucagagguccccuuguggggaacauugucauauauuggugcacacuugucaaagaguacgguccguaaaauggagauccuuccuucuucccuaacaauggaaucuuuugaaauuuccuagauuauuucagggauccaccucucgcauugcucugcacgggggugggugcucaguaaauugugccaggcuggccaggugugguggcucacgccuguaauuccagcacuuugggaggcugaggugggugaaucacgaggucaggaguucaagaccagccugaccaacauggugaaacccugucucuacuaaaaaaauacagaaauuagcuguaaucccagcuacuugggaggcugaggcagauaauugcuugaaccugggagguggagggugcggugagcugagaucgugccacugcacuccagccugggcgacagagcaagacuccgucucaaaaaaaaaaaaaaauugugccaggcugccugguaaguggagagcucuaguggguugcucuuauuuggugggagaugaugcuggguucucuaaugcugccuugugcuuuuccgcagaugucauguggccuguguuuuggaccgugguucguaccuaugcuccuuaugucacauucccuguugccuucguggucggggcuguggguuaccaccuggaaugguucaucaggggaaaggacccccagcccguggaggaggaaaagagcaucucagagcgccgggaggaucgcaagcuggaugagcuucuaggcaaggaccacacgcagguggugagccuuaaggacaagcuagaauuugccccgaaagcugugcugaacagaaaccgcccagagaagaauuaauggaggacacagggcccuaugguccuacuguggguggugacuuguccugcuaccauguugacagagccccagaacccacaucuaauuggcuuuguugcuuauucuggcccuucccacaccacacagccacacaaauacuggcugcuccuugauggccaggcagacccagcagcagccgaggggccagugaagaggaaggccgcaucuguugugugguggccacaagcacucaggcaucugaguuuacuggugcacugcugggaggagaguuaugagaugaacauuggcugucaaucucugugggcaggcgguuuggccucuagugggaauggcugggauuugggcguugccuuuaggagggauaccugcaugucuaguuccagucugcacuggaaagaauucaaauaugcaccuggcucccuucacuauuuugcccuauccuuugugcucauucuuacugaaaucugucuugucagcucaggaaugggauucccccaggaaggaaagcacuuuucuguucugggaagcccagacuguucacuuuggggcagggacgaacaugugccucgugaauuugcuugaaaacagucaccaucuucuacccccaucacuguauagugaaaaaccugauuaaagugguaucugagaaccauaaugaucgaaucuuaucauccaggugguauuugggggucuucuuaggaguuaggcaaguaca

SEQ ID NO: 14131 - RNA, 4915 nt, Homo sapiens
ccuguauaaaacacaguauuuauugauuucaaggaaacugucuugaggauguucuaucagcgcauccacccaagucccugggagcagggucugaaaggcuggcaccagccugagcacaguuguggggaggaagaugggagcaccacugccugaggcugagggaguaggauuuggggaaagagggcuuccacugagccaagugaugaccugggggaccucuggguaucuccagaaccucuagucagguucauucucagcccuccagaccugcugcugcuggaagaccuccucuccacugcaggaaucugggcggcuccucuggagggaguagagaugccuuaggucugcugaggcuagcccagggcgagcaucacuuuuuguguggccuccagaccucugugcugcuguugugucugcuugggagcacuucucaccucucuuacacauuauguccucagggaagccucuccugaucaucccuuccuggguugaucccuuccugguugaagcccugcuagcagugcccuaaguggccccuugcaggcagcguagauaguuaauucgcuuguuucaaagucuauguccuuugagggcuggcacugggccuguggguuaccuauacccggcuagacagcccaguucccagugucaaaaaauaucugccaaaacgaaaguugcauaacuuagugaacucagaguggggucacucagccccuguaggaccucuccaccugccacaccgcccugcaugucccauuggcagcccgcauguugccccaccccugcccuguggucagaugggggucagguugggugcugaagccugcagcuuguuauugccugggucuggauccaccuccccagccuccaccagcuugugguggcagcggcagguggaagcucggcuggcggaggacgaggggcugcaacccccucgaggcuuguccuugugcaggccucgcaggacccuguggcagaugagguagcagagcucacagauggugaguacgaugcagacggcggaggcgcccaccaugaaguaggugaagauuuucuucucgguaggucgggcaauguagcaguccacgauguuggggcagggggccacguuggcacacugcaccaggcgcggcauauugaagccaugccagagagugugcagcagguagaggaagaggaacucaaugaugagcuugaagaugaggcugaacagguagguccaccacaggccuccgugcuucuugccugcguugucguacagcuuggcgcacugguccccguguuucuggcggugccggcgcucccgcuccucacgguaggccacgugcaggaugaccagcagcgaggggcaugugacgaagaugagcugcagggcccagaggcggauguuggagauggggaaguaguugucguagcagacguuggugcagccgggcugcuugguguugcagucaaaguccuucugcucauccccccacacgcgcucugcagccaccacguauaccagcacccggaagacgaacaccacggacagccagaugcgcccgaacgcuguggaguacuuguucacaccgcucaguagggccuggagugucuuccaguccauggcgccuggugggggccgugccuaccugagagaauuagaggaaaaaccaucguaugaaugaauaggugacuuuauugagcauuuacuauguaccaggcaguguucugaguucugacuuguucaauacucacaacgacccucugaguucagaacuguuauuccucccaagcugcagauaggaaacugaggcacagcaagguuauauaacuuaaccaaaggcaacagagcuaguaugcuggaaggaagcaaauaugcuuuggcugauaauaacaaucaccauuuauugaguguuuacucagagucaggcaugaaguuaaacacuuuaugagcagaaccucauuuaaucucuuagaaugaccccauaagguaguuauuacagugcuccucacuuacagaugaaacugaucauugaacgauugcaaagcaaguaguacauaguaagugccccauaaaugcuggcuacucauuacugugaaauuuagagaggucaagucacucacuuaaaacaagagguggauucaaggccaggcuguuggguaccagagccugugcucuccaccaccuccucuucccuucuccgcuggacuccugcccuagaccagauucuugaaacguuuacuuuguggaugccucacuacuauacugugaaguugcaguuaugagucccauucuacagcagggaaacugaggcucagagaggagaaauaaccagcucaaggucucacagcugcuggguggugaagaggggagaccaguucagguggggggugcauggagccuuaugaucugacuccugggaggacacuagauccagggaauaucuagagaaaacucccugcucccugugcugggccuggggaagcccagccacccccagccacacuaguugccagggccuugugguggaaagaugugcuuuguucaggccuuaacucacacaucuuccucccaguccuggagugacucagaggguguggacgggugggucugccugagugugccuuguuucugugcugcugugggugugagagcacccgccugccuguccacgugugugugugggccuaugugcaugugagucccccuggagcugacuugcaccucugagcaugcgugaugccugcgaggccaccacccugccccaaaccacuauuauucuggccuguauuauggccucuuuacuggcuuuucaccuucccccugugccccuagaguccauuaaaucaguucaugccacucccuuguuuaagacucuacuagcuucucgcuaggcuuagcaaaaccccagauucgacauuuucacccugccacccuggaauaagggccuugggggcuuuuuacugauuccuucugccuggaaugcucuuccuccagaaccucacauggguggauccuucucaucacagaggccucugcucaaaccucaucucuuuagaggccucuccagauuacccugggucugaaagagccccugcuucugucacucuguuccuguccccuuucuuuuuuuuuuuugagccaaggccuugcugugucgcccaggcuggagugcaguggugcgaccuuggcucacugcaaccucugcuucccaggcucaagggagccuccuaccucagccucccacguagcugggaccacaggugcacaccacuaugcccaccuaauuuuuccagcccccucuguuuucuuuauagcacuuagucacuaucugaaauuaaagaauuuguccuuuuuuuuuggucuuauuaauuaucuggcucccccucuagaaugucaacuuggucuugcucacugcuuuauauuuagugcccagugcuuggcacauaguaggcacucagcgcugaauggguaaacaaaugaaugcugaguuuucagcaaggcagcuuggagggaggggacaggagggugggcaggauccuggucagggggcagccuggucagggggauugggggaaagacuucccuacacuggagagagggagagagcacaguuccuucucagcaccuggcucuccuggcugcguuuccucugggaaucacagucugggcaggauggggugauugggaagaccucauucuuggaaacccuccucuucuccccuacucugcuccuucuaagcccucguggugggggaagggagugggauagcauggaacacggaguuccaccuggauucaaaccucagcuuggccacuuaguagcugggcgacuuccaagaauucccuaaucucauugacccuauuuacuaaucucuaaagggaaauaauuccuacuuucugguagaauccugagacucuucccucccaggcugcuacucaccuggugggaguucacaagaacugaagugaagguuggagcccugucuguccggacagagagcagagagggacccugacggcugcuuccaccugacacacucccauggcugcccaccagggugcagcucccuccugggcccccaucuucuacccuugggugcugucugcccagucccuccugacacaccccagggaggagcuucacuggcaaagaauuuccuucccaagucuaggcuggggacugguggagccgguucugguucccccagcugcccuccaaagccagcucccagcgcaaccguuuuuucccugacccccagacuguacugugcccagcccuaccucccgccccacaaugucccugaaggauaaagcucccuuuccuucccaguuucccuccauccuaggcagcuugggagcuugcggacuuggggagggggugucucggaaccuucccgcagccgggaccccuaaugggcccagaauugagaggcgagagggaggauugagagguacgggguggcgggcuccccgcacccccgcuucgcgccccaucccagcgcacuggcaggcucaagccccagcccugccgcagggggucgccaggagcgcuuggcgccccugagggucccgcccagccucgccccgccccguccagcacuuaccugcagcggccuggccaacgcgguggccugaccccgcguccccggggcccacagcagaggcgagggcgccggagcugggcucagcaguggugcacacagacggcgggcacaccccgggcggcgcggaggagggagcaggagggagccggcuccuagacccgacgcugccaggcgcucccgggccagccuccggaggggcugguggcccgucugagccuccgcuuccucaggcgugaaaugggggcaucgguggccaugggcugggcuguccgaaggcuccaaugagaucaggggcgggaagcacucugcaaacuguuaagugccg

SEQ ID NO: 14132 - RNA, 4915 nt, Homo sapiens
cggcacuuaacaguuugcagagugcuucccgccccugaucucauuggagccuucggacagcccagcccauggccaccgaugcccccauuucacgccugaggaagcggaggcucagacgggccaccagccccuccggaggcuggcccgggagcgccuggcagcgucgggucuaggagccggcucccuccugcucccuccuccgcgccgcccggggugugcccgccgucugugugcaccacugcugagcccagcuccggcgcccucgccucugcugugggccccggggacgcggggucaggccaccgcguuggccaggccgcugcagguaagugcuggacggggcggggcgaggcugggcgggacccucaggggcgccaagcgcuccuggcgacccccugcggcagggcuggggcuugagccugccagugcgcugggauggggcgcgaagcgggggugcggggagcccgccaccccguaccucucaauccucccucucgccucucaauucugggcccauuaggggucccggcugcgggaagguuccgagacacccccuccccaaguccgcaagcucccaagcugccuaggauggagggaaacugggaaggaaagggagcuuuauccuucagggacauuguggggcgggagguagggcugggcacaguacagucugggggucagggaaaaaacgguugcgcugggagcuggcuuuggagggcagcugggggaaccagaaccggcuccaccaguccccagccuagacuugggaaggaaauucuuugccagugaagcuccucccuggggugugucaggagggacugggcagacagcacccaaggguagaagaugggggcccaggagggagcugcacccuggugggcagccaugggagugugucagguggaagcagccgucagggucccucucugcucucuguccggacagacagggcuccaaccuucacuucaguucuugugaacucccaccaggugaguagcagccugggagggaagagucucaggauucuaccagaaaguaggaauuauuucccuuuagagauuaguaaauagggucaaugagauuagggaauucuuggaagucgcccagcuacuaaguggccaagcugagguuugaauccagguggaacuccguguuccaugcuaucccacucccuucccccaccacgagggcuuagaaggagcagaguaggggagaagaggaggguuuccaagaaugaggucuucccaaucaccccauccugcccagacugugauucccagaggaaacgcagccaggagagccaggugcugagaaggaacugugcucucucccucucuccaguguagggaagucuuucccccaaucccccugaccaggcugcccccugaccaggauccugcccacccuccuguccccucccuccaagcugccuugcugaaaacucagcauucauuuguuuacccauucagcgcugagugccuacuaugugccaagcacugggcacuaaauauaaagcagugagcaagaccaaguugacauucuagagggggagccagauaauuaauaagaccaaaaaaaaaggacaaauucuuuaauuucagauagugacuaagugcuauaaagaaaacagagggggcuggaaaaauuaggugggcauaguggugugcaccuguggucccagcuacgugggaggcugagguaggaggcucccuugagccugggaagcagagguugcagugagccaaggucgcaccacugcacuccagccugggcgacacagcaaggccuuggcucaaaaaaaaaaaagaaaggggacaggaacagagugacagaagcaggggcucuuucagacccaggguaaucuggagaggccucuaaagagaugagguuugagcagaggccucugugaugagaaggauccacccaugugagguucuggaggaagagcauuccaggcagaaggaaucaguaaaaagcccccaaggcccuuauuccaggguggcagggugaaaaugucgaaucugggguuuugcuaagccuagcgagaagcuaguagagucuuaaacaagggaguggcaugaacugauuuaauggacucuaggggcacagggggaaggugaaaagccaguaaagaggccauaauacaggccagaauaauagugguuuggggcagggugguggccucgcaggcaucacgcaugcucagaggugcaagucagcuccagggggacucacaugcacauaggcccacacacacacguggacaggcaggcgggugcucucacacccacagcagcacagaaacaaggcacacucaggcagacccacccguccacacccucugagucacuccaggacugggaggaagaugugugaguuaaggccugaacaaagcacaucuuuccaccacaaggcccuggcaacuaguguggcuggggguggcugggcuuccccaggcccagcacagggagcagggaguuuucucuagauauucccuggaucuaguguccucccaggagucagaucauaaggcuccaugcaccccccaccugaacuggucuccccucuucaccacccagcagcugugagaccuugagcugguuauuucuccucucugagccucaguuucccugcuguagaaugggacucauaacugcaacuucacaguauaguagugaggcauccacaaaguaaacguuucaagaaucuggucuagggcaggaguccagcggagaagggaagaggaggugguggagagcacaggcucugguacccaacagccuggccuugaauccaccucuuguuuuaagugagugacuugaccucucuaaauuucacaguaaugaguagccagcauuuauggggcacuuacuauguacuacuugcuuugcaaucguucaaugaucaguuucaucuguaagugaggagcacuguaauaacuaccuuauggggucauucuaagagauuaaaugagguucugcucauaaaguguuuaacuucaugccugacucugaguaaacacucaauaaauggugauuguuauuaucagccaaagcauauuugcuuccuuccagcauacuagcucuguugccuuugguuaaguuauauaaccuugcugugccucaguuuccuaucugcagcuugggaggaauaacaguucugaacucagagggucguugugaguauugaacaagucagaacucagaacacugccugguacauaguaaaugcucaauaaagucaccuauucauucauacgaugguuuuuccucuaauucucucagguaggcacggcccccaccaggcgccauggacuggaagacacuccaggcccuacugagcggugugaacaaguacuccacagcguucgggcgcaucuggcuguccgugguguucgucuuccgggugcugguauacgugguggcugcagagcgcguguggggggaugagcagaaggacuuugacugcaacaccaagcagcccggcugcaccaacgucugcuacgacaacuacuuccccaucuccaacauccgccucugggcccugcagcucaucuucgucacaugccccucgcugcuggucauccugcacguggccuaccgugaggagcgggagcgccggcaccgccagaaacacggggaccagugcgccaagcuguacgacaacgcaggcaagaagcacggaggccugugguggaccuaccuguucagccucaucuucaagcucaucauugaguuccucuuccucuaccugcugcacacucucuggcauggcuucaauaugccgcgccuggugcagugugccaacguggcccccugccccaacaucguggacugcuacauugcccgaccuaccgagaagaaaaucuucaccuacuucauggugggcgccuccgccgucugcaucguacucaccaucugugagcucugcuaccucaucugccacaggguccugcgaggccugcacaaggacaagccucgaggggguugcagccccucguccuccgccagccgagcuuccaccugccgcugccaccacaagcugguggaggcuggggagguggauccagacccaggcaauaacaagcugcaggcuucagcacccaaccugacccccaucugaccacagggcagggguggggcaacaugcgggcugccaaugggacaugcagggcgguguggcagguggagagguccuacaggggcugagugaccccacucugaguucacuaaguuaugcaacuuucguuuuggcagauauuuuuugacacugggaacugggcugucuagccggguauagguaacccacaggcccagugccagcccucaaaggacauagacuuugaaacaagcgaauuaacuaucuacgcugccugcaaggggccacuuagggcacugcuagcagggcuucaaccaggaagggaucaacccaggaagggaugaucaggagaggcuucccugaggacauaauguguaagagaggugagaagugcucccaagcagacacaacagcagcacagaggucuggaggccacacaaaaagugaugcucgcccugggcuagccucagcagaccuaaggcaucucuacucccuccagaggagccgcccagauuccugcaguggagaggaggucuuccagcagcagcaggucuggagggcugagaaugaaccugacuagagguucuggagauacccagaggucccccaggucaucacuuggcucaguggaagcccucuuuccccaaauccuacucccucagccucaggcaguggugcucccaucuuccuccccacaacugugcucaggcuggugccagccuuucagacccugcucccagggacuuggguggaugcgcugauagaacauccucaagacaguuuccuugaaaucaauaaauacuguguuuuauacagg

SEQ ID NO: 14133 - RNA, 24957 nt, Homo sapiens
aauuguggucucagacguuccauucccaggguggcgccgcucggacuccgcgucccagcauuccccgcacgagcccgggagcacuuccgcccuguugugaagugggugucucggugggugaguccggguggcggggcgggggcagcugagacgcaggcucugggcuggagacuuaggaggugguggugacacagggggcuggggaaggugagaggggagaaagaagcuuauauguggggguggagggugagggacggucaaaggauguagaggccggagaugggaagggucauacaggggucggggaugaggaggcgauagagggcccugggaaugaggagggccuuagaagggucugaaggugaggggguugagggagguuuuggaggugggagagucauagaaaggucuggagaccacagaggaaaggauagagggucuggggcccuggcaagaagugaagagggccugagcuugaagcccgaccuuaaaaauaguguuucaaucucuaccuucccaucuagaacaagcauaucuaauuuguuaccucccuaaugauuguuaccucuggaacccaguggaugggacuggcuauuguguucugccccaaaccugcacuucuuuccuuaugucuuauggaagucaguggcacgaucaucccauuuaccuaccuaccuaccuacuuacccacugauuccucuugcauucuuccacguccaaggaucuuccgaucuuuaauuucuuuaauaucuuuucagucggccucuuucuuguaggguuuucgcagaagccuuuucaguuucccagcaugaacacacacauugcaccuagugugaucuguuucaccuacaaaucugauuaugccuucugcuugaaaacuuucauuggcacccagcaccuguaaaguccaaacaccuuguccuucauaaacuccuuuugcagccuaaucuucaugcaccucacacuccagggcugucaagguuuuccucguuuccuggguaggccauuugguuuuccaucauuauauaugcuguucucucagcuuagaauauucucuccuugcccuucaccuucuuugccaagagaacuucuuuaacuuaaaaaaauuucaacucuuacuuugcucaauucccuuaagcaaauuaagucacccccaacccucagcucccauaacuucuccuauuaccacauuugaucauaauuaucugugaagugugugucucuuccauuagacugugaacaucuccaggacaggaacagugucucaaucaccucuguuuccccauugcccagucuagagcaguaaacacuugauguaaagcaguaaauacuugauguauguaugugugaaugaagaccaugcaggguaagcuuugcuauaccagccuugaagacuucuauugccaguggauuuccagggcaggagcuuuagucuuccucugccuggcaaggcuaucugcuggaagcugaagcugauucauugccaaugggaguuuaagccaggggugacaaauacauggaaugugugcugccagugccccuuccugugucccuggcagucauggcuaauugguugguucucagcacauauucacacuguacucagagcccucagcacacuacucuaggcagccacuuccaguugauugaaguuucugcuuuaaaugaaaccuauuugcucucccuggcuuaagcccuuaugugugaggucaggucagacugcuuuaagccauagcuuggacugucagccaaaugggccugacagccuuuaagaguucccaguuuuuucucuuuggaggucacagaccagucuuggccuuuccuguggaacuggagagcaucuucucuucccuuuucacugagugggcuccucaugaccacguucauacuuacugcccuaggagucaagaugccccucagcuucccuguguuuguaaagacaucuugauuuugauggcagucagcacuuaucccucaugaccugggaggcucuguacucuuucuaggucuuucuggauauuggaagagagcuuugagaucacuuagcugaaucuaaguggcaaagcgacagcccaugcugaaugaaguccaccaucaugcuuuauuuaaucucauagugugugaaaaaauuuugaguugguuaccaacauuuaaaaauccagagugcuaguuucuuuuggaaaaaucagcaggcuuaggaauauucugggcauauguuccccuggcacucuauaguuggcuguagugcccacccaguucauuucagucauugacucauuuacauugcuagguccuuauacccauuuaaacuuguagccacugacucuagucucccuucucccuugcucuaccccaucauacuaauuggggaaccuagggcaacugcugaguaagaucaggcuguaagcugcagccuagcuaggcagccacaggggcuacauaacuuguccaaaguaacacagcugauuaguggcaggaguggaacuagaaccccagucugcucacuccugccuuaauguucuuuccauucucccguacugucaucuuaagaguuuggaugacuagcacacauagaggaggcuauaagacaugguuaagaaaaaugauuggagaaaagggaucucggcuuagacccuaacucuaccacuugcuaguuguguaaccuuaagugaaucuucauaaacacucaguuucccuuuagguaauugaggauauagugcagucauaccuuaucagauaauaauauucuaagggugaaaaucacuuuagccaaaaaucacaguuaguuugaaaauccuuuggcaaggagccguuucagaaacuaacacgcugccuuucaauaaauaaacuaaucagcacagcugggcuuucuuguuugaacauuagaugagaauucgcuuguauuagggacugugcgguaugaaagacacuuuacucacacuuaguggaaagagaggcacgagggaaucaagaccaaccuggugaauagcgaaguccuaggugccaccaccacaugcuuauucucgaacagauagugaacgcaacuggcugcacuauuuaaaucaugcucuuucucucuuucuuuuuuuuuucuucuuuuucugagacagagucgugcucuguugcccaggcuggagugcaguggcacgaucucagcucacugcaaccuccgccuccuggguuuaagcaauucuccugccucagccucccgaguagcugggauuacagguacgagccaccacgcuuggcuauuuuuuuuuuuuuuuuguauuuuuaguagagacaggguuucaccauguuggccaggcuggucucgaacuccugaccuugugaucucccugccucggccucccaaagugcugggauuacaggcgugagccaccgcgcccggcccucuuucucucuuucugaucuuugcaguggaaguuacagaucagugaaaugcagcucaacaccuaaugagacuccaguugcugccuggaggcuucagugagauuaugaauguggaacacagcacugugccuggcaccuugugggcacucaguaaagggguacucuuagaaauugcugguccuaaugaggcucgauauuccuggucaucucggaacugaggaaugccccgguccauuuucccuuguucacuucugugugaagucacccggcuguuggccgacucuguuggccucccucuccccacaauagccugcuauccauacuucggucuaacuuccuuagaaaguuacgguuaugguuccuuagaaaaaaaagguuauggugauauguggucccuggggcuuuccgauuucuauuugaaacaaaccuuugggacuuucaagucuuuccaggagaaaauaccuauuaucugagacucugagcuuugggccuggugugacugcuaauugccuauuuuguuguaguguccuguuugugcaggaacgcaaaugucuuugcuugcuuauugacugucugucucacuagacuguaauuuuauugaagguagggacugucagucccagcuacugguagaucuguagcuuccaaacaggguauagcugguacucuauaaaugauugaugaauugcuccuugugugagagggugacagaaauguguuugaacucaugcaucaauaagguugugguucaaaaagaaauuucaugaaaggcgaauucuuuagguucaaaaagaaauuucaugaaaggcaaaaucuuucuacauaugugaucucucugagugcuuauagcaguaauguagguagacagaaauaguuuaguuuaauauaaauuauggaauaucuguaucccauuaggcuuuugauacgccagguuuaucauuuuaauacaugguaauaaaacuuuuuaauggcccugcuauuuaucagauacuggguugagcacuguggauacagaaauuaguaacauacaauacugauucuaguaauauaguauaaugugggugucagauauaguaacagguaacuacaauaguguaggauaauaccuauauuagagguauguaccaauugcuuuggugauauaggaucagggaggcaauucuuggagggcaggacaugaaaagggcaugucaaggaacuccuaucaaaggaggugacauuugagcuggugguugaaggaugaguaggaagcugccagguagccaugaguugugcuuuaagccucuuccuaagcauauggaggccuuuagggcaagacuuuaauuuuuauuacccuugucuuguuucucuucaguccagucagauugcccaaaaugaaaaauaccaccaucucuccauucucaauucaguugugucauucccacuuggaagcagcuaaugaucuccuuugagugggcauuuuuuaugucacccagacuuguugggaugacacagagagcucauuuuuucaaauaacccagcaugggugccaucagagaggcuguaaucuccucugggacacacauagauacgcacauccuucucauacaaugucucauacaguguagaaagugguaagugucacagagacauggaaauaaaagagaaaggaauuccuuuuggcaugagcgcgaaggucauuuauuuuuuaucuagugugcacagaaagggauuaauugcaauccuugcuuaaugacacaccaucaucauuagucaaucauucgugacuuuauuauuuauugaguacuuccuauaugugcugagcacugugcuaggucucuugggaagcuaaugaucuaguggguaagaaaauuacaguaaagcaugaucugggcuaugguagagaaaauguaagaugcuaugggagcuuguggucgaggacugaaucuuguuucagggugcagggaaggccuuacggaaaaagagcaauuuaagcugagaccuugcuagcugaaggaagggaggagaccauucccaaaggagaccuucccaaagaggggaagguucagagggcagcgugguguaagaucuggaagcugugcuucuggagcaccaugacuaguggagcaugguaaagagacgaguuggagacuuggguaaggcuugugcuuuguccugagggaaaugguagaucacuggaggguguuuagcagggaggugguguagucaggcuuugaucuaguuugguuguugugcaaacaauagagcagagguuggggugaggugaguggaggcagggacguguuaggagacugaucagguggaagacaugaugauucucugcacugaagugguagcauuggagauggagaugccaaguggacacagcguggugaugaauuggauuuggggaucuuagagaaugaugaugaccagguuucugguguggagaacuugauggcagugccuucacugaagggggagcuucagaaggcagacaugauugcaggagaaaauaacaaauccaguuuuugacucauugaguuugaggugccuaagggacagucaaguagaagugucaugaagggguuuggauuuuggggucuggaggucuggaaacagguccuugcuggaguuuuaggagucauguauagggaugaugaauaaugccaaauaggugggaugaccaggggauagcauagaguuguuggauuuugcaaggagaacauccuuagaggaaugccagccaagcuuuaagauuagggaagaaaggccuuaggaagggggugacauuuggaacccaacuugagggaagguuggacuuuggacauguguagaagggaggaagucuacacuggaccagaucauggaggugugggaugccaggcuaagguguucaggcaugaccuagaggauugaauacagugcugucuuccuccaaagugugaggcucaaaugagauauuaauugacauuuugugagcacucacugugucagacacuggucuaagcuuuuuauauauagaucccucaucuaaucaacccagcagucaaguaagguaggugcuacuggcuuuggugccagauuguggccuuacuuccugccuaugggaaaggggcaucucuuagcaccucugcccccaugcaaagguggcggaagauaugggggaagggggagaaugaagcuucugcauccuuuugcucacacucuauccuuugucuuucugccuuagagccuuggggagcagucccuuuucuaggagccucuugaaggacucaccguagaugcaggaagacauuggaugaggucagcauagcugaagugaggugucuggguuagacaauggcuauggcccuggaauugcaagcccaggcaucuccgcagccagagccugaagaacuccugauugugaaacuggaagaggacucuuggggaucagaauccaaacucugggagaaggaccguggcucugucucuggcccagaggccucccgccagcgcuucaggcaauuccaauacagggaugcagcuggaccccacgaggccuucagccagcucugggcucucugcugucguuggcugaggccggagauccgucucaaagagcagauccuggagcugcucgugcuggagcaguuccugacuaucuugccuagggagguccagaccugggugcaggcacgccacccugagaguggugaggaggcuguggccuugguggaggauuggcaccgagagaccaggacugcaggacagucggugagacaaacagucuucuccugcagaggagugggucaggcaaggcagcaggguugugacuacguuaauaauugccaaauucacaauaaaaauaacaauaguuauugagaacugacacuuauugaccacuacuguauaccaggaaguguucuaagugcuuuacauguauuaacccacuuaguccugucaacaauuuaaugagauaggugcuauuauccuaauuuuaccagugagaaaacagagacagagaaaagauagguaaguugcccagggucucaacagcugcuagaugguagagucaggauuugaacucaggcauucuaacucuaaagcugguaugccuaaccacuacuccaaacugccucccacuaccguauucacaauaugauuaacucguguuuuauacuuaacaaaaucuuucugcauaugugaugucucugagugcuuauagcaguaauguagguagacagaaauaguacuguuguccccauuuuauagauuaaacuaagagccaaaaaguuggccgggagugguggcucacgccuguaauccuagcacuuugggagguugaggcagguggauugcuugagcucaggaguucaagaccagccugggcaacauggugaaacccugucucuacaaaaaauacaaacgaaacaaaacaaaaugccaaguggcccacaaaggucaucagugaauagaccagagccuaaagccaaauccuuagguuccaaggucauuguucuuucuacugcaugucagaugccuccucugcaaaccaugggaauuaaaauaccuuugagccaugaggcucaaaugagauauuaguugacauuuugugagcacucacugugugucagauacuggucuaagcuuauauauauagcccucaucuaaucaacccagcaauccaauaagguaggugcuauuaucauugccauuugccaaauggguaaacagagauggagagguaaguaacuuaucuaacuuuauauaacuacgugauagagcugagguaagggaaaugaaaguauggauuuaacauucgcaguuucaacaauuugcaagugaccgcugaaagcccaugauauaaugcauaauuuugcuaugacacacauuuugaauccugcuucaaagcugguauauguagaacagauccuuuagcuggauccagaaccuuccucuaaacaugacuuuuucucuacuuguuauaguuaguaauucuugugauauuuuacuuacccccauuuugcugggggaaauuacagguuugggaacauaucccuugcaaauggcagggguuuucuguacauuuaaacuguaaaguucuauacagugugagguugggggagcaaagguuuuagaccggugacuuugcucuuuggauuccuuuacaaacugauugaagauacagggagacuaauauauaaaguuacagaacuaaguaugagagagugugccuuauuuuaauguaccuccccaccccccuauauuuuucuuuuaaagaaaccagcuguuugucuuaaguggcagugaagaaacaaauggaaguuuuagggcuucagaguugggacauaaagaacuugagacccagagaugaaaacggauuuaaaucaaggucuuuaugauucuucaucuguaaaaugagaggguuggauuagaccaaagguucucaaauuaugccccugugagcugaccaaaaguugaacugcuucuaaaauugagaaaaaaauaagguaauggaaucuugucuauuauguauuuuuguuuuuacugugacuuuuuuuauuuuuaaacuuuccuaccugcuccugaguggucacaaauuucaaaacaaauggacaaguagcagaggagcuuguuuuuuucaggugcaaauguagcuugugaucuuacauugcaagauauauaacuuaguugcauucucugcaaguaaaauuuuucaagucuuaauaaugggaugaaauauaguuauaauauuccucaaagugaaccugaaaaagguuggugccuacaggacuaaauggccccuaagguaauuuccuaaaagggaucuuucagcucugcuauuuugugauuguuacuuguuucuucugucaucaccaucuuguugaaucccccucucugucagaugcccccucuccaucaggugcacagggauuuuuaaaaaacaggcuuuauuuuuuagagcaauuuuaggcucaaacucacagcaaaauugagcagaagguacagagaguucccaucccuccccgacaagccucccuaacuaucaacaucccugcaccagagcaauauguuuauuaccauugaugaaccuacagugauacaucauuaucaucacucaaaguagcaguuuauguuagggcucuuaauguuauucauucuguaauguaugacauuaagagcccuauuauaaacuguaucuaccaucauagugacauaguaacauguaucuaccauuguagugacauacagaguagcuucacugcuguaaaaacccucuguguucuaccuguuuauucuuccuuccccccaaccccuggcaacaccgaucuuuauacugucuccauaguuuugccuuuuaaaaaauguuacauaguuggaaucauacaguauauagcccuuucagauuggcuucuuuuacuuaguaguauacauuuaaguuuccuccacgucuuuucauggcuuguuagcucauuucucuuuaaugcuuaacaauauuccguuguguggauguaccacaguuuauuuaucuacucaccuacugaaggacaucuugguuccaucaaaguuuuggcaguuauguaugaagcugcuguaaauauucauaugcagguuuuuguguggaccuaguuuucaguucauuuggguaaauaccaagggacaugauugcuggaucauaugguaagaguauguuuaccuuuguaagaaauugccaaacugucauccaaaguggcuguaccauuuugcauuuuuacuagcaaugaaugggaguucuuguugccccacauccuugccagcauuugguguuuuggauuuuggccauucuaauagguagauagugguauuuuauuguuguucgaauuugcaauucaccaauaaccuaccauguuauacauguuuucauauguuuacuugccaucuguauauuuucuuugguguggugacuguuaaagucuugcccauuuuuaaauuggguuguuugucuucuuacucuugaguuuuaagaguucuuuguauguucgggguaacgguccuuuaucagauauguguuuugcaaauauauucucccagucuguggcuugucuucucauucucuugacaguaucuuucauagagcaguauuuuuuaauuuuaacgaaguccagcuuaucaauuauuucuuucauggauuaugccuuugauuuuguaucugaaaagucauugcuauaccugacauuaucucaguuuucuccuauauuuuaggaauuuuauaguuuuucauuuuaacguuaaggucugugauccauuuugaguugauuuuugugaaggauaggauagaagcuuuuuuuuuuuuucauguggauguccaguuuuaguaucauuuguugaaaauauauuugcuucacuguauuaccuuugcucguuuaucaaaguucagucgacuaucuuuaugugggacuauuucuggggucucuauucuguuccauugaucgcuuuauucuuuugccaauaccacacugucuugauuacuauaguuuauaguaaaucuugaagucaggugugucauuucuuugauuuuuuuccuucuccuucaauauugaguugguuauuccaggucuuugcuucuucauauaaacugcacauggccaggugcaguggcucacaccuguaaucgcagcacuuugagaggacgaaauggguggauugcuugagcccaggaguuugagaacagccuagguaacaugaugaaaccccauugcuauugaaaaaaaaaaaaagaaaaacaaacgaacaaaaaaagacuuuacagucaguuuguugauauccacaagauaaauuucugugauuuugauuggguguugaaucuguagaucaaauugggaaaagcugacaucuugacuacagugagccuuucuaucugugaacauggaauauuguuccauuuauuuaguucuucuuugaugccuuucuuugguaguuuuccccauguaaaucuucuacauauuuucuuagauuuaugccuaaauauuucauuuuuuuuggaugagaauguaaauguuauuaugccuuuaauuucaaauucuacuuguucauuguugguauauaggaaggcgauugacuuuugcauauuugcauauuuguacccugcagccuugcuauaacugcuuauuaguucccagaaguuuuuuuuguugauucuuuuagauuuucuccauagacaaucgugucauuugugaacaaagagucuuuuucuuucuucccaaucuacguaccuuuuguuuccuuucuuaucuuguauuagucuggacuuccaguaugaaagaauagugagagagaacauccuugccuuuuuccugaucuuagugcaaaagcacuguguuucuuaccauuaaguaggauguuagcuguagguuuuuuguagauguccuuuaucaaguugaggaaguuccccucuauuccuaguuugccaaguuuuuaucauguguguuggauuuugucaaaugcuuuuucugcaucuguugauauaauauaugaucaugugauuuuucuuuuuuugcccguugaugugauggguuacauuaauugauuuucaaauguuggaccaggcuugcauaccugggauaaauaccacuugguugugguguguaauuucuuuuuuauacauuguuggauuugauuugcuaauauuuuauugaggauuuugcaucuuuuuuuuuuuuuuuuuagcuggagucuuguugguucugucgcccaggcuggagugcaguggcaugaucucagcucacugcaaccucugccuccuggguucaagugagucuccugccucagccucccgaguagcugggacuacaggcaucugcaaccacacccagcugauuuuuguauuuuuaguggagaugggguuucaccauauuggccaggcuggucucaaacuccugacuuggugaucugccugccuuggccucucaaagugcugguauuacaggucugagccaccacacccagcugauuuuugcaucuuuguucaugaggaauauugguuuguagcuuucuugucuuguaaguaauuucuuugguuuugguauuaggguaaaugcuggcuuuauagacuaaauaaggaaauauucccucugcuucuaucuucuggaagagauaguagagaauuguuauaauuucuuccuuaaauguuugguagaauucaccaguggacccaucugagcuuggugcuuuguguuuugaagguuauuaauuauucagucaauuuccuuaauagauauuggccucuucagauuguuuauuuuugugugaguuuuggcagaugggguggguaaaggaauuggucuuuuucaucuagguugucaaguguguggccauagauauuccuuuauuaaccuuuauguaguucauaauauuccuuuauuauacuuucagugucuaugggaucuguagugaugucucuguuuucauuucugauauuaauaauuugucuucugucuucuuuucuuuuuuauuuuugagacggguucuuucucuguuacucaggcuggagugcaguggugggaccuuggcucacugcacccucugccuccuggacuuaagcaacccuccugccucagcccccuguagcugggacuacaggaccacaccaccaugcccagcuaacuuuuguauauuuuuuuuuuguugagaugggauuucaccacguuucccaagcuggucuugaacuccuggcuucaaaugauccaccaccuuggccuuccagagugcugggguuacaugugugagccaucgugccuggacugucuuuuuucuuagucugacuagaggcuuauugauguuauuaaucuuuucaaagaacuagcuuuugguuuuguugauuuucucuauugauuucccauuuuaaauuucauuuauuucugcucuaauuuuuacuucuuuucuucugcuuacuuuggauuuaauuugcucuucuuuuuucuaggucuuauauugguguaccugugucccuggacucugaccuuugccagugcuucucaauuuuuucccaucuuaggugggacaggaugccuaaagggggcugcacuggguauuucuuaucuugcauguggaagagcagagggagcuggaauugcauauuucucuuccgacaguuagguuaggcuuugguaaaauaguuucugcugaggacaggacuuauuaagaagagcagagugcccuggcauauuucaaaaugguucuuuuuuccugccaucugccauaagcaugaagagauuuuucucugauauucacugugagggucugguugagcuccuggagauaaaacuuacaaaaaugugccccugcucagugauuaagugcccuggaguuuuuaccucucagaguuguccacacugaccuuccagcaguucaucaauuacaguuuagguuuuucuccccuggaacugguucccacagaggcuucugcuccacuaaguugugauucucugauucuaccuguuugucucuccaauuuuggggagaaugguuugcccugugaccucacuucucugacagaucuaaggagaguuguugauuuuucaguuuguucagcuuuuuacuuguuacuguagagucuagaggggcaacuuguagacuacagacuucuuggaaacuagaagucugaccuacuaauuuuuugucuccugguugucacuugaaucuacuucuuucuguguccaaaauuaccauccauggaaucagaaucuuugcuuagggaugguaauaguuggaggcacugggguugagaguaaagauuguuguugaauuuagucacacaguuccucuguagguuauaaugauaacaaagugaauuuuuuuuuaacaugaccauauaagaagauugauaagcagaugcuuucucccugugaagucacacaggacacugguggaucuucuuauuuggaauggcccuugaugcucauggcccauuccuauaugucuucucaaugguaaaaauccuucucugugaguggaucugaauuuucaggccagccaaaaaaguuuuggagcuaaguuuggcaaacucaguaauuuaaugaagauaguuguuauuauuuugguucaaaaaaauaagacucagagcaguauaucuagucauaaguuuuuguauaaaaaagagggaagcuaagaauacacauuuacauuugcuuguauguagaaagaaacucuaaaagaaugcagaagagcauaguuaccugugaugaggagaggggaaaagaacggggucgaugggaugaagauggauggagguggggcauuuucacugaauauacccauguauguauuuucuguuuuuaaaccaugugagucuauuaucuauugaaaaaaauugaaauauguuuuuaaaaguuagguguuucuauaaaguauugagauuguuauauuuuggagguuuuauagccuggguaacaccuugaccucucuaccugugaacuuggaaccagcugagaaauagagauaagaaauuagcugugugauugaugaaguugauuggguaauguuauuuuaguugauuacucccuuuuauuuuaaauaucuauaucucugaguaccuuuuuuuuuuuugccugaaauccaacauugaaaugaaaauugccacuuccuuuuuccuuuugaguuagagugccuugucuuuugcauguccuucuauuguaagauuaacaacacguacuuuuaucucauuuuaaaauuccaucuaauuucuuuuuuugagacaaguucucacuccauuguccaggcuggagugcaguggcaugaucauaggucacugguacuucaaacuucugggcucaagugauccuucugccucagccucuugaguagcuggggguacaggcaugugccaccaugccugguuaauuuuauuuauuuauuuauuuauuauagaggugagggucugcuauguugcccaggcuggucuugaacccuuggcaucaagugauucccuugccucagccucccaaaaugcuagaauuacaggcaugagccacugcacccagccuccaucuguaauucuuuguccuuuuuaaaaauuuuauuuuaaaaauaucuuucucuuucagcagagauauuuagagcaauugcauuugggguuauaauuuuauauuuuuuuccuguuuuuaugccucccuuugccuuuuaauauacaacuugauaacuuuuaucuuuuuuugaucauuuaaaaaguaagcaaccuauuuuugaugcuuauggguuauuuuuuaauguuacacaaauuuuacauaauuuaucucuuuaugaaucaaaaauguuuugaacagugggacucucauugaaacacuuggaucgccacccuguguucaacagaugguacucauuuggugguauaaaugcuggucuaccuaccaaacucacucugauggcuuucucauccuauuucaagccauuuuggaucuuaaaagagccuguuagccucuggacugcaguuguacucaaaauaccaaagugggucuuacugaauuguugauugggaauuuugacuauuuguguguagggacuggaauugcauacagaagagaccaggcccuuaaagacaggggaagaagcucagagcuuccagcugcagccaguggaucccuggccugagggacagucccagaagaagggggugaagaauacaugcccugaccuucccaaucaccuaaaugccgagguggcaccacagccuuugaaagagaguggugaguacaucugagaacauuagggaaugaggccuucugcaggggagagggaugggaggugaggaagggugcauggggaagaaggaugugcagaauucaaagcaagggauaggcugcaguguggugggcacacuuacugagaaguaagcaagccucguaaagaggcugugccuaucgaugaugucaucaugcccugcuguagcuggaguccugcagcaggugcaggcugggacagggguggguggugaucacaggaggucagggcuggcaucucccacauggcacaccacucacagcagcuuaggagcuacacacucuagaagggaaguaaaggggaagucugcacuggccauagggauagcccuagcuugauccaaguguuacuuuuggaaagccaaucucaaagggaggugauuuuuugggaaccagagcuuggguuucagugacuuuuucuuuuccucagcuguccucacuccccgagucccuacucucccaaagauggggagcguuggagauugggaggugacagcugagucccagguaagcuguuacucguucuuccuuuccugucauugcugcuccugugcucuugcccccacaguguuccuccucucucuccaugaccucugcucagcaaaagggcaugaggcccaggguguuagccuuugcccuucacccccagccugcugggccccaaacauccccaaacacauguauguaccaaauggccauccugcuccuuaugaugccagcuucacacaugguaucccucuguucccaucaucuuuccugggagccugcuaggguuccuaggcuguugucaaaggucagugauguuugggguccuugucuugugcaucucgcaggaagcccugggcccuggcaaacaugcugagaaggagcucuguaaagaccccccaggagacgacugugggaacagcgugugccuggguaaggagacguacccucugaaggugauguugucaugcuucugauacacccaguucccaaagaggguuuugccgcuccuuuaagaaucauggcucugcagucucuggaauuucagaaauaggaagaagacuugcccuuuguagccagcacucucauggcagggauggagucugccuggagacgggguggcaggauggcuuccaagagccugcccucucugggcacauuaccuuccuuaccucaguccauucaccacaguccaggggccaggccuggacugccaucucagaaaucugauuuuuuuuagcacuguaaauaggaucucucucucaggcagacuuaagugaacuaaacccaugagaccaaugaauuaaacccaauaggaauaaauaucacagagcccaaaauaccugaagcccauauaagcagcacagacuccuuucuaugugggcacuccuauguggcaagccaaauaauagggagccguuucccuguggagcccgggaucacuguguggggaguuagacaugugaauagcugaaauagaaaagacucugauaggccugacucaugguaaguuuagauaccagaagcucgcuggcuacuugcuugacaguggaaccccuuuuuacacaugauaucugggggaaauaguguucaaaggaacagauuuugggaaacggugaauuaaauuauccuuauaccucuuuaaacccuuuucaucuaguuuucuucaaauauuuauuucaauuaaaggcuuccuauuuuguuagggccgggagcuguugggauagcaguccauuaaacauagcuaacuuuuaaaaauaaggaaauuuauuuucucacauuauuagaaguccagaggaggacaugcuccagccacaguacagacuagcugagcaaugucuuaaugggucuguguucuuuauuucugucugccauccucaguguuagcuucauauuaaagcuguuuuguuucauggucaaaagauagaugccaaugguggcaauggaugccuagcaggacagagacucacuacacacacaaacacacacacacacacacacacacacacacacaccacacacccuuuuccuccagccauggaguucagucuaauugggccaauuuaggccaugugcccaucuguggaccaaugaguuacucuuauaugauguuucauguuucauaacaacaacaacaacaaacaaaugaacaaaguaaacaggucacuuaacauuucucauauauuggucguguuaccucuucucucucccuauuccuguaaacauuuuaugggaucaacuugggaauuucucguuagccucuugcaaggaaaagauagaaguuucagggagauuuuggacaaacaugccgcucaacagaccauuucuacucugucauuucucuuccuuuuguaggaguuccaguuucaaaaccaaguaauaccuccgagaaagagcaaggaccagaguuuuggggucuaagucuuauaaauucugggaaaaggagcacugcagauuacagccuggauaaugagccagcucaggcauugaccuggagggauucaagagccugggaggaacaauaccagugggauguggaggacaugaaggugucagguguucacuggggcuaugaggagaccaagacuuuccuggcaauuuugagugaaucuccuuucucugaaaagcuccggacuugucaccagaaccgccagguauaucgggccauugcagagcagcuaagggcaaggggcuuccugcggacacuggagcaaugucgcuauagggucaaaaaccuccuacggaauuaccggaaagccaagagcagccacccaccagguaccugccccuucuaugaggagcuggaggcccuggucagggcucggacagccaucagagccacagauggcccaggagaggccguggcacuucccaggcucggguauagugacgcagagauggaugagcaggaggaagggggcugggauccugaagaaauggcagaagacuguaacggugcuggccuggucaauguugagucuacccaggggcccaggauugcaggggccccagcucuguuccagagucguauugguaagaacauggggguuuagucagauucagauuuccaacccuccuaccagcuagacugcuauucccugaggucagggcacaggcugcaagucuggauugaagccacuagagugaagagcuacauuccuuaggucauccucaaacuccaacuuucuuuucccaugaccaagucucuuugcaaaagucuucuuaguuauagaagcaaacauuuuuaaagccuuaaggggccucaaagagugaauccaguauuuccaaaagugugucacugguaguaugggaugaucaucgacguuacaugaaugaacuuuaaauucuuguauuuauauauuucucuuaauuuguaugagugcaucaaccugugauuucacagauaacaaaguuagguaaagagugauggcgagugaaauauugaacagauaauggcagaaaucccgacaguguagacuugaauaaucaaugucugggaaacauccaaucauuguaaaggugcaaacauggaaguccaugagaugaggcgucuuauagacgcacagguaggagcagagcccggaucagagccuguggcuccugccugcugguuucacaugguuuucccuccaccauguugccuuccugggcuacaucacuuuccugcagaggagcugagacuagaccaccuccuuuucauuccccugcaaaggaggaaaguguguccucauuuggccuuucuugcaggacuauuugaaacucauuuaugccucuaaucuuuaggaauucucagcuuucauguuuuguuaaaaggagaauuuauggccaggugcgguggcucacgccuguaaucccaacacuuugggaggcugaggugggcagaucacgaggucaggagaucaagacuauccuggccaacauggugaaacccugucucuacuaaaaaaaauacaaaaauuagcugggugugguggcaugcaccuguaaucccagcuacucaggaggcugaggcaggagaauugcuugaacccaggaggcagagauugcagugagccaggauugcaucgcugcacuccagccuggcggcaaagcgagacuccgucucaaaaaaaaaaaaaaaaaaaaaaggagaauuuauaaaauaaauagaguacagguauugagugaauauggggaaaaucacaugcaucccaauuacaggccuuucccugaacuaaucagcuaaagccaggcacaugggaucaccugauauaauugauauaacauggcuacuuaaguccucaccuucagccaagacuugaaguguuaauagaaucucuuagaagagggugagggugggaagcucuggcuggcuguccuagcaugccccugagaagcaaagggauauucuccagguaccuggauaguuucugacaugccuauguucuagguauuuugaagggcaggugacuuuauucucugaugaccuaggcacaucucauuaagucucacaguucucaacucuucacuccugacagcaggugugcacuggggcuaugaggagaccaaggccuuccuggcaauucucagugaguccccauucucggaaaagcuucguaccugucaccagaacagccagguguaccgggccauugcagagcggcugugugcucugggcuuccugcggacacuggagcagugucgcuacagauucaaaaaccuccuucgaagcuaccggaaagccaagagcagccacccaccagggacaugcccuuucuaugaggaacuggacucgcugaugagggcucgggcugcagucagggccauggggacuguccgagaggcugcaggucucccuaggugugggcagaguagugcugagacugaugcccaggaggccuggggugaaguggccaaugaagaugcugucaaaccuucaaccuuguguccuaaagccccagacauggguaagccuggaguaauuggauguucucaaaaucugugggcauguggagagaaugaggaagccaggcucauuaucuuuugucucuuaacuaaaagagagaaugggauugaaugggaaaaaguauuucugcuuugcucagauuauccagucucuagcuuugugugaucccccgaaucagucagucagucagucauucuaucuuuuacuagguauaucugggcgguuagagacuuuauucaauccaguaugacacaggauauauggaauguacuagaagaaggagguguucaugauugaguacuaagauagaggaguuugauggggaaacagguuggcuguggcugcugggcugagccccauggcucacuugguggggucaccaugucccagaguccauuccucagcuuugcaggucacaaacacuuguguguaccaaaacuugaucaauuucuuguuagucacauuuauaagaugugcgauagaagauauaagaaucaaauucauguuagccaaauucacagauguacaauacagacacacacaaacacacacacacgcgcgcuaaugagugaagaaaaacugcauuucuguccauuuuuucagguuuugaaaugaggcaugaggaugaagaccagauuucagagcaggacauuuuugaggguuugccuggagccuuaucaaaauguccuacagaagcuguuugccaaccucuugacuggggagaagacagugaaaaugaaaaugaagaugaagggcaguggggaaaucccucacaggaacaguggcaagaaaguucuucugaagaggacuuagaaaaacuuauugaccaucaaggccuguaccuugcagagaaacccuacaagugugacacaugcaugaagagcuucagucggagcucccacuucauugcccaucagcgaauccacacaggugagaagcccuacaaaugccuugaauguggaaaaaacuuuagugaccgcucuaaccucaauacccaucagagaauccacacuggagagaagcccuauaaaugccuugaaugugggaaaagcuuuagugaccauucuaaucucaucacucaccagagaauucacacgggggaaaagcccuauaaauguggagaauguuggaaaagcuucaaccagagcucaaaccuucugaaacaucagagaauccacuugggaggaaauccugaccaguguagugagccugggggaaacuuugcccaaagcccaucuuuuagugcucacuggaggaauucuacagaagagacagcuccugaacaaccucaaaguaucaguaaggacuugaauucuccuggaccacacagcacaaacucaggggagaaacuuuaugaguguucugaauguggaagaagcuucucuaagagcucugcccucauuagucaccaaagaauccauacgggagagaaaccauaugaaugugccgaaugugggaaaagcuucaguaagagcuccacccuggccaaccaccagcgcacccacacuggagagaagccguauaaauguguggacugugggaagugcuucagugagcgcuccaagcucaucacacaccagagagugcacacaggagagaagcccuacaaaugccuugaguguggaaaauucuuccgugaccguucuaaccucauuacucaccagaggauucauacgggagagaagccguauaagugcagagagugugggaaaugcuuuaaccagagcuccagucuuauuauucaccagagaauccacacaggggagaaacccuacaagugcacagaguguggcaaagacuucaacaacaguucccacuucagugcucaccggagaacccaugcaggagggaaggcgucguaggggacaguuuccucaacaacaaaggaggacucaauguauauaucuuauaucauaagauguaugcuagagauaaacuuuccaauuuuuaagcuugguguguacccagggaaguuaucuugguauaaaccagguaauuuggaagugaauuacaaauacuaaggauccagauuugaaggcacuuuuaaguguaauuuguuuuucuucuguaaagacccacacagaauccugacuguccuuguauuugcuaucauguaagagcugugucaguauuugagccaaacuggcaacuuacgagauuagaguuaaaucagugguccugagcagugauuccaaacucucacugugccuucacaccauccauguguaauccaccccaucagcagugguucuccuacuuucucagugggggcauauccucaagggagaauguugugacucuggugagagaggaguuggccuagagcaggccacugugagcucagcacagaguaggaagaacagugacaucauuacaaaaucaucaauagcagcaauagcugguguuuauugagcuguugcucuuuggcaagcucugugcuaagaacuuuguauacaucaucucauuuaaucuucacaacggccccaggagauaaguacuaacuuucuccccauuuccuagaggcuugggaaauuaaguaacucgcacuggucacacaucuguaagugggagaggcaggauucaacagaucugucugucuugagucuaucgugcucuuauugcuauacugaauucccauucauguuagguaacuuaggggccagaaucuccaugcacuuuguagaccacauuuccuguuaugaaauuuccacauuuugaauuuuuuaaacaaauauggaaacugagaaucccuaaggauuaaaggacuugggauauccagaauuggugaagugauuugagcaaggaugagcuauuaucaaaauacuugaugugaguuuccaucuucgcaauaauaugggugagagauauagguggguugagauugggaaaaauaugcggccuaaguaauuuuucuuccaauaagauacugcuuuggcuaaggaaaugggauguaagaguucucuuuuucucaggggacaguccuacuucuugccaugcuuggcugaucauagguuaacccuaacagaagccuggggucccuacauuuuugucugucuggcuuuuccuuuuggcaagcagaagcuuuguucuugguccccaugccaagacugaggugggaggugcugguguauauggucaucuacugagagggccuugaccacuguucuguguaccagguucuuggcacaauuuuacccugagccauccugucccaggccugcccagggcuuucuguauguugacccuuaagacucaccucccacauggacaggcuaaguuagaaagguucacauaggaugguuuuaacauuugcagcacuuuggccuccagaguuucuccuuagaaggguuuaaaacuguugaccaaggacuucgguuuccauaggacuuuaaaggaaaaucccccuccugccauccucuuaugacacuaggauguauucauaaccugcuugguucaugggcuggggaaguaccuaucagauaguggaugugaagcagccuugaagaauggaacuuuuauuaacaugugaggaagccaguggagagauuugcuacucccacagagugauaucccuucuuaaccccuuccccugcuucagaaccuccuuucccaagaaccagccccacuaggaucaccgucaacucccucccaguuuaccuuuucuggcccacguuaucucugcggggcaggggucaugggaugaacccuggauagaagucagcagaugucaguaacugcaguaauacagugauauugucuaguaaugugagcugagaggaaggauccugaggugagggagagggagggaauuccagggaaaggcacuguuguguggaauagcauggauucagggugggguuguaugaugggagguugggaacagggagcugauauuagaggagugcuggagcaagguca

SEQ ID NO: 14134 - RNA, 43940 nt, Homo sapiens
gcccggagccugugccggagccccagcccggcccugcucgggccgccgggcgcggggcugcggccgcgucccggaggcgccgccagcacagccagguccgugcgggcccggggcgcgcggggagcgggcccagcggcggcgggcgccugcccgcgggaaaguugcgccgaguugcgggcgggggccgggccggggcgcgggcgcugucagcgcgggccggggcgcuccgagggcccggggccgccugcgccucgggcccggcccagagcggcggcggcggcggcggcagcggggcgcgcgggguaggaagugucucccgcggcgugucuggggcuggucuccgagugugugugcgugugugugugugcgcgcgcguguguguguguuuucuuaagccgggcuauucaaacccugcugcaauucuccgguaaacaaugauucauggggcauaaugcaaauaaacggauugcaaacggcgcgguucgcgcacuuugcagccggcccgguggagcagccagugccggauuucucccuuuuuuugcagaucugcagaauauggcgucccuguccuguuuuaaaaauaagccaggcugccauuuuuguuuuucuuuugucugaaaauuuuaauaaaacugucugagaaugugggagaggcggcuggaagcagagggggcacccgaaggguuggcuuuuuuccuuuucuuuggcgagagccgcgagccuuucggggaggugagacacaaugcaauugcacuuuaaagaaaaaaaaaaagggaagcugccgggcgauuugaggggggagggcugggaauuuaaaguuaacuccgaaaguuugcuuugcuuugcuucucuuucuuucuuucuuucuuuuuuuuuuuuuuuggaaggcggugaaaugccgcgaaaggaucucgaggcccauuucucccccagccagcugccuuugcaggauuuuugggaaaaguuaacugccgguuuccucagagcugcgcgggaugggggugggggggcggauguggaggguugaggaugggaguuuugggggaacugggaaacauuuauuuggaaggggcucuauaaacauggcauuguaaggagcuagauccucagaucugggggagagggccggcaagaggggcucagaauggguccaggauuuccagcaaagaccccuggcaugaggaaauaauccugcugucccaccacccugcccucgagcaguguggaaccuucgggagcuguguguguggcagugggccugucuccuucauggguggccaggaccccccguguaggcuggaaucucgcccaagcccuggggugacccuuggacccugaggcaagugagcuuggcccuuugcaguuggagagcccccuccccaaccuggugguccuccugcccccagagguggcagcuggugguaaugucuuccccgaccccacccuaugaugaacuuuugguugggugcaggccugcggcccagugggucccgucugagggaaggggcaggaaagguagucugguuugcuagaccuccucggugugagccucaccccuguaguaugcucuuauuccuuucugccacuccugcccuacgcccgggagguagaagcacuuuggacuucgguuaaguuccugaaguaucuugcuggacaggucagggccugcuggcuccgcaggcugccgagggggaucugaaggccaggcccacaaggucuggggugacuggugcuguccaaggcacuggggcaguguugggccuagccucucauguguccccuaccccagcauuucuuggaggggagacccuucuagucucacuccugguuuguguccuggcuccacuagacagagugagcucccagaagccagagucggggguugaaagcugggguuagggguucagggcuguggaacauggcaugucuuggccagaggguaccaagccaggugguuuuuagauggaggaacugagguccagagagaggaagugacuugccugaagucacgcuaccagguagaaggagacugagaccgggaccuggguguucaggcuuccacugcugggcucccuccacuguucuccaugacgggccuggaccccuggaagauccguuuugaacagaacuggacuagaaugggacagcacgaucccuucacccccuccuacccccgccaucauaaucuuuccugagagaauugaacuucacaguuuucacaguaugguguggugauuaucacaucagguucucccagaaacucaguuaggguuaaauuguccuaauggggauuaugaaccucauuauaaggaaaccaagacucagagagguugaacaguggcagaggaggcuuaaauucaggccugcaggcuccucgccuggccuuuucccagguggacuuuggugcugugggaaggacucuucuagguuuuggacucucuaauucuucugcugaacccagugacuguguaaacauccagaggcccaccccacccaaagaaugucagacugaaaaggcucagaugucaggaggucaccugggcucagagaggggaagcuacuggcuggaagucagugauuugggucucagaaccagacccugaucuccugccucccuuccucugugacacucagagggacaaugagccccucuacccauugccaggcugcacgggccccaggauggcaggaauugcuaguggaugguggugcuggugauggugucauggaauaacggccagcgcuccauggagacaugaacuuaucccagggacugaggaauaggcuaucugcagucuugggggguggaggcaaguuggucccacauggaaaggaggaagcagguguguggguaagguggggaccgggucugaagccaggcuggcccuagcccuucccugggcagacacuuuccugucuuaucucucuguaaaaugaggagccauucauuccuucuucugccacgggcuauuuuauucauucauuuguugccagaucauuccuuuauucuuucauuauccauuaauuaguuuauugguuagucaucucaguaaucuacccaucuguccuucuaugcaauccuuagcucacccagcccacacuggacagacaugugagauacaaguguaguccuccagggcucuaaagccaacaaggaagaagaggugagacugcaggugcaugaagcacuagccagggcaguguuugcugagugccuccaugaguccccaggggaggucucucagagaauggaaagcuugaagacaccaaaggaguuccauaaaccaucacagugguagaccuggguccugagauuaggucccauugugucacauggcuucugugacuuucagcacauucuuucccuuucugagccucaguuuccucaacucuaaaaugggguacuuucugugaaucucucauggguuguugggagugauaucaagacaguguaugacacgucucccugcccuggccaggcauguggugggagcucaguacguacccacugaguuauaaggauugcugaugacuguccuaggcccugccaugaauuugagaaccgugaugcugguuucagaaugaggcaaaugaucugggcacccugaaagcccuggucugcuuugucauuccccugcugaaacuuuucuaauguuuccuaggcauuuauaagaaaaaauaucugaaguacuuucugggccuacaaggcccuuaauaguccaggcucugcccaccucucaaccuuggcuccccgcaucccauugccaccuccagccacacaccaguuucauucuacaccuugaauuuacaaagccugguggcagggccuuugcacauucccccaccaggacagcuuuucccugaguguuuacauggcuggcaccuucuuguuucacagguuucuacuugaauguuaccuccucagagggucugcuuggaccacuugcucuaaaauagcuuccuacucucacucucucacaucagcugcuuuuucuuuucucuuguggcugucaccaguaucugaaacccucucauuauucgcauuucuugccugucuacaccauuagaacaugcugaagcgccaugcgugugagugagcaggugguucuggugugguguggcuggggcuuuuguagaggugaggaaaugcuagggaguccagguguggcagcgcauugccugggagauaaaguuacacugagggcugucuucuccuuccucccaccccgggagacucagggcuguugucaggaaauaaugagaugauuaaaucauggaaucuaagaaucccagucucuuccagucucagagcuuuagcaucugagaagcuuuccagcucagaaccuuugacacuuggaaucuuaccaugauaggaugauccagucuuagguuuagaaucuuacaaaguggacucucacugccuuauuuagcaucacagagggcucgcuuugugccaugccauguucuaaaagccuuuauaaauauuaacauauuuacaggugaggaagcugaggcacagagguauuuagguaucauggagcaguugcugggauuugaaccuagcacucugggacuccuuagaaucccucaacuguugaggggaagcccaaccucacuugacccuugcacagagcaggaauccuuuucccacaccuuugucaaaagggccucugaucucugccaaaaaaccccccuccagugaacucccuccuaaccaggccaccuagcuuccugcugucagaaaguucucauugcuaguaagauuuucuugacaauguguaaagugcugcaccucccuugugaauaacgccugggaagugguguuagugucaugguuucccagugccuuugaccuuguggauuccugguuucaguggccucuuucuucccacuggguugugggaagaaaggcagacagccuugaggcagacagccucggugcauuguugaauguaagaaugaauaaauuggugcacaaagaccgcaugaacccucaggauuucugaguuccuaucucuuuagccuggugcucggcacucauccaggguaauuggucaggcuugguguacucaggaaaaggagacaccguuaucucuccaauaaagucuguaucugaugacauuuauguaugcaauucuuggagaaucaugugagaucuaaaaucaugcacuauucggagcgagguggaugucaucuagccaaacuucauucuacccguuggggaaacugaagugggaagggagaggagcaggccuuauccaaggccacgugcaucucugucugcuacccagaggccaacaggcugcugcugcaguaucugccuuggggaucaaaggcaggggaaagugcucaaugggacaguuacuucuucucuagugcagaagcuaccccuguacaaugggggcaacauuuuuggaugcacagggugugccuggcacuuggggggagauugaggaagccagcugcauugggaguugguuggggcuauggugauggggauggcuuucuagaaccuggggcuggaacugggcuuuggaggcuggguggaauuugggggagguggcugaauagugucuuuaguggauaagguguguagggaaggccaagggauuuggcucuggggccuaagggguccugccuuguucccugccucaugcauguggccacaaggguacucuugguggggucuccaccaucugggguccuuuucugaacuuugggcaaaggcuuuaggauucuuuuuuuuuuuuuuuuuuuuuuuuugagauggaaucuugcucugucccccaggcuggagugcaguagcgcgaucuccccucacuguaagcuccgccuccuggguucacaccauucucuccugccucagccucccgaguagcugggacuacaggugcccaccaccacgcccagcuaauuuuuuuguauuuuuaguagagaugggguuucaccguguuagccaggauggucucgaucuccugaccuugugauccauccgccuuggccucccaaagugcugggauuacaggcgugagccaccgcaccuggccggcuuuaggauucuugaggggacagucuaggcagccauuccagguucuggggcucugucgggggacaccugcuugagagggggcacaacccuucaacacacucaaauacauucauacauauucacacuauuaccuuuuccauuaccaccccugacccucccuccugcaccauccuugccaauguggagcacuccucugcuauuucagaaauaccaccacagguguccuaaacuggaucccuaggagccaggaguucaggaagcaugucugcuggagugugcaugcacacacgguaugcacaucacauaggagcacgugcaugugcucuugccacugggaggaccacauacccaagcguacaccgugcacucuccugggaaacagcacacagccacaugccugaucaucugcacauucucccacacgcaugguguucaucuguacacagcucuguucacucaggccuccuugugcacauguguguuuuuacauguagaugagucuugcaugcacaugcuuauuuacacuugagauaacauagccucaaauucuagccguugcgcagugugucucauacacacccuugcauucacaccugcaccuacaccuggccuggaucuacuggaaaugguggagccggcagcccguuucugucuccugccuucauucacuaguauuucuugagcauuuacuauauccaggcuuugugcuagaugcugaggauagaugggaggaaaacugauguauauaggucccugcccuagcggagguagacaggcacuauauaaaagaucacacaaaugaugauuuuuuuuuuuuuuugagauggagucucgcucuaucacccaggcuggagugcaguggcacaaucuuggcucgcugcaaccuccaccuuccaggcuuaagcaauucuccugccucagccuccagaguagcugggauuacaggcgugugccaccacacccggcuaaucuuuguauuuuuaguagagaugggguuuugccauguuggucaggcuggucucaaacuccugaccucaggugauccacccacuuuggccucccaaagugcugggauuacaggugugagccaccgugcccagccacaugaugauuaagauuagagauuuuggucacuauguugacugaugaugggggaggagcagagggaacagccugggcagagacccggaggugagaaauucagggacaaagagaaggugguggcacugggaccuagggaaguugcaggagaugaggcagcaggugaggcugagucugguggggccuguagccggucuucccuggccuguuccccgcgagccauuuguccaccccacacccuccccacuccuuucucugcccagcccagcucagccuucccuuugcugcuguggccugcuuggggccugcucugucugcuggccugcaccccaggcuggaggccuguuuggccugccccacaggcugccugccuuggagguccugggauauagcagggaagcaggcuucacugccugccagggguucccuguccaggaccccugagaccugucuagaaagcuccugggggccgggccagagccaggguccagcaguuggcuuuccuguuuuuaguuaaucucagaccuggaucuuugccagucagaagaauggucccuguggguccugaaggccacccagagcuacugccaccccccacccccuagauggcauuacuggcuggucagauuuccaugugggucuuuggaauguugggaaaggcucccuuaggccuuagagaaccuagcaacagcaauggcagcugacuguucaggaguccucacugugugucaggcaguguucgaaagauuuuauccauauuagcuaacuuaguccucaguacaacccauggagauaccauaaucauccccaguuuacagaugagaaaauugaggcuuggagauuuagguaacaaucccaaaggccugagcuggggcuaucugccuccagaauccauacuuugaacccuugagcugucacauuuccccuuuaaggguccaggagcccagacuaugauuugguugaaccccuucaccuuauagaggcaggaaaggaggcccagagagaaaauggacuugacagaggguucuguuaccucugccugcaccagaugcauggucuugggcagguuaguuaccucucugagccucauuccugaccccaaacaaagaagugaugaccauagaagcuugggggacacauggggacugaaauugagaaaggacccagggugagggcuucuuaggucuccugauacaugcuuuguaagugauuaagcuguccguucauguucuaagcaucuuucugaauauauguuauauuucaaaacacucacagcaucuaccucauggggucguuaggagccagagugagaaaugcuuguaaaguaucuuaaggugccuggcauggaggaagcaacuauuauuauuauugccaucaucauuucauacaagcagaaggaguucccuguggggauaggagcuggggguccccaggagaaauagaaguagggagggggaugugcuccaagccuguagaacauucucucagaacugagagagugucauggccccuucccuagaugagggcacugaggcucccagagaggcucaaccgcccucagugucucuggguagcuggaggugggaauggggggcccagagguugaggguguuggggagggggagggacagugaggggaaggggcaggcucccagcucccacugaccugggcacagacagcaaccccuccugcucugauuagcccugccaucacaaugaaaacagcccuucccagccccguggggcugcggaaacccggucuaauuggauccaggacccugggagccucuuuccuuccggggaaggaaguucccaggaguguguuucuggugcuggccaggacugcccaaagucuugagagugggguggggugcaguggcuggggcucaggguucuagcugcuuggaguggcagagggcagaggggccaugggaggcaaacuuugagcgugucucaggagccuaaaacaugagaagccucaguuucccucuccuagaccaucugcuuauccucuccaggccauccuucuggccccauacagcuuguccauugaaaaccuuggccauggcccucccuugcucagggaccucccauguccccccuauguucuuucaccggagcaccuuagccugcaacucugguccuuuaugaacggcuccagccaccccacccuucuucccuugugaauuccugcacuauaccccugacccacgugaugcugugugcuuuccugccucggggccuuugcacaugcaguucuuuccaccugccauacucuccuuuggcaucucccucuugcaauuuccccuucccccaucaguaagucccaccuuccugaagucuguucuucccacagugagaugaguucacccuccugagaaugcugccacuacccucccuucccucccagccugacugcagcaguagcuguugccccucucugggggcagggauuauguuugagaaaccuuugcucucccagggaguuaacaguuuuccagcuucugcacaugcugcccuucugccgcaguggcucuccuggcaaacucgucugucuucacggcucacauggaaagaccccuccucaucaauucccucagugaacaucuguugaguacccaguguauacuaggcacuugaggcccuacugcauggcuggcgcugggcucuggggcugcagcagugacggcugauggggagacaggccuaaagcauauuuaggugcaugguauuaauacaaaggugggguagggagaaggcaggggaccaugggaguguauaacaggguagcccaauuccuaugugggaaacgucaaaagugaccuuuaaguugagacaggagggaagaccugggugagcuguggggcuauguugggguagggguuguaacuaagaaccagaccaagcccugcuuuuggggagcccacagccuacaugggggacuggacaaauaaccagauaaccagacaguuccucaagguggugccagcugagcagaguuuugagggcaggguuccagcugggugguauggcucccagauggaggggcucagccugugcaaagccauggcacaucagaucaccuuguucugggggcccugaugcuggagggaugcugccaaggagcacaccuggugagaugaguguggccaggggaccuucuuggcgaaaacccgagcaucagacuguggaguuugaacuauaccccaaaagugaugggaauccaagaaggauuuuaagcgguagacuuagcgcccugggaaggcucuccuucggcuugguccuccccgcuggggccccuggaugggaccaggagucccuuccugacugcucuccuggcuggggucauggguggggcuggaggcuuuugcugugggacuuugagcaggccccugucccucccugagccccacucuccuggguaaacuugcagggccuuaggcugggguuuggggugucuugcuuugucaaagguugcuuaacuuuugguuuuauuaaaaauauucccuuaaaaagucacauaagaauacucuuccaggccuaucgccccaucagcugugacauggagaaaaaugagaaaacagggauaugaaauaaguaaaaacccaccucaucucugccccugcuccaagccggaagcaucaccacuguuagcauuuugguguuuucuuccccucuuuucucucagcacccaguuuuuauauagauguccuugcuccaucuauacaugcaguuuuuaaaaaucuucccauuuccccccugacuauuguuguaucacaaguauuuuuuuaaaugacugcagagugguuucaauccuuccuuuuaauggauccagugucaggguggagaguaugggcuuuagggccugauugucuggauucaaauccuacacuuaacugcuugacuuuaggcaaauuuccugaucucuuugugccuucaguuccugacaggccaaugugaguguuaaaugagucauuacaaggccaguaacauuagcuguuauuaacgaccauagacuaugacaccagguaacaugacuuaaacagaaccuguuuaaaauuucggcuguuccagguuuuugcugcuguaaaaaaccacugacgcaaacagcuuuguacauauaacuuuuucuauauuuuucuagggauggaugaccaagaaugggaucacuaggccaggaaguuuggacauuuuuagagcucuugacaaauucaugccagauuuauuucagaaaugauuguuacaguuuacacucccaccaauaauacaugagcgugccaauuucaccauacccucaccaguauuggguguuagcauuuucuuauuucuuuuuccuauuuugacagguuaaacucauugaauuuucacugcuauggaagcagaaccauuuucuguguuuauuagcuguuaacauccuuuuuggguuggcucgucuuuagagaacacacauagccccuucuugggucaauuaggaagacaggacuugggucaauuaggaagacaggacuuagacacaggaaauaguaaacaguguuaacacagaggacagcacagugccagaguggguggaggggacuuggaggagggggagggggcuuccuuccauccaggccacagcccuuucaguuccccccaccugauuauuaaguaaguaauuaauccaaacuuuuaucagguacugugcagggcuuaaaagauaaaugauucagccaugaucccuccccaucagagugcuugucuggcagcagagauggaugagcaaacagacagaacauggggugagagggguucugaugauggaaaggcaggguacaaagggagcagagaggagagcacacaguguagcucaggcauggaggcagagcaguccccgauugcuuccaggaagagguggccuguaagcuggggccugagggaugcauuggaauucacuagugaaauggggagggcagagagcaccagggagaggaugcagccuguggaaggugagaagggaagcagaacccugggggaacugugagauguucagucuggcugggcagugcaaaguagaacagccagagagauuggcaggggccgcacauguaaggcuuaagcaauccagaaauugucuggagggaaguagggagcuauggaggguccuaggaagggcaggguuaugaucuuuuauuuuauuaaaaucacagugacugcaguaauggaguggaggaugaggguggagugggggaaccugugagcaggcucuuacaacagcugaggccagagcugaagggggccuggaucagggcaggggagguggugcagacccucuucucuccccacccuguaggauccuaaucagcuucaugguacagauugaaugccaccucuuccggauagcccuuccugacacccacccuccaaguugugcuuugaggcugaggcugugcagggccuggcaugcaacagucaacugccugcccaccagcagcugacccugaccucccccugccccaugccucuggacccuccaucuguuccccgcacugggcuaccaacuacuuucuuucauuuuuuaagaauaaauuuauuguuuucauuaagcagcugaacagcauuacagagaauuuggaaaucagagaaacaaagacaaagaccaagauuggccccagcugccuccugccuugcucccagccucccucuggguguggcucccugaagcuuucuuuuucugacgcagguuuuuauuuuugccuccuuuguaaucauaguguccggauaguuuuggguccugcucucucgcauuugcuuugugaagagcuaguucccaugugaccauggggucugggcaacugucuucuuuuuaaagacagguucucacucugucacccaggcuggaguguaguggugugaucauggcucacugcagccucaaacuccugggcucaagcgauucuccugccucagccucucaaagugcugagauuacaggcaugaaccaugcccagcccagucaaaucucacuuuuuaaugucuguggguugggcuggggcggggguugggggauggccguaaguugcuuuacugaacccuucugccuugcaguggguaagucuugugacauuccucccugggcugccuguccucuuucuguccauuugucuaggucugaaagucuccagguggcagggccuggcaccugauguacaccuuccucaguacccccucccucaguuccccucucuggagcuugcugggcuggccucagagacacccuucugggacggagugauaaacagacccgguuucaaguucagacucagcucugugaccuaaggcaacuugcuuaaccucucuggaccucaguuuccucaucuguacaacagguuuauugugagaguaaaauaauggcuguaaauaucuugacacaguucccaguccauuggaaguggccaccuugggcuagaggcuggcagaaaugaaugagcaccaacccuacuugugaagaguuugaagucugguggggaggacacccgggaaaauauaacugcacuggagugcaguuggcccuguagugcugggccagugcugggcauccuaacuccaucacuuacuagcugugugauuuggggcaaguuggucaaucucucugugcugcacgugcaucucagagucauugggaagauucagugacaugaaucaugacauauucaacacauagauguugaaaucaaugguagcuggcacuuuacuauuauuauuauuguuauuauuguuauuguuauucccauauacaaggugcuguugggaacacagaggaagugacuggcuggggguucagggaaagcuccguagaagagggaacacuugagcugggucuugaaggaugaguagaaguucaccaagugggaaaggacacucuagguaaggagccugugauuccagguugcacucugucaaugaggguuuguucuuugggggauuaaagcauuguguucgucccaccuucccugagugcccccgcugcuacccucugggucugcccugggggaggugugugcuuacccuccuguagcggccuccugugucgugguggcuguggguuccuccucacggcagcugcuggguccccaucaguccacauuuggggccacaggucuguaucugucauuugugucuggguuuggugcugucuguccgcauguuccuguggcuguguuugucagcauugguaugcagugggccuccugggcuccacugugggggucaccuugcaugcuuccuuggccuccagcuucaggccucuuuggccgcucuccucccuggcccaggcgcagccccugccucucugcucugcuccccaggggccucccacugccucuucuccuguccuuucuaguccccucuacauugggcacucagaggggccuuucucaaccacagauucugucccaucacccacugcuucaagucuagccuucaggccuaggagucagggagcagccuuuaaggucuggccccagcugcuggcuccagccucaucucccaucugccaggcaacaccgaacgcucguggcuccccucacacuguugggcuccucgccuggggggccuuugcucaagcuguugcuucugcugggaaugcucccacuucuucucugccuggcuaacucccacucauccuuuaagacccaaggcaggcaucaccuccccugggaaguccucccugauccucuccaggcugggucaggucccuggcucugggcugcuaaucccuuacauggggggcaggagcaagugccuugcccaagaucacacagcuggugaguuggaguaaagauuggaacccggguauguugggcugcaaacagagcgggcuguuccacaguccuggugaggcgacaguggcugggacuguuggagaagagugggugggcuugagagagauuuuggaacuggaauccugaggacauggcugagaugggugugaggugaguggggagggagggcgagugugguagaucacuuugugucugcaggagcaucugggcagaugugugguagaucacugugugucugcaggagcaucugggcagaugugcgguagaucacugugugucugcaggagcaucugggcagauggggaugucccgcugugagcugggggugaccagaccaggugcauggcauaggggaagacuaaguccagcucaggccugcagagucugagcagcccaggagucggccaaagggacugucagggagaggccuggcuggagguggggacuucgggcuuggcugguauuuagauucuaaagugguugggccacccagggaacugaggcuggugggagagagggggcucccgcucuguccugaggagcugaauugguggggaagagaggcuagggacuguaaaggaggcugagaaagugaggagccaggugucaugguacacaggccuucuccaaggggccagguggcagggaggccauggaggacaggacuggaaggugggccauaagcuuugaccucagggaggccacgguggugugugguuggccuuauaggugagaguucuuugcagaagcuuauggcucacuugucugcuuccuucacuuagcuuggggcucggggagggcagaguucuuuccaguuggcucagguuccccagcgcuggucccaguuuggcccagaggauuuguccaauaugaauggauggacagauugauagaugggccagcugccaucagcaggccguuuucuggaaggggcguuucguucauccgcccauccacuguuuuucaccuuuuagaauaagagaaacaaaaugacauuugcuccccuguaaggaucagcccugugucuuggggcucacaguagagagucuuggcuuuugucgugcuugaggccuggccaccagcguguuuccucugcccauucugguaugcacacucaacccccggguggcuguucugucuccacccccugcccucaccagguccucagauaguccccucugcuucacugcuccccuggcccagcaugcuuccugccaccuucucaccaccagcauuccaacccaacaucuuagcauggcauucagugcccugugucuccccaccucccuggucugcagcucucuuuggugucuuugggugcuguucacugucccaagccugccuugugcuuucacaucuccacaccuuugcugaagcugugaccucuuccaggaauguccuucugccuugucccucuguccugaacacacuucuggccaugucucuuucuggcuucaagccccucccuuagacaaggucugaguggcuuggccuggcccuggcugucuuaccccuucaccucucaccagggcccacccucuuguacaggucccagggcugcacaggggauacccaccucaaaggcauguugggagucucacaugagaugcuguugaugagcaccuagcagugugucugacacgcaggaagagcucaggaaauguuuggccccugcccugccuucccugugccugucacacaguagguagauaccaggacuagggucacugacugaaucauuaaauuacuuagaaccagccagaaaaugaugcagagaaaucaggcaaaggugguguggaucagauuaagugaucuggggcccaucuagggugaaggguggccccugccugaccaggggucugauaaguggcaggauguucuaucccagcugugguacccugggcaagacccccucuucccauagccuccugaucaggguaguggcucugaacuuggcauugaacugaacugaagaggaggaaaagacggaucucccagaacugucugagaagcagcgaggugcagugggcagaguccugggccagggcaggagugaggcaggguagccuguuucaccccauuuuacagaggaggaaaccugaggcuuagagagcuagcacccagcaucacaucacagugcugcuuccuguuucucaugcauguggccugagcaaggugccucccuccuggugcccuuguuucuuccuccgugaaaucagggugaaaauucuuccuugcuugccauccuccugagguucugaugagaaugccagugggcacagaagagcuuuguaaacugugagcagugcuagauaauuguaugggauugucuuuaaagucauucugauuauuauuacuucauuuauucauuccauuaugcaacucacauuauugauaaccucugggccugggugcuggggauacccagaugaacaggacagguguauccaauucucaagcucccugcccccagccguggagccuccuuacccuggcuuuacaucucgguccccuccacauuucccccuguggacaguagcaggguugggacagguccugagacugcugugugagcgggugcucaccuguggggucgcagccgugucauccuaagguaggguuuauucacaagccuguggucaggaugcgucauuccccugaauacguaagggacugaugagcuggacuucagagucaggcagauuagagugggaaucucagcucucugcuuacuugcugugugaccuugaacaagucacuccaccucucugaauucaguuuccugagcuauaaaaugggaaugauaagaguaccuaccugccuuucagugucauugugccuggcacaagagaggcacuugguaacuugcagccuccucaccauaauuauuguuucgaguuuguucugggaaaggauaugucccaggggucuggagcauucagggagaacuccaggcaggaaguacuucuuguguugggcuguaagggauuggugggcagagggaagagcaucuuggugccuguggauggaggagcaggggggcugauagagggcaggagcugccccagccaccugaggagggugcucugacccaaacuggcccucaggcugggagugagggguaaggacauuugcauauagauauugagccauuugcauaugggcauuugcucuuccaaagacuaggguuugcaaagcaaauuccccagaggaaccagcuugagcaaaucugauuucuaguuuugacuguggcaccuucgcuuuguggccuuggacaggucuccuccuuccccucucucugagccucaguuucuucacugauaaaaugguauaauaauaccucuugugccuacuuucaaguaaagaucacaagagauaauucaucuaaaauuucuuucuuaaaauauugagauuagauuguguccuuauugaggguuuucucccgaagcccuauagcuaccauuccaauagggguuucucaagcucauagaaucaggaaaagagguugaaagcacuucauuuuggucuuuccugucaaaauaaacaauuucauuuaagcaauaauaccaguuaggcaagugauuucuguaagagagagauacgagaaacuugacagggagcaagacuuaauggaaacccucugugaggcauggucccuguaagucacuucuugacuuacucuaggguagcaggaagacaaaccuucuggaagacugagauagcccugaaggcccauccuucauacugcccugguugaaaaggccuucuaaccgcacaggccugccauggaacuugccagaggugagggccaccagacaguuugucacacacuuuuaccaaagagccgcagacugcccuagcuucagccucuucagcccccuccauaaccacagcauucucauccacgucguuguaggucagauguugcacgugacauugaacaaccacacguggccuguuucuugaagauaacuuuccagaaguacaauuucuugagucaaagggcaauaaucauuugggucacuguaaauuguccugccaaacugccccucagaaaggcuauaucuggugaccucauguugcccccugauuuugagaaggauguccguacucaaggggucagggggcagaagagcagggaucagggaugggcauuuacaaauuugcugcaguccuccccaguuugucucuggacuuggggggccuucuguauggaaccuacgggguuggcacagcagccuggggcccuccugggggauggagauugguuggccagcacuggggugauaggggugggagcugguugagaguacucuggucuggaugugaccuuugcccuauggggcccacuaaggggggguggugggggugucacugaauuccagguuuuucagccuggagauguggcuuccuggccuggugggaggccugcugugcugugaggcugggggacccacggggacauggaucccagacacuggcccugacuugagugggcgcagcugaggggugcucgccccaggccuuggggagggcucucuucccggugacagucgcucucuucccgcaggauggccgagccucgauuuaacaaccccuacuucuggcccccuccucccaccaugcccagccagguaagacugacgucgccccuccggcugcccuacccuccuuggcgcugcuucgcuuccccuggguuuuggcuguggccugcggggagcggggugaggagcgaggggcucgcggguggaccagcgggccugggcaaggggcgggaggugguccagaccuccucagcccguccucuucuucccgcagcuggacaaccugguucugauuaacaagaucaaggagcagcugauggccgagaagaucaggccgccucaccugccgcccacgucggccucgucgcagcagccguugcuagugccgccggcacccgccgagagcagccaggccgucaugucgcugcccaagcugcagcaggugccggggcugcauccacaggcggugccgcagcccgacguggcgcugcacgcacggccggccaccagcaccgucacagguaggccgagcgggcggggccggcggggccggugaggacugggcaggagggggcgggcguagcgggggacuuggugaggaugggacccggcuagguaagagcagggcgggcagggccuagggguagggcauaaagcuuggaguggcgggguuggccacgacgagccacagcaccggacuuccaacgacccaguacuggaaggacccuucuccccccaguggacacgacaggagccggucacugccccauggggcucaccaggaaaguuagguucacauagagaacuuuggaaaucacgagauucuuugggaauccagagaacgacccugaccagauuuaggggguaagagaagacuuccuuggaggagccaaaaggcgaggaaagguuggcagcaaaccagggaaaugggacaggaagagggaaccgcacaggcggagggaguauguguguaggaagcaagaguaggacagaccgucugggguggggaggcccggaagaugguggugaugacagcuagcuccagucgagcgccugugucuguucaccaguguucauuguacucccagcagccugugaggugugugcuguugguauuagguggaacacuggaccguuuugacuuagaaaaacagcaguuucaugcaguucaccuuaaugucucuauucaacagaugaggaaacugaggcagagaaagguaaagccacgugcaaccacgguuuacagcuaguaagaggcagaggccggcaguguggcuccagagccuguaucuucacucuguuuugaugcugaguucugcugaggcuucgaggaagcagggaccagauuaaaaagggcccuguaggccacacagugguuuggacuugacccuugggcaguggggaaccacugaagguuuuuaaguaggggaggaaacacucagauacggguugagaaaaccgagucuggcugcuagguggagacccgguugucaggggguaagcauggaagcagggagaccuucaggagugugguggccugggcaaugccgugguagugggaauggagagaaguggacagauaugagauacauugugggagaagagaggacaggauguaggagcaugaggggagggaggaggugagggagacucccagggcaccgcccuugugauggaauccccggagaaagaacaggguuggggaaagaugugagcucagucuuggauagguugaggcuggggugccaggcggacauccugggauaaugucaaggggcuggagccaccggaggccuccucggagcuugguggauaggcuuucuugggagaccucagugguugggccuuuguuccuccccugucgccccugcugcuaggcaggugcuucugccucucuccuucucuccugcauuuucccagagugacccaagaauuacagggccugguaaaccucuccaggccccagccgcacucuguauguccccuguuauuaugauuuuauuaaauuuauuuuuuccauuauaaaaguaauauuaaaaaguaauauaagcauauuaagggaaauuuggaaaaaagagaaacuagcaacaaaaaaaucauucauaauccccagcucccaacugagcagcucagagaggcuguugguccauuuccuuccuuugccauauuuuuggcuuuucaauguucauguguguuuugcugagcuugugguagggcuguacccaugauuuuaacuugcuuuuccuacucaccauucugucauaaacauauauguuccacuuuuuauuauaaagguaauacauagucauuauagaaaauuuggaaauugccgauaagcugaaaggagaaaaaauagccuuaauccuacuauuguuaagaauuuucauauguuuauaauuuauuuuauuuuguccuuuaaucacagauguuaaaaauggauaaauucaccagguaaaagauucaaauaauacagaaucagauagacaaaguaugaaaaucuccuuuuaccaaaaaauuauucucuuucccuagagagaaccacaauuagcaguuugaugugucuccucucagaucuauuccugugcguuuacaugcacauauaucuuguccaaacuacguauguaguuugaguguguguucuuuaaaauagauggccucguaugucugugauuugcuuuuuucaccugacagcucauuucgaccuucucucugugucacuguaucacaucgaucuuguuuuaguggcugugcaguucucccuaaugagaguggaccacagcucuuuacaaagcucaugcugaggacaaacagguuguguccaauuuugucugaucacaauuuuguauggauauguacacacaucuuugugcucaugugggaauauuucuuuauuguaaauuucuagaaguagaauugcuuggccaaaaguuguauacauuaaaauuuauuuaaauuaauuauuuuuuuuaagaguagggucuuguucuguuacccaggcuggagugcaguggugugaucauggcucacugaagccucgaccucuggggcucaagugauccucccaccccagccucccuaguagcugggacuacaggcacacgccaccacacccagcuaauuuuuguaauuuuuguagagacaggguuuugccacguugcccaggcuggucuucagcuucugggcucaagugauacuccuaccucagcuuccuaaagugcugggauuacaagcgugagccgccgugcuuggccauguuuaaauuuuaauggcuguugccagacuacccuucauuaacauuaaggcuucauuaaggcuuugcaaauguacacucccaccaccaguguaugauauaaaacauucuccugccaacuugacauuaucuuuuucaaugcacaaauuuuuaguuuuuuuuuuuuuaaaaaaacauagaaccacacaauagguaccauuuucaugauuuuguuugcuucaguugauauuauguuucuaguccuaucauuuuuaaaagaauaacuuuuauuacagaaguuuuuaaaacgcucauugucaaagaaucaagcacaguuaagccucuuuuuuuuuuuuuauuacuccugaucuacuauccauaucacauuuuggcacguucuuuccuacuuauuuuuuugugugcauacauacguaguuugcuuaaacaaacauaaccuccuuuucaaugggcaguucaguagaggcaauuaauugcuguuuaccgaauccuucccuaauguugcauauuucaguugccucuaaaauuuugcuguuauaaauaagacggcagugaacuucuuugugccucaguauuuuucuauaguuugaauuuuuccaaagugccccuguuaucuaacucaauuuaaucuuaaggugucuaaggcaucuuacacaugcacaaggucucauuuaguuaccccuggguaauaacuuaugaacguuaaggggaugcucgccugccaaaaucacauagcugggugggcagcugagcuggccucugcagcuccgcucaccccugcccccacccaccugucuucgcaggucuggggcuguccacccggaccccgucugugagcacuucugagucaagcgcgggcgcgggcacgggcacggguaccagcaccccguccacacccaccaccaccagccagagccgccucaucgccucgucccccacccucaucucagggaucaccagccccccucuccuggacuccaucaagacaauccagggccacggccugcuuggcccccccaaguccgaacgcggccgcaaaaagaucaaggcggagaacccgggggguccgccuguccuuguaguccccuaucccauccuggccucgggcgagacugccaaggagggcaagacguacaggugggggucuuggcgggaugggguccgagugggcuuggggcuggggcuugagccagggcugcuccaggagcccagcagcggggcugaaacaggacccuuagggcugaggggcagggcuaggguccagaggggcggggccuucuggagagccccacccacaucccaagucccaguucggggagggcugcuggggaggggaauagaggcuuggacccuuagguguggucuguggcuggcagccacccccacagccugggguugugagagucgguuuccuccucccuuuaagcaguguucucaacccuggccaccuuagaaucaccugaagaggccgugcacaauggcucaucccuguaaucccagcgcuuugggaggccaaggcggguggaucaccugcggucaggaguuugagaccagccuggccagcauggugaaaccucgucucuacaaaaaauacaaaaguuagccgggcaugguggugcgccccuguaauccuagcuacucaggaggcugaggcaagagaauaacucgaacuugggaggcagaggcugcagugagccgaggucgggccacugcacuccaaccugggugacagggugagacucugucucaaacaacaacaacaacaacaacaacaauuuuaaagaaucaccugaagagcuuucagaaaaugcggaugccagggcugcaucuccaggaauucugaguuaauuuucugaggauggaaaguauggaggguggggcaggcguugguauuucuuagacgcuccccagaugauucuaaugagcagccugguugagaacuacuucacgugguagcgccuccugcccagaaccgugggauauagcccugggcaaacccucaccaggaucaggccugucuucccuaugagguguaaccuaugcuccaggcucuguaauguucccccaggcaagagcuuccuccuccagauuuaagggugcccaggcugggagacuguccccugucuuucccaggugguccugugcuucuugggcucaucacaggaaagaccugucccaggugcaaggucucucugauguagaaggccuccccugagauggacagucugggggaucuucccacgugaaccugucucuugcuccgcagguguaagguaugcccacugaccuuuuucaccaagucagagaugcagauccacuccaagucgcacacagaggccaagccccacaagugcccgcacugcuccaaguccuuugccaacgccuccuaccuggcccagcaccugcgcauccaccugggcgucaagcccuaccacugcuccuacugugauaaguccuuccggcagcucucccaccuccagcagcacaccaggugaguggccugccugcugcccugcugcagcccgacucagcucagcacccguggccuggcacauggagccagugcaaggaggggcaaggaccuucuccaggugcccauugcccucggggucacggcccuuguggaccucacuggccucagcuguuguuacugcaccccguccccacuguuucucaucucuaggucuuugcacaugcuguguccuuuaccagagagacaccccucucccgcuuuucccuguuucucuggccauccccuuguccucucucagucuagcuuccuccaggaagcccucccugauugcucuagcugggugagggacccgaccucuguguccccacagggcucugugcauguccaucauagcagugguaggcugucacgcccgugucucuuuaucugcccaccucacucaaucuacugggaguucuugaaggcaagagcucagucuccuccauuuccauauccccaguuuguggcacaaaauaagcaauuauuaaauauuuuggaauaaauauaacugguuuuuacagagcauaugauucauccauuuaacaaauacuuauagaaacuuuuacucuaugccagacacuauucuagauguugaggauacagcaaggaagaaaacagacgaaaaucucugccuucguggggcauacagucuaguugagugugugaaagggagacucaaagcuauaaaugcuuuaagaaaaauuuguggcugggugcgguggcucacaccuguaaucccagcacuuuaggaggcugaggcggguggaucaccugaggucaggaguucaugaccagccuggccaacguggcgaaaccccaucucuacuaaaaauacaaaaauuagcugggugugguggugggcgucuguaaucccagcuacuugggaggcuuaggcaggagacucgcuugaacccaggagauggaggcugcagugagccgagauugcgccauugcacuccagccuggaugacaagagugaaacucugucucaagagaaaaaaaaaaaaaaaaguuugugcaggaggguauagacaucagaaagacuggcucaccaaauaaaaauaccauugguauuuuuaaaaacaagccaaagauuaccaagauugcagucccucuguucagaggggaagcagcaccguuuucucacaugacgaugaucaucugugugagcauugucacguguuugccaauaucagcauuguaaaagucagggauaaaacugguuuuuguuguggaguuuguaauuuacagaaagaauucaagguuuuuucuguuuugaggacuaauacuauacagaagggcucuauuuuuuugagacagagucucacucuauugcccaggcuggagugcagugucaugaucucggaucacugcaaccucugccuccucagcuucccaaguagcugggauuacaggcgugugccaccaugagaagggcucuauuuuuuauuugcuuuuuuuguuuuugucauuuauucguuuaucuccauugucuuugaauccuuuaucccugggugcaagauguuuuaccuugucuauuucucugacuuugggacaugauauguggguaugauaguaagaaucaaauggcaggcugggcucaguggcucaugccuguaauucuagcacuuugggaggcugagauggguugaucacuugaacucaggaguucgagaccagcaacauggcaaaaccccauugcuacagaaaaauacaaaauuagcugggaguaauggugcaugccuguagucccggcuacuugggaggcugaggugggaggaucgauugcuugaacucaggaggucgaggcuucagugagcugaugucacaccacugcacuccagccugggggacagagugagacccugucucaaaagaaaaaaaauaauaaaagaauaaaaugguacaauggcagcagggccaggugucagucuguuuucucguuaccaugccucccaaggcacaagucugaccauguaaguuaguuucagcaauuuucugauuuuguugcuacuuugauuuuuaaaaaauuuggccagguuuauguacagagauguauguaacaagguguugauugauaaaguccucccaguuguaugguucuuaaagagcauuugauagaaaagcuugagaguuaacucuguuaggagacuuuguaaggccuccaggccagaauuguguauguguguauguaugugaaaaaauuuuauauuauuagagaucaggaaccuagaaccauccaauucaccucugccagauugugccuauacaacguguaauguggcgguuacccuuuuuuuggagaaucuucguuugucaguguuucugaacaagcagagauugaugucuuuuuauaaccuuaaaggcugaaauuccacaagccauaagcagguccaguccgguuuccuggaggcccggggaggccucauucccacuuuugaagugcaguccuuguuucuuacucucaggcuugucaugccuaauuaaaugaaauuugucuuuaacugugacauuucuggcacagccaugguuacaaauuugauuuacccaauuauauccuguuaggaaggaggacagauucuuacagauccuguuuacagaacuaaugaucguaaaagaaaagggucucagcaaagguacuuugaagaguuuuuagcuauuauuccuaguaguuuuguagauaaggccaauuacauuuguuguuuucaauagaaugauuauuugaacauuuccuugaugauuuauuauuucauaucuauguuagguuuuuauagucccccucccacccucacccccagaauucugaagaguuaguuggaagaaggaagaaggcaccauuuuaggaauauuuuauuccaguuuauugaauacagccuccuaaauugaggauuagcgacaguaauaaagaaaaaaaaagaccuuuagaaaauuagaacauuaagggugaaaucaguuucauccaguccuggggaaaaauuccuguuccucugauccuggguuaguuagccugcuuucaaaguuaucuacuucuggagcaaggacucuuggagccuaccuuggccucuggcagugucuggucaagaagaggaugucaacguggcagccuguaugcauuugucuuuucuagcucaaagcagaggccuuuaauuaagcaagugugaggguaaaaaucagaccuguugacuagaacaaaugauucugcuuaguuaauuguaauaaucaacaauaucacaauggaggacaauggaguccucuauuaagguauaaucaugaucaauuuuucaaauuaaaaacaugguaggcuggcacgguggcucaccccuguaaucccaacacuuugggaagcugagacagguggaucacuugaggucaggaguucgagaccaaccuggccaacauggucaaacuccgucucuacuaaaaguacaaaaauuagccgagugugguggugcaugccuguagucccaucuacucgggaggcugagacaggagaaucacuugaacccgggaggcagagguugcagugagccgagaucaugccacugcacugcagccugggugacagagcaagaccccaucucaccaacaacaaaaaaauguuauuggcagcaagcgcacuggcccaucuucagggucuuuuaaucccauaaagcauuaucacuaauuguuuagggcauucuaaaucuagagacaaaaucuucuuaaagaaaugucuuuguugaugcuuguuaugccagccucugugcauuagauuagguuuuuuugguccaucuuaaaaagugcacaagaacauauuauauguuauacauauuauauguuuauguauguauaaaauuaacccagggagguugaguuucucuuuuuauuugccaacuuucuuacgcuacaaacuuuguagggcagcugucacucuaguguuuggcuaauuaaaaccauggagaauacauaggccgggugccauggcucacgccuguaaucacagcacuuugggaggccaaggugggugaaucacuugaggucaggaguuugagaccagccuggucaacauggugaaacccugucuuuacuaaaaauacaaaaauuagccaggugugguggcgggugccuguaauuccagcuacuuaggaggccaaggcaggagaaucauuugaaccugggaggcggagguugcggugagcugagaucgcaccacugcacuccagccugggugacagagcaagacccugucucaaaaaacaaaaaaacaaaaaacaacaaaaaaagaagaauacaaaacccaaucauuguaagcaucccuccuuuuguaaaacaagggagcaaaucuuugguguugcccagcagccgucuggaaaugccaagagcaauuguauuugcauuugcaccuugacaauuuuaucuuucugaguggggaccuggaucugagaaaggcgacagcacaaaguugacagaacaggcaagcuaauaaacacaagagcaagugauaauaaugaugaagaauucuguuuuuuuuuuccaagaaguagacuuuguuuaaaaauauuauuugagaacaugaccaaaaaaaaagcaacaaaaaauuaacaggccuuugaaggagaggagaauauuuugccagaauguucuuugacucagggauuauucuccauuccugagggcacaauuuuuuuuuucccucucucucucucuuuuggacuaauuugaguucauaauggcaggaaaccaaacaaacaacaaaagaggauucuaucaacauuuggaagacaguuuauaagucacuagacgcuugcacauauaauuaaacugauauguccuaacucaguggcaaagaggcgagugucccacaugcccagaacucccaggauucuuuagacaaacaaacaaacaaagccaaagcugaagaaacaaccagauuccagauuccuuguccucugcuauuugacggaggcccuuuccuacuuauuugucccuuggcagagaaccaggcaucagaucauauaaucaaauccaucuucccaauguuacagccacuaaugaagggcauaaaagaaggucauguccaaaacagagccagccccggucaagcaauagagguagaguuagcaagagggcaagcaagauccacccugggaguugagaagguugugcuugggagcauggucggagugaggcgguugaguggcguuggagcaucuuaauuggccugcagcgugaaaggaaggcacaagcaaagugagggacuugcaaaguguugaacaaguccaggcuucagaaggaucagcccucuacauaauaaacaccacauggauuuauagagaaaauagaacauuuucuguucuuguuagucuguucaugguagaaaaccagcauugucucgugcaguuaguguauguguaagggucgucuguaccugcagauaucacagugugggagucagggcuugagaccaggagucugagacuggccugggcaacauguugagacccaucucuacagaaaauuaaaaaguuagccgagugugguagcauguguuguagcuccagcuacucaggagacugaggugggaggauuccuugaacccaggagguagaggcugcagugagcugagaucacgccacugcacugcagccugggugacagagauccuaucuaaacaaacaaacaacaaacaaaccaaccauuguuuugggaggaaguuaaguuauaggaaauggcugaaaguuuuaucuauuuguggaacuagaacuagacagagugacucuggauuugucuguuuauucagggugcaaagggguuuuguuuuuguuuuucuuuuccugacagagugauguuauguacaugccuaaugaucauugcagcaggggaaaguguccuuuuaguuuuuucaagucugauaauaaugcuaauaacaacgacaacuauuccuuauuaaagaacuucugugugccagguccugcuuaagguguuuuaauauacaagguguccauaaaaucccuguacagugugaauuuguuauuucuucauaagagauaaugaauuugaaaaaugccacagagggggaauccucucaaggaauguuuaaccuucauauaucuaugaccauuguuuuaguuaaaaaacacgacaugccaaaagccauaucauggcugagaaauaaaagugauaauucaugaauccuuaauaauuuuauugaaacauugaauacguuuccucuguuuucauaaguugcuuaacuuaaauagaaauuaauguauuaaaaacuaacacugcaaaaauauuuuaugaacacccauuaaauucuuauagucuauuauccccauuuuagagagggggaaacugaggcugagggaggcagagucaccugccccagguuacccggcuaagagguggcagaagcaagauuugagugcagagcaccaagaagcagcccaguucagaaagaaggaagggcuggggcaucaggcugcagaagaagcacuuggggauggcagugccaggcaagagagaagagcaagucuuuggagccccugggugggacugggacaguggggggugaagugggguaguccagggccacuagcuucagcucagcuuccuugugcugccuaaagaggagugaccaccagccgggugcggugguggcucauuccuguaaucccagcacuuuaggaggcugaggugaguggauuacuugaggucaggaguuugagacuagccuggcugacguggucuugaaccaugguggucuacuaaaaauacaaaaaaauuagccgagcacaguggcacaggccuguagucccagcuacuugggaggcugaggcaggauaaucgcugaacuggggaggcggagguugcagugagcugagauugugccacugcacuccagccucggcgauagagcgagacucugucucaaaaaaaaaaaaaaaaaaagaagcgugaccaccuagagucagggguggacuucccaucgccgcagaugugggagcuggggcugggugcuccccuagugggaagaugcccuacagagagaggauucugauguuagaauugagggcuuaggcuugacuugaaguucagggacugaagacaagagcuuuguggcuaaaagaacagguagccugguccuuccuuauccaacaguugcucccugaagcuuuuucugagccagccccaugcugggugccaugcacagggacacaggagcgggcagaggcaggccccugccacugugaccuaggaggauggcagauguggaaacuuccuugagagagggaaguaggagguggagguugcgggggaucaucuggguugaguacagagggguccacagcccuccccagucagaggaagaacgacaugagcaaaggcucgaggcccgccgggaggcugcaucugcauguguguugggggagguugguaagaugcuccucucaggagcgcaguggcagaggaggaggccuuagaaaccaaggccagaaugugaagggccuugcaagcuggggaaggggauauggacucuguccuggaaaaagagggagaccauggagguugccagacugggcugugaccaggucagagcccugcagcuucagccgugccgaggccuggcggagagaggcugaggcugggagucaagggggaggccgggcaguuguugcacgugcaugggaggaggccagaggggcaacuuacuggucaagagggcuuggcugguuccugaggaaggagcugaauccacuggaggacugucggucagucagugagcaaacccucaugaaauacacccagagcauggaagucgcugauaauguggaaccuauuucucuugucaaugauugacuucagggagaaagaacuugcuuuccuucauucagucugugucuauuuauggaauccccucugugcugagcccaugccaggcgcuggggugaugguggggaaugagcccaagggaguuccucugaaggaacacagugaccagacauggagaaaauaaguacccaugcagagacuucugggaagccgaugucuuuguuuccugcgaggugggccgcagggagccugaccuggucuagggggucagggaaggcugcccugauaaagggacuuguaugcucagaucaggaguuggguuuuagccagguguuaacugaggaacagguguuccugguagagggaacagcuuggauaaaggauuggaggugggcaagggcucagugcuggaggagcuagugcaaggccacuguggcuggguggguuuuuuuuuauuuuuuuauuuauacuuaaaguucuaggggacaugugcagaacgugcagguuuguuacauauguauacaugugccauguuggugugcugcacccauuaacucgucauuuacauuagguauaaccccacaacaagccccggugugugaugguccccuuccugcaucgaaguguuuucauuguucaauucccaccuaugagugagaacaugcggcguuugguuuuuuguccuugcgauaguuugcugagaaugaugguuuccagcuucauccaugucccuacaaaggacaugaacucaucauuuuuuauggcugcauaguauuccaugguguauaugugccacauuuucuuaauccagucuaccauuguuggacauuuggguugguuccaagucuuugcuauugugaauagugccgcaauaaacauacgugugcaugugucuuuauagcagcaggauuuauaauccuuuggguauauacccaguaaugggauggcugggucaaaugguauuucuaguucuagaucucugaggaaucgccacacugacuuccacaaugguugaacuaguuuacagucccaccaacaguguaaaaguguuccuauuucuccauauccucuccagcaccuguuguuuccugacuuuuuaaugauugccauucuaacuggugugagaugguaucuuauugugguuucgauuugcauuucucugauggccagugaugaugagcauuuuuucauaugucuuuuggcugcauagaugucuucuuuugagaaguaucuguucauauccuuugcccacuuguugaugggguuguuuguuuuuuucuuguaaauuuguuugaguucuuuguagauucuggauauuagcccuuugucagaugaguagauugcaaaaauuuucucccauucuguagguugccuguucacucugaugguaguuucuuuugcugugcagaaacucuuuaguuuaauugggucccguuugucaauuuuggcuuuuguugccauugcuuuugguguuuuagacaugaaguucuugcccaugccuauguccugaaugguaaugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuguuaaauagggaauccuuuccccauuucuuguuuuugucagguuugccaaagaucagauaguuguagauguguggcauuauuucugagggcucuguucuguuccauuggucuauaucucuguuuugguaccaguaucaugcuguuuugguuacuguagccuuguaguauaguuugaagucagguagcgugaugcuuccagcuucguucuuuuggcuuaggauugacuuggcaaugcaggcucuuuuuugguuccauaugaacuuuaaaguaguuuuuuccaauucugugaagaaagucauugguagcuugauugggaugacauugaaucuauaaauuaccuugggcaguauggccauuuucacgauacugauucuuccuauccgugagcauggaauguucuugcauuuguuuguauccucuuuuauuuauuuauuauugagcacugguuuguaguucuccuugaagagguucuucacaucccuuguaaguugaauuccuagguauuuuauucucuuugaagcaauugugaaugggaguucacucaugauuuggcucucugucuguuauugguguauaagaaugcuugugauuuuugcauauugauuuuguauccugagacuuugcugaaguugcuuaucagcuuaaggagauuuugggcugagacgaugggguuuucuagauauacagucaugucaucugcaaacagggacaauuugacuuccucuuuuccuaauugaauacccuuuauuucuuucuccugccugauuccccuggccagaacuuccaacacuauguugaauaggaguggugagagagggcaucccugucuugugccaguuuucaaagggaaugcuuccaguuuuugcccauucaguaugauauuggcuguggguuugucauaaauaguucuuauuauuuugagauacgucccaucaauaccuaauuaauugagagauuuuagcaacaagggcuguugaauuuugucaaaggccuuuucugcaucuauugagauaaucaugugguguuugucguugguucuguuuauaugcuggauuacauuuauugauuugcguauguugaaccagccuugcaucccagggaugaagcccacuugaucaugguggauaagcuuuuugauguguggcuggauucagucugccaguauuguauugaggauuuuugcaucgauguucaucagggauauuggucuaaaauucucuuuuuuuuguugugucucugccaggcuuugguaucaggaugaugcuggccucauaaaaugaauuagggaggauucccucuuuuucuauugauuggaauaguuucagaaggaaugguaccagcuccuccuuguaccucugguagaacucggcugugaauccgucugguccuggacuugguugugggguuuaaaacaaaggcagugugaguccuggggacccuuaaggauuaggugauggggagccuaaguaaacgaauuccccagcccuagagagaaugaggaugggaugaagugaagaggaugcuggccucaggcggaguugguccagaugacccuuaagguccuuccauuguagagacggugcagcagccugggaugggauccugaaacaugugacauccagaaaugugcaggggugcucagaacugggucagcccagcuucucuuggcacagcuguuguggaaggccagaccccaggccuugauccugagacuggggcccgucccugcccucgggauuccccaucuagcaggggagagaagugugggaggccuugagaguccagugggguuggcucuguggugaggaaugugcucuggaagccuguggggugagcaguucgcucgggagauuccgcagagccccacucgccaacgaaucuggaaggaugagcugacauuuacugggcaaaagagcuggggaggucccagugcugaggaugcagacauagcagagguguggggagacuuaucagacauggcuggcagggaagaaucauuaucugaccaggacguagggugcguacgagcagggaggggaugcuggaccaccuggugaaggcuugaaugacauauaaggaauuuggacuuugucaguguuuauaauggcagccaaugggcuuauugguagcagggaguguuucuuacucaacccugugucucuaagucuaacacugggccuggccagaggggcuuuaguuucuuugaugaguuuguugaugggcugauggcaaacccagucagugagaggggcuggggccuuggaaggaaggaguggacacccuuuugauaaaaucuggauauuccccuccacuucuguuccucaacaaauuaggcaaacaaggugcaggcccagcuggcauuucauugcucaccugcuugguacagcagauuugcccaaacagaugcuugaagacacgcccagggagauggugcaaaggcaugaguguggaaagcagggaaggccacuauuagugcaugccaggcugcugagcuccauuuguggacaucaucacccaguccacagcuccauccucaccugggcuguugggcagguacagggucaucagcccucaagucacugccccagugucaccuuccucaugaggcccuuaucuccguuuaaaacuguaucccuccuucccgucacucauggucuccccaucuuguuguuuuucccacagaacuuacuaccuucuacaugugauuuacuuauuucacgcuuguugcuuauuuccuccaggcaguggcuuuugucuguuuuguucaugauauauuccaaauaccuagcacagugccuggggcauggguacccaauguaaugaaugugaaugaauaacgauaacuggcaaacguugagugcuuacuuuguaccaacacuaggcuaagcccuuuacaugcauuaucugauguuaucuucacaaagcccgaugagauaggaacuguauuuuuauacccauuuugcagaugaggaaacugaugcucagugguuuguccaaggucacccagcugguuaauagccaggaugagaacccaggaguggcagggacagaaggagcucucaggaaggacacagaggggcugagcuucagggccaugcugucccacauucucccauuuacuggggugaccaugcagcugucacggagaugugccugacaugggguagggacaggaaauaagugucuggggccaauuagagggagaugucuccuucuucuuagggaaggaggcugggugggcagggaaggucccgacaaagcugugcaucuguguucuuugcaauaugugguccguagugugggguuuucaaagagaggggcagccaaaucaggcccucuccgaggccugcacuggguugcugcaagggcucugguggugggcuggggacagcugggaccugugggaaguaggaggcucuggucagacuggcaguggaggccagagaaggaaggaagagccauggccguugaaguccccagcucuugccugggcucacucuugguccuuggggagcaugggcaggguagggaccgagaggcuuaggggccagaguaaggacuugggaacuggagcggucuuggggugugugucagggacuucgaccuuacugggcugcccauuacagaauccacacaggcgacagacccuacaagugcccacauccuggcugcgagaaggcuuucacucagcucuccaaccuccaggugagugccugccugccuccugcccaccaggugcucuggugcccccccacccacccccacaaggaagcguaggaaggggguggggugagggagcccuguuccucuccugacccccugcugugccccuacagucucaccagcgccagcacaacaaggacaagcccuacaagugucccaacugcuaccgggccuauucggacuccgcuucuuugcagauccaccucucggcccacgccaucaagcacgccaaggccuacugcugcagcaugugugggcgggccuacaccucggugagugccggucggccugugcccugccccgggggagccacuucgucuuccaggccucaguugcuuccccauugucagaucugugucgacucuucccauuuuccagacaaauugaggccuagagaagggaagugacacccugagaucacagggaaggggagaaccagagcuuuugcuucccacuucugguuucagcuaccccugaccaagccccuagccuccugcucaccuuuagccugagucuccgaggcccuggaguacucacagcaguggcaggaggcuuuucaccugcuccgcagagcuacagagagaagcgccuuccugucacccaggaagcugcaacccccauuguggccacaagguggcgcagugacauggcccauagccacccucaucucaggaaaggccugagcagcccggaaagcucagagcauucagcucccgucccugggugggaauuuccccaaacgagggccuuuuggcacccagaaauaccauucacccccaggcgaaucgcuugagugugugcuucuguuugaucuaauauucuaguuaacagaccccguauccccgacauagaggucacugagccucaguuuccucaucugucaaauggaugaacucacagggcuguuggcuggcagaguggugccaaaucaaccugagcuaguaccauuauuuauucacucagucuuuacuaaacacuucugccuggugcucgggcauugggaugagccagacagaucuauuuuuuguccccagggaaauuaagaacuguuggagacaaguauuaaacaaguacacacguaacuguuugacgggaaauuguguagcugcuguaaagcagagacucucggcccuaguccagauggacauuugggccggaccuuuccacugugggcgcuggccugcacguggcagggcucugagcagcauuccaggccuccauccgcuagaugccaguagcaaccgcuccccaaguggugacagccaaaaaaugucuucagggaugacacagaggggcugagcugcagggccaugccguccugcauucuggaguccugcauccugggggacagcauggcccugaagcucugucccucuguguccucccugggagcuccuuuugucccugccacuccuggguucucauccuggcucuuugucccuggggggcaaaaucaccucaauugagaaccacugugauaaaaguguguuuugaaagacagcagggaggacacaauggagcugggaagggggaugaguccagauugaccaccuggaggagcaacacuuaggugaagccuugaaggauaauuggaugaggaggagaaagaggggaaagaagcuuccaugcaggcgaacacugagugcgaacccccugagggguaacaaacuuggcacguuacaagaacucaaaggaaauuaggucaguuggggccuuggggcucuguuagaaaaguuuggauauuuuuucagguggaaugggaagcuacagggaggggacugucaggaaggguuuuuuuuuuuuuuuuuugguauauuuuagagacggggucuugcuauguugcccaggcuggaaucaaaauccugggcucaagggauccuccugcuucaaccuccagaguagcuggggcuacaggugugcaccacugugccuggcagggaagguauuuuugcaaggucacucuggcuggaggcuguucauggaucauaggugggguuguuggcaguacuugucaggugccgggcagggcugccacuugcuaagugcugagucuguaacauuuauucuucccuggaguucaaagggcagaggagggucaggaggcgaagaggacagaaucugcagggaaaagggcuccaaaggggugagcaggagcccucgcuuggcuagcugaucuccagucagucccugccucucuccaaggcucaaguuuuccauaaccuccuacaccaucaaccaauccugccucauccauacuccuauuuuuugaaguacaauccagacaucauacuauuucuaaaaauugcacuuuaucucucugauaaagacuccuuuuuugagcauauccacaauaccuuuggaauaucaaaaaguaauuaaccaaaguccuuaucaucaucagauacucaaauacccguucagcauugacauuuucauuugugucacgaaugccaugauuugguguauuuacaugauuccucuuuuuuuuuuuuuuuuugagacggagucuugcucugucacccagguggagugcaguggcacagucucagcucacugcaacauccgccucccagguucaagcgauucuccugccucagccucccgaguagcugggaauacaggcaugugccacuauggccaccuaauguuuuuguaucuuuaguagagacgggguuucaccauguuggccaggcuggucucgaauuccugaccgcaggugauccgcccgccucagucucccaaagugcugggauuauaggcaugagccaccgugcccagccuacauuauucuuuuuagaucaagauccaaauaagauuccugcaucguaguagcucaguagaucuuuuaaucucuagguccccuuacccccacuuuuuuucuuuguuauuuauucacugaagaauaguuuccuagcuaggaauuugcagguugcuucccucugguauuggauagcauguugccgccacauuugagggcuuccucugcuggguucugagcauauugaggucugaagucaaggaguggcaggugggaguaccgccucugcuucuggcaaaggcgauuggaaggauguggcuuagugugagggcuucugggccugcagugagcccugggucacaaccucaccuacccaguccuggugccucaggucagauccagcagagccaguggaggacaugauaguacccaccuguagucccagcuacuuggagggcugaggugggagaacugcuugagcccaggagguugaggcuguggugagcugugauugugccacagcauuccagccugggcgacacagugagaccuuaagaaaaggaaggaaaggaaauguagagacuggggcaggaguggacccuucaacccuuacuccaugcuaagggcuugaucuuugucaccacagcaaccuguugagguuguuccuccccuaugccugcuuacagaggaggaaacugaggcucagagagacaagaugacuuguccaaguucucaccacuaagaaagagcagagcuaggcucagacccaguccugcugccucacugucacugggaucaccagccagaugcaggcacagugcuucaccuggcagacagggcugagguucagccaguauacccagcuacauccagguggcaagggccugggggccuggcccuggagagccacaggugggcauugcugaggggugagcucuccagccagcacucauacuggcagcagugcagugucucuagaaccaauggccgacgcccaucugacccugcaaaacuguggcuguccuccacccucugaaccgccuaccaagagcccuccaguggcugcuggugggaacugcagccucuucucccucccuugcuggugguucccuguucugaaucucaucccugcccacaggagaccuaccugaugaagcacauguccaaacacacggugguggagcaccuggugagccaucacucgccccagaggacggagucccccggcaucccggugcgaaucucucucaucugagcccacuggaggcgccgccccacccggcccacuggcagacacagacccaggcagcaccaggccccagcucccuccgggggcccuccaggaaccaccaagcucucucacgaccuucccaaucuuccagaaagcuugguccgcagaagcccugccugguccaguccgggggcggccaggccaacugcaagauucuggacuguuuugguggcauccaaagacgaucucagagcacuuugaaccucucuguugaguuuucuuuuuguuccccacccuucacuugcuucacuguuuuuuuuuuuuucguuuuuuuuuuuuaaguuuguuuuggaaauaacagaaaagauauuuauuggccaggaaguuggugcugcuaagaccgagaaauuuaaagaaucggacagauggacgcagagaaccagagggcaaugugggaccuucucuugccauggccucaggucuugagggaaggcucgggccuagguuucuggacugcaaaggggacccccaggugggaggggcaggaagcagccggagugagcccuucgccccugagugccuggcucgcaccucucgagcugugcccugggcaucacugagcagaggggugcggcagcuucaggaggcagaaacgagaggggugggagauccacaggaccaaagggugcagugaugggcuggguggcgggcccagggaaaugggguggggaugggcuggguaagaccuggcccuccccugcugcccugaagaccaccccagucuaccucggugcuggccaggaaaccuuucggcuaccucucccaccaucccagacugugggcagggggauggggagggagugggccuggaucugggaccucccuccagaauuuccuccagaugggggcagugcccagggagggguuauuugucuucccugccauggagugggaauccccagccgaggcccuaggccccucagcagggaagggauccccggggaggcaggucccaggagcagacccugcccccagcccccacagacacaccccaaucugaaagccaugcgugucgguguauauaggaaccauguacagagcccagagaagcccccuacauccccccgggaaaaaaaagaaaacuagacagaaacucaucuauauauucuguaucuggaguuccguuuugaauauuaacuguguuauuuuuauacacuuuuuaagccuuaacucgccauugauuuaccaguuuaacguuuccugggguuucuuugcccaugggguucucugcccccacccccggcccuuuguuugacuugcgucgucugauacucaguauuguagcuuuuuguccgcauguuacucccuguaaauacgcuguuauacauacuguuaacaccccuuugcuuuuucuaugggaccuccaggccaccauauuuagaacuaguuaccuuauuaaaaaagaaaaaacagucug

SEQ ID NO: 14135 - RNA, 41332 nt, Homo sapiens
cgggcggaaggcggggcgugggggucuguggcugcugggcuggcggggcgcaggccgcgggacccgagcccggggaagcgagagagcggaggcgccgaggauccgauucacucccuggggagaccuaugggccgaagccguguaaaugcguuuuaaggcgagugcggaaaguggccuggggagccucggggagcggacgcccuccgcccuggugcugaccugccucccugccccuucugccuccugucagcagaggccucggcuccgcaacugccacuccuccucgggguguugcacaaguuucgaggucaccggcgacccccccuagcagcgcgccuggcucuggcccccgcgaaggaggacggaguuugguaaggggcccuggggguuggggggaccucagcccugcacucuguaggagucacucggacagaaaaaaccucggccuuccguucucucccaggagcuugcggcccccacccaccgcguggcguccccaggcacgccuagaauucuagcaccucaggaucaguccagcccccauuuacaauuggggaaacugcggcuccgaaagggucagaggguacccgaggucaagcaguagagagcggacucgaacuuaagcucuugcucuuaggcugagacgccuugauguggccaccggcuacccucuaggugggcguggucaagacugggggcgcccuggaaacuuccccacccaaguuucucagauuuucuguuccaucucucucucacucuuuccugaaauccagaauuucagaacugggaaggcucuccaaaacaauucauccauuuuacagagggagcaacugacucggagaggcagugacauuugggcauacggugccuugucuccgucugaaauccgggauucuugacuuucuccacccuugcccagugaaccccgggcuugugcugggggcggguugugacgggauugggaucccuggccucgggaggcgaguggggcagcagagccggccccccagcgguucccuucaucuccccucgccccgcaguguguugcauacuuucuaaggcggcggcugcagcagcggcuccauccagcccgucagcuccuccugcaaggcauggcuggcuaccugagugaaucggacuuugugaugguggaggagggcuucaguacccgagaccugcugaaggaacucacucugggggccucacaggccaccacggugaggggcugggaauggggguggguccccgguccccuguacagaucagcugccuccucaggaagggucccuagggcccucaucuuauccuuucgcuuauuugguacgcaauccuugcuauuugcaagagaggggcucaauuuauccccaauucuuuguccuugcccccaaaccugccccuccuauguugccuuuuuacccagcccuccaaggucagaaacgggggauuccuuuccugcugcccccucucccucaccgcccacaucuaggcauuaccaagcucugugaauucugccuccuuaaauaagccuccagugugcuuauguggaaccucgcuuucuaguucagucuuccucucuccaaaggcccccugaucucccggucucaugccacccccuccaaagguaucauaguccuguucaaaaucugaauuuggcaauucuccacugccuacaggaucaagucagagcuucccugccuccauagccccauucccagcuuuccccacaguauauauuaugcuccuucggagcugaaugacucaauuugcauuucccaaugaugcugugugcccaaugaugcuauuaccaugccuuugcccaggcuguuccuucugccugcagcauccuucucucagccucuccccucuuuaccccuuucuagucauuccuugcuucucaucaguguugccuuuccugaucgccccaggcagauuuucuauuuucuuucuccaugccccugcauugcaccuuguagaaacugccaucuaacaucugcugaauggacuuguaaguacuuaagggguuccuuuucuuccagacccaagcuccuucagaacaacaguacuguuuggucaucucugucccuuagcauaacguuuggcaccaagugggcaugaguaaaaaaguguugcaugaaagggaaacugagucccagggaagcaacucuggaagggucccuuccacauuuaaguaauguggucucacccacagccucauacauguuuggccuuuagcacaucuacaaugaacaguuguccauagggauagguugcagugucagugggacuagcuuaaggcuucauugagcaccuguguuuggaaggcagugagcuguaggucauagcuucugccuuuagggaguuuacccuuuucuagaauggacagaugcauaugcaguucugauaccuuggaagcauaugcaaaugcagugggagcauuuaaaagcagaguugccuuauugguuuggggaagguggcauuugagugaaacuuuaaggauuuugccagacacaggaguggggaggguauucugcaggacauggugggaacaaagguuugaaggugggaaaaugauccagccuacagcuggaguuuuagccgcauugaggggagggauuggggcuagaucagagccuugaaugccaggcugaggaguuugccuucugcccuguaggcuuggggaggcccagaaaacuuagcagcaggguagcucuguggccaguacugaaccugggucagguacuuggaaggaucacggauggcaugcacagggugcgagcuggauggggucucacauucauccacuucuugucauucaggacgagguagcugccuucuucguggcugaccugggugccauagugaggaagcacuuuugcuuucugaagugccugccacgaguccggcccuuuuaugcugucaagugcaacagcagcccaggugugcugaagguucuggcccagcuggggcugggcuuuagcugugccaacaaggugagcccugcccgcacggugcacugacccuccaugcccacugaacacacacauggccaggcuaguccaggugggcucuggggagcaagagguaccuguaguugguccuugcccucugggaagaccacccacucaggaggggucucaagggaugagggagggagaaacgagcauggaauuugucagccuugaaguuccagauuggaaucuucuuugucccugguagaaagcucaucuuuuuaauggagauuugcaaauuuguuuggcacagagcuauacaugauguucuucuaauuaaaacaaaagcgucuccauauuguugguuucuuuucuuuuuccuuuuauaaucauaauaauguguggcggugcauuuucuuaacuaguccuuguaguuuuguuguugccaccaauucugucuuucuaauuugauuucugcuguugucuucauucccuccugcucucuuuagauuuauuuuuuucauuuuuugagauggugucuugcucugucacccaggcuggagugcaguguugccaucuuggcucacugcaaccuucgccucccggguucaagugauucuccugcccucagccucccgaguagaugggauuacaggugcacaccaccguaccuggcuaauuuuuugguauuuucaguagagacaggauuucagcauguuggccagguugaucucaaacuccugaacucaggugauccacccgccucagccuccuaaagugcuggguuuacagccgugagccaccgcgcauagccacuuuagauuaacuuuacuuaucuacugucauucaguaucuacugaacuccuacagcguguagucacugugcuaggcagggcuagcaauacagaauugauagacugcuguccuugaguugaaugcuuaguuuauuuauuucuauucuguccuugcuagauaaaagcauuuaagcuauaaaguuucaacuaaguagagcugaaaguaucucauuuauugauucagcaaauauuaauugggcaucucuucugaggccaagcauuauucuagguggggauuuggcagugaacaaaauaaaacaacaaaagcccuuccuucauggagcuuguuuacaaaaaaaaaaaaaaagaugaaauaaagaaaauauuuaguauuuuagauggaaaaugcuguagagagaaagcaggaaagggaaguaaggaauguugggagagaggauuguacuuuuagauaguuuggccagggaaugguucacugagauuugaauacagacccaaaagagccaagggaucaagccagguagauaaccagggaaagggcauuucaggcagcaggaacagcaggugcaaaggcccugaggugggagcaaguccagugggcacugcuuugugauauugucauuagcacuauuuucuuggugguuaguaaugguugcguaauauggcuggauguugugaggagaguucuagaaaggacuccuggaguccugggcaggaugacagggcuggagcgacuccagguuggggagaggugugcacuuggccgggauggucagaaugagcagguuaaccuguagcagggaccgaauguuaaugccuuucaugguagaugaggugcuuccucuuaucuuugggcuaguucaugcuuugcacaccucguuuugugcaugucuuccacgaagcucugugaggcacacagugggagagacugccguucuacaguugaggaaaccauggggucagccaucuguggguagcagagccaggacguccucguuucccacuucuuccugcggugcccugggccuccacgugggaugaaaaggagcaggauccuuucaguccccgaggucuagggugaagaacaggaccaaaccccacugccuagaguuuucugcuucaggaaccccagggggaggagcuugguucuguagaagaaagggcagagugagguguuaaggcugagagagaccuugaugacagcggggacuggagaagcaucugcccuuugcugagugugucuguugugucagguacuuugccaaguguuuucuguacacgaucucauuuuauucucacaacagcccugugagguaauuacuauuuuuuuuaauggggauucugaccguagccuggugaggacacauuuaacguauaaggaaaugagagauggagguuccgcaucagggugguggcagcuugaguccugcugaguugccuuggacucuguuuuuuccaagguggcuggggagaggauggcugagcugggauucagccagugauggaugcccucagccaacugcaggggcgaggagagacuuaagcccccucccugugaugggaucaugcagacccuuuggugcgcuucuggagagguggcuccccgacuuacagcuuuucuuggaaggccaaggcugcccucuucuggucgucuguaguggguggccaugcuuaacagcguugugccuuaguggacacugaccaagggccuggcguaagcuagggcuggaugugcagacagacaugcguuggacgggggccagggccacagcuugcucggggacucuggucuacccagccaccugcccgaggaccacuguaucaucucuccugucccaaucgcuugcccucugucucccucagcauccucccaucuuaaaaagccuuugcugggcagcacauccucuuccagcccaaucccuugcucucuuuucgugaccaaacucaaccaaguugucugcacuugccugucugcccccauuuuuucuuuccuucaguacuccuuccuuaagccauugcuucccagccuccacuuucacuacuccaaagaauuuucucuuaccaacauccccagugagcacuuaccaacauccagugagcacuuuacuuuaaacauggauugugaacuaauaauacaugcaaauaacacauugauucauucaccccaaaagaaacuaggacaucagcuuuaugucuccauagauaaucaccaggaugguuuugguggauauguaguauuuuuuuuuuuuuuuugagauagaguuucgcucuuguugcccaggcuggagugcaguggcgcaaucucggcucaccgcaaccuccaccucccggguucaagugauucuccugccucagccuuccgaguagcugggauuacaggcaugugccacgaugcccggcuaauuuuguauuuuuaauagagaugggguuucuccauguuggucaggcuggucucgaacucccgaccucaggugauccacccgccucggccucccaaagugcugggauuacgggcauaagccacugcacccagccauauauauauauauuuuuuuuugagacagagucuugcucuguugcccaggguggagugcaguggcgugaucucaguucacugcaaccucugccucccagguucaagcgauucuccugccucagccuccugagcagcugggauuacaggugccuaccaccaugcccggcuaauuuuuuguuucuuuaguagagacaggguuuuaccauguuggccaggcuggucuugaacuccugaccucaugauucaccugccuuggccucccaaagugcugggacuacaggcaugagccaccacacccgacuggcaaugcauucuuuaaaaaaaaaaaagacucaacaguaacauaugguccuacuuuuaaaggcuucagaaguguauaagaugaaagagaacacugcuucgaccccaccucaucaggcacuucuuauagcugagacagcuccuuccuguccagacacaugucucgcugugagacgagauuugcauuuacaggaauagcuuucuaaucugcauauugcucuccaucccuuggaaacguucuccauccucaccucugcaggucccggguaccaucucuccccaucuucugccacucucuaaaugguagcauucuucugaauuccuaggccucccugucuuguaaacccuccuucuucucagaagaaggguuaucuccucccauggcuuuaaauaccaucaauaugccacugcuucccacauuuuaaucuccagcucagaccuauauauccaguugacuugauacgaggagaugccuggaacccggcauguucaaaugugcuccugauguccccuuuccccgucaugaagggcccccucagucugcugggugugggaguucccucugacguccucguccucaucaccacaugcaaucuaucacccagcuugccagucccaccuccagaacacaucuccccacuuuucuggagcuggcucugucaucucccccagggcgauggugauagccacugacugucacugucuauucccccagaauccccuugggcccuccuucagguagccagauagacauguagaccuuauauuuaaaaugcaaaucugaccaugucguuucccuuccuaacccuuuagacucuuucccaucacaugcaggguaaaacauguuuccuuggcagcucugccccucucccucugaccucaucguccucacugcacuaacuugcucuucuugagccacugcagcauucucuguuccuugaucaggcugaagugcucagcacugcuugccucagaaccucugcacagaccacuuccucuacuggaaagauucuuagauucuuuccuucccucuuggccuggcugaggccuccugcagggcucaguuuaaauaucuaacccugaaguuguccuuugccucucacacccaggucucuugcagcacguacuuuuucuucccagcucuuaaccacuuguaauuccaucauuauucagcgcucauuugggacugcccugccuaucuuucccaccaaccugaaagcuccauggucucagagacccuaugugcuuuagucaccacuuguuuuauuaacaccuaucacagagccuggcaacucaauagaugcucaaaaauacccgucagugcagcauugagguugcauuccccauuacagcagugagguuaagagcuggugugcuaaggucugacaguuagaaucccaucugugccacuuagaagcugugugauuuuggacaaaucacuuagcaucccugagccucuguuccccaccuuauaagauuauuaguaagguuaaaugagaauguauauaaaauacuuaaugcagugacuggcauaggauaugccuucaaugaaugacaacacuuauuuaaauauuuauaauuaggcugagugccuuggcucacagcuguaaucccagcacucugggaggccaaggcaggaggacugcuugagcccaggaguucgaaaccagccugggcaauguagugagacccugucucuaauuaaaaaauauauauauuuaaaaaaaaauuauaaucaaagcucaaucacagguccccaaagugcuaaagugcuaacacugcuucuuccucucaccucacguggugaggcagggaacaaaaacacagguccacauccacucagauucgggguaggccacaucugccccugggaagcaagcugugguggcagcaagcccagcucuggagcuugaccuuugugucccauucugcuacugguuggcugugucaccacagacagguggaccucacugaacucaauuuuguccuccauaaaauguagccaguaaauauuucauagcauagucauugggauuaaaugaaauaaugcuuauaaauaucuagugcugaaaaguugcuaaauuaaaauuagacucuuauuacaaaaucaggauggcuaaaaaugacucuuaugccucucaccauguuucaaaacuggcucucucuucucuuguuuauucguggagagucagacuugaguucgaaaguucguucugccaccuauuuucugcguagcccuucugagcaucaguuuccuucucuguagauuggagcuaauacccaucugaauggguuauuggcaaggacugaauaaaagggugaauccaaaguagggguuggcaaacuacggauggaaggccaaauccaguccaccaccuaauuuuaugaaguuuuauugacucacagccacauucauucaauuaugcuuuggcuguggcuguucuggugcuacaaaggcaguugagaaguugugacagagacuguguggcucgcaaaaccuaaaauauuuauucugguucuuuauagaaaaaguaugcuaacacccgauguaaaccaucuaauucagggccugcuugugguaggugcugaaugaacacaguugcugucgucaucaucaucaucaucauuuguucauaucauuaaugcagcaaucaggugcccacagguucuagaguaaaggggaugaagaggaggccccaagaggagcagggcugagcccgcacacccugcacacccagugcagggccgugcacagaguaggccuuuggaguggggugaucucuguccaaaagauccuuggucugguggacuuucuaauacaccagcagugcuuuuguuauuuauuaagcugacaaauaaaaauuguauauauuuaugguguacaacaugauguuuugauauauguauacguuguggaaugguuaacaagcuaauuaggcauuaacucacauacuuaccuuuuuuuguggugagaaccccuaaggucuauucuuuagcaauuuccaaguguaccauauauuguuauuaacuauagucaccaugauguacauuagaucucuugaacuuaauucuccugacuaaaacuuuguauccuuugaccaacuucuucccacugcccccucgccauugacccgagcccuuggcaaccaccauucuaugcugcuucucugaguuugacauuuuuagauuccacauauaagugagaucaugcauguuugucuuucugugccuggcuuauuucacuuaacaugauguccuucaggcucauccauguugcugcaaaugacaggauuuccugcauuuuuaagguugaauaauauuccauuguguauguggaccacauuuucuuuaucuguucaucugugauggacacuuagguggcuugcguaucuuggcgauuguggauaaugcugcacugaacaugggagugcagauaucucuuuuacauauugacuuccuuuccuuuggauguauacccaguauuggauugcuggaucauaugguaguugguaguucuauuuuuugagauggagucuggcucugucacccaggcuagagugcagugaugugaucucggcucacuccagccuccgccuccuggguucaagugagucuccugccucagccuccugaguagcuggaacuacaggcauguacuaccaagccuggcuaauuuuuguauuuuugguagagaugggguuuugccauguuucccaggcuggucucaagcuccuggccucaagugaucugcccaccucagccucccaaaguguugggguuacaggcgugagccacugcgcccuguccuauuuucaguuuuuuuuuugaggaaccuccauacuguuuuccaaguaauauuuaaacauuuaaauuugccaggaaaaugugucagaagccuguugucagggcuaccaugaguccauauaaugccuuuguguaaauuagaaaauguacccuuuccuuaagacaauuaauuguuauaauaaauauacugauuuucuuagaaugagaugcuuuacugccaggaaguuuuaauaaauauacaaaucuacucuguauucauucugaaugggaacuccccacccccaggauuguucaguguaccacccgcauggcuguacauggcagcccugcuuaucaaagaauggugaauccauguaaguccugauaucuauguaucuguugucuuagagcaaggcccacuguuaugggccucccuaugcauagcuaugacuuugcccucaucugugcuuccuugggcuccgugggcuagcaggcccuggugccuccuuacaaccaccuuuggggccccauaggcagagauggaguugguccagcauauuggaaucccugccaguaagaucaucugcgccaaccccuguaagcaaauugcacagaucaaauaugcugccaagcaugggauccagcugcugagcuuugacaaugagauggagcuggcaaaggugguaaagagccaccccagugccaaguaagcugagaaccacucauggggaggcugggcuguggggagccugggcuguggggagccugggcuguggggaggcugggcuguggggaggcugggcugagggaaggcugggcuucagagugaagggggggguggggugaggggguggagcuggggcaggucacccuguccuggacccagccacaguugcaggagguuggggcagguacuccuggacugaacccaggaugcuagggucuagcuagaacaaaggcagaaauaacugguuaaagcccuaggcagagugagacccauguguuauggaggccaaagucacaggcuugagagagucgagggaguggucaggaaggcuccacggaggaaguggcauuugaagcaggccuugaggaaugaauagaauuuggagggggcauaaauagugaacugcguaagcaaaugcauugagguuggaaacagcaugggacauucaagcguaagcagaaacuuaguguggcugacgcaugcuauguguagggggugaaggagauccuggucgggggcggggagccgaugcaaauggacuuucgaaggggucagggcuggacguuuugcucuggcugugccuuuuacaugauuacuggacacccuuggacuucccaggaggggccuuggggugaaggggguggccaggugaugggccacuccaguccauccaaagcagcuuccaucguauuaauggguucuccuuaaggcuuuguuuaaaaaugguuccucucauacacgacaaguuugaaagcucuaacugguguggagacugauuuggagggacuggagcugccccaggagaguuggugaggucuggaccagggcgcaggggcugcaggaaugggucagggacauuuagagaauggauuggacaggacuugaagguugauuggcuguguagggagagggaggggucagggagccugugggguuggguggcucugagccauguagcucacagcccuugauugagagauguggcugggguggggcgacaggguuuguccagcagaggggcacugcgugucucaucaggaugguucugugcauugcuaccgaugacucccacucccugagcugccugagccuaaaguuuggagugucacugaaauccugcagacaccugcuugaaaaugcgaagaagcaccauguggagguggugggugugaggugagcacugggaaccccugccauccccucccacaccaggcucccugccucuuucccaggaauuaauucuauaugagaccuuccccagggccucugaguagggccugucccugggccuggaauucuuccauuugagaauuuccucuguuugaaaaggaaguuuagaagggucccuuccccagucccaggguccccagaaggucuugucccaggaaguuccauccagagaccuggcuuugagggagucuuaccagccuguaggacaaagguuuugcagcuacacucuugaggggccucuuuucuuuucuuucuuucuuuuuuuuuuuuuuuuugagauagggucucacucugucaccuaggcuggagugcaguggcaugaucaugguuuucugcagccuugagcucccaggcucaagcaauucucucucccgccucagccucccaaguagcugugaccacaggcgugcauuaccacaccugacuaauuuuuauuuguuguagagauggggucucacuuuauugcucaagcuggucucaaagucuugggcucaagcaauccuuuugccuuggccucccaaagugcugggauuacaggugugagccacugcacccagcugugugccucuuuucuuacagggauauggaaggaguaauaaugaacuaccuaaugaacaaugaacuaccuaauauagggcuucauuuauucuguacuuaggugugccaggugcugugcuaagugcuucaugcacauucucucagccuuguguggugugggucuuguccccgcauuauagguggggaaacuaaaacaaagcugaguaagcugccaaggccacccugcugacugggaggcacagccagaucugguugacuuggggguccuggcucucaucccagaaggagggaugggaggagcaccaagugccaggagcccuuggaucaagccuccuguccacuucucccuugccauauggcccuuggcaacccauugaacauuucaggaccuuggucacugcaucuguaaaaugggcacagugucucaugugccugcccaaugucauucuuggcuggggcucaggugguggcacuuggagcccugcaugucagccgaggcucuuccucucuucccaguuuucacauuggcaguggcuguccugacccucaggccuaugcucaguccaucgcagacgcccggcucguguuugaaaugggcaccgagcugggucacaagaugcacguucuggaccuuggugguggcuucccuggcacagaaggggccaaagugagauuugaagagguaacccuggagcugggagugucaugcugggcucuauggcggggaggauagggagggauuagaugaucggagggagaccaccgugcguggguccuaugcacugcaugcagugcuuggugcuuaccugggugaucucacugcuuauuaacccugugcuacagcugagcaagccaaggcucacagagguuacauugcuuccugagcccaaagcagaaccugguucugccugccaugcacuucagccaauuggaggcauaaccaggacacauuuacauaagucguaaggcucuuuaaggggcgggauaggccucuucacccuaaggugggcugaugagauaucggguggggaggcagggaaacgaaaaccaaccuuuggucugcugccuguccauucucuuccucuauucccuuuuccuuacccacugugaggugaaguuaagaaaaauguguccuagcaguucccacuccaaccacuagaggucgccucuucuuggaaggcgccuccuucgggaauaccgacauguaggaauugaccuuacagaaaugauuugggauagucucaaagaauuugccucaaagaugacuguucuagcuuuguuccuaacagaaguccaguggacuucccugguccaucuaauacucaggauuuguuaaauuaugguacauccuuuugaugaaaacacuuccuuaauguggggaggucguucacagucuauuaaguaaaacagguuccaaaaacauauacagagaccuaccaugguuauaauaaaaaauagcguuuguauaaaaaauaauuaaagacacuacuccaaaaaguuaacaauaauuagauucaucuaguugauagacuuuggagugacuuuuaucuucuuuuuccuuuucuguauuuucugaauuuucuguaaucaaguauauuacaguugaccuuugaacaacgcagagcuuaggagcaccgacccccuacacacuacaaaaucugcauauaacuuuugauuccccuaaaacuuagcuacuauagccuacuguugacaagaagccuugcugauaacauaaacagccgauuaacagauauuuuaugugugauauguauuauauacuguauucuuacaauaaaguaagcuagaggaaauaauuuuuuuuuugagacagagucucacucuaucacccaggcgugagugcaguggcacaaucuuggcucacugcaaccuccgucuccuggguucaagagauucucgugucucagccucccaaguagcuaggauuacaggugcaagccaccaugcucagcuauuuuuuguauuuuuaguagagacgggguuucaccauguuggccaggcuggucucgaauuccugaccucaagugaucugcccacuucagccucccaaaguucugggauuacaggcaugagccaccaugccuggccagaaauaaaauauuauuaagaaaauuauaaggaagggaaaauguauuuacuauucauuaaguggaaguggaucaucauaaaggucuuuguccucauugucuucaaguugagaaagcuguggaggaggagcaggaagaggagggcuuggucuugcugucucaggguggcagaggcagaagaaaauccaugcauaaguggacccacacgguucaaaccuguguuguuuaagggucaacuguauuuaacaaacugguuauuuaugaaagaaagauccacaucagggcuucuggaaucugaguaccaagugugauaugaagaggacuccuucccauuguggggccauggaggagggugauuuacacaagcacgaggcucucuacccagcucugucccccuccuaccuucuuggccagcuguccacaguuaucagcuggggccuuagcagcugccaaauccuucuuccggaaaucaaagcagcuuucaagaaauagacuuggagcuguagcaagucuucagcauaaagcccacauuucaaacacauaauugucuccccauucuccuccuaccagauugcuuccgugaucaacucagccuuggaccuguacuucccagagggcuguggcguggacaucuuugcugagcuggggcgcuacuacgugaccucggccuucacuguggcagucagcaucauugccaagaaggagguucugcuagaccagccuggcagggaggguaggugccaggugggcaguggagcccuguucuccccugaagcuucagauagugguuggcugagcaggaucugguuuuagacccaguggcagaggaugggggaaucuggagaaugaauggguucuugcuuuagggaaacuuucagucaagucgccccaccccaagacauuuauuuagcaucuuuuuuccuaggcauguucauauuuugugaagauugagagcaaaacaaccuuagagagaauagauacucuguugaccccauuuuacagaugaggaaaccgagaaccaaagagaauacaagugaacugcuuaauagcuaguaagagccugcauuugaccccaugucugucuccucuccaaaauacaggcuccuacucacccuacugcuucucauaauauaaugaaaauaauuaaugacagcuuacauuuguuugaguccacuuuacagaugacaacauaggcagggggaggcugagucauuagcccaaggucacauggcugauaaggggcaguguggggauucaaguucagguuaggcugacucagcgcuucugggcccacaucaccaacaucagugcucuucccuccccuuccagauaggucagggauagcagccugugagugacaggugucagggacucugaucuugaggcuugcccucugcucugggacccucaugcaggggagccucaggacugugcgcuuuuccccagagagaauucaugugaaggguggugggcuccagguagaauguccuguguucguguguggcauucuucuggcuuccuuuauagaccugggggauugucccgucugauccaaucaagagaccuggcuucucauucuggcucauccacugcccuaucaugugccucugagcaaguggcuuaaccuuuuggggucuugaguuugggugggcugcucuucugccuuugcuggggcaccuaggggcucagaugcaagcaggggagugcauccugggcagguugcuuggcugcaggggugaguguuccuaacacggcagugaacccaugucauuggaaggauggcugcugauggcuuuuguuguaggccucgccucaugguugaggaauggguagccauuuugcuuccuuacugagcccacuguugugucagccccacuaccacccccucacauugcuacuugugcugccucugaacccuccccuccugcagaggaaaaugguuccaccuccaagaccaucguguaccaccuugaugagggcguguaugggaucuucaacucaguccuguuugacaacaucugcccuacccccauccugcagaaggugagcuuaccccacgugggccuguuuucaguuguguguguguauuucaauaacauuuguuguguuuuuaucuaauuuuuaaaaagucaaacauauuuauugucgauaauagacaacaaggaugacgaagguuaucacccauaaucccaccacacucuuugagcauuacauauuuuaaaaaaugccuuauacuuuuuucaugacauuggaaucauauuguuuuguaaccugcuuuuuccauuuauaugggguguagcucuuuccaugccauuaacugaucuuugacaacaugcuuuuguauuuuaaccaaucuaacucuagugguuggcuauuugguuuccucuuuuugagcacugugaauauauguugagguuucagcucugugguaaauuccuggaaguagaaacaguucauauacaguggguuuuucuguaauaacaggggaacaggaauacauaaaacauuccuccuagccuguggaacccagcccagggccuccagcaauuuuaaugggcaucuuugagaggauaaagaaaaccagacaucauuuuaucuuccccucuccauugugucuuccuaucucucucucucuuuuuuuuuuugagauggagucuuacuccgucaaccaggcuggagugcaguggugugaucucggcucacugcaaccuccaccuccugaguucaagugauucuccugccucagccucccgaguaggugggacuauaggcacccgccaccaugccuggcuaauuuuuguauuuuuaguagaggcgggguuucaaccauguuguccaggcuggucucuaacccuugaccucaaaucauccaccaacuuuggccucccaaagugcugggauuacaggcacgagccaccaugccuggccucuucccaucucuugaccuuugugcagccccucuuccuggaaagaaacuuuccuugcaugccuugaagugccuaacuagcacucauuauguuuuuccuucccuucccaaccuauccaguuuuucaaaagucagucagaggggucuugaaaaucaacuccacuuuguggcucuuccugccccuuaucccugugcuggccuagggaaccccucucucccucccuccuuccuccagguacccaggcacccuagaugugcuugauggagccucacuccaugguuaaaugugguuacaucugcuggucagaguaggccuccccaaggugcugaggaaugcugagcucucuacucugacgcacuagcauugccugcauucuugugguagcccacauccuacugcacugagaagggaccaggccagccagcuuacagagcgggcagcuguugaguccccguuacucugccucuccaguacucgucuuccuguugcaugcuggcucucacccacuccacucccuucauuggcuccucagaagaggagaugauggucccagcccacugccacgccccccaccgggaucuuugcuuuggcugaucucuaguuggcauuccugacuugggcacugggauguuugacucucuuuguggucugugcuguuccuccccugaacgaugcugcgguuucuuccuuuaggcucuuaacugcuuuucaaguuuggccacgugagcgccuccagaguggggcccacagccuggcgguggaauaagacauugcauagaugacaauacacauaauaaguuaacuccuguggugcugggagugugugucagagggauucagccuggcuggggguauccguaccuucuuucccaaagaagguccccuuacaaguauuaguuuuggcaucuuucuuugcauaccugcucuuccuucccagggacuuuguguuuagaccuggguauaaaaaguuguaugaggccaggcgugguggcucaagccuguaaucucagcacuuugggaggcagaggugguuggauaccugaagucaggaguucgagaccagucuagccaacauggugaaacccugucucuacuaaaaauccaaaaauuagccgggcaugauggcacaugccugugaucgcagcuacuugggaggcuaaggcaggagaguaaccugagccugggaggcggagguugcagugauccaagacugugccauugcacuccagccugggcgacagaguaagacucugucucaaaaaaaaaaaaaagaaagaaaagaaaaaaaguuguaugaaacauaauccuuggcucaagauauacuucuuauugcaccaugcuuggcccuuuuuuguguguuucuuuuugguuuuuauuuuuauaaauucagcaaauaauucaguacucucaaagcaguacucucaauacucaaagcaccgugcugaggucugcagaggaauugucugugcuuuggaaguacaguccuguuggauagaaacacgugugugugugugugugugugugugauuaguauacaagcuacaaccauguaugagaaaaguacagaacaaauauuauuggagcuuuuaaaacauauuuuaguacuguacauguuucuaaaaaauaaggaacuuaaaaaaucacaauuccauuaucaaauuaaaaaaugaauaauuccauaguaucccccaucaucgguguugagcuauccccaacugucucauaaugguuuuuauauuaacuugcugaaaucaggaggcaaagaaggucugcauggugcauuugguugccaucucucucucucucuuuuuuuuuugagacagagucucacucuguugccuaggcuagaguucaguggugugaucucggcucacugcaaccucugccuccuagguucaagcuucucuccugccucagccucccgaguagcugggauuacaggugugugccaccaugccuggcuaauuuuuguauuuuuaguagagaugagguuuugccaugcuggccaggcuggucucaaacuccugaccucaagugauccaucuggcucggccucccaaagugcugggauuacaggugugagccacugggcccggcaccaugucucucucuuaacccauugguuuccccauacucuuuucuucuuuuucuuuuuuguagagaugcaaucucccuguguugucuaggcggguugagaacucccagccccaagcgauuguccagccucagccucccaaagugcugggauuacaggcaugaaccacugugccuggcccccacccucuuuuuaagucuguuuuguuuguuuguuuucuuugguaauuuuaaacugaguuguuuuuccuguggaguuuccugcauucuugauuuuccugauuggugaauuuccugaauuucccuuuggugcuuuugaacauguuucucugccugguauuuuuuuuuuuuuuuuugaaauuagguagauuuagagguuugaauagcaucucaaucagcuuuggaauaaaaauacuccaugggagaucuugucuuuguuuuccuuuuagaguaauaagcauccuuauuauuuaaccuacauugccuuccaugcaaagucgucacuaucuugacucaugcauuaucauucucuggcuuucuuuuucaguauagguuuaucacaucuaaaucuauuccucgaguguauuuauaauuuauuauauuuguuuuuuugcuuuauaaaaagguauuuugaugcauguaaccuguuugggcuuuuucucccucauaucacagucuaagaaccacucacccugcuacaugucucuagaguccauucauuucauugccguguagcgcucuuuuggugaguaugcugcaguuuauuuguccauucuccucucaaggcauuuggacugucuuuggguuuuugcuacugugaauacugcugcugugaauucuuguuucccucucucugaugagugagcaaggaguggaauggcuggguauagggcaugugaauguuuggcuucaugagaaaaugccaaacaauuuucugaaguguuguacugacaaucccaccagcaguguguaagagacucgguggcucugcauuuucuccagcauggaguauugccagacugaaaacauuuucccaguggaauggauguaaaaugauaucucauugugucuugauuugcauuucccucaucacuagcaaagcuggaugucucuuuguauauuuacuggccaaauguguuucccggaacuucuuccagggacuuuguaaguugguguuccccuucaugucugaauuucuccaccgaguggucuguacccacugccccugcucacucagcucccuuagcccuuccaaccucuccagucagguaccuguuccaugaugccauggaagaugcucuugaaagucacuuccacgcugcuagcucuuccauauggcucuucugucccagcagcugguccuccucuguuuucaugcucaccucuccuggcuucuguggcaacauccugggccuuggcuacucuucugcuguucucaccuugucuccuuggcacuucuccugcucacccuuuaagugcugacugucucaggccucaguccuugaucuucucugucuauaugcgcuuccuagguaaaugcuuccagacugaggcucuuaguaucuuccauacuaucaucacucccaaauuucuaucucuauccuggaucacaccccugagcuccagacuugcacauccaacuacccgcuugagauuccuacugggauuucacagacaucucaaguuuaacuuguucagaacugaacucuugauuuccaaccccaaacuucucucacuaaauagcacugccacuagccaacugcugaagcuaaaaaaguuggcauuauucuugauuuuugcuuucccucuccuuccacaugcaguccaccugcaauucuugaguguaguuccaaaauacauuuugguuucagugaauucuuccucugucgccacccuaaugcaagccaccauugccuccugcuugagcuacugcaguagccauuaacugguuuuccacccccauacuacuaccugcuuaccacccauuuuccacgcugcagacagaaugaucuuuuaaaaucccaaagauuaugccccuccucugcuuaacaccaucuguggcuucccauugcucucagaauaaaaccuagacuccuuaccacaacgagcaaggcuccugccaucuucccaggcaccucugcccucacuccugucccuguuuucagcuccacuuaccugcuccagucccauuccucuccuuucuguuuuuguaacaccuaaguuguuucugcucucagggccuuugcauucgcucgcccagaaugcucuuccacucaccccugagacagcugcuguauucucuuucuuaugucucagcucagaugucaccuugucagggaggccuuuccugacugcccucucuaaaguaggcucaccuccccuagucagauaauuuugauacccugcuuauuuucuucacaacccaucguaaucuguuaauuaucuuguuuuuguuuacuugccuauagucugucuucuccauuagcagguaggcucuaugagggcagccacguuguccaguuaguuuccucugaguucccagcaccagacacagugccuggcauauaguaggugcucacuaaauaucuguugaaugaauugugaauggaugaaucaaucauucaauaaacugugagacccuugagggucucacaucuguucauaucuguuucccuaguacggaacuuggcauacaguagguucaguauauguuggaauuaaauagaucuuuuuuuuuuuuuuugagauggagucucacucugucacccaggcuggagugcagugcuacagucuuggcucacugcaaccucugccucccggguucaagugauucugcugccucagcuucccgaguagcugggauuacaggcgcccgucacuaugccuggcuaauuucuguauuuuuaguagagacggcauuucaccauguuggucagguuggucuugaacuccugaccucaagugaucugcccgccucggccucccaaagugcuuugauuacaggcaugagccacuguacccggccauuguuucuuucauuucuaugucuuugacaaggauaaaccauuuuguuuuuguuuauuguuuuauuuauuuugaugucaaugucuuuuuauauccucuguucacuuaauuugggaggucuugaaguuuuuucuugcacauagaaaugagcuugcauaugcaugugugcauguauuuaauaugauguuugauacaaauauuuuuucacucuauugguuuauuguuuuaguuuuguaauucuuuguuauucuuucauagaaguuuugacacacuauuuuguuuuaacuaaguuugcuguaauuaauaggaaggaaaucuguuacuuucuuuugugcucugcuguuauagauuaucuuuauuacauauauauauauauagucuuauagaaauagaauguuuauuagaaaaaauuuaacacaaauaguaaaauaaaaugauucacuaaucccaccauucagagaugacuauuguuaaauguacuuugauuucuacuuuuuuuggguuuaauggcuauuuuauuuuguuuuauuuuauuuaacacaaggucacauucugucacccuggccagagugcaguggcacagucaugcucacuguagccuccaccuccgaggcucaagccauccuucccacuccagcuucugaauagcucggacuacaggcacaugccacuaugccuggcuaauuuuuguauuuuuugcagagaugggguuuugccauguugcccaggcuggucuugagcuccuuguuuuguucaagcaauccucccaccuugagauuacagacaugagccaccacgccugaccugauaauuuuuuuuaaaagguugucuagucuugcuaagaauaagcaagacguuucguuuacuaaugucaugauuuaaccaguuuuagcugcucugauauuaaaagguguuuuuguuaauauacuucuaaaauauuggaaauaaucagagcuggguggggagagagaacuaagcccaaaaucucuaauuuacaaugcuguaacauuuugaaagaccaaucuuguuuuugauuucuacuuuuuaaaaaagugucauagugcacuuuguuuuucacuuuaaaguuuuauauauugugagcauaugguuuucuuuaaauacugacguguuagguggacuuuuaaauauagaaacauuuuaaauguucauugagugcucuaaaauaauacauauuuaguguguguauuaguuuguucucacacugccaaaaaggaauacccaagaauggguaauuuaaaaaggaaagagguuuaauugacacaguucugcauggauagggaggccucaggaaaccuacauucauggcagaaggggaagcaggcacaucuuacauggcugcaggagggagaggugugaagggggaacuuccaaacacuuuuaaaaccaucagcucucaugagaacucccucacuaucauaagaauagcaugggcgaaacugcccgccaugauccaaucaccucccaacaggccccucccucaauaucuggggauuacaauucaagaugagauuuggguggggacacaaagccaaaccauaucaguguguaaagaugcaauucaacaaauguguaugagcacuucacaaaugcaagauacgauuugguauaggguggaaucaagaggaggcaaguaucaugggaguuuuauaagaaucuuggcaggcaaaauucaggacaguuaccccaguccaugaagagagauucuccuuuuauugccaagauggggcuuucuuacuugcuguuccauuuuauucuaguuuguuaugcuuucaaaagugugaaucugucuggaauguauugcaauagcacuuaccaagugugucccuagacuaagaagacagaagacucaaauaaauaaaauuauaaaugaaagaggagacauuacaggauaccacagaaauucaaaggaucauaagagaccacuacuagcaugaauaacuauacaccaagaaauuggauaaccuaggcaaaauggauaaauuccuagacaaauauuaccuacaaagacucaaucaugaagaaacagaaaaucugaauagaccaauagugaguuaggagauugaaucaguaaucaaaaaccucccaacaaagaaaagcccaggaccuuauggcuuuacuggugaauucuaccaaacauguaaaaaagaauuaauaccaauccuucugaaaugcuuccacaaaacugaagcagagggaacacuuccaaacucauuuuacaaaaccacaauuaccuuaacaccaaagccaaauacaccauaagaaaagaaaauuacaggccauguucacagauaugcaaaaauccucaacaaaauacuagcaauccaaauuaaauagcacauuaaaaggaucauacaccaugauccuuuuaaaguggaauuuaucccugggaugcaaagaaauuuuaacaugucugaauuuauaaaugugauguacuauaauauuaccacaaugaaggauaaaaaucauaugaucaucucaguagauggagaacaagcauuugacaaaauucagcauccuuucaugauaaaaacuuucaacaaauuagguauggaaggaauguaccucaacaugauaagggccauauaugacaagcucacagcuaauguuauacucaacaaggauccuaaggucaggagcaagacuaagaugcucacucucaccacuucuauuuagugugguacuagaaguccuagccagagcaauuagagaagaggaagaaauaaaagucauccaaaugggaaagggagauguaaaauugucucuguuugcagaugacauuaucuuauauauagaaaacucuaaggcuuggcgugguggcucaugccuguaauccuagcacuuugggaggccaaggcugguggaucacuuaaggucaggaguucaagaccacccuggccaauguggugaaacccugucuacuagagauacaaaauuauccaggcguaaagaugugugccuguaauccuagcuacuuaggaggcugaggcaugagaauugcuugaaccugggaggcagagguuguagugagccgagaucaugccacugcacucuagccugggcaacagagugagacuccaucucacacacacacacaaaggccggcgcaguggcucaugccuguaaccccagcacuuugggaggccgaggcaggcagaucacuuaaggucaggaguucgagaccagccuggacaauauggugaagcccugucucuacuaaaaaugcagaaauuagcugggcacggugaugggugcuuguaaucccagcuacucaggaggcugaggcacaagaaucauuugagccugggagguggaggcugcagugaacugagauggcgccacugcacuccagccuggcgacagagccagacuccaucucaaaaacaaaacaaaacaaacaaacaaaaaaacucuaaagacuucaccaaaaaacuauuagacuuaauaaguucagaaaauuagaagauacaaaguuaacauacaauguuucuauaugcuaacuaucugaaaaagaaaucaagaaaacuaucccauuuauaauugcaucaaaaaauuacuuaggaaauuuaaggagguaagagauguguacgcugaaaacuagaaaacauugaugaaggagauaaaaaaggacauaaauaaauggaaagauaccccauguuugugaauuggaagaauuaauacuguuaaaauguccauacuacccaaagcgauccauagauucaaugcagucccuaucaaaauuccaaugaucuuuuccccagaaguauaaaaaaauccuaagauuuguauaaaaccacaaaacauccuaaauagccaaaguaucuugggcaaaaagaagaaagcuggaggcaucacauuaucugauuucaaaauauauacuagaaagcuauaaaguaagcaaaacugcaugguacuggcauaaaaacgaacauauagaccaguggaauagaauagagagcccagaaauaaauccaugcauuuacggucaauugaucuucaacaaacguaccaaggacacacaaugggaaaggacagucucuuccauaaaugguguuaggaaaacuagauauccacauauagaagaauaaaauuggaugcuaucucacaccauauacaaaauggauuaaagacuuucagauugacuuuuuuuuuuuuuuuuuugagacagagucucacucuguugcccaggcuggagugcaguggugugaucuuggcucacugcagucucugccuccuggguucaagugauucugcugccucagccucccgaguagcugggauuacagacaugugccaucaugccccgcuacuuuuuguauuuuuaguagagaugggguuucaccauguuggccaagcuggucuugaacaccugaacucaagugauucgcccaccuuggccucccagagugcugggauuacaggcaugaaccaccguggcccagauugacuucuuucacuuaguaauaugcacuuaaguuuccuucauuccuuucauggcuugauagcucauuucuuuuuagcacugaauaauauuccauuaucuggguauacagcaguuuauccauucaccuacugaaggacaucuugguugcuuccaaguuuuggcaauuaugaauaaagcuauuauaaacaucuauguguaaguuuuugugugacaagcaauuuuuaacuccuuuggguaaauacuaaggaguacaauugcuggaucauaugguaagaauauguuuaguuuuguagaaaauugccaaacgguauuucaaagcggcuguaccauuuugcauucccaccagcaaugaaugggaguucuuguugcuccacauccacaccagcauuugguguuaccaguguucugaauuuuggccauuugaguaaguguucagugguauuuguuguuuuaauuuauauuucccugaugacauauguuuauuugccaucuguauauauucuuuggcgaaguaucuguuaaaguccuuugaccauuuuaaacagaguuuuacuuguuuguuuucucauuuuugaguuuuaagaguucuucauauauuuuggauaacaguccuuuaucagaugugucuuuugcaacuauuuucucccagucuguggcuugucuucucuuaacauuuucuuuuucuuuuuuuuuuuuuuuaaguuagagucuugcucugucacccaggcuggauggagugcaguggugagaucuuggcucacugcaaccuucgccucccaggcucaagcgauucuccugccgcagccucuugaauggcugggauuacaggugugcacuaccaagccuggcuaguuuuuguauuuuuaguagagacgggguuucaccauguuguccaggcuggucucgaacuccuggccucaagugaucugccugccucgaccucccaaagugcugggauuacaggugugagucaccacgccuggugaauauugucuuuugcagugcagaaauuuuuaauuuuaauaaaguccaguuuaucaauuauuucuuuuauggauugugccuuagguguuguguguucuauucuuuuuuuuuucuguagugcuuauuaccuucuaacauacuauauaauuuacuuguuugccuccccccugcuaaacuguaaaccccaagaggacaaggaccuuuguguauuuuguuuauuagugugucccaagcauacaaaacagugauuauccaaauauguauuaaauggcaaccuaauucugaaacuggauuuuuguuuuggaguguaugcugaaucaugguagcauugaccuucaguuuugauaucuguguggguuccuagggccuagucaagauggagaauccaauaggaugcccuuacauagagcugagaacccaaaagaaguacauccuuaguguaagagucaacuagagaaaaaagcccauucuacagagaauggcagcaagaaaacuucacuguuuugaucuugguagugauuggaagagagaaaaaaauugagauuuuguaaccacaagccagccuucuuuugggcuuauggcccaaauucacauuaacuauggucugaaaaaccuuaagccucaaaauaauuucaucuagcagaagcaaacaaauucucucuggaggaggaaucuucaguuuaggcuucucacugauaagguuucaaaguacaugagcucacagucaaaaaucacaacauacaaagaaacaagucaucgugaggaagaaccgcaaaagcaauagguagcagaucagaccugcguuuacuucauauauuggaauuaucaggugcuaacauucuuuuacaauguuugaagaaauaagaaauugaaaauaugaccaaagaauaagugaauauaaaaauauguuguagcagauuuuaaaaaggauuaaauagaacuagaaaugaaaaauaugaaaauugaaauuauggccaggguaagcagcauauuagagacaacagaagagagaaugagagaaugggaagauagaguugaagaaaguauccaaauguagcacagagacaaaaagauauaaaauaggaaaggcuaaggaaauggugcauagagucagaaggcauaauguccaaucauaguuucaggaagagacuguaucaggauacaaaugucacacuaguaauuugaacagggaaauuuuaacauaaagaaugguuaacuguaaaggugguucauuacaauuacuaaaagggguaaaaucagcuaccaccccugguccugagggagagugaagaaggcaggaacuuagaaacacagaggaggagggcuccucccuccaaggcugauauugaaaccuuugaggagaggcugcagugucacagaaacagcaguccaccaguggcaaacuugucagagggugacuacugcaacaauccaugcagcacagaagcagccugcugcugagugggggagaaucuugcuggaaggugcaggccagggcugaacugugaaggccacuaaggcgaaugcuaccauguacuugcuggguaaccuuaggcaaguuacuuaaucucucugagucuuacuucucuagcuuggaaaaugagggggcugaacuuuaauuacuaauguugcuucuuuuuuugaagugaggccauuccaguguaucuucacaaaguuagaguugguuccuuauugaaauggucugucuucauugugggguuuuguuuugauuuuucuguaguuuugaucaagaauagaugguacagcuauugaaugccacguugagauguuaaaauguaaauguauagaguaaccacuacaagaauagaaauaagauaauauaacuucuaacacagaaaguaauuaaaauaguuuaguuuugaucccagcauaagaaauagaccagcugaggcaaacuggggggaauauugaaacacauauauaauugauaagagauuaguagacaaaauauaugaauaauuuuuuuuuuuuuuuccugagacggagucuuuuucugucgcccaggcuggagugcaguggcucggcucacugcaaccucugccucccagguccaagcaauucucccaccucagccucccagguagcuggguuuacaggcacacgccaccgugccuggcuaauuuuuguauuuuuuuuaguagaggugggguuucaccauguuggccaggcuggucuugaacuccugaccuugugauccacccaccucggccucccaaagugcugggauuacaggcgugaaccacggcgcccggccugaagaauucuuaaguaaggaauagagacaaacaagaaucucaagaaaauaaggaaaaaagcaacccaauagaaauacaggcaagagacuuuaccgggcaauucacagaagauaaacugaaaaggugcucagugguaaucaaggaaaugcaaauaaaagugaaaacgagauaccauuucauaacaacuagauuagaaaaacauuaaaagcaugauaaugccaacuguuggugaggauaugguguaguuggguccuuaggcacugcuagguggcagugguguaucacuacuuugggaaacaaguaggcauuauucagauaaauuugcacauauguauguccuacauuacagcaaguuccuaggccuauauuguaaagaaacucuuggcauguguguucgaggagauauaucagaacauauauaucuuuauaauauaaaacauuggaaaugaccuuaauguuuauuggcaggguagcagaaacauaaauuaugguguauucuguacagugaauucuauacaguguauugugaacuuguagagauuacauacucuauaauuuauauaaaucucaaaagugugcaaaacuaaacaauacauuguuuaggguuagguacacucauggaaaacaaaguaagaaaaugaugaacaugaaagugaggauggugguuaccucuaaagagguuaggaaagaggagaugucauuggagugggcacauagggaguuucaaagauacuggaaauuuuaucuuucuucaguugggugguaaguacacagauauucauuuuauugucauucguuauaucuuagacaugauacaaauauucuuuuguauaaauuauuuaacaaaaacugaguuugucauuugcuuuauuauuauucuuugauaggcucacauuuauucuuuuaucacauuauuucuaauguuuagaaaaacauccuggggauuuuaauuaguaauaguuuauuuaaucuaguuauuaaauuagggagaauucucuuuuuugcuuuacuaaguuuuucuagcuaggacaguguaaacuucauaucuuuuauuucuuccaugaagguuuuauuuauuuauuuuuuuugagacggcgucucgcucuguugcccaggcuggagugcaguggugcaauaucagcucacugcaaccuccaccucccaggcucaagcgauucucuugggaggccucagccucccaaauaccugggacuacaggcgcccgccaccaugccuggagagaugggguagagaugggguuucaccguguuaaccaggauggucucgaccuccugaccucaugaucugccuaccucugccucccaaaguguugggauuccaggcgugagccaccgcgcccagcugguuuuauuauuuuuuuauuguuuuauuugaauaaguauuacuguggcccaaguacauccaagaauguaauagcuuaaugcuuucacuacuauugugagugaaaacuuuucccuguguuuuugagcugagaugcuggcuugcauucuaaaauucauugauuuccucuaguaaccacacccacccccuuaagauuuuccaggugggcaaauacguuaucugcaguguaauauuuuauuucuucaucuucuauguauuaugcuuuuuuguuucuuuuuuucugauagcuauugcuagcauuucucaucauauauaaaaugggaaugaugacagaaagcuucagacuuggaaucagaagacauggguuugagaccuggcucugccauagaccagcugaguaaccuuaggcaaagcaagcuacuuaaucucucugagccuuguuucucuaguuucuccauuuggaaaaugacagggcugaacuucaguguaucucaaugaagucagaguuggaucauuauuuaaaauagucucucuucauugugggguuuuguuuugucuguaguuuuaauaaagaauagaugcuacgggcuacuucaugguauguugacauguauugggaaaauuaaacuugaacuguagaucuauauuuuccauguuaugaagccagugauugacuucucuccuguugucugcaccuuucauuuuagagauaauaugacugugaauuugguuagcuaagauuucaugucagguuuuugccuauauauucacaagugagauuuuggccauaggguuuuuuuuucuuuuuaucucauuuuugucuuuuaaaauauuuuuguacgaauuauugauuuauucuuuucuuuuuuuuuuugagauggaguccugcucugucacccaggcuggagugcaguggugcgaucucagcucacugaaaccuccguccggguucaaaugauucgccugugucagccuccugaguagcugagauuacaggcgccugccaccaugccuggcuaauuuuuuuguauuuuuaguagagacagggcuuuaccauguuggccagacuggaugauuuuuuuuucuuuucuuuuuuuuuuuuuuuugagauggagucccgcucugucgcccaggcuggagugcaguggcgcaaucucggcucacugcaagcuccaccuuccggguucacgccauucuccugccucagccucccaaguagcugggacuacaggcgcccgccaccaugcccggcuaauuuuuuguauuuuuaguagagacgggguuucaccguguuagccaggauggucucgauuuccugaccucgugauccacccaccucagccucccaaagugcugagauuacaggcaugagccaccgcgacccgccuuuuuuuuuuuuuuuuuuuuugagauggaguuuugcucuugucacccaggcuggagugcaauggcuggaucuuggcucacugcaaccucugccuccuagguucaagcgauucuucugccucagccuccugaguagcugggauuacacgcccagcuaauuuuuguauuuuuaguagcgacaggguuuugccauguuggccaggcuggccucaaacuccugaccucaagugaugcgcccguguccgccuccuaaagugcugggauuacaggcgugagccaccgcgcccagccuauugauuuauucuuuaaaaguugaagaauuauuuagggauuccaucaaggccgugcaccuuuuucaauguuugaccuuguuuuuucuguggcucugucagacauaugugccuuugaagaaggcagcuaggugcagccaggaggcuccuugucugggacugcccagaguucuacuaacucccccuagagccuugggcaggucaccuucccucucugaguuuucucaucuguaaaaugggaaugcaaucaugccaccugccucccagauaagguaugaagugguggugguaugcuuuguaaaugaggaacccccugcccucucucacagaggggccuaguggcuggcagacugggcaucuuggauuuuugcagaugcuuguccauuuccacucagacuuguaaaaauagcugagauuuacaagcuuguugccacagcuuuuagaauauuuauuucacagauuccuuaaaaaaaaaaaaauaggcugggugcaguggcucacaccugcaaucucaguacuuuggaaggccgagguggcggaucaccugaggucaggaguuugagaccagccuggccaacauggcaaaauccuguaucuacuaaaacuacaaaaauuagccaggugugguggccggcaccuguaaucucagcuacucgggaggcugagacaggagaaucgcugaacccaggaggcagagguugcagugggcugagaucacaccacuacacuccagccucgaugacagagugagacucugucucaaaaaaaaguuaaauagauacauaaauaguaaaagcguagcuuugcauuaugucaugugaagauuuaaaaucuuuuuucaccuaauuuuuuaaaauuuacaccacuaauaacaagugagggaaugcuaacuucuuauaauccaagggugccuuuucucuuuaccauggaagaaucuuuaaaauuuauuuucccaaagauccuuguagauucauuuauagagcauccccuccacucaucuuuaaacauuagcuuaauguuuuucaaugaguggggcuaagggaaauaauucagaccacuugagguuaauuuuauucaucaacaaaaaguuuauaaacaagaauguucaguuauaugaacaaggauauacaguauuccuuugucuccccuucuuagaaugggagcuucaugaccacaggaauuuuauuuuguguguguguuuacugcugcaucuccagcuccuagaucacagccuggcaauuaguaggugcucaauaaguacuuguugaaugaaugaauuccugaagauuggauagcuaucauucuuaacuuacauaauguacauauuuuucuuuauuaaugggacuaauagcuuauuaacuuuuuaucaaauauaugagcacuauuucugcuuauggaaacugcgacuuuucuuucucaauuuuacucauuccugcucuggcuaagguauugaaacgccuuuccuuuuuucucugcuggucuucucuguugcuuccaucuaugcccuuuggauggcuuccauucauauccuuuuucuccccuuugucauucuuucucuuucucaucacucauauauuccccauucuuuaauucauuuauuuaaaaauauuauuugaauaagcaccuaauggaugccagccugcuaggcauugaggagauggggaugacaagaccuacacauccccugggcucauggaauuuauagucuucagggaagacaggccugagcagauauuucacaaauauuuaugaauuaugguaaauacuacgaaagcaaagcuugagggagcauggagcuuuaggaaaggcuucccugaagccauuuuagcugagaucuaaaggagaaauaggaauuugcaaauuuggggccucagggaauagcaugggggaaaguaggagguaugggaagggaaguaggguuuaccuggggagcccagagcaacuggaguaacuggagcacagcaagugcagugaugggagaagaggccucucagagggcacagucaucaucauccacauuucaguggugacucuaggaucugccuggcaagaucccugccuacacuguggcaaauggcacugauaacuugguuguccagagucuguuacaaauuucuggauuuggaaaucauuuaagaaaaaaucuuaaauuuuaugucauugguaguugugucuuugggcaagucauuuaagcugucagagccuccauuuuucugaaaugggaguaauugugucuacucugugggguccucugugaccucugccaggucccccugugauuguuguuggaaguccaucuuucucauuagacugagggccugagggagggugagucuagccugguauacugcuggcuccuguuguggggccuggcauggagugaggacaucugggagggcuucauagacgagggagccccagggcugggcucagaagacaggcuagauuugagggucggggaagggcuguagagguguggacauaucgacgucuggaaagaggccagugaagaccaaagugcagaggugguaacaacagcaaucacaacaauaaguuacaauugugcugacuuucugugcacccucgccgugugccgccacuguucuacaugcucuccauacacuaacucauuuauccuugcaguaaccuuacgagguagguacuguuguuauccccauuuuacaaaugagcaaacugagacauggagagauuaagcauuuugcccaaggucacacagcuaacaacugcuggaaccuggauuuaaggccaggcauucgugacuucagaguguaagaggcaacgaaugcagagaagugggaagggccuuaaaugcuaagcuaggaggcccaucuagacuuuauccuguuggcuaugggagccauagaaggcuuuugagggagggaguggcaaggcuguuguaugcccaggagagcuggcauggccaucccuucuuccuacagaaaccauccacggagcagccccuguacagcagcagccuguggggcccggcgguugauggcugugauugcguggcugagggccuguggcugccgcaacuacacguaggggacuggcuggucuuugacaacaugggcgccuacacugugggcauggguucccccuuuugggggacccaggccugccacaucaccuaugccaugucccggguggccugguaagagggcccugcuggaaaauggggguauggggaggaacugggcagaaacgagggaaacuugagauuugagauucugcuucuguguaauccaacuugacaaguagcuguuggcugcuggucccacgugagggaugugcuuggcaccuggcuguggccauaagugaggcugggcuuuccuagaggagcucacagcccugagggaggcacagagaagcagacaggcccuugugauaauacugugccugguggaagugcagagcccucccugaggcccaggccucccugaggaagugggagucaacuacaggagugggugguaggacuucccagaagaaaggaacggagagcaaguguggugcauucaaggcucgcauggagaguggcugugacugcagagggaggcagggcuagaucugggaagggcuugaaggccgagugacacgcuuugacagcagugggaggcauggaccaguuugaagcaggggcauaacacagucugauuugcacuuuggaaagaccacccuaguuccuguauagacugaggacaagggcagaugcagaaagagaugaccaguuagguggcugcugugugacacaggagagacuuggucugccugcuugcugagccuuggucuuuccaucuagaaaauaagcguaacaguagcccugccugccccaccaggcuagugcugggauccagugaggcaagaggcaugcaagaugggggagucacauccagugaacccugacaucaggccuuacguuaggugucguaugacuauuucacccacacaacacucugugggggucagcguuaucacagagaggucauucuucugaggucacgcagcuagucaguggugaagggucccucuuuugggguagggagagggccacagaaagcaggagcaguuugcccaggcacauucaauuccucugcuguguccagucucaggacugucaccaaagcugagaccugaaggcuaaggaggaauuagaugagaguugaugauacaggcagagagacaaggauggauccaggcuggggagaggacauguguaagagcccaaaagguggccauaguggauggcucaggugugugggccaguguguccaggaguggguggaagaggcggguagagccagaucuugcagggccugagagcagagggaaauggcuggcagcucaagggcagggauuuguuuuuuggaaagaugaaucuggguccuggcugagaacugucuggagagggcacgagcagaucagggagacugaaaugguguuacccauggggauggagaccauggggcacaugaggauguucagaagcugggcucagcagggcucaacugggugugggaacaagauugccaacuguuuacaacucugauaguggagccauugaucaacauggguauguaggaggagaagcaguuugugggauuguuugagagaaugggauaugauuuuauuugaagucccaagccugggguaugaugaaugugggcuuucgagugagaguuggguucaguccuaguucuacuaccuacuagggaugugaucuuagguaggucacuucucucucuggggaacugauugauuacaucaucaaugcaacggggaugguaaugccucccucaugggguuuuugggaagauacaaauagauaauauaagugccuggcaugaugucuggcauguaguaaaugcucgauacauguggauuucuuucccuuguugagggguggggaccacacgggaguaggaagcaguuggggaggggucagcagccugucccugccccugcccucagcugagcucgggcucacgugagagcccucugcccaauggggcugcgucuccagguacagggcccugccagucccaugcuggcuacuugcagcaccccucucucaccccuagggaagcgcugcgaaggcagcugauggcugcagaacaggaggaugacguggagggugugugcaagccucuguccugcggcugggagaucacagacacccugugcgugggcccugucuucaccccagcgagcaucaugugagugggccucguuccccccggagaaucccagcggggccucagagaugcaucugggagagguggggaagauggcaggcaaggguacccuuggccaggacucuggugcccacccugccacccccgcgcuccaccugcaguguuucugcccuguaaauaggaccagucuuacacucgcuguaguucaaguaugcaacauaaauccuguuccuuccagcugugucugccuccucugcagugcaaggggccuggucagccagguguggggguguucuuggggucuccuuuggucuccuucccaccuuuguaaauauaaugcaaauaaauaaauauuuagguuuuuaaaaacugcagcggaaucuggcaguuugauucacaaagcagccugggcuaggccuggggcaggauuuccccaucacucacugaugagcccacacccucugcuuuaguccugagcccuggcugcagcgugugccucccccacuaguacucaccuuaucugacucaucucucuccuccucaugggccuccaggccuggugccauaaggaaggggcugcugucagggacugagaugggcaguuacguagcucauaacuggugaauggccuuugggucagcccaacacccagcuuaaggccuggcccagaguaggggcaauggaguauuuaacacagcuguggaaauucauacugaagauacagagccaagaaaugggugugugggagguuuugaguggacccugcacccuugcucucccugcagguuggcaaggcagucagaguaaagcagacaccugguggucgcuuuugcuucuuugggcagugccuguuagaacagggcuggccacggaguauugcuguguccagugccgacagcccuggcauccccugagacuggcagugcuuaucaggacaaaggcuccuucacacugccggguucccaaauuaugccccggggugugugagcuguugagcaaaggaguucagauuuuagagucccccucaguggcugcaggggacucuaaauauuuuucugcugcaauuaaaagauuugagauguaauucauaugcaaucaucaaauucacccuuuuaaaugcagaagccugggugcaguggcucacaccuguaaucccagcacuuugggaggcugaggcaggugaucaccugaggucaggaguucgagaccagccuggccaacauggcaaaaccccgucucuacuaaaaauacaaaaauuagccagguguggugguaugugccuguaauuccagcuacucaggaggcugaggcaggagaaucacuugaacagggagguggaggucgcagugagccgagguugcagugagccgagauugcaccacugcacuccagccugggcgacugagcgagacccugccucaaauaaagaaauaaauaaauaaaguggagaaguuagugguuucugguguauucagaguuguguaaccaucacccuagaaagaaaucccauacccauuagcagucacucuccauuuuucccauuccccagucccugaugacacaaaucuaccuuccaucucuauggauuugcuuauucuggacauuguauugugauggauuuucuaucuucacuugagcuucucucuagguaagccugaccauccugcuucaguaucucagccaguccuggugggaacuguacguggcuuugaggucaucucaugaggcaauguggcauggguuuggagugaacgaggugcuuucucaaagccaggggugucucccuuuuccaggugggaucuaguuuucgguaucuugacaauaaauaggcugaaagcuugggacaucaaaagacucagggcaaucagaaaggguuacucuacuaccccgugauccaucaaagccacgauuuacagguauuaccaugccaguaauugucuaucagacucugagacuucuuccaucucagaucuccaagcacucauacuucuuuugcggagagggacauagguuuucugcuggaaccaggcaucugcugugaaaagcgcaggaauccugggaagaucucauggcuggcuacagugagacccagguguagcugauucccucuucugagcaaguccacugagggggcauucuguggcuuuugaaaugacaguggcugucauggaguuuggauggauuucucacuggagccuuucuaguguuucauguuccauuugcagcaaggaugugaaauuuacuuuuccaagaaagauacacgcagaacuugauguggcuuacuugaggauaauaguuaauagucauuuuuu

SEQ ID NO: 14136 - RNA, 31355 nt, Homo sapiens
guuuagccauaaacuacugccccuccaacagacuucuuugauuuuaucaaagaagugaauuguucucucgaggcuucaagagaauuccaaguuuugaguugauaauuugcguuucagagaucuccaggcugucugccucuuuuuccaacaaguucucuuuuucacacaaguacacgcccccuucagggaacauucuuccagaaauccaaaguccacuaacagcauuuccuguccuaggugcagggaaaugugugaagucuggcugcagugcccaagagauaagaaucuucuaagcuggcuguuguccagacuugccauccucauuguaguaaaacacuggccaggaagacaaaagugcaucugugaaaggaaacagaaagucaucuggucuucagggaaaggaggauuucaauuuuuccucugggcccaggacuaaggugagagaggucugacacuggaagcucuuuaaaugcaaucugagggccgggcgagguggcucaugccuguaaucccagcacuuuaggaggcugagguggggggaaucacuugagucaggaguucuagaccagccuggccaaaauggcaaaaccccaucucuacuaaaaauacaaaaauuagccgggugugguggcaugcaccuguaaucccagcuacuugggagucugagacuugagaaucacuugaacccgggaggcugagguugcagugugccaaaaucaugccacugcacuccagucugggggacagagccagacuccgucucuaaauacauaaauaagaucugaaaguuggggaaguuaggggcaugaaacugacucauacaaaguaagucacucuaagauuuggaaucugacaucagguuucacgagucuucuaauuuucuugcuauacuguauauaagcuuucacuucuaaggacauuauuuuauuuugucagacggagucucacucugucacccaggcuggagugcaaaggcgcgaucucggcucacugcaacauccgccucccgaguucaagugauucuccugccucagccucccgaguagcuggacuacaggugugcgccaccacgcccagcuaauuuuuguauuuuuaguagagacgggguuucaccauguuggccaggauggucuugaucuccugaccucgugauucacccgccuuggccucccaaagugcugggauugcaggugugaaccacugcgcccagcccauuauuuuauuuuuuauuuuauuuuugagauggagucucccucugccucccaggcugcagugcagugggugaugucagcucacugcaaccagcaccucccagguucaagcgauucuccugccucagccucccgaguagcuggaauuacagacacaugccaccaggccuggcuaacuucuguauuuuuaguagaaacggggguuucaccauguuggccaggcuggucucgaacuccugaccucaggugauccaccugccucagccucccaaagugcugggauuacaggcgugagccacugugcccggccaggacauuauuuuacacagaggcaaaacuccaaguaguacaaacuuagcucaauuuugacaaauuuguaagaucagauaaauauguucagagauuuugagggcauacccccuccuuucauuacaaaucucagauuuuagucccuuuuauuuaaaccagauuagcaaaacugagaaaguuuaucagaacacggagugguauaccugagaacacagcaaacaccuaugucauugcuuugugauuaugcgcaucaguguauuucuuccuccaauaacagaauauucuguucuccaacuuguaaccaugcaacauucacugagaacucuuuuuuuuuugagacagggucucugccacccagucuggaguugcagugaugucggcucccugcaaccucugccuccccaggcucaagcgcuucuccugccacagcccccugaguagcugggauuacaggcgugcgcaacuaccgccuggcuaauuuuuguacuuuuaauagaggcgugguuucaccauguuggccaggugggucucaaacagcuggccucaaaugauccaccugccucggccucccaaagugcugggauuacaggcgugagccaccaugccugaccacugagaauucucuuaagagcuaccugggacugccacuccuucucuccucugaagcauaugacuacuagugacuauaaugcagaaaagggcaaaguuuuaagaguaaauugcacaguugcuucuagagggcaaacaaaguuaguuuuaaucuacugcuucccuauucagcugacucagcuaauaauucuucagccugacuacaaaguccaaaacaagccuagcuuugcuuccugucaugcuaggagucauagguuuauagaugacuacugcgguuggauuugaauacaauccuucuucccuuggauuagaaaaauucaggucuagagacugucaaagauggugcuuuguuucaaacacuuggcucugugggacuauccaagccaaggaaaaugagguaaguugaauuaugacagaaaucuuuauuaaaaugugucuuucaguaauauguuuagcauucaauauacacacauacauauguacacucuuugacacaccucauggauugcugccaucaguuuaaccaauaaauuaaaacuaaaaagagggaggggaggggaggggaacuaacggcaaacuuuucauguuuuaucugguaagaaauugugaauuucucagaauuucccugggcaaaaaccugugaccagagaaucugugaaauaaaauacauaaaucucuaccccuuggaaaaaaaaaaaaaaaaauuccaaaagaugcaguuacaagugugcuucucagaacaggagcauucauuccacuucauacucuggcuucuccaccuucuggcuucaagacaguuugucccucggcuagggcagagagguucauaugggcacuugggcucggugcaccuugggcucugggggucgaggggcaggcugcaguaugggagcggggggagccacacucaucugaggugaugucuggcacaucgucugacugugcaucagaacucucuaggucacugcggaugcuuucaggcugggccaggcugaugucccaagguuugcuggccaggcagucuuucuguucacagcuuuggugucugcaggggggauccucuucacugccuccgccaccacuaccuucuucuucauucucugccaucugagcaugaacauggagcgaguccuccgugcugcuuccacucaccagcugauaguggcuugguuuggcuucaauguccacuuggauuuccauauuguugcauucucuguggagacaaaauccacuuugcugagucaugcauggaucaugcuaaaccuguugguaaaagcaguucauggguucaggauuaggaauuucaaaaagauaggugaacaguuaacuagagcucacuuuuaacaaaaauaacauuuuaaucuaacacucaaaugagauggaggcuggacgugguggcucaugccuauaaccccagcgcuuugggaggucgaggugugaggacugccugaguccaggaguuugagaccagccagggcaacaaagucagacccuguuucuaaaauaaaaaaaauuagcugggcauggaggcacgugccuguagucccagcuacucgggaggcugagaugggaagaucacuugaacccaggaguucaaggcugcagugaguuaugauugugucacugcacuccagccugguugacagagcaagacccugucucuaaaaaaacaaaaauaaaaauaaaugagauggagaagaguaauuagauccuuuuugcugauuuaacuauacaugcacacgugugcucagaugcacacacacguguaucucagccaaucucuuuaaacauacagaaagagcuuccaaaauucaacuaagggucagagccccaugcuagcuuacucaaaauagaaaaguaaaagcuuuuuacuaccaugccacaaguagaagaagccagaauaccuacuagugggaguaccacaaucacaccaucccagauacaccaguuucucaaaaugaaagagaaagaagcuaugggaauccuaucaagcaaagggcaagcagaaacccuagacuugaagacaucaaugaacaucaaucuagcucuuuaaguuccauguaauuauacacuguugcaauagccaagaaagacaaaaaaaaaaaaaaaaaaaagaaaaaauacauaaaaggaagaaagaaaagaaaucucuaaaaaucaagcgcuaacaagaagaaucaagagaugccaaacacucaaguaccaagaacuugcucaaaugaauucacagguuacacuauauaucccaggagaugguacauacagcccuaacaugaggcauugaacuucugaagaccuaguacccaacgaaaaaaugcaaccucuccuggacaucugacuguucacauaccuguccuguggguuguaggaacugauuauggaaccggccauagcacgagugcuugcguugucacuaauugcaccaagacuggcugugucuuuggggaaaauuuccuuuuggacaucggcuugaacuucuaaccuguguaaagaggggacguucaaguuaauaugagaccuggguauuccaagacagucugcuuccuggcacacaucucuuccauuacucucuugcaaauugugguugucugucugaucuucuccaacugucaaacagcgcaaauagaugcccauacauuuuuucucuuaaauaucuauugaaaucguccccuccuuucuauccccacagcuacugcugaacuucagguuuucaucaucuccugccuggaugacuaaaacugggcucccucuccaguagcccuuaaguccaagucaaacaaccucuagaacagugccagugugaauaaagacccaaucacucuaacaauucucuaacucuuggcucccuacugccaacaggcauuaaggucuuccugaucugccaggaagcucucuguccaguucuaucacucccuauagauccgaaaucauagucacucugaauucuuucuuucuuuaaauaccuauacauuuuauacuuccaugacuuugcacaugcuauucugucucucuagaaauuuccuuucucuaccagacaaacuuauacucaguccuuaacaacaaaggaacuaucacuuccccucauuaucccagcaaaccauucacuucuugcuaaguacucccacagcaccugccuacuuauuuauuauuauuuguuuuuagagggagucucacucugucacccaggcuggagugcaguggcacgaucuuggcucacugcaacuucugccucccagguucaagcgauucuccugccucagccucccaaguagcugggauuauggguucccaccaccacacccagcuaauuuuuguauuuuuaguagagaugggguuuuaccauguuggccaggcuggucuugaacucuaaaccucaggugaucacccaccuaaaaaaggugcugggauuacaggcgugcgcaggcccugccuacuuauuauuaugcaucucucacuugucuguuaacuccacaaaaggagagaccacaacucauacacacuuuaccuucccugccuugcacauaauaggaaaucaaacauuuaacaaucaaauuaccuccagggaaugagacugaaggacauacaggagccaaccucuucccuccucuuggagcagcaaacuuucccaauagugucucagagcccauaacuauugccuuucuuggcuccaacaucacuuuguugcacaguuaaguauuuccuuauaauggguuucacagucaaacccaucugacucauucacuuccuauaaaauaaaggcuuucacagaacuagaacagcuggacuggcuaagcugcaguuucagcaagucagucuccaauuaugucugucugcuuauuuacagggguguugguuuuaagaaagcacagcagugaauaugccagcaugugggggcgggauccccugauaagagacaaccagagucaugagaugcacagacgggucaguagcagccugcagcugcacauucaagcagcuuccauccuacugccugagccuuugcuuugcugcuccagcuucaggugcccuucaaaaaugugccaaggcccagggaaaugagggaaugcaauggaaagugcacagugucagagaccuggcuucuaguuucaggucugccacagaaucacucugaguuggaagagucuuucagaaagggcuccuacuuaggugguugucagaugcugguucaugcaacggcugugcuagaauuaccuggggagcuuuugcaaaacacggaucacccccuaggugccacuccaggaaauucuaagcuacucauucugggaugggucccugaagucuauuuuuaagaggcucccaagugauugacaggcacucaggugggagauccaguccaccugccaucuguugcuugaauccuucuuauagccaaauagccaucuggucucauuguaaacauuuccagggauaggcagcucaguaucuacuaaaguagccuuuuuccucuuugggcuuucauguugcuuuucccuauauucucuauacugaaccaaaauuaguuucccuuuagcuucugccaagucaucuuaaucuaccuuuugguaugaggcauagaagucuaauccuuuucacaguugaagguccuuuggauagcugaaggcaaccaucuccucuaccuuccuauccugcuuuguucuaccuuuaccccucccuaggccuuucuucuccguugcauucaacugcuucucaggcaacauguuaugcuccucugaaaauauacacucuggucugccuaacuagugaaaugaccaagcaagucacaaucuuuuuaguuacaaagcuuuacauauuuucaacacaaguacauagaauugauuuuccuuaucuagcaaauggaaauagaaagguaauaaggauugcaguaucacuaaaccagcugggggcaaugguucaugccuauaauccuagcacguugggagccaaguugggaggauggcuucaggccaggaguuuaagaccagccuggguaaccgagcaagaccccaucucuacaaaaaauuuaaaauguuagcuggguguggugugugcacuuguaguccuagcuacucaggaggcugaggugguaggauugccugaguccaggaaguugaggcugcagugagccaugauugugccacugcauuccagccuggaugacacagugagaaaaaaaacaaaaaaaaauccccaaagcccacuaucaauaaaccaugaugggcuggguguggugguucaugcuuguaaucccagcacuuugggaggcugaggcggguggaucacaaggucaggagcuugagaccagccuggccaacaugaaacccugucucuacugaaaauacaaaaauuagccaggcaugguggugcacgccuguagucccagccucuugggaggcugaggcaggacaaucacuagaacccaggagguggaggcugcagcgagccaagauugcaccauugcacuccagccugggcgacagagcaagacuccgucucaaaaaaauaaaauaaaauaaauaagccaugauacagcauaaaugcuacugaaagccaaugacaagccuaacggagagcauuuuacgaauucuauaaaaaugccuacucucccuuccugaagcaggcagccucaggcagucaagggggaaucucaagucaggauuauucuuuauauagaggcagcuauggugcaauggaaagaacaaugaacuuugcauaacugacguaaccuuuuuuucuaagcuuguuuccuauuuguaaaaguaaaaaaaaaaaggccugucgcagugacucaugccuguaaucccaacgguuugggaggccaaggcgggcggaucacgaggucaggagauugagaccauccuagcuaacauggugaaacuccaucucuacuaaaaauacaaaaaauuagcugggcgugguggcgggugccuguaaucccagcuacucaguaggcugaggcaggagaaucgcuugaacccaggaggcggagcuugcagugagccgagaucacgccauggcacuccagccugagccacagagugagacucugucuuuaaaaauaaaaaaguaaaaacaaaacaaaacaaaaccauugacaauuaaaucaaaauaagaugauacguggcacaagccuggcacagagaaauggcucaauguguuacuucuuauaauucuaaccauuucugucagaaauuaucuauuuguuuaccugcuauauuuucccuugccacuggagagaaugccgccacucagcgugcccccugagagggcugcaaagcuggccguuucgcuguaaggaccuugcauaacacuaaguccaucuguagggcuuccacuagugcucaauacacuagucaggccuucaaugcugcuuuccccaaugcugggauucuugagggcucuccaggcaucugccacuggggauagaaccaaacauccaauucaagacagcagagcaucaaaacagucaguaggcauuuuccugcaaugacuuuucagagaacuaauguauuuacuuaaugaacagguacugugugcagucgccacauaucagguguuuuaacauauguucauauuuaauccuccaaauaacuaggcauuaauagccucaauuuuagaugagaaaacuaaaauuuaaaacuaaaugacuuguccaaggccaugguaguuacaugaaacuauaacucugauuccaaggccacuauucuuuccacuacacuguugcuuccauguaaccaaacgugaagauuuaaaaaauauguuugggucaugugcugauuuuaauaggaagcuucuaguagaaagcuagaaaaaccggccgggcgcgguggcucacgccuguacuuccagcacuuugggaggccgaggcgggcggaucacgaggucaggagauggagaccauccuggcuaacacggugaaaccccaucucuacuaaaaauacaaaaaauuuagccgggcgugguggcgggugccuguagucccagcuacucgggaggcugaggcaggagaaugacgcgaacccaggagccggagccugcagugagccaggaccaugccacugcacuccagccugggcaacagagcaagacuccgucucaaaaaaaaaaaaagaaaagaaaaaaggaagcuagaaaaaccuuugggguuuucuacguuacuugugcccuacguuacuuacuacgaguagaaaccacauuaaaguaaaagucagaagacuugcccuagucucagcucugugaagcucuuaauagauaguaagaugaaagcuuaaagaaauucccauuuaggccagaugugguggcucacaccuguaaucccagcacuuugggaggccaaggugggcggaucauggggugaggagaucgagaucuuccuggcuaacacggugaaacaccaaaccccgucuauacuaaaaaaaaaaaauuagccaggcgugguggcacguugcuguagucccagcuacucaggaggcugaggcaggagaaucacuugaaccugggaggcggagguugcagugaaccgagaucgcgacaucguacuccagccugggugacagagacuccgucucaaaaaaaaaaaaagaaauucccauuuaaauggggauaacagcuccauccucccucgucagagagcuguuuguuguaaaaagcaagugagauaauuguguaaaauacucugaaaauuaucaaguacugugcagauauaaagauguuauuauaaucacuacuacuaccagcauacuuggaguuacuuggauuccuacuaguuuguaccugccacacagaggcaaguaccaggggaauuaaccuaauaacuuuggaacaaagaaaugaaaagcuaaaaauacuuuacccccuacaaagcucauuauccaaaguaauccaaugacaaucucccuguaaaaugcgcugaauuuuacugauuuuuaucuuguauaucauaaauucaaauggaaauaaacauccugcuuuuuaccugugauuggaccaucaucuucaucaaauucaauuuucacuccuuuuccguuggcugugcuaacuccacagccgccuccacgacaaagagaaaugggcacaaccccauaaacauaugccagcauaauggggacaccaauaccugggggaagagaaggaaacaugucagcuggcuauuagguugcaagugcccugaauucuucuucccagucugggcauggacaaaccacuuuauaaagaaaggaagacagaaaguggcuaucccaaaaagguggccugguguaacagaaugaugaccaggcuagaaaucagaaaggucuggauuagauucuuggcuccauuuacuagcuguauaaccuuggaccuaucuucccaggguugucaauaaucaaaugagaaugcuauguacuguguuuugcacaguaaauauauguugcuuucauuuuccccucuucuaaucacugcugaaaugcuaacccaaucaagagccaaucaagaaucaaauauuaaauaagugacuacugcuuggaguuuaggaucuccucaggauguuaauuccaaaaucuuacugcugugugagguagaauggcuuagcuguuaagagaacaggaucugaaggcagauuaacuugauucaugucccagcuaagugaccuugggaaaauuacugcaccuuucuuuuuuuuuuuugagacggagucucacucuguugcccaggcuggagugcaguggcacgaucucggcucacugcaagcuccgccucccagguucacgccauucuccugccucagccucccaaguagcugggacuacaggcacccgcuaccacacccggcugauuuucuguauuuuuaguagagaugggguuucaccguguuagccaggauggucucgaucuccugaccucgugauccgcccgccucggccucccaaaacacuggaauuacaggcgugagccacugcgcccagccaauuacugcaccuuucuauuaaaauugugcuuccuuuuguaaggauugugaggauuaaauaaauuaauauaugcaaaagucucagaaccacuccuggcacaugaagagccacauuaaauguuaguuacacuauuauuauucuaaaacaaacucuuaugccucccaaaguaaugugaagcauuaaacaaaucaaaacaaaaguaauuuuguuuuguggauuucauggcaaguagagaaggaagaugaaaggugaaaacuagggcuuaaaauaaguuucuguaauucaaccuuuucuaugugccaaauggaguucuaggcacuaacuuaagaacaaaagauugcacacucugauaauuuggugugcuugaaaaacuuaaaaauaaucauaaucauggugccuaacagaauuuacuaucaagguggguucgcauaaaauguaggagucuuugagaaacaucuggccaucuggcuaaacugcuauggucagaaagcugagagagaagaggugugguccugacuagcuuaccaacacuaacugcagcaauaacuggggaugcaaugaccgacaaagucacuccuccagugauagccaaauuccucuuguguuuggagguuuuccuucccucauaccugcugugaaucuaagaauaaaaaaagaaaauccaggucagcagguuaggacaucaaucuuuugccagagaaaaaaaggacaggugaauauucacuuguaaguuaucuauauuaaaacauauccucuaccccaaauaggcaucuuuaucaaauuuuaaccuaacucagaccuggaagauauaaaguaauacaggcaaaguuaauccaaaaagagacaaaauaacuccagcagaaugaaguaagcauuuuaccuucuucuuuuauuuuuuuuuuuggagucugucaugcaggcuggagugcaguggugcgaucuuggcucacugcaaccucuacgucccugggcucaagcaauccucccaccucagccucccuaguagcugggacuguaggcacaugccaccauacccagcuaauuuuucuauuuuuuuggguacagauggguuuugucauguugcccaggcuggucucaaacaccugggcucaacugaucuaccugccuuggcuucccaaagugcuaggccacguauuacaaaugugaaccaucaugccuggcccagcauucuaccuuuaagucacugagacaagccaggcccaggauguuaauaagaacuuucagaucucauggggguuuaugaaaauccauuuaagaaaguaagguuauuuuuaucuaagaaccagcugguuuucaggcagcucugaaacauagcuccuucccauuucccucaaaccuuuacuaacgaaccuaaaguugaaacaagcacagaaaccagcaugucuuucuuaccuuccuuccaacauaaacaggaaugccaaugaccauggcaggaauggcaaugccagcaaugagagaaauccccacuggagcaccaaucaacgugcccagcugccaaagaauuuucuucuuacggcuccauggcuucuugccccagaauguacagccagaggggcugcaggggaaacagacugaaguuaaugucaacauuacaaauacagcuaguauuaucauagggcuugauaacagcaacagccuucuuuucaguaaggauuaacagaagaguuuaugggaaaugaauacauuacacaagggagagcaaaggacaaggccagacuauuagagcucugggcucuuuaacuuuuuugguuguuguuguaaagacaggcuuccagacuugaaauuccuuuuccauucuucucugcugaauucugucuucccuaacccaccaaaacugaucuagcuuccaugacugacaauacuugggaugcugcauagccuuaugcacuugacaucccauccagacacacugcacccugcacuaaugaacacucugauuuguguaguuuucuuggcauauguccuaccauaccuaauagauacugcaaaccauguucgugggagaggauauaaaaagaccucaucauaaccuuucuaucaguuugguauucugaguuuggcuacuuuuacagucagcccuucugugcccaaccauuuuugcccauucucuuugugcuaucuucuccacuagaagggauaaacaauuuugaaaauagggaucaugucuuacucaccccuauguccccaaugacuagcacacaguaaguacucaaauguucgacaaauuggcaaugaagguguuguguuucauuuacacaaugaauguuuguuuguaaauauuaacacauuuuguuuauuuguaaauauuagcaaacauuuuguuuguaaauauuaacuccuccacaacauuuuaauauucacucaaugaggcugggcgcgguggcucgcgcuuguaaucccagaacuuugggaggccgaggcaggcggaccaccugagguucgaguucgagaccaggcuggcuaacauggugaaaccccgccuccacuaaaaauacaaaaauuagcugggcaugguggcaggugccuguaaucccagcuacuuaggaggcugaggcaggacaaucacuugaaccugggagguggagguugcagugagucgagaucgagccacugcacuccagccugggcgacagagagaaacucugucuuaaaaaaaaaaaaaaaaagaauucacuuaaugaauuccuugggaacucacuaaaugcaaaaaacuguaaaaaggucacaacucuagccucaagauacuuacaguuuaguaagauaagauagguacgugaaguguaaaguacugacgauauuuaugacaaaagauaaaagaaagucaaagaaugaggcggaaaaaggagaggcaacauggaugaaaggcauuuaaguggcucuuaaaagauaagaacugaacaaguugagauaaaaggaggauacuggaagguaggcagaaagcauucuaggcaaaggaaagaacaugaacaaguauggaggcaagacagcaaaagggaaaaagcaaguccagacuaccuguaauauggcaagcaaagaaagguagaaacagaauaguagcuggugaaaacaugauuagaggagcaugucagaagaaguuuucacagcuuccuuaaaccuguaaugagagaacggaugugucuuuuugacauccuuuucccuaaaucaguaagagaaugagacuacgaaaggaauggaugcauuucccaucuuaccugagguaaugcaagucugagaucucuuucauacaaagccaacagaauucacagccacacacugcacaggucaugugauuacagcuuccaucauucaucuugauaauguaugcacugcaucgugggcauggcuugaugucaucugcuaugagugggggaagaauggguagaaaaaauaccccuaguuaaauccaguuugauuuaauuguuccuaggaguauauauaagaaaugaggcagcagucaagaacucuucacugaacacuccaaauuguacaacccacuuuacuggaagguuggcuaugucuagaccucaggaauuuucauaaaaugaauccugucucuuauugagcugccuaucccaacaacuggcaucuuacacagcacuugaaccacauucuagcaaggagauuuccuuagggagaaagauguuuccaagaaaaaugaaauuucuaccagucgauaggcugguagauuuaaaagaagaauccuacagaaagaauagccugcagccuggaauuagcuuuacauuuuuaaaaacuuuaguuugggaaauuuauuuuucagguucaacauguaucauugugauuugcuguuaacauagcccacaaucccuucccaugauacuuucaaauucaaaaccuaaaaacaacuggguaugcuaucuaccauauacuugguaauuuucagagcaaguuaugaacuauccuaauaaaaugacaauuuaggaaauuaugcugugccaggaaaaagugaauggcaaaaucuuuccuacuagccucucccaaaugacaucagcaaaauaaaaguacaaagcaauaaauccacugacauuuuaaaauagguuuccucugacucgccaagguuggagcugaaugugugacauuccuccuuuuaagguuaaucauuaaucuauacuaauacuguuuccuuuucuucaaucuguacucuacuuccaaaggcagugaggcacuuaagucagcuugaaggcaaacagcacagguuuaauacuaauuaaaugucuuucuguucacaaugaaaguuuugaaaaagccccuagcaaaacaaaaugaacuaauugcucuccaaucugagacauauuacuaagaaaguaggaacuacauaauucaauuuuguugcauuucaauuuuauauaguuggauaaccuauaauggucagagagggaagugcuaucuuuauuauaauauugaaaguauuaucaaaugauauuuucugcucucugauccuuuggaguacuuggguuauacaauaagauaauuucuuucagcuaugggcucacaucaugaaauaccaaauaaagagacaaugagauaaugccaacuuauaccugguccagauucuugcccauaacugagaccugaaguguguuugguccgaacucguaaagucugggcccucuguugacgggccauaucgcaugucugauuuggaugccauaucugcuugcagugguagcagaacucagucuggcaaccuucccucucacaaguuagcuucgggcagcuggcacagccauaggcaauaacagcauaacuagguaaggaaacaguaagagauaccaguaagguaagaaugaucuaaccaaaagagacauuauucaucagaguuaacaauguuuggcacuaccccacuaucacauaugauacagagaaaagaauacacauacacacauauacacacacaagcacauuugaccaacuguaaaauauaucccaugugagaaaguaaacuuuuuuuuuuugagacagucuugcucugucacccaggcuggauuguggagugcagugguguaaucucggcuuacuacaaccuccaccucccagguucaagcaauucuccugccacagacucccuaguagcugggauuacaggugcaagccaccacgccuggcuaauuuuuuuuguauuuuuaguagagaugggguuucaccauguuggccaggcuggucucaaacuccugaccucaggugauccacccgccucggccucccaaagugcugggauuacaggcgugagccaccaugccuggcuauaaauuucuugagauuccaaaaacacaaaucauuuauuuacuuuaaaaaguggagguggaguaucuuauuuauccuggauuuccagcauuuauucaaucauagcugaagcugcuuuaggaguaguuugucauaauaaguuucauaaauaacaggguacaaaacuauuuccuuuugauaguuugcuauauuuagagagauuaguauuuguuuauacgaaggaagaggacauuagugaaauaaagagcuauggcaaaaacuaaaguuuauuuuuuaauuccuucuuuuuuuuuuuugagauggggucucacugucacccaggguggaaugcaguggcucacugcaaccuccgcauaccaggcucaagcaauccucuugccucagccucuagaguagcugggacuacaggugcgcaccaccacacuuggcuaauuuuuguaauuugcauagagaugggguuucgccccauugcccaggcuggucgcaaacuuccgggcucaaucaaucagccugccucagccucccaaagugcuggaauuacaggcaugagccaccaugcuaccuuuucauucuuuuuuuuuuuuuuuugagauggagucucgcucugucgccaggcuggagugcaguggcgcgacucggcucacugcaaccuccgccucccggguucaagcgauucuccugccucagccuccuuaguagcugggacuauaggcaugcaucaccaugcgcagcuaauuuuuguauuuuuguagagauaggguuucaccauguuggccaggauggucucgaucucuugaccuuaugauccgcccuccucggccucccaaagugcugggauuacaggcgugagccacugcacucagccuuuuucauuuuuuuucuucaaguaaaaauuguuuuauugucauuaacauauuuaauauaaaaagaaaugaagcaaauggcucaguguuguauuuuuuaaaaaauccagguuugugcagguuacucuauuuacaucugggagcagagcuguccccacgucaggcauagcaguugcacuucuccaacgccccuuugcagaugcagcccugggcacacuuggcacagcccacggggcagcaggagcagcagcucuucuugcaggaggugcauuugcacucuuugcacuugcaggagccggcgcacaugcaggagccaccaguggcacaggagcaguugggguccauuucgagcaaaggagaugcuggagcucccaccggugaggccaacaagcagucaggcaguuggaaagcaugcugccuuuuucauucuuaaguuccaguuccacagugaagcuggucugaccauagucacagagacaauaaacccuaaagacuuaugaucagcaucccucuugaaagcucaucuuaucuuuccauacuuuuucaauucaaaccuauaccuugaaaugucuugauaggcuccagaauccaagaauaccaggccucuaucuuauaaauuaaaauagcauuaaggccauaccucccuuucucucuucugacacauauucuuuuuuuuuuuuugagacagagucucacuauaucgcccaggauggagcgcaguggcgugaucucggcucacugcaaucuucucccaaauucaagugauucuccugccucagccucccgaguagcugggauuacaggcgcccgccaccacgcccggcuuuuuuuuuuuuuuuuuuuuaguagagacagggcuucaccauguuggcaagacuggucuucaacuccugaccucuggugauuugccugucuuggcuucucaaaguguugggauuacaggugugagccacugcacucagcugugacacauauucuucauguaaagauucagaauuuaucagcacuaaugucgaccauuucuuguaguucauguucauuuaccaagaauuagucucacacaaacaauccaauauauuuauauaacuauuagccuuucugauuaauuccaaauaugucaauuaagcgcucagauuacucuaacaagaaauauaauacuuguauaaaauaacauuuuagccaggugagauggcucaugccuguaaucucagcacuuugggaggcugaggcaggaagaucgcuugaggccagcauuuuuagaccagccugggcaacacagcaagaccuuuucucuuaaaaaaaaaaaaaaaaaaaaaaaaaaaaaacagccuggcgugguggcucacaccuguaaucccagcacuuugggacacugaggcaggcaagucacaaggucaggaguucgagaccagccuggccaacauggugaaacgcugucucuacuaaaaauacaaaaaauuagcugggcaugguggcgggcgccuguaaucccagcuacucaggaggcugagggaggagaaucgcuugaacccgggagguggagguugcagugagcagagauugcgccaccaugggugucacuccagccugggugacagugugagacuccaucucaaaaaaaaaaaaaaaucagccagguauggugacacaggccugcagucacagcuacuugggaggcugaggugggaggacugcuugaggcugggagguugaggcuccagugagccacguuugcgccacugcacuccagccugggugacagagugagauucugucuaaaaaaaauaauaaauaaauaaauggaaaguuaugaaaguuaaucacacaauuuuuuuuuuuuuuuuuuuuuugaagacaaggucccacucuguugcccagcuucuggacaguggugugaugauagcucauugcaaccugaaacuccugggcucaagugaucccaccucaggccuccaaguaccagugcauaccaccaugcccagcuaacuuuuucuuuuuucuuuuuauuuuuuuuuuguagagacaggguuggucuugcuauguugcccaggcuggucuggaacuucugucuucaagcaacccucccgccuuagccucccaaagcauugggauuacaggcgugagccaccaagcuuggucuaugacacacauuuuuaaaaacaucaguaauugcagguuuccguguugccaucugcacucuguccucuauuccaauacucucccgcaauauucaaagaccucaaauaacguguacaaaaagcuaauaacauuuucugggauuuauucuacaguuugcuuguuuauuugaauguacaugagauguuaaucauagcaacucaaguucucagguuuaucauagagucugcaaauugacuugagaaugaugcugaaaauauaaaugacaauguauccccuauguuauauaauacaggcuguauuaaaacucuuuucagaaagaacaaagugagaacaggucagucuaugaaugcaaaugauucauauccuguaggaguucugggcaaauuuaccccaccuagcugcaaaauaacuacuaaagauaaacaacgugucuccucaagacagugacuagcuuguuauuuugcauuaaaugggaaaguuacuggaugaccucagaaaagcacuaagucaacuucuaaagauacaaauuaaguggacauccaguagggagccuugaacacuucaucauccauuccuaccucacauggcagaaguaaauguuuauuaacauucccccagcccccacuucuuuuuuuuuuuuuuuuuuuuuuuugagacggaguuucacucuuguugcccaggcuggagugcaauggcgugcucucggcuuacugcaaccucugccuccuggguucaagcgauucuccugccucagccucccaaguagcugggcuuacaggcgcccgccaccaugcccagcuacauuuuuuguauuuuuaguagagaugggguuucaccauguuggccaggcuggucucgaacuccuggccuucaagugauccuccugccucagccucccaaagugcugggauuacaagugugagccaccgugcccagcccacuuuuuuuuuuuucuugaaaaagaagaacauuggauaggaucaacaaugucaauuuugaguguguaauuuggugccaaggaaguaaaauaaccccaaauuacucaugaauccacagcaaucuauuacuacgacacagaauuacucagggcacgagauuuggcauuccuguuuuuggguaccuggucugagcucuugccucugacucaugcugcaugacaugaagcuauuaaaaucuccaaaccggccuggugcagucacucacgccuguaaucccagcacucugggaggccgaggcagguggaucaccugaggucaggaguucaagaccagccuggccaacauggugaaaucccgucucaacuaaaaauacaaaaauuagccaggcaugguggcgcaugccuguaauccagcuacucgggaggcugaggcaggagaauugcuugaaacugggaggcggagguugcagugagccaagaccacaccacugcacuccagccugggcaacaaaagaggaauuccaucucaaaaaaaaaaaaaaacaaucuccaaaccuuagcuucuauuccaccaaauggagguauagguacuugucacauucaaacguagcuaaacacguucuaaaacugcaugugagaccuuguccucaaagauauauggcguaaaaacaucguacacucuguccuacuuucuggcuuuuacauacucuauuccuucuaccuagaaaugucuuguccuuacuucuugcccugacaaguacccauuuaagaaccaacucaggugucauuuucucuguaaaauauacuuaaccucucuaggcagcucguugccuacuucgugggugugcacaauuauuuuauaacacuuacauuauaauguaacuaacuguuuauaugcuugccuuccaaaccacacuggacuuaaggagacauaucauccacuuuuuaaucucagucuaguauacugguucaugcucaaaauaccuguguugcaugaaugacagagacccucucuuguuuugguuguuugaccuucccuaggacauucuaggucuucuccuaggccaucacucugcucuaaagcaaucuuuucaauguauccauguaucuauuggcuuauuauaugccagguacuauaaccuaauccuaaaauuucauauaaacccacuuuagugguaaaccccuaaguucugaauacgguaaucuucuucccgaauaguuggaaaaaaaaaaccucgccugggcaugguggaucacaccuguaaucccagcacuuugggaagccaagguggguggauugcuugagcucaggaguucgagaccagucugggcaacauggcaaaaccccaucucuacaaaaaaaaaaaauacaaaaauuagcuaggcgugguggugcaugccuguagugcaugccuguagucccagcuacucaggaggcugaggugggaggacggcuacagcccgggagguggaggcugcagugagccaagaucgugccacugcacuccagccugggagacagagcuaaacccugucucaaaaaaaaaaaaaaaagaaaagaaaauaccucauccuugaaacccaaucugcccuguccacuuuguuccuucucuuccacgucccaugcuggugcaucucuccuacucugcucuuuuagcuuaaccaaucagucaggcuugcuaaucagaagcuaaaagaaagguguagaaaauuacaugcugugaagaauacagacacagcugggugcaguggcucaugcccauaaccccagaacuuugucaggcaaaggcaggaggaucacuugaacccaagaguucaagaccagccagggcaacauggugaaaucccaucucuacgaaagacacaaaaauuaggccgggcaugguggcucaugccuguaaucccagcacuuugggaggcugagguggguggaucaccugaggucaggaguucgagaccagccuggccaaccugacaaaaccccucucuacuaaaaauacaaaaaaauuagcugggcaugguggcgugcacuuguagucccagcuacucccagcuacucgggaggcugaggcaggagaaucacuugaauccaggaggcagagguugcugugagccgagauugcaccacugcacuccagccugggugacagagugagacucucucuucaaauaacaacaacaacaaaaauuagccgagugugguggggcgcgguggcgugugguggcacaugccugcagucccagcuacuuaggaggcugaggugggaggaucaccugagccugggagguugagguucuagugagcugaaauugcaccacugcacuccagcacgggcaacagaguuacagaguuaaacccuaucucaaaaaaauaaaaaauaauaaaaaagaaaaagacuacagaccgcccaccccagccccugcugcuuaaguucauacaacuuuuacucauuuuauuaauuuccuaaaucuucagaaacuucauaaagugacaagcuagaccacagcauuacuuagcuucagcccuggaaagagauuuccauuaguauaaauuugauuaugcuccaauagacuucagugguuaaagaaauguguuccuauauuaugucuguacuuuccauccccaagucauguaacauaacuaggcuacccauuuacaaauagaccccuaguaggcaucagggugguagacaugcgccaacuugucacaaugaacuguacccuuaacaucuucauuuuuccugcccuauuuaagacccaucucuaggcuagacaacuccaagagccuccuuaucugcucucccuauuccccacuccauccaaauuccauucuggaagguuacucuuuugcuuaaaauccuucaaagaaaaagaaaaaagaaaaaaagugcuucaacccaaaacuuauuuccauggcuuacacaggccuaucaaccugaauccaguccacguuuucagguugaucucuagucauuucccagguauggggucuugcuauuacccaggcuggucucgaacuccugggcucaacuaauccucccaccucagccuccuaagcagcugggaccacaggugcacaccaccaugccugcuccucugugaagucuuucuugaaaccaucaugcaaauucuauuguucuuucaucuaucuaagagcacccguauuuucuuuaguauuuaucauaugacauuugaauaauuuucuaucuaucuauguaucaauuaucugucuccucuaccaggugaaacuuccuaucaagaaaaccaugucuaaguucuuuuugaaauacccaguacucacccaggguucaacaguguaucauucugaaaguaucuguugaagccaggugugguggcucacaccuguaaucccagcacuuugggagggugaggcggguggcucgcuugaagucaggaauucaagcccagccuggccaacauggugaaacccuguuucuacuaaaaauacaaacauuagcuggacauuguggcacaugccuguaaucccagauacuugggaggcugaggcagaagaaucgcuugaacccgagaggcagagguugcagugagcugagauggcacaacugcacuccagccugggcgacaaagcgagacuccaucucaaaaaaaaguugucuguugaauugaaugaucaccugucuauacuauucuugcuuaucucuuucaucucuauucuuccucugagaacuaugcugcucauauuucuuaucuuuuucaucaaaauucaucuauguaccacacucuucuagagccuaauugaaagacuuuguacacagaguuguagaaaugguuggaauauagauauccuagucuagagacaugagcucucaaucuauucagagcauaagguuuaugguuaaauaaggacacuaaccaaaggcaggccagcaugguaacuauuaaaggaguuuagggaaaguuugaguuaagccuuaaagaugcuacagaaaaaacaaaaaccuguuuccuggugaucuaaauuggggaaauuacauuauauugaagauuuauacuacauauuagcauauuagcauguuuaaagauuuaagaaacucauaaacuuguuuuauuuuguuuaacucaguauuuuccaagcuuauuuccucacaaaacauuuuucuuucaaguaaugccuauaacauaccuuaggaaauagugaugugagugaaaaauagaaaauaaaaucaaaagaugguuggagauggccgggcgugguggcucacgccuguaaucccagcacuuugggaggcugagauggguggaucacgaggucaggagaucgagaccauccuggcuaacacgguaaaaccccgucucugcuaaaaauacaaaaaauuagccaggcaugguugcaggugccuguagucccagcuacucaggaggcugaggcaggagaauagcaugaacccgggagguggagcuugcagugagccgagauugcaccacugcacuccagccugccugggcaacagagcgagacuccaucuaaaaaaaaaaaaaagaugguuggaaacuguaaaggagcuuaaaugauaaggguagaucaaauaaguucucaaagacauaauaagaacucaucuuauagguuagguagucaaugaauagucuuaggcaggggagugauacagauguucuccuuuaguacaaguacuuuggcaaaucugagacagauguauugggauggagguugguguacgugcacaagaggagggggugguguggaguuggggaaugcagggaaaaguuguggaacaggagguauggagccaaaucaagagaagagguucagggaggcuucagaaagcaaaaauccuccuucacugacugaaauuugucuugcucaaagagcuugcuugaucuucccucauaaaugugcuagggaugaaaaaagcuuccuguuuaugggaugguccagucuaguugucugggaaggccaauagcugauacuguuuccugggaucaggugggaggaaggauucugcagaggacagaggcagcaaugaaaggcuggagugguggaccugcacaaagaauuuaggucaagacagccuuaucccuucuuauucaucuguacagaagaucugccccuguacaccaggaaauuuucuguugccuacuuugcucacccgucagucuccuagagauucugaaaggguuuuaagauuagcaacaggauacuugagaggaaaacauuacaguuaccugacuucgggguuucugaaaagacauacuugggcagagacucaaaagcguaaaagaucaauuguaccaauuauuagcaaugaaacacuaggccccauguuuaaacuucucugaacugguuucuccuuuauaaaaugcacgccaauauccaccuggaugagacuaaaaugaaauuaugucugaaugagauuauagucugaagacuauaaagaacuauaaaaaaucaguuauuuguauuuugaacuaauuuuaucucauuugacagcuuguuuuaagauuauacuaggccauauuguucuuaguauauuaaauaauaaugugaggccgggcacaguggcucacgccuguaaucccagcacuuugggaggccgaggugggcagaucacgaggucaggagaucgagaccauccuagcuaacacggugaaaccccgucucuacuaaaaauacaaaaaaaaaaaaaaaaaaaauuaaccaggcgugguggugggcgccuguggucccagcuacucaggaggcugaggcaggagaauggcgugaacccggcaggcagagcuugcacugagcagagauggugccacugcacuccagccugggugacagagcgagacuccgucucaaaaaaaaaaaaauuauaaugugaauguuuucccacugaaauugguucccuuauuuaugaauaaaauaaaaccauauuugaguguaagagaagaaaaauccaaaacucuuugcucuauccuacaaauauucuguaaacaaaucaugaaucucugaauguaugguguucuuguuauuaugaguaauuauaguaaaacuaaugaucagaaccuguaagauugcucacaugccccccucacccuaccaaaugcacauacaaacaaggcagaggggagaccugaucaauuuggcuggcaagaacuuuaucugugggcaguaaagauggucagguaugggaauaggagguaacugggacuuggacuucucuucuaguguuuaucaaugaccucuaccagccccagaagaauagaacgauuuguuuaaaaaaauaaaacaaaggagcagugugcagugguucgugccuauaaucccaguuacucaggaggcugaggugggaguacugcuuuagucaaggaguucaagguuguaguaagccaugaucaugccacugcacuccagccugggcacagagugagacucugucucuaaaacaaaacaaaacaacacuguucaaaacaaaacaagggaaccaugacauccaguaagaacacagaagcuauuuuuuuuccuggcauuaaaaagaggcagcaauaaucccagcacuuugggaggccaaggcgggaaaacagcuugagcccaggaguucgagaccagccugggcaacacagggagacccuaucucuacaaauaauaauaauaauauuaauaauaauaauuagcugggcuugguggcaugcacccguguucccagcuacuugagaugcugaggcaggaggaucgccugagcccaggagauugaggcugcagugagccgugauugcaccacugcugcacuccagcuugggugacagagcgagacgcugucucaaaaaaaaagagaugcaaagccacuaggcacaucccaagggagaacucaggcaucuauuuggcaacuaacagaauuuuaaaguuacucccuauaaccacuuucaacugaagaucucaaaacaccguguaaacauuaauuaaaccucucaagucaggaaagaauuagaccuauuucagauaagaaaaauaacguagguaggaggcuguuaacaacaggaaucagaaaggaaacuagacucuaguaucuuuggcuuucuccauguuguccucaggcuacacuuaaugaaaugcacccaagcagcagcauccucaauaaugcggcuauguugacaagcaaaugcuuuuuaaaacaggggcugaauggaaggaauauuggcauugguuggaauuaagaccccuguucuaagccugguuccaccacuuacuaguuauaugacccugaacaagucauucaauuuccuuaaacuuuaguuuccucauuuauaaaacuauaucaaaccuaaaccuaucucacaagguuguaucgaauuaaauuauauauaccuggcacacagguauugagaggccagcuuucuucuuuccccaaacuccaccuuaaguccguagaugacacauauaaaaaaauacauuguuuauauauauaacuauauauaugauuaucauucuucuaacuaauuaaaaaaauaaaaucuggaggauacuaacauaauacuuggcuaaaauaagaaauggccuaauuuuuuaauaacuuccaaauaguugagaguugucaccaagcuugaaaauuauuuucugugcauuuuuauugaugugagcaaagacagaaacugacuuuagaaaaauaaaaaaacaaacagggaccuuuuccagaaagaugaucugccacauuucuuagaacucaaggaaacaucucagaaaggaguuaauguacuauuccaaaauuaacuaugcaguguuuuguuuuuuuuuuuucuugagacagaaucucgcucugucacccaggcuggaguauaguggccugaucucggcucacugcaccucugccucacagguucaagcgauucugccucagccuccuggguagcugggacuacaggugugcaccaccaugcccggcuaauuuuucuauuuuuagcagagacaggauaccacuauguuggccaggcuggucuugagcucccgaccucaggugauccacccaccuuggucucccagaaugcuaggacuauaggcgugagccaccgagccuggccuguguucucuuaauauucguuugguuaagaaaacagaucaacaguaucuguaaaacuuuaauauaaauuaaccucagagggccaguaagaucacuagacauagacaguuccaugaaccuaaaagguccuuccugauacuuauuaacugaaagugaaagugagccaccauaaacaccauuccuuugaccacaacacuucaaaguaauuuagaaaccccaucucagugagguuaaauagcacacccauuucuaaacaaguuuggcagaauuaaaaacagaaguuaacucuucuuacucuccuagacacucuaagacagcuccuuuugaaaggagacaaccagcagcaucauggagauuucaaaaccaccuugauauauaggcuacaauuaaaaguccuuaacuccuuugaagcuaaagaucacacaacuuuuuacuagcauuacguuuacacacugcaaggacuccccagcaucuuuuugucgccaaaacaugacacacaagaauaaaauuaucugcccaaggucacagaacagguaauggcugucugacucccaacuacuuaaaugagccccucuuccugcgugcaaccccuucaugggauauacugacaguaacaauuagacuucuaaaggcggggagggcgaggaaggucuccacugaaugcuucagauagcaaaaucugguguauuaugucucugcagauauugcauauuuuaauuuacugcccuuuaaaauucagccuacauggugcauuaaaaagacugucaucaagaacucaagaucaaagggguucagaaacacaauuucuccuaucacaccaaccucugggcauucuucucagugcccccauugagacucuggacaaagaacauaucugucuaccccucacccuacccaaggcagcaagguaagaacgacagagugccucccgauagcguggcacagaacacauagugcucaggguacccgagagccuauuccccagucaccuccaucccaacuuucagcggugguugucagggagaacacgccuucuucugcaaugcuaagucugucccuagccaaguggacacaccccuccgacgcgcugcccccucagaauauucucauucccuccuuggccaaauauccccuccccacucucauuaagagauacuccccaccuuggccgggagcgguggcucacgccuguaaucccagcacuuugggaggccgaggcaggaggaucaccugaggucaggaguucgagaccagccuagccaacauggugaaaccccaucucuacuaaaaauacaaagaaauuagccgggugugguggcgggcgccuguaaucccagcuacucgggaggcugaggcaggagaaucgcuugaaccugagaggcggagguugcagugagccgagaucgcgccauugcacuccagccugggcggcagggcgagacuccgucuccaaaaaaaaaaagaaaaaaaaaaaaagauacuguccucaccuccggacagagggcauucccccaacaaaaaaaccgccucucccugucuccuaacuuggacagcucccuuccccucaccgaaugcuuagcagccaccucgagcccuggggcagggggcggggugucgggugcguucacaccacuagucugggcuugccugaugguuaccaccccgccgaagcugccgccuugcggguuucccugcuugggacacccacgcggggucccugcugcccccagccacgccccucggcugcagcccgccgccacccgcgccacgcccccgcgcucacccgcaguccggggccgggcaccagcggcagucgggguccgaggcuagguagcggcgcagcaugaacuccucguacuugugcauaagcggcgggucggcgagcagcaagcggaugucgugcggguugagucgcucgcugcacucggggcagcugaugggcacccugcucucgcuuaucuccaggcgcagguaguggcggaggcagucccggcacgagcggugcggacagcugaggaggcgcggggcccgcucaggcggcagccgcaccaggcacagcggacacuccaccuccuccgcgcccgggccaccgcccuccgccgccuccucaucgucgaacccaggcuccgccgccgccgccgcggccuccgccucggccucggcggccggcucggcgggcagcgccucgggcggcgggcccugggccgcggcaggggccggggcgggcggcggcugcgcagccgggggcggcggcucggccugcggcuuggcccgggcgcggcggccgcgggccgaggcagagaagacgcugugcaaggugaggcgccggcgccggccgccgcugcggcacuuagggucgggugcggccgcauguagcgauguggagcgcggcgacucggaguccuucucggagcccauggccggcagaggccgaggagccaggggcgcccagcgccgccacagcucccgccucagcgccccucagccagcgcccggccgccgccgacgccgccaccaccgccucaaccgcccucccggcgauagaagccgagcggcaacgacgaagugauuauaaagccuccgccccgcgcgccgcugcccugcgcaggcgcuucgcucaaacaccucacaacccuugcgccccggucuaggagugcgcugggcagggccgagcgggguggggccgagcgagcuggggcggagcuccgccuccugccggucaggugguuccagggccgccauguugcggagacucucagagauccuagcccgcugcucucccuggucuccgccuccaauuccaucaccaugacacccaagguggacuuuuugguuugccguuccucacagguugauugccacuuccaguaaaugaugguucaguuacauuauuuauaaaaagcaggcagggguugaucagauggugacucccaacugguucaccuuccaacauuucuguuuauuaagcagacggcauaaauuaauaaagaauauauucauucacu

SEQ ID NO: 14137 - RNA, 2457 nt, Homo sapiens
uaaagcaccacuaaagggacgacauuuauuccuuuuccaaauguuacaguaaaaccagguggaagagaaugguuuuagcaguuagaaaaaaaaaaaaaguacaaaucugggguuuggccauuaaaaguuauuuacaacagugggagaaaaaaagacaagaaguuguuucacauuacagaccuccccccaccccaaagccuaauacuugcuuaccaagucaaaaaagagacacaguugauucacaggcuggagguuugaacuugaguaagacauuuauaaaaaccuagacggggcaguguccuccccagcccaggugccacuaggcacagcacaagagacuaaaaacaacaggggaaggcuggacacucaagguuugggaguauaagcaccccacuucuggcucagggauuuggggaguaggguaaacaaaaccuacuuggaaaagaauuggggaagaaaaccaacaacugccuuaugcagggguggggacagggaaggagguagggccagggacaggagcauuucacaucacuaaccuaacuugggaagcuguaagggaccaucuucaacuggccuuaagaggagaaccagauggcugaugggagaauccacaggagggagaggaggaaagggaacguggcugggaggaggcaauagccccuuccuuucugggcacaggaaggcagccagggcaccagguccaggcagugaccucacaaggacagcacaguuuuugcagcuuagagaucacccaccugccccuaccuagcuacucauucugcucagcgcuggcugguguagggccacucuccggccccgagggaguggauggcucuguagccuggggcccugccucuucuucugaggcugcacuagccucugcccccuuggccugggguuccuggcucucagggguggcugcggccuucccuuccugagcagugcccucgucgcugcaggcaccgaucucccccugcuccugcucuuccucugugggugaggaggcagaagaaucacccccacccuccuuccgauuucucuugaaggacaggccgcucaauuugaaaggcuucuugaaagagaauuucuucuucuucuugggggucuccuugggggggaccucccccuuggccucagcacccuggcuagggggugcuggcucgauggcaucgccaguggccccggcugccucaucuguuccguucacagggggcgacuccccuucacccuugggggauaagucuccauugcuuuucacguggccauucuccugcagggcagagggaauagcaaugagggcaggggcucccccucccccagcccgcuucugaucccuucuagaggaagggguccucgauucgauucuacugcaacccgaaagucuggcuucagccucacccacacccaggaucccgucaaacaccucccucucgccccucacgggcgcgcggggagcgagcgcgcagagggcgcgaccggcaggaggcgcuggggucccguggcccccacccccgucccccggggcgcgcucucuauuccgcgcggaaccgcuccggaucugcugugcggaucccgggcaggcgggcgagccgcucuaggcgacauugggcgggaagccgccccggggcgcugucucucugcaccuggacggccuauuuucccagccucccgcuuuguguaaguggcccccacccaccccaggcucucccgcaucucggcucccccuuaaaaaaaaaaagaccgugggccaccgaggucgggucggcggguggagugcgcuccccgccgggccccagcuccgcggccccugggcgcccccuuggcguggcccagcagcgccuuuguuccccgcgcggcacucggggcggccggggggcagcgccggggaccggggccgcgaacaaagaaggcggcagggcccggccggcgcccccuccccgccccuccccucgcuucgcccgcgggggcugcggcgccgagaacaaagggaccgggcgggggagggggcgccgcgugucccgggccggacaaagcgcgcggccccggccccggccccgggcccuagaaggggcgaggugcgagaggaggggcuggggccggccgggccaagcguacccaccuggccguuggccuucgcgggggaagcgccugcugccuccucggcggucacgucgccccggggagccuuggagcucuggcugcccaugaugggggucugcuggggggcgcuuggagccgccccgggcucgcgccgcaggggauaguacggcggggucggcccggccggcggagggguggggcuggcgcccgagggggaggggugccgggggaagccgagcugcaccuccgcuccgcggccgacccgcuagcugcgcccgccgccgcuccgcuccgcgccagaaugccgcccgccgcccgccgagcugccuauauauaagcgcccggagcucggggcgg

SEQ ID NO: 14138 - RNA, 7420 nt, Homo sapiens
gucagagcgcuuuggcugaaugagggguggaaccgagggaagaaggugcgucggaguggcagaugcaggaaaugagcugucuauuagccuugccugccccacccaugagguaggcagaaauccucacugccagccccucuuaaacagguagagagcugugagccccagccccaccugacuccagcacaccuggcgaguaguagcugucaauaaaucuaugguaaacagacaagagguuaguaaguauucuuuuauugugacaaacccucucccaggcuuagucagcuacuccuuucucuggccagagaaucccauaaggaaauagcccccacagccagggcugcucugcucagaggaagggaaggcugggcuguggguuuaggagcaggagaacggggagggcugaggaggccgcaguguacccugugagcccagcggaggugcuggcuccugaggaacaagcugcuggaggcuaaggacaaaagguggccagaguagugguccccaguugcccucuggagcugcuggcucucaagauggcagagcuggggcugaggcugagauagcagccccagccccaggcugguuuuccagggacaaggccucuuccacuaucugugcugcccucugcaggagguggaaggccauacagaauggagccgugaguauggccagccuccagcucucagccaggagguccccaaccccaaggaaggaagaaacuggaaauuaggaacugcuuccucauuuaacaagguaggaaguuaggagaucauuuacuuucaaucacaagggaggagaacuguuccuggggcccaaggcugccaguuuccagcucagagcuccucccaccccaacauacuguuuccugauccaacagcuuaccugauccaagggcuccucugucugagugucuucaucaucugcuacuuccagggcccccgcugucuccuuccuucgguggggagcuccauauacuccuauaacuccuaaagaggggaggcagcacugggugaugcccaggcugaagagcccucagcauuccugcccuggaccuucaugcuagccccuuucccuccccugaaccugguucugcauuccccaccaccucccaggauggcaaggaagugagaggugggccuuuggucccacccccauccccucuauaucccaccccugaagucuuaucgcuuuaagcacugcccuuuccaggugcuucuuuucaugugaugaggcccugugaagaagggacaggauauacagacgggggcagcuggagacaguuaugaugaggucaguaccagcuuuuuuuuuuuuuacgggcagucuccugagccacaguagguucagacuccuuuaucuuuuuuuuuuuuuuccagugccggcuuugugucugagcauucugcucccauggacauccccaacaacagcagggaccaaccuaugucacugucaaagggcagcugagaagggccugagccccagggaccccucaccugaugggaaugagaguguggggagcuugcuucuuggcugaauggucugcuggggucuggcauagaaagcagauggcuuaauucggucugguuccuuuggagagggcuggguuaccugggcccuguggccuugggccuagagaagggacacugggcuuggacccugauugcuggccauucuuaccuuuccuacuccccaguucaggcuucagagagccccugacgccugcaggaacauggcagaggagacaccgucugucuucacaaaguacguccucccuccuugcugccucuucccaccagccugacuuauccagggacagagcaguagaugccuggcacuccucgaugcccagugaaaccagacugugcuuccccacccccaccaccaugccccaugcucacuggcucauuucuugggagggcuuagagcuggauaauauaaguucccuuggacccugcugugccaaauauaccaauucucucucccagcguccaaccuagcaagaagguauuaaguccugcaaaucagaugagaauucuggucuggccccugccacucaauaacucugucacccugaacaaaucacuucacuuuuuuuuuuuuuuuuuuuuuuuuugagacuugagucuuacucucucacccaggcuggagugcaguggugugaucucagcucaccacaaccuccgccucccagguucaagugauucuccugccucagccucccaaguagcugggacuacaagcacccaccaccaugcccagcuaauuuuuuuguacuuuuaguagagaugggguuuuaccauguuggccaggcuggucuugaacuccugaccucagguaauucacucuccucagccucccaaagugcugggauuacacgugugagccaucgugcccaaggcccacuucacuuuucagcuucaguuuccaccucuggaaaauggggauaaucuuucuuucacaagauuauuaagaguggccaggcgagguggcucacgacuguaaucccagcacuuugggaggcugaggugggcagaucaccugagggaguuugagaccagccugaccaacauggagaaacccugucucuacuaaaaauuaaaaaaauuagccggguguggcugagcgcgguggcucacgccuguaaucccagcacuuugggaggcugaggugggcugaucacgaggucaggagaucgagaccauccuggcuaacacggugaaaccccgucucuacuaaaaauacaaaaaaaauuaaccgggcaugguggugggugccuguagucccagcugcucgggaggcugaggcaggagaauggcaugaacccgggaggcggagcuggcagugagccaagauugcgccacugcauuccagccugggcaacagagcgagacuccaucucaaaaaaaaaaaaaaaaaaaaaaauuagccgggugugguggcacauaccuguaaucccagcuacucgggaggcugaggcaggagaaucacuugaacccagaagguggagguugcagugagcugagauugugcuauugcacuccagccugagcaacaagagugaaacuccgucucaaaaaaaaaaaaaaaaauuauuaagaggaugcaggcugggcauaguguaaucacagcacuuugggaggccaaggugggaggauugcuugagcccaggaguucaagaccagccuucgcaauaucgugagacucaucucuauauuuaaaagaaaaaaggaggccgggcacgguggcucacgccuguaaucccagcacuuugggaggcugaggcgggcagaucacaaggucaggaguucaagaccagccuggccaacauggugaaaccccaucucuacuaaaaauauacaaaauuagcuggauaugguggagcgugcccauaaucccagcuacucaggaggcugaggcaggagaauugcuugaaccgggaccugggaggcggagguugcagugagccaagauccugccacugcacuccagccuggacuacagagcaagacucugucucaaagaaaaagaaaaaagagaggaugcagugaaauaaggucagagccugugccagaagaguugucagccagucacuccccuucuucccaccccucauuguccccugcgucaccuacccccugccuguggggccuagacuucgagccuggagguugccuacaaugacaaaaggaaaggcuuguagugggcagagggcauagagucaaagcacacagacccagaggguggcuuccucugcccggccuguuaccgcuccaccucccacauacauaccagcagccccugggcagggaggggcugggcaccagcagcuccagauagggaagguccuugaacucauccucuccgacagccacauaguaauggccaguuaccagcuccuucccugcugacagugggagccccucuagggugcagagucugggagagagaggugaggaggauaagggcugguagacucgaugcuucuucacauucagcagacugaaggggugggugcagcuauuccaaggugcccucuggccucuaggcacccaggcucuacccugccucugagggcugggcagagggcccucucccaguggcauagggggaagucccaugugggggaacaugcuuuccuuuugccucuucauccucagccacagcugaagccaguggcgaggcucucuuuggggacuuuugggcccucgcaguccccauacucacuugcacacagccccacucugcaacuugaccuucucagucaggagcuucaacacaguuucccaguccuggcuggcagccugggacagcuucagacuaaaugggggacuuaccagguccccauuccugaacacacugagacaaaaagccugguaagggggaguguccccaggagucccuacaugugaggggaaggguggcacagggccagcaauaaccauaacacuggucucucuucacccaucaagcaugcuggacuucuacauucccaacaguaaccagaggcuccuagaacaaacccaacaccauuuucuuggccuuacuaaaacaaacaucaacaccccugcucccucacacuggcacucacuggauauagcugggagcaccugcaggcagcugccguccaauggccccaucacacaaguggcgagucacgggaggacccugaaacccaugucaggccuccaaaucaggagaguuggggccuuugguuaggggugggcccauccaagguguggagugagggggccggaaccagacuggggcaggaagggggcgaggaggaguaagacaguuuacaccuuucaccaaacggugcuuagauguucccuaagucacauucuaaccacccccucccccaaucuguguuucacaucuuucucuuuccuuuggggaccccaguguggaguuaaaggcugcgacagaagcaagaaauagugucuugaaaucccacgccccaggaaagauaguagcuggcuccaaaguaccccccuggaacuggcagauccugcugcuucccuggcuucccagaccaaauugggggcaguuccaggaggagugggaagacagaggggcuggggcacagguuccccgggacucacuuguagucugcagcucuucccaccuggguccuucccucuaugggguaaauagcugaaaggacagauagaucacaggucaucuuguggagacugaggccucaauagccuggcagaugucaguguuggguuggggcgcagcucaccagauaucccuccccauggaauaguggcaaucaucucaguccagaaacaagauauuggcagcugaaccugcccuaggaccccuugagugcucaagugcugucuggguaagugcugaguaagucuggaaauccagacuggggucucaguacuaaccaugagauuaaaggucaagaaggcugggcauggcagcucacgccuguaaucccagcucuuugggaggcugaggcaggaggaucacuugagcccaggaguuugagaccagccugggcaaccucauugcuaccaaaaaacaaaaaaauuagccaggcaugguggcaugcaccuguggccccagcuacuugggaggcugaggcaggaggauugcgugagcucaggaguucgaggcugcagugagccaugaucgcgccagugcacugcacuccggccugggugacagagcaagacccugucucaaaaaaaaaaaaagucaagagaaacuagaaacuagugcauuaugcauccugcuguaucccaagaauauucucauucaugagauaggucguuuuaucuccauuuuguaugagauuccaagaaauuaagugacuugcccaaagucacacaaggaaugaagccuagauucuaagucuaccuagcuucccuccucuggccuuuuuuuucuuuuuuucucuuuuuuuuucuuuuugagacagagucucacucugucccccaggcuggagugcaguugugcgaucucagcucacugcaaccuccgccucacggguucaagcgauucuucugccucagccuccugaguagcugugauuauaggcacgugcuaccaggccuggcugauuuuuuuuuuuuuuuuuuuuuuuagauggaguuucacucuuauugcccaggcuggagugcaguggcacgaucucggcucacugcaaccucugccuccagguucaagcgauucuccugccucagccacccgagcagcugggauuacagacaugcgccacuacgcucagcuaauguuguaguuuuaguagagaugggguuucuccauguuggucaggcuggucuugagcuccugaccucaggugaucugcccgccuuggccuuccaaagugccgggauuacaggugugagccaucgugccuggccaauuuuuguauuuuuaguagagacagaguuucgccauguuggccaggcuggucucgaacaccugaccucaggugauccacccgccuuggccucccaaaguguuaggauuacaggcgugaaccaccgugcccagccacuuacucccucuugauccuuacauuauaguaagcaaccucagcugagagcuaagaguaggaccuggaagccagacaugagucagagacucagguacucaaauucuucucccacccugggagacagucuccuccugcaacagaggauggcccuagccuaacgggagagucugggaugccuaugcacaguggggaggaauggauggguggauuuagaguguucagugauaggggguccaagcaagaagagcuuuuggaaaaaggggcucacccugugggagaguggucuucccacaggcugaucuuggcugugaugggcauaaacauuaguaacacacagaauucuauuugaauuucaguucaacuauuuguuauguacuuuuaggcagguuuucugucuguuuucccuuucuaauggaggcaaaaccacccccccuacauagaguucaguaaguaccaguaacaugcugguacauacaugguagguacugaauacacgcucuugccguuaccucccuugcuaggcuguuugaccagccccagcccacucacuggagcuuguggaaucguucaaauccagcggccacauacugcccucuguucuucaagucugccagguuggugacaggguggccaugacaagguguguagagggcacgcacagccaguggggccugcacagcugaugucaccucgcagaggaaggccuccaugguggggaagcggcguugagucaccaccagcugggagccugggaagaauggguccccauuccgguacaccacuacccucuuggcugcuggacugccaccugccauaguguauccucagucagagaaacagaccuguugccaggcaaccaaggaagggcugggaacauugccaaucagagguggaguccug

SEQ ID NO: 14139 - RNA, 1661 nt, Homo sapiens
uucugaguccaaguuuccgccuguaaaauagggccgaauaauaggaucugccucauaaagcuguuguggagagucaggaggugaugcuuacgaagcguuugguacauagugagguguaacauguguugcccuuuagcauuuugauuuuuaguagacuucuaaaaggccagugcccggaggguccucaaaauagagcccucauuuuacagaggaggaaaugaagcccacagagggcugcgaucacacaguuauuuaggagaugaaauccauaaacgaaaugugggaaaacaagaucaauugguauauuacacagugcucaacugaguuuagucacaggccaaaagauguaacaguccuuccagggagugcagucuugugcggguuacacaguguuuggaccuccauuauccuaaucaugaagucccuaucggcaugcagguauuauuaccccuaauuaacugcugaggagcaaacccaaagagguuaaguggcuucccaaaagucacacguaguaagugagggugaggccaugaccagagcuuaggacuucucuuauugcauccuuagagagagguaggaaagagagaggccagugcgggcuggaguuaggaaguguagcauagcaguugcuuccuaaaguccauuccauuugcugagucuugggagguuuuaauagauauuguuaauauaggaggauucuguaguuaacuaaaguuuuggaaauacucuuaaguauagcugaauaaguuuauugaccacaagcuauuucagaauccuuaauuugcuaauguacauuguaaaucauccagaaaggaauauaauaugcaguauuucuuaaacauaucuaaccauagaaacuccgccucccggcuuucuuuucagaugucuggucacuuuuuugacucuaguauuucugaggaacacaggcugaaaaaacauucauagcgccuuguuucccaguggcuggucuucugccucagaaucagcugagagcuuguuuaagaaagcacacuuuugggucccacuucagaccuguucuguacccaggaaucuacaugcuaauaagcauuagggacaauuggugugcauccuaaaagcagugacagguuagagagaacugugcuagaauucuagcuguauuacuuaauaguuauauaccccuggacaaacuaagggcucugagccucagcuuccucaccuguauaaagggagaaauaauaccugugaaaagggcuaaaaugagguuaaaaugcagggagccuggcguguugcuagugccuaguacaugccagugucugguggcagcucuugcugccgugacugcucucaugaugccaugcugccugggcuauuccuggagugaaauacugaaaaggagcacagagagaagagucuggaauagaaaaagaaauguuguuuuuuuuuccuaccauacccuuguccgccuccuggucucagguguucuaagaaaggaaacgaguuguuuuaaagcaucucagucagugcugccuccccuccacccacuacauagcuuuggaggauuccagccuauuguuaggagucagaauuccuguaauuuuccacugcuuccaguccaggguacccaagcagggacuggguauuggaguaguaaaauucaagcacccuuugguccuaugggg

SEQ ID NO: 14140 - RNA, 11677 nt, Homo sapiens
ucccccaagugggucagugcccagggcauugacaauuagggcugaauggaaguuaggauuuccaguccccccaccccugccaaccagcaacaccucaggcaguccuuucugcugucuaaccacugccagcccaacuuuggcuuggcuuuccacucccagagguuccaagacacuguaguuaucaauacuuugguuuuauuuuaaaacagugaaaagaaaaauaaauaucugaagaauaagaauacagggcugggugcaguggcucaugccugcaaucccagcacuuugggaggcggaggcagguggaccgcuugagcccaggaguucgagaccagccugggcaacacagugagaccccccucuuuacaaaaaauacaaaaauuagccaggugugguggugcaccuguagucccagcuacuugagaggcugaggugggagggucacuugaacccaggagucggagguuacagugagcccugaugggccacugcacuccaaccugggcaacggagcaagacccugucuaaaaaaaaaaaaaaaagaauacaggaguggggugggguaguggggcuggagacuugagguguccuggcuuugguagucuugagugggggcgccagaggccugggaucugcagcugugcucuucccaggccaggcccugccccguccccacugggaggucugggggcuccgccagucucgccugcccgcggcucccaggcggggcgcugcgucagcggaacccgcgccgggauuagcgcccuggcgcccgccugcgccccgggcucugucgggcgaggcuggggucaccgccccauuggggccucuuccgccggcccuuagccuggaucccaggccggaccccgcguggugcccgcagccucagugaugacccauguccuccaugcccacgcggccccagacgcccagcacgaagcucucgaugucgcacucauugacgccgcgcacgaugcggaaguggccccucucgccccaggcugggccccaggaguuggccgcagucugggaauaaggagggguggugagaaggggaaugggaguggggcgaggggaagagggggcggggaaagggucagcggccucacccaguauuugagcguccuuccaucuggcagcgucuccucuccccaucugugggcagagcagaggagggggaagggagcugggucuaccugcucucaggagcuccaaucccggaaaccugccccauccagcccccaguugccuuuggaggguuggguacacccuuagggcucaggcaggucucuguaccucucugcaucucccucacucucacaucuguaagucggugcacccaggcccagcaugggaggggguggggcaccaaggggacaaguggaggcaaggugagcagaagaggagggaaccuggguccuccagagacccaccuccuaggggccaguucuaugggaccacacauccaccugcccucccucacuuggggauccagggagggguaggugccaagggccagaaggaagacacucugagaauauggguaucuuagagaccgccaauucccaccguaaagcacauuucaccgaguucauugaagucagugauccuaacaucuauauucccuaaaucggauagggaaacugaggccaggggagcgaccucccaggucacucggugggucaggcagagcugggacaggugcugagguggggagagguugagaaacucuugaggcucucuucauauuggaguuauuuuaucccaauguaaggaaggaacaguuccuaaaaaagccuucagaggcucccaaccuucaauucgacccagggcaaguccuuucucuuucugagucucaguuuucucccuauugaaaugaugagagcaguccuggcuuuuuagagagguuguaagaacccaaggcaggcuccagagccccuagcacaaacccugcugucccaaacccccucugcccacacgccccucacccugugaucuugacugagugggucccaugccggcgguaucucucuggccucccaaggcucacuggcguguggcuguagaugccucccuuguauaggaagaaguccucaugcaccuccaugagggcugugggcagaugucaagguaggguccacucagcccguuggcacaggcacuggagccugagucuauugagaugugcccaggcaccagggucccuccauaccaaagcucuaagugcucccuccaggugcugccugugggagggggggaccccuacuccuggcccuacuggacaugcugcugaaugcugugcaggccacuugugcuacugugcccacucucaagcaggcacaagcuucuggaaccagggugcuggauaaggggguuuaccuuggacagggccauucuccaucagcuccuucaugaucuccuuguccuggagggcaggggauggacagagagcauacgucaggggugagacuccaggcuuucacaacccuccugccucggcgcccucacccaagugcugacuuacguuggagccgaggcgguagacaggagugaccugguagaugucauuguuauuaacauagcuguuggggcagugggcaguggccuggcgcuugccccgacccauggcucggcugugcaucauacaggggggcgcagggccagccucgucucguucacggcccgagaagggguagcaguggucagacaccacccugcaaaggcagcaagagggagcaaaggcagaaagacucagugcaucauggcccaggccaugcccacggagcuccuugcccucuucucugcccacauccccuguugcugcauacccucggcgacgcaggaaccaccaggcaccaucgagacgcccaccgcggcagcccugcugcuggugggugucacaagacagcagguucuggggcgacaggacaggcgucaugugucccagagaauggauugagacacgaucggaugccacagcugguggggugagauagaggggcugucgggaggcucaggacuuggcccuccucucccaggcgccagcccuugcccuuggcuuaccugcuguggagaaggcccaggagccugcacaguugccuuggucaagaggcucaugaaucagguugggccacuucucagaggccucgaaggcugugggaagcaccuccccuggguucagcacugucugcaagauaaagguugcccugucugccuccugcucugcccuggccugccccucaggugcccauuggcacuggagggccaccaaguccagggccuucugcaguuuaaucuugagcccuccugcugcugcaggauuccagcugccuccaauuuugacuuguguugaagaaccaagcaccauuuagugccucccagguaucaggugguggggcggggcgggguggcgguggugacuaguccugcuucccagaugaggcagcugaggccaggcacagagaaguggccaggccaggucccucagcuuuccauucucaaccccugccucuuuccucugcaccuucugaucggccuuagcuuucuucaggccuuagcuuucccucaggggagggaagaggcaguagggucccgugaccaggcagucugccaacacaaacagcaagaggcagaaaauagccagaggcccaggggaauaagggcagggccagggucuggucacccaaggccgaagucuccgcagggagggccacuccugccagccccugccuccccgcugccugccacugauggacaaaugcuccggcacaugucccgguccaggccugcugaagcuccccuuccucacccuuucacuuugggccugguuuucauuccucucccagagggucccacuggugggaagggagaagcccucuccucccuugggguuccgcugaaccggcauuuauuuccgagaacugcugcccucuggccagaacuggaggaguguguguccuucccuucccaaaauaccaaggugacccccuguccccuugggcccuaacccagcuguacugagaccaacagcauuuuucccaggcuggagagaucaggggggagcugaugccaagaccacgaaauucaaucugagcaucaguucuuccagcacagcacauccuguggaagcagggaacagaggcccagagaaggggaguaacuuguccagggacacacagccuuguaguaggggaugguccaggcccuuggaggagcagggcacagggccagcaucccugagguucugagccauggggagauggcagcauuguggggaaggauggacuuacauaaauuucaugcauguucaugaccgaggaagaugggcggauggugcccaggcgguagcgaaugcccucauccagggucaugccccagaaggcgcugugguucccagccugccagcugaaggagaggggacggaaggaagucacagaucugccgaggcucaggguccuuggcgugggugcaugugggugggagagacgcacaguggcugagcgcacacacagucaaaucuggguguaggaguggccugcuggacgugccccacagcacagcaugcguguauacaugcaugaguaugcaugugugcccacugagggugccucuagggccucucacccauaguugcccugguugauggcuuugaucaugucuggauccaccaggcaugguucuuggucacacugccacugccuguucuccuggcaggugcuggugagaaaaggagagaaggaaaggguaagugggggacuggggauacuuugaaggaauguggccucggagguuaacaugggccagggagucugugcaagugacugugggagaaucucuaggugaucccauccagccugguggcuuuaaaugucaacgucuaguucaugauucucaaguuuauaucuguggcccagaucucugccugaacaccagagucaaggaucucacggcuacucaacaucacuacccugaaccaaaacacucccugaaccgaauuccugaccccccucacuuauucccccuacaguucucagaaaacggcaacucuauccuuccuggaguuugggccccaaaccuggcaguccccgcugacuuccuuucccaugcugauccaguucauccgcauauccuaugggucuaccuuaaaaaugcauccagaauccgaaccacucucauucucuccugcagcccgcccaaguccgaucaccucucaccuggauuccugcuguggccuccucacugugggugcuccaugcaucugccccuugcccugcuucccaggguauuuuuaacacagcugccagagugacccugcuaaaccuaagucauaucaugucguuccucugcccaaaacccuccacuggcuucacaucacagaauaagagccaaaguuuggugacaacaaggcccugcacgcucuguccuccuguccccugauccccuccuccuucaaguucugguucuaaggcuccaacuaggcuggccccugaugguucacaccaaucugccugcuccccuuccuccccgcuuuuuuuuuugagacagggucuugcucuguugcccaggcuggaaugcaguggugugaucucggcucacugcagucucugcuucccaggcucaaguggcccucccaccucagccuccuaaauagcugagacuacaagugcaccaccacacccagcuaaauuuugcaauuuuuguagagaugggguuuugcuauguugcccaggcuggucucaaauuccuggccucaagugauccacccgccuuggccuuccaaagugcugagauuuacaggugugagccacaggcccggccuguuuauauugcuuaucccuguuuccucauaggcuguaaauuccuugagggcagguauuguuugguauuuucagcgccuaggaaaacaaagccuagcacauaguaagcacccaaugaauauuuguuaacugagucaaugacugaggccauaugcugaauugacuaagagcauggguucuggaauucagauucuggguuucagcccacuggcugugugaucuuaggagaaucauucaagcucugucucucucaaugcccuugucuauaaaaugaggauaauacagugguaccacuuuccagggauuuaaugauaggcuuguaaagcauuuagcacugggccugguccaucauuaagugcucagaauuaauaucuacuaucaccauucuguuacaggaaucccagaccccacuucucuagagcuucagacucauaucccacugaccuucugacaucucuggaugugcaaaaggcaucucaaacucaaaauagcccgucugccucccacaagccugcucuuuccuaacaucuucaacucugaaaauggcacccaguuguucacaucagagcuccagguggucugugguguccgcccacaugucccccaucagcagggcuuggagauggcacaugaggaauccaccuaccucucgccccuccacuguggccacccuacucccgucccucaucaccucucaccuggaccccggcacugccuuauucaccaagucugcuaccccuuaaaauucccggccauccccucccuacccaccccaaagccagagagaucuuugaagaacguaaaucagaccgugugcucucuacguggcuuccugugacuccaaacaaaaugcagaauccugggcacagcugaugugagccacggaacguggccugcaccuccuugggacgucucuccccuaccccagcuccagcuaaaaugagcucagucaccucccggccuucccacgagccacucccucugccuaggccaggccucuccuauccuucucccuggucucagcauaaaugucccuuccucagaguagcuuucccacccacucccuacucuaaacugggacccccguuauccucucuuuucccuauaacacugggcagcuugucagaauauacucauuuguugucuucccaugcccuucaccuuacacuagaaaugggacaaggacugugucuguugcauucccgcuccaucuccugagcucagcauagugccugucacgcaguaggucuuuaauaauaggugccgacugaagggcugcauucuaugaauucuauaaugcuuuuacaagcucauaacucuguuauuacaagaugcugaacugccuccuugcaagcuguccaaggcucccaccuccaauguugccuuuuaaggagccucaaggggagccaagacccaguauggcugggcuuuccagccccaggagaggcgggggcacugcuggggagggccagaggagucugcagggccgggaaggcuuuccucauccuuccuuucccucucugcacaccaggcuguucccccucugcacaccuaggcagcagcacccgacuagacucuggaagcauccuuugagggcucugacacccuggacacucccccacccucgcccccagagccuucaugaggagagggcaguagacuguucuguccuuuccugccaucuccuccuuugcccccagggcugcccacacagguccaggcagggccggugguagcaggucccagcauuccagagggggccuaaggggccagggacagcagugagagagagagagacagagagagagagacagagagagacagagagagagagacagagagagagagagagagagagagagagagagagagagagagagagagagcgcauuaaccccucaacguccagagccauccuaucagaaccugcagacgcgggccaggcauguuuuauccuuuugaacacacacacacacacacacacagugcacacacagucacgcugaacacccagacacaugcugaaacguucccucccucacugugacccgggcaccccucacccuagugaggcaauggaaauaucuuaugcgcaaugcauuccaaaaaguuuccuucucucuggggccucuuagucccaggcaaagagggaguggggguggagugggugcagggccgccuccuccaagucgcaggcuccccauuauuucuauuaaggcuuucaggguuuccuaccuggcccuucuccacuucccaucucagacugaauagggggguacccaugaccccuuccuccuccuacugggaaugguggggagggguggggaaggaaaaaggggccacauuucagggaaggcccugcuagaggcuggcuggccgcccgcucagccaucccugacccucauccgcucagggcagcggaugcugcagucagagcuuuccuuccuggcgcccccuucucccucugacucugcagugacagcaggaauagcugggaggaauagcccagcccaagccaggagggguggggaaggaucucaguucaagggugaccccugggccaggcacccauggcuggccaugcuugaggaauguuguuggaaugauguuagauaaguugacuuggucaguguuaaaauuccucuauugcagaugaggaaacugagguucaaagaagggaaaagacuucucccuugcaaaaggggucagggauaagauuugaaccaagucugucagccacaggcucacaaagcaagaccccucuaagcuccaaacacucaccaacgguuacaguugucccaguacguucccaagacuggauagauacgaccuccaugcauacauccuguuggaagggaagagaagagaaguggaaccagaaccagagaggaugggcuaauuggccagguccuuggaggucagguaccuugaaccuuuccaagauucucucucuuucucucucucugucucacacacacacacacauaccagcucucacugaaauuaaacuauaacugaagacaucacacacacacacacacacacacaccagcugucacuaaaauuaaacuauaacugaaggcaucacacacacacacacacacauaccagcucucacugaaauugaagccaaacuauaacugaagauaucacacacacacacacacacaccagcucucacugagauuaagcuauaacugaagacaucacacacacacacaccagcucucacugaaauuaaacuauaacugaagacaucacacacacacacaccagcucucacugaaauuaaacuauaacugaagacaucacacacacacacacacaccagcucucacugagauuaagcuauaacugaagacaucacacacacacacacacacacacacaccagcucucacugaaauuaaacuauaacugaagacaucacacacacacacaccagcucucacugaaauuaagcuauacugaagacaacacacacacacacacacaccagcucucacugaaauuaagcuauaacugaagacaucacacacacacacacacauaccagcucucacugaaauuaaacuauaacugaagacaucacacacacacacacacacacacaccagcugucacuaaaauuaaacuauaacugaaggcaucacacacacacacacacacauaccagcucucacugaaauugaagccaaacuauaacugaagauaucacacacacacacacacacaccagcucucacugaaauuaagcuauaacugaagacaucacacacacacacacacacacacacacacacaccagcucucacugaaauuaaacuauaacugaagacaaauccugcagggucacacaccaacugcuguuugggaaguucuucaaugauuccaaccuggauuccucuuacuuuacuuggaugccagccacaacauuccugggauccuuuuccauuuaaauaaguuagggcuuggagauggggagugggaggagcauggggaagccaaggcccagagaagguaagcaaccguccuaagauaacacagcacucuugagaugacagcucagguaugcagucugccggcccaagccccauggaacugugggaaggaacgcaagugauucuccuauuggacaggggcaagugcauggaaaaggaugauggugaggcugaaagcaggaaaagauuugacccaucucccagguaugagcagccaucucggggcacaggauccuagaauccucagcaaaggcagaaaaauggcuaagaugacccucaccaacccauaugugccuuaucagcccaagagugagucagcaggugcggccagcaccuuccgugucuggaaaagagacaggauugggagaaaaugugggagguugcccuuucccugggccaaauuagaauucuaaccaaggagcuucuucagucuugcuggagaguaaaguucccagaggggcagggaagagucccagauucuacagagcuuccccuggaaaugucagugcauccaucagcuuugcucuugagccuugcugagucugagguggacaaagugacccacccuccuggccaucuuagugcccaccuuggaucgggggaaaaggggguggcacgccgaggcagaagucccagaagucagggcagcagucggagaccgugcgguugcagaagaggucacaguaacagauggcgcccagguagggcagggcacagucgucggcacggccgcggcagcacagguccugcuccuggcaguaccggccucccgcgucccggaugccccgcaggugcagacccggugcuagcucccggcgcccacgacccugcugggcacccagagccaaguggccagccagcggcagcaacagcaguagccccaguggacaucgccacaugguggcuccugggcccuggggggcagagauggugggcagcagagacucccuggaacaccagggaugagucucccaguuuccuggagcugugaguucaagagggcccagcagggagggagaucccgauuccugaguccccaggcaggacacgggcagaggagccccagugugugggcccuggcuauagggggauggggacugggcagaaacggagccccucccugaccuaggcagggaccuucaaggacaaggaaaugagggugguggcauucuuggugcucccacccaacacucauccuguggacccaaggucuucucuccuguccuaggucucucugcccuccagcagccuccaucccugaccuggguccuugacuuugugcuuuccugucucccccggucuuuuggguacaccucucuucuguuccugugucccucugucccccuccacugucccucucucugccaucugucuugguuccucuaccugcccccucccccuguuucuucucugucuacaccuuccgcccucugagcaggggagcgucccuaccuggugaaggugugggcuggggcccaggcuggcccgcgcgccuccgccuccuggcucugcgaccgccggacgcucaaagucaagagaggagcgcggggcggggcgcuuuuuguaccgcccgcccucugcaccgccccagcaguggcggaagggaggggcgccuggcuuguaccuggaguaacuaccccacaacucaugggcuugcaggguggagaaacgacaagcacacgauuguccuggcugggucuccuguggcggaagccguucccuuaggggaaccccaagcaggaaggauugcgguuucacacugggaaggacuucacagugggcaucccuguggagcugaggggcucugguggagaaggggggauaugggcagccgagcucuggguuauggacacaaguuug

SEQ ID NO: 14141 - RNA, 11677 nt, Homo sapiens
caaacuuguguccauaacccagagcucggcugcccauauccccccuucuccaccagagccccucagcuccacagggaugcccacugugaaguccuucccagugugaaaccgcaauccuuccugcuugggguuccccuaagggaacggcuuccgccacaggagacccagccaggacaaucgugugcuugucguuucuccacccugcaagcccaugaguugugggguaguuacuccagguacaagccaggcgccccucccuuccgccacugcuggggcggugcagagggcgggcgguacaaaaagcgccccgccccgcgcuccucucuugacuuugagcguccggcggucgcagagccaggaggcggaggcgcgcgggccagccugggccccagcccacaccuucaccagguagggacgcuccccugcucagagggcggaagguguagacagagaagaaacagggggagggggcagguagaggaaccaagacagauggcagagagagggacaguggagggggacagagggacacaggaacagaagagagguguacccaaaagaccgggggagacaggaaagcacaaagucaaggacccaggucagggauggaggcugcuggagggcagagagaccuaggacaggagagaagaccuuggguccacaggaugaguguugggugggagcaccaagaaugccaccacccucauuuccuuguccuugaaggucccugccuaggucagggaggggcuccguuucugcccaguccccaucccccuauagccagggcccacacacuggggcuccucugcccguguccugccuggggacucaggaaucgggaucucccucccugcugggcccucuugaacucacagcuccaggaaacugggagacucaucccugguguuccagggagucucugcugcccaccaucucugccccccagggcccaggagccaccauguggcgauguccacuggggcuacugcuguugcugccgcuggcuggccacuuggcucugggugcccagcagggucgugggcgccgggagcuagcaccgggucugcaccugcggggcauccgggacgcgggaggccgguacugccaggagcaggaccugugcugccgcggccgugccgacgacugugcccugcccuaccugggcgccaucuguuacugugaccucuucugcaaccgcacggucuccgacugcugcccugacuucugggacuucugccucggcgugccacccccuuuucccccgauccaaggugggcacuaagauggccaggagggugggucacuuuguccaccucagacucagcaaggcucaagagcaaagcugauggaugcacugacauuuccaggggaagcucuguagaaucugggacucuucccugccccucugggaacuuuacucuccagcaagacugaagaagcuccuugguuagaauucuaauuuggcccagggaaagggcaaccucccacauuuucucccaauccugucucuuuuccagacacggaaggugcuggccgcaccugcugacucacucuugggcugauaaggcacauauggguuggugagggucaucuuagccauuuuucugccuuugcugaggauucuaggauccugugccccgagauggcugcucauaccugggagaugggucaaaucuuuuccugcuuucagccucaccaucauccuuuuccaugcacuugccccuguccaauaggagaaucacuugcguuccuucccacaguuccauggggcuugggccggcagacugcauaccugagcugucaucucaagagugcuguguuaucuuaggacgguugcuuaccuucucugggccuuggcuuccccaugcuccucccacuccccaucuccaagcccuaacuuauuuaaauggaaaaggaucccaggaauguuguggcuggcauccaaguaaaguaagaggaauccagguuggaaucauugaagaacuucccaaacagcaguuggugugugacccugcaggauuugucuucaguuauaguuuaauuucagugagagcuggugugugugugugugugugugugugugugugugaugucuucaguuauagcuuaauuucagugagagcuggugugugugugugugugugugauaucuucaguuauaguuuggcuucaauuucagugagagcugguaugugugugugugugugugugaugccuucaguuauaguuuaauuuuagugacagcuggugugugugugugugugugugugugaugucuucaguuauaguuuaauuucagugagagcugguaugugugugugugugugugaugucuucaguuauagcuuaauuucagugagagcugguguguguguguguguguguugucuucaguauagcuuaauuucagugagagcuggugugugugugugugaugucuucaguuauaguuuaauuucagugagagcuggugugugugugugugugugugugugugaugucuucaguuauagcuuaaucucagugagagcuggugugugugugugugugugaugucuucaguuauaguuuaauuucagugagagcuggugugugugugugugaugucuucaguuauaguuuaauuucagugagagcuggugugugugugugugaugucuucaguuauagcuuaaucucagugagagcuggugugugugugugugugugugauaucuucaguuauaguuuggcuucaauuucagugagagcugguaugugugugugugugugugugaugccuucaguuauaguuuaauuuuagugacagcuggugugugugugugugugugugugugaugucuucaguuauaguuuaauuucagugagagcugguaugugugugugugugugagacagagagagagaaagagagagaaucuuggaaagguucaagguaccugaccuccaaggaccuggccaauuagcccauccucucugguucugguuccacuucucuucucuucccuuccaacaggauguaugcauggaggucguaucuauccagucuugggaacguacugggacaacuguaaccguuggugaguguuuggagcuuagaggggucuugcuuugugagccuguggcugacagacuugguucaaaucuuaucccugaccccuuuugcaagggagaagucuuuucccuucuuugaaccucaguuuccucaucugcaauagaggaauuuuaacacugaccaagucaacuuaucuaacaucauuccaacaacauuccucaagcauggccagccaugggugccuggcccaggggucacccuugaacugagauccuuccccaccccuccuggcuugggcugggcuauuccucccagcuauuccugcugucacugcagagucagagggagaagggggcgccaggaaggaaagcucugacugcagcauccgcugcccugagcggaugagggucagggauggcugagcgggcggccagccagccucuagcagggccuucccugaaauguggccccuuuuuccuuccccaccccuccccaccauucccaguaggaggaggaaggggucauggguaccccccuauucagucugagaugggaaguggagaagggccagguaggaaacccugaaagccuuaauagaaauaauggggagccugcgacuuggaggaggcggcccugcacccacuccacccccacucccucuuugccugggacuaagaggccccagagagaaggaaacuuuuuggaaugcauugcgcauaagauauuuccauugccucacuagggugaggggugcccgggucacagugagggagggaacguuucagcaugugucuggguguucagcgugacugugugugcacuguguguguguguguguguguguucaaaaggauaaaacaugccuggcccgcgucugcagguucugauaggauggcucuggacguugagggguuaaugcgcucucucucucucucucucucucucucucucucucucucucucucucucugucucucucucucugucucucucugucucucucucucugucucucucucucucacugcugucccuggccccuuaggcccccucuggaaugcugggaccugcuaccaccggcccugccuggaccugugugggcagcccugggggcaaaggaggagauggcaggaaaggacagaacagucuacugcccucuccucaugaaggcucugggggcgagggugggggaguguccagggugucagagcccucaaaggaugcuuccagagucuagucgggugcugcugccuaggugugcagagggggaacagccuggugugcagagagggaaaggaaggaugaggaaagccuucccggcccugcagacuccucuggcccuccccagcagugcccccgccucuccuggggcuggaaagcccagccauacugggucuuggcuccccuugaggcuccuuaaaaggcaacauuggaggugggagccuuggacagcuugcaaggaggcaguucagcaucuuguaauaacagaguuaugagcuuguaaaagcauuauagaauucauagaaugcagcccuucagucggcaccuauuauuaaagaccuacugcgugacaggcacuaugcugagcucaggagauggagcgggaaugcaacagacacaguccuugucccauuucuaguguaaggugaagggcaugggaagacaacaaaugaguauauucugacaagcugcccaguguuauagggaaaagagaggauaacgggggucccaguuuagaguagggagugggugggaaagcuacucugaggaagggacauuuaugcugagaccagggagaaggauaggagaggccuggccuaggcagagggaguggcucgugggaaggccgggaggugacugagcucauuuuagcuggagcugggguaggggagagacgucccaaggaggugcaggccacguuccguggcucacaucagcugugcccaggauucugcauuuuguuuggagucacaggaagccacguagagagcacacggucugauuuacguucuucaaagaucucucuggcuuugggguggguagggaggggauggccgggaauuuuaagggguagcagacuuggugaauaaggcagugccgggguccaggugagaggugaugagggacgggaguaggguggccacaguggaggggcgagagguagguggauuccucaugugccaucuccaagcccugcugaugggggacaugugggcggacaccacagaccaccuggagcucugaugugaacaacugggugccauuuucagaguugaagauguuaggaaagagcaggcuugugggaggcagacgggcuauuuugaguuugagaugccuuuugcacauccagagaugucagaaggucagugggauaugagucugaagcucuagagaaguggggucugggauuccuguaacagaauggugauaguagauauuaauucugagcacuuaaugauggaccaggcccagugcuaaaugcuuuacaagccuaucauuaaaucccuggaaagugguaccacuguauuauccucauuuuauagacaagggcauugagagagacagagcuugaaugauucuccuaagaucacacagccagugggcugaaacccagaaucugaauuccagaacccaugcucuuagucaauucagcauauggccucagucauugacucaguuaacaaauauucauugggugcuuacuaugugcuaggcuuuguuuuccuaggcgcugaaaauaccaaacaauaccugcccucaaggaauuuacagccuaugaggaaacagggauaagcaauauaaacaggccgggccuguggcucacaccuguaaaucucagcacuuuggaaggccaaggcggguggaucacuugaggccaggaauuugagaccagccugggcaacauagcaaaaccccaucucuacaaaaauugcaaaauuuagcugggugugguggugcacuuguagucucagcuauuuaggaggcugaggugggagggccacuugagccugggaagcagagacugcagugagccgagaucacaccacugcauuccagccugggcaacagagcaagacccugucucaaaaaaaaaagcggggaggaaggggagcaggcagauuggugugaaccaucaggggccagccuaguuggagccuuagaaccagaacuugaaggaggaggggaucaggggacaggaggacagagcgugcagggccuuguugucaccaaacuuuggcucuuauucugugaugugaagccaguggaggguuuugggcagaggaacgacaugauaugacuuagguuuagcagggucacucuggcagcuguguuaaaaauacccugggaagcagggcaaggggcagaugcauggagcacccacagugaggaggccacagcaggaauccaggugagaggugaucggacuugggcgggcugcaggagagaaugagagugguucggauucuggaugcauuuuuaagguagacccauaggauaugcggaugaacuggaucagcaugggaaaggaagucagcggggacugccagguuuggggcccaaacuccaggaaggauagaguugccguuuucugagaacuguagggggaauaagugaggggggucaggaauucgguucagggaguguuuugguucaggguagugauguugaguagccgugagauccuugacucugguguucaggcagagaucugggccacagauauaaacuugagaaucaugaacuagacguugacauuuaaagccaccaggcuggaugggaucaccuagagauucucccacagucacuugcacagacucccuggcccauguuaaccuccgaggccacauuccuucaaaguauccccagucccccacuuacccuuuccuucucuccuuuucucaccagcaccugccaggagaacaggcaguggcagugugaccaagaaccaugccugguggauccagacaugaucaaagccaucaaccagggcaacuaugggugagaggcccuagaggcacccucagugggcacacaugcauacucaugcauguauacacgcaugcugugcuguggggcacguccagcaggccacuccuacacccagauuugacugugugugcgcucagccacugugcgucucucccacccacaugcacccacgccaaggacccugagccucggcagaucugugacuuccuuccguccccucuccuucagcuggcaggcugggaaccacagcgccuucuggggcaugacccuggaugagggcauucgcuaccgccugggcaccauccgcccaucuuccucggucaugaacaugcaugaaauuuauguaaguccauccuuccccacaaugcugccaucuccccauggcucagaaccucagggaugcuggcccugugcccugcuccuccaagggccuggaccauccccuacuacaaggcugugugucccuggacaaguuacuccccuucucugggccucuguucccugcuuccacaggaugugcugugcuggaagaacugaugcucagauugaauuucguggucuuggcaucagcuccccccugaucucuccagccugggaaaaaugcuguuggucucaguacagcuggguuagggcccaaggggacagggggucaccuugguauuuugggaagggaaggacacacacuccuccaguucuggccagagggcagcaguucucggaaauaaaugccgguucagcggaaccccaagggaggagagggcuucucccuucccaccagugggacccucugggagaggaaugaaaaccaggcccaaagugaaagggugaggaaggggagcuucagcaggccuggaccgggacaugugccggagcauuuguccaucaguggcaggcagcggggaggcaggggcuggcaggaguggcccucccugcggagacuucggccuugggugaccagacccuggcccugcccuuauuccccugggccucuggcuauuuucugccucuugcuguuuguguuggcagacugccuggucacgggacccuacugccucuucccuccccugagggaaagcuaaggccugaagaaagcuaaggccgaucagaaggugcagaggaaagaggcagggguugagaauggaaagcugagggaccuggccuggccacuucucugugccuggccucagcugccucaucugggaagcaggacuagucaccaccgccaccccgccccgccccaccaccugauaccugggaggcacuaaauggugcuugguucuucaacacaagucaaaauuggaggcagcuggaauccugcagcagcaggagggcucaagauuaaacugcagaaggcccuggacuugguggcccuccagugccaaugggcaccugaggggcaggccagggcagagcaggaggcagacagggcaaccuuuaucuugcagacagugcugaacccaggggaggugcuucccacagccuucgaggccucugagaaguggcccaaccugauucaugagccucuugaccaaggcaacugugcaggcuccugggccuucuccacagcagguaagccaagggcaagggcuggcgccugggagaggagggccaaguccugagccucccgacagccccucuaucucaccccaccagcuguggcauccgaucgugucucaauccauucucugggacacaugacgccuguccugucgccccagaaccugcugucuugugacacccaccagcagcagggcugccgcggugggcgucucgauggugccuggugguuccugcgucgccgaggguaugcagcaacaggggaugugggcagagaagagggcaaggagcuccgugggcauggccugggccaugaugcacugagucuuucugccuuugcucccucuugcugccuuugcaggguggugucugaccacugcuaccccuucucgggccgugaacgagacgaggcuggcccugcgccccccuguaugaugcacagccgagccaugggucggggcaagcgccaggccacugcccacugccccaacagcuauguuaauaacaaugacaucuaccaggucacuccugucuaccgccucggcuccaacguaagucagcacuugggugagggcgccgaggcaggaggguugugaaagccuggagucucaccccugacguaugcucucuguccauccccugcccuccaggacaaggagaucaugaaggagcugauggagaauggcccuguccaagguaaacccccuuauccagcacccugguuccagaagcuugugccugcuugagagugggcacaguagcacaaguggccugcacagcauucagcagcauguccaguagggccaggaguaggggucccccccucccacaggcagcaccuggagggagcacuuagagcuuugguauggagggacccuggugccugggcacaucucaauagacucaggcuccagugccugugccaacgggcugaguggacccuaccuugacaucugcccacagcccucauggaggugcaugaggacuucuuccuauacaagggaggcaucuacagccacacgccagugagccuugggaggccagagagauaccgccggcaugggacccacucagucaagaucacagggugaggggcgugugggcagaggggguuugggacagcaggguuugugcuaggggcucuggagccugccuuggguucuuacaaccucucuaaaaagccaggacugcucucaucauuucaauagggagaaaacugagacucagaaagagaaaggacuugcccugggucgaauugaagguugggagccucugaaggcuuuuuuaggaacuguuccuuccuuacauugggauaaaauaacuccaauaugaagagagccucaagaguuucucaaccucuccccaccucagcaccugucccagcucugccugacccaccgagugaccugggaggucgcuccccuggccucaguuucccuauccgauuuagggaauauagauguuaggaucacugacuucaaugaacucggugaaaugugcuuuacggugggaauuggcggucucuaagauacccauauucucagagugucuuccuucuggcccuuggcaccuaccccucccuggauccccaagugagggagggcagguggauguguggucccauagaacuggccccuaggaggugggucucuggaggacccagguucccuccucuucugcucaccuugccuccacuuguccccuuggugccccacccccucccaugcugggccugggugcaccgacuuacagaugugagagugagggagaugcagagagguacagagaccugccugagcccuaaggguguacccaacccuccaaaggcaacugggggcuggauggggcagguuuccgggauuggagcuccugagagcagguagacccagcucccuucccccuccucugcucugcccacagauggggagaggagacgcugccagauggaaggacgcucaaauacugggugaggccgcugacccuuuccccgcccccucuuccccucgccccacucccauuccccuucucaccaccccuccuuauucccagacugcggccaacuccuggggcccagccuggggcgagaggggccacuuccgcaucgugcgcggcgucaaugagugcgacaucgagagcuucgugcugggcgucuggggccgcgugggcauggaggacaugggucaucacugaggcugcgggcaccacgcgggguccggccugggauccaggcuaagggccggcggaagaggccccaauggggcggugaccccagccucgcccgacagagcccggggcgcaggcgggcgccagggcgcuaaucccggcgcggguuccgcugacgcagcgccccgccugggagccgcgggcaggcgagacuggcggagcccccagaccucccaguggggacggggcagggccuggccugggaagagcacagcugcagaucccaggccucuggcgcccccacucaagacuaccaaagccaggacaccucaagucuccagccccacuaccccaccccacuccuguauucuuuuuuuuuuuuuuuuagacagggucuugcuccguugcccagguuggagugcaguggcccaucagggcucacuguaaccuccgacuccuggguucaagugacccucccaccucagccucucaaguagcugggacuacaggugcaccaccacaccuggcuaauuuuuguauuuuuuguaaagaggggggucucacuguguugcccaggcuggucucgaacuccugggcucaagcgguccaccugccuccgccucccaaagugcugggauugcaggcaugagccacugcacccagcccuguauucuuauucuucagauauuuauuuuucuuuucacuguuuuaaaauaaaaccaaaguauugauaacuacagugucuuggaaccucugggaguggaaagccaagccaaaguugggcuggcagugguuagacagcagaaaggacugccugagguguugcugguuggcagggguggggggacuggaaauccuaacuuccauucagcccuaauugucaaugcccugggcacugacccacuuggggga

SEQ ID NO: 14142 - RNA, 2437 nt, Homo sapiens
ucauuuuaaagaugaaacugaagcuggcgugguggcucaugccuguaaucccagaacuuuaggagguccaggugggcagaucaccugaggucaggaguuuaagaccagccuggccaacauggcgaaaccccgucucuacuaaaaauacaaaaauuauccagaugugguggcaguugccuguaaucccagcuacuugggaggcugaggcaggagaauugcuugaacccaggagguggagguugcagugagccaagaucacaccacugcacuucagccugggcaacgagacuccuucucaaaaaaaaaaaaaaaaaaauggagacucagaauggcuuaagugaauugcccaaggccacacagcuaguacccaacaaaauucagaucagaacgcagaucugccagcagccauuagcccagccccagcucuccaucauugcauuacaagggccacauaaggagucaguucuaguuccuggccacacaguccuugagaggaggcccuaugugugagggcugcgaccuugagucagaaaucaucuuuucccccuccuccucuccuggcaccuguuccaacagugagaucaccaaggcuccaugcccagcccugaagccugucccuauagcuuuggcagaaaugagccucugagucuucuggcaacuggaccguccaaaggaaucaagaucuuaggguggggagagggcucuuccucccuggccuuguucucagaacaguccagggaagggaggcaggguuugcacauggagaaacagagucccaggaaggagggccugccauacucuacgcacguggcaggccucugggcuccuguguuggcuccugcaggcccacccuggacaggcugcugcuggcugaaauucaguucggcacuacuccuuggugugcagggccuccugccaucccucagaaauucauuuauaccucacuuccuuugagaagucuacauugggcccucaggucaggacaggacaggacucccuuuagaggcaccacgcuaguuuuaugucuggcugcccagaggugaaugugugucuuguucccuguugucucucuccaaagcagggccuggcacaaaguaggugcuuuauuaacugcugaauuaaugagugagcuccucagagcuucaacuuguucaccuuuuuaaaaagagaaaauaauacaguaacaccuacuucauggauuuugcuuuaaaaguccaaugaggccaggugugguggcgugugccuauagucccagcugcuggggaggcuaagguaggaggauccccugagccccggaguuugaggcugcagugagcuaugauggcgucacaguacuccagccugggagacacagcgagagacuuugucucuaaaaaauaauaauaaaauaaaaaguucaaugaaacaauacacccaaagcccucagcaugcaauaaauagcaagacaaggcaggucuuauuuuuacugaaagugcuuaguaaacuauacagugacaaaccaccgcacaacaggcucucgaaaggaggcagcaaauuacccaaaagugcaggcggcuugcuagugugcacaggccaaagaaagggcggcagguggggaaggcagccaugggccuugaagagcugaccgaauuggcagaauuucugcaggaggggagcugggaacgaccugagcuaaagcucggagcugugcgaagaaaccggaaaagcccagagcacuugcaggggcggguggggagcuagaugguggggugggguggggacggaggagggccagcaggagacauuccgcagggaggggcaagcacgugugaggcgggcggggcgcgaagggucaggcuuuugcucaaaacaggcagaggacaaggucagcucagccgcagaccgagccgcuggugacugucuccgccaccaggcagugagagugaagggagagcgcgagcucugaagcccgcuagacuaagcuugcaaucugagcuccauucacccccuccuauuucuugagaccuugucaguuccccugugagccucggacuccucacuuguaaaacgaggacagaugcccgugccagaagucaaccagagcuuuccccggcgugggcaccagcccaagggcguuuugcuuuucuagucucaucucugcucugacgcuaagcucaaagagggacugggggacgggaagauauccaccauggcaugcgcccuagcucucgggcugguguuggcugcuuccuucucagauuccagagugccuagaggccaggaaagggagaagguccuaccagccugggguagggacucgggggccaggcacuggcgcugacgcaggcuagcagggcgccacuggcugguccccacccaccucgguggguugggggaugggcgcaccagccccuccugggugagcccuagccuggggcuuccuauuucgggagccggg

SEQ ID NO: 14143 - RNA, 7609 nt, Homo sapiens
caggcuagcagggcgccacuggcugguccccacccaccucgguggguugggggaugggcgcaccagccccuccugggugagcccuagccuggggcuuccuauuucgggagccgggggcgugggccacgucuccucaugugaugcgagggcuauuuaaagcggcagcccgggcagggagccgccgucggagcccuugcacgccugcucucuuguagcuucucucagccuagcccagcaucacuaugguggacgcuuuccugggcaccuggaagcuaguggacagcaagaauuucgaugacuacaugaagucacucggugagcaagccgcggggcucaggauguuggcuuggggacuggcugguggcgugccuagccccacgcagcacuccugccgcaucccuccugguuaagacuggggaauaggggagcgcggagauggcagccuggccuagagcagguggggccuguucagagggggcuuuggugguccaaaucugguuagagaccacgguagggaggugguggaaggaggcagcugugugggaggcucuuuccaggaagagggauaugugauuuggagguaggaggaggguuuggauaaagaacacugaucacaggaaagggaguguagccaggggagaaaaagaacaggggcauggguaguuuagaaauuggaggagacugaacccagaaagggaauggggcagccagggaguguacaaugauguaaacaaguaggaaauaccuaggaggaaaaagauuaguggggaaaaaacuguggaucagugaaucagauaugagaaggacguaagacaggaaccugcaguaagcagcaauccccaucucugcuugguuagggaagagaauucuugcuggagaaugcccuuucucaccagccagucugaccuuguccugcagucuauguauccaggccuucaucacugucugugagccucgugguaggguggggcaagaggcccaugaucagcugggccuuuccugcaacccaaggcucaccuaucugugcgagggguaggcagagaaagccauuggacuucugaugugcaguagagggucccaaggcaaggucaagaccugggagggaggaucacugguuuaggaggauguggagaacugcugugguguugggauggagaagaaucaggauucaaagaaucucacaggugaggaacuuggagauucccauaccaucuaguucaacagggaaacugaaaccaggagaguagaaauguauuauaacaauuccacagcagagccaauaugaaaaucuaagguuucuagaucuguaacccagagcucuucccacuacccuacaggcccugcgagugggaagaaaaguagaaacugcuuagcuaaugauugaccucagcccuucuucuacugcuuugggcuuagauggagaggucaaagcucucaacggccucuacccuaucuugggcgcuaugcccaguaauucuaggcaggcagucauucuuagaggagcagcccccagcccccacgaacacagcccagcagcuauugggaaguuggaaugcccagauuuaguuccuccuuccaaagcugggccagagcugagucuugaauugagcugcaacaacuuuaccauucuuguucccuuauucugccccgaguugggucagcgggcuggucucccugaaguccuguuaucuuucagcagcuuauguuaaggcagccagcauucucaucguaggaauggaaagccugggaaaauacccuccucagcucucaguaaguagugcuggcuucauuucuaaguagaacccagaucucccugagucuccuaaauucugucagcucaauauucuuaguuucucuugguucagacccucacucaucccgcagugguuuccuuuucaaacacuccauaccucuggguagauccuaagugaacagagcucccagugccgugacaagguccugcucugugcaagggagugugauuggccugacucauccugauaccaaggggcaaugccaaguuccucacuggccaagcaagggugggcugacagcauaacagcagaggcagccccugccccuccugcuguagaccuagggcucucaaggggcaaagaggucccgucuaguaccagugaccacaggcacaacugcuggccuggauugaguaugugcuggacagaaucgcccagugaaaauagucaacaguuuuggagccgagguucaaaucuaugucaguaguuuauucucuuugaauuucgacaagacacuucgcacucuucauuguaaacuggggauaaucuacgcuucgaggcuguuacaagcauuaaguaaaacaacccauguagggcaugugcagaguaccuagcuuccagcaagcacuauguagccagguacauuuggagacuuuacacacaccaccucacuacacugggcugccuccugccucaccuuugccuuggaagacaguucaauguuaagcugcuggggggagagggggcagucaugauuaguucuuuguucuuuacuugguugcaggacacuuaggacuuugcccaguacccaaggaagccaugcuugggucaggaagagagucucuguaaagccuuagacugggagucaggagacggguuugagucuaacucauuguugcuaccgcuuuaggcuccuccugaaucugcacaauaggacaaauacuuccuuuguaccuaacuccuagaucauagauaacaggcuuugaaaaugauggguugccauguauaagggacaagagcacuaacacuucuuaguuucaggguaaaaacuuccaaaguuggaaaacuccuaugccuaaggcuuuggaagggaaagucuauguuucucuucuuuccucagccuuauuccuaaggcuuugagagcuuuucaggugcccuggaaggcagccuuaugcuccagccuugggagguaguauagcugagcacuuaagcaagcucuggacucagacaauucugggcuucaaucucagauuugugacccugggcuuuaccucuguuuuuguaucuguaacguggaaacagucuucagaagaacaggaagaacuaaaugagauaacauguacaguucuuacuacacaaaaagcucauaguacuuaauaguagcuuuuuuuuuuuuuuugagguggaaucucacucuguuggcuaggcuggagugcaguggcacaaucucgacucacugcaaccuccaccuccuagguucaagcaauucucagccucagccuccugaguagcugggauuacaggcacauaccaccacaucuggcuaauuuuuuguauuuuuaguagagacggguuucaccauauuggccaggcuggucuuaaacuccuggccucaugugauccgccugccuuggccucccaaagugugauuacaggcgugagccaccacacuuggcccaauaguagcuuauucuaaucccagcucugccacugacuugcuauggcacugcuguuccuuaaguaucucucaucuaaugggaucaguuaucuguguucaccaaacagaacuaagcgcaagacugaauuuuaaaauucccaugcaaaggcuuugaaagauacaguccuccacuuccccauacccaggccugagaguuauucauugaguuucuuguacacugcuucucuaccccagcucauauacucauaaccuucccccuacccucagguguggguuuugcuaccaggcagguggccagcaugaccaagccuaccacaaucaucgaaaagaauggggacauucucacccuaaaaacacacagcaccuucaagaacacagagaucagcuuuaaguuggggguggaguucgaugagacaacagcagaugacaggaaggucaagguaagucagggaaacagggguggggaauggagagugcugagacucuaaaagagaauaggcugguagucuuggcucccugguauugcacccugaggggcagacuaucauggggaauuuaaaugaaacaagauucauaaagccuguguagugcuggaaugccacugaugcuaaauacaugucaguucuguccucuuguuuucuucccucccuucuugggauucaucuauugucugccucggaaugggcagcacagagccaggauguucuucugaccucaguaucuacuccagcuccagcugggugacccugugcaagguaugcaguagcucuagguuucuuuccccuuccauagauggcagaguuauguggccauggcugugaccugaagugcuuuaggaaugaugcccagaagucagggcccuccacugagugaggucauugugaccuccagcagcaaaaaaggcagccaggaacuagaagcaccuacucagaugccgcuucaacuucuaacucccagacauggccaaugacccugacaaacuauuuccaguguugccagcugacaggcaggaagagcuauguuccgugauagggcauucaccuugucaugaauguguuugcagugucuucccaccaagccuuagccccuccucccaggguucuaucacccugcaguggcugucuuggcagcuugccucagccuuccaggccaggcaugggagcgagagaacuuaagggcuuugaccucuauagggugucccuauagcaguguucuaucaugacacuaucauucagccccaucagcuguuuccucuuccucauagcuguccccagaaagaacaggaucacacagguggcuggcagcagagcuggggauggugcccaaagauggcagucuaccuuggauaaagguggcugccccaccaccugcucauaccuccuuggacuugccuacuuucucaaggggcaagaaccccaauuaaacacaauagcccuguggaaugccuagggcaaaaauaucuacucugaguaggcaaaaaaaacuaggggaaugagaacaaggaguaagguaaggauaaaaaagagcacacuaagagacaggccucauaccccuuaucaccuaaacaauacacagaaccuucucagauucuccuacugaaccaccuugcucaucaggaucccuuagccuggccuuguggcccccaaacuccuaggaaagagagcuggaagagcugccaaaugagaaccagcugauguauguaugcuggcagcacccagagcugaggaaccacuucaagggcauccagucacaggacuuugugguugcugcccucuuguuggcuaaagaggucacaugauguggaccaagaaaagguguaggaauacagggcaggaagucuaauuauccaauacuuccuaucacuaagggucuuuuagacauuauguggacuaaccacaaggcuggauaaagauucucaggacuacuccuccuccucagucagucuuucccagggauagacuaguaaaucccaccuguaucugaggggaccaggcuacgggaaucaccuagaguacagauaagugucugucuugaaggcuugugguacuucucagagccaggcucucuggcuccaccauacugccugccucucccuccuugccuaauaucugaaggccucuuccccagaaaggcaguaguggagcagaggcuggaggugaacuagaugucuugcagggauagcugggaggcggauugccugagcucuuguccucacaccaucacuaguuugggucaaaggcugugugcucuguggcccaguguccagaccccacccugccccucaauuccugacuaagaucacagcucaggccucuacccucuuuccacaguccauugugacacuggauggagggaaacuuguucaccugcagaaaugggacgggcaagagaccacacuugugcgggagcuaauugauggaaaacucauccugguaagaugggcaacuuuggagcuauaucugauugguuauuacuacugcucuuucagccaagccuguucuaaaaagccaaguccuccccugagagcuguagaagcugggacaagagagugguugugggucagggugguaucaggugggaauuuucuguguaguggcuuuggacucacacaggccggaacucaaaucuuaccuuauaggcuacaugacugugggcaaaucaccuuuuccaagugcaacuguaaaacggguauuaauaauaccaaccuuguagggcugcugggaagccuguaagagacaguguaugcacagcacaaagcaucacugauugaggaacacagcaggugcuccauguccuuuguuugcucuuccuguguuucuaccuugccucaccucaggaagaaguagaaaacagggccaaaucugaucccaggcccucuaggaggggcucccauugccuaucucagcauucccuuuccucuccucccuaggacugcauugucacuugcagggacaggcucgugacugguggggacacugaaugacaguacaguccuuucuuccccauucuaguccuaccccauuuucaugcuuucuaugucuggccuacugaaacuacuugacuacugcuuggguaggaaguaccacagccaggcuggcagaucuguucaagcuuggggacuucacuuggagaaucuagccuugacugaauuccccccagacccagggagagcagccaacuguggauucugccuaaccacagggccucagguuuucaccuaggcaucuucacugcacaccuucuugggucagcauaaccuguuaacugcauucuuguacucaugugggacagggguccccuugaaguuuggaaugaggugccuagcuuugguggggaugugauaugcaggaccaaauucucaguggcagcugaacuauggugaggccaugggucuggcucuaugaugccagaccggauagugggagguacagggcucuggcccuggcacuacucuaaguuagggaaggauuggaguuaguagccaaacacaguccuuuccugagucucuggauauuuuuccuauuugucaacuauaugccaggcaccaucuuagacacuaaggaugaaggaagccaaaugguauaagggaaggaaaaacacucaggaucuugaccaaauuacuuccucucuaaaggcucguuuuuuccaaaucucuaaaauaagaauuacaaugccuaucuuaaggauuugcugugcauaucagaaaaaaaaaauuauguauguauacacacacacacacacacacacacacacacacacacauacauacauauagccggcacauaguagguacucaagugacaauuaucaggaggaagggaggguagaaugcucgcaaugguguuccuggcuccaccccccaucucacucugucuuuccuuccagacacucacccacggcacugcaguuugcacucgcacuuaugagaaagaggcaugaccugacugcacuguugcugacuacuacucugccaaucggcuaccccucgacucagcaccacauugccucauuucuuccucugcauuuuguacaaauccacgaauucuucuggggucaggugccacugaccgggauccaguuccaguucccaugguguaugugguuuuuuuuuuuuuuuuuuaacugcacucauagggugcucugaggucaauaaagcagagccaaggccacccaguug

SEQ ID NO: 14144 - RNA, 7609 nt, Homo sapiens
caacuggguggccuuggcucugcuuuauugaccucagagcacccuaugagugcaguuaaaaaaaaaaaaaaaaaaccacauacaccaugggaacuggaacuggaucccggucaguggcaccugaccccagaagaauucguggauuuguacaaaaugcagaggaagaaaugaggcaauguggugcugagucgagggguagccgauuggcagaguaguagucagcaacagugcagucaggucaugccucuuucucauaagugcgagugcaaacugcagugccgugggugagugucuggaaggaaagacagagugagaugggggguggagccaggaacaccauugcgagcauucuacccucccuuccuccugauaauugucacuugaguaccuacuaugugccggcuauauguauguauguguguguguguguguguguguguguguguguguguauacauacauaauuuuuuuuuucugauaugcacagcaaauccuuaagauaggcauuguaauucuuauuuuagagauuuggaaaaaacgagccuuuagagaggaaguaauuuggucaagauccugaguguuuuuccuucccuuauaccauuuggcuuccuucauccuuagugucuaagauggugccuggcauauaguugacaaauaggaaaaauauccagagacucaggaaaggacuguguuuggcuacuaacuccaauccuucccuaacuuagaguagugccagggccagagcccuguaccucccacuauccggucuggcaucauagagccagacccauggccucaccauaguucagcugccacugagaauuugguccugcauaucacauccccaccaaagcuaggcaccucauuccaaacuucaaggggaccccugucccacaugaguacaagaaugcaguuaacagguuaugcugacccaagaaggugugcagugaagaugccuaggugaaaaccugaggcccugugguuaggcagaauccacaguuggcugcucucccugggucuggggggaauucagucaaggcuagauucuccaagugaaguccccaagcuugaacagaucugccagccuggcugugguacuuccuacccaagcaguagucaaguaguuucaguaggccagacauagaaagcaugaaaaugggguaggacuagaauggggaagaaaggacuguacugucauucaguguccccaccagucacgagccugucccugcaagugacaaugcaguccuagggaggagaggaaagggaaugcugagauaggcaaugggagccccuccuagagggccugggaucagauuuggcccuguuuucuacuucuuccugaggugaggcaagguagaaacacaggaagagcaaacaaaggacauggagcaccugcuguguuccucaaucagugaugcuuugugcugugcauacacugucucuuacaggcuucccagcagcccuacaagguugguauuauuaauacccguuuuacaguugcacuuggaaaaggugauuugcccacagucauguagccuauaagguaagauuugaguuccggccugugugaguccaaagccacuacacagaaaauucccaccugauaccacccugacccacaaccacucucuugucccagcuucuacagcucucaggggaggacuuggcuuuuuagaacaggcuuggcugaaagagcaguaguaauaaccaaucagauauagcuccaaaguugcccaucuuaccaggaugaguuuuccaucaauuagcucccgcacaaguguggucucuugcccgucccauuucugcaggugaacaaguuucccuccauccagugucacaauggacuguggaaagaggguagaggccugagcugugaucuuagucaggaauugaggggcaggguggggucuggacacugggccacagagcacacagccuuugacccaaacuagugauggugugaggacaagagcucaggcaauccgccucccagcuaucccugcaagacaucuaguucaccuccagccucugcuccacuacugccuuucuggggaagaggccuucagauauuaggcaaggagggagaggcaggcaguaugguggagccagagagccuggcucugagaaguaccacaagccuucaagacagacacuuaucuguacucuaggugauucccguagccugguccccucagauacaggugggauuuacuagucuaucccugggaaagacugacugaggaggaggaguaguccugagaaucuuuauccagccuugugguuaguccacauaaugucuaaaagacccuuagugauaggaaguauuggauaauuagacuuccugcccuguauuccuacaccuuuucuugguccacaucaugugaccucuuuagccaacaagagggcagcaaccacaaaguccugugacuggaugcccuugaagugguuccucagcucugggugcugccagcauacauacaucagcugguucucauuuggcagcucuuccagcucucuuuccuaggaguuugggggccacaaggccaggcuaagggauccugaugagcaaggugguucaguaggagaaucugagaagguucuguguauuguuuaggugauaagggguaugaggccugucucuuagugugcucuuuuuuauccuuaccuuacuccuuguucucauuccccuaguuuuuuuugccuacucagaguagauauuuuugcccuaggcauuccacagggcuauuguguuuaauugggguucuugccccuugagaaaguaggcaaguccaaggagguaugagcaggugguggggcagccaccuuuauccaagguagacugccaucuuugggcaccauccccagcucugcugccagccaccugugugauccuguucuuucuggggacagcuaugaggaagaggaaacagcugauggggcugaaugauagugucaugauagaacacugcuauagggacacccuauagaggucaaagcccuuaaguucucucgcucccaugccuggccuggaaggcugaggcaagcugccaagacagccacugcagggugauagaacccugggaggaggggcuaaggcuuggugggaagacacugcaaacacauucaugacaaggugaaugcccuaucacggaacauagcucuuccugccugucagcuggcaacacuggaaauaguuugucagggucauuggccaugucugggaguuagaaguugaagcggcaucugaguaggugcuucuaguuccuggcugccuuuuuugcugcuggaggucacaaugaccucacucaguggagggcccugacuucugggcaucauuccuaaagcacuucaggucacagccauggccacauaacucugccaucuauggaaggggaaagaaaccuagagcuacugcauaccuugcacagggucacccagcuggagcuggaguagauacugaggucagaagaacauccuggcucugugcugcccauuccgaggcagacaauagaugaaucccaagaagggagggaagaaaacaagaggacagaacugacauguauuuagcaucaguggcauuccagcacuacacaggcuuuaugaaucuuguuucauuuaaauuccccaugauagucugccccucagggugcaauaccagggagccaagacuaccagccuauucucuuuuagagucucagcacucuccauuccccaccccuguuucccugacuuaccuugaccuuccugucaucugcuguugucucaucgaacuccacccccaacuuaaagcugaucucuguguucuugaaggugcuguguguuuuuagggugagaauguccccauucuuuucgaugauugugguaggcuuggucaugcuggccaccugccugguagcaaaacccacaccugaggguagggggaagguuaugaguauaugagcugggguagagaagcaguguacaagaaacucaaugaauaacucucaggccuggguauggggaaguggaggacuguaucuuucaaagccuuugcaugggaauuuuaaaauucagucuugcgcuuaguucuguuuggugaacacagauaacugaucccauuagaugagagauacuuaaggaacagcagugccauagcaagucaguggcagagcugggauuagaauaagcuacuauugggccaagugugguggcucacgccuguaaucacacuuugggaggccaaggcaggcggaucacaugaggccaggaguuuaagaccagccuggccaauauggugaaacccgucucuacuaaaaauacaaaaaauuagccagauguggugguaugugccuguaaucccagcuacucaggaggcugaggcugagaauugcuugaaccuaggagguggagguugcagugagucgagauugugccacugcacuccagccuagccaacagagugagauuccaccucaaaaaaaaaaaaaaagcuacuauuaaguacuaugagcuuuuuguguaguaagaacuguacauguuaucucauuuaguucuuccuguucuucugaagacuguuuccacguuacagauacaaaaacagagguaaagcccagggucacaaaucugagauugaagcccagaauugucugaguccagagcuugcuuaagugcucagcuauacuaccucccaaggcuggagcauaaggcugccuuccagggcaccugaaaagcucucaaagccuuaggaauaaggcugaggaaagaagagaaacauagacuuucccuuccaaagccuuaggcauaggaguuuuccaacuuuggaaguuuuuacccugaaacuaagaaguguuagugcucuugucccuuauacauggcaacccaucauuuucaaagccuguuaucuaugaucuaggaguuagguacaaaggaaguauuuguccuauugugcagauucaggaggagccuaaagcgguagcaacaaugaguuagacucaaacccgucuccugacucccagucuaaggcuuuacagagacucucuuccugacccaagcauggcuuccuuggguacugggcaaaguccuaaguguccugcaaccaaguaaagaacaaagaacuaaucaugacugcccccucuccccccagcagcuuaacauugaacugucuuccaaggcaaaggugaggcaggaggcagcccaguguagugaggugguguguguaaagucuccaaauguaccuggcuacauagugcuugcuggaagcuagguacucugcacaugcccuacauggguuguuuuacuuaaugcuuguaacagccucgaagcguagauuauccccaguuuacaaugaagagugcgaagugucuugucgaaauucaaagagaauaaacuacugacauagauuugaaccucggcuccaaaacuguugacuauuuucacugggcgauucuguccagcacauacucaauccaggccagcaguugugccuguggucacugguacuagacgggaccucuuugccccuugagagcccuaggucuacagcaggaggggcaggggcugccucugcuguuaugcugucagcccacccuugcuuggccagugaggaacuuggcauugccccuugguaucaggaugagucaggccaaucacacucccuugcacagagcaggaccuugucacggcacugggagcucuguucacuuaggaucuacccagagguauggaguguuugaaaaggaaaccacugcgggaugagugagggucugaaccaagagaaacuaagaauauugagcugacagaauuuaggagacucagggagaucuggguucuacuuagaaaugaagccagcacuacuuacugagagcugaggaggguauuuucccaggcuuuccauuccuacgaugagaaugcuggcugccuuaacauaagcugcugaaagauaacaggacuucagggagaccagcccgcugacccaacucggggcagaauaagggaacaagaaugguaaaguuguugcagcucaauucaagacucagcucuggcccagcuuuggaaggaggaacuaaaucugggcauuccaacuucccaauagcugcugggcuguguucgugggggcugggggcugcuccucuaagaaugacugccugccuagaauuacugggcauagcgcccaagauaggguagaggccguugagagcuuugaccucuccaucuaagcccaaagcaguagaagaagggcugaggucaaucauuagcuaagcaguuucuacuuuucuucccacucgcagggccuguaggguagugggaagagcucuggguuacagaucuagaaaccuuagauuuucauauuggcucugcuguggaauuguuauaauacauuucuacucuccugguuucaguuucccuguugaacuagaugguaugggaaucuccaaguuccucaccugugagauucuuugaauccugauucuucuccaucccaacaccacagcaguucuccacauccuccuaaaccagugauccucccucccaggucuugaccuugccuugggacccucuacugcacaucagaaguccaauggcuuucucugccuaccccucgcacagauaggugagccuuggguugcaggaaaggcccagcugaucaugggccucuugccccacccuaccacgaggcucacagacagugaugaaggccuggauacauagacugcaggacaaggucagacuggcuggugagaaagggcauucuccagcaagaauucucuucccuaaccaagcagagauggggauugcugcuuacugcagguuccugucuuacguccuucucauaucugauucacugauccacaguuuuuuccccacuaaucuuuuuccuccuagguauuuccuacuuguuuacaucauuguacacucccuggcugccccauucccuuucuggguucagucuccuccaauuucuaaacuacccaugccccuguucuuuuucuccccuggcuacacucccuuuccugugaucaguguucuuuauccaaacccuccuccuaccuccaaaucacauaucccucuuccuggaaagagccucccacacagcugccuccuuccaccaccucccuaccguggucucuaaccagauuuggaccaccaaagcccccucugaacaggccccaccugcucuaggccaggcugccaucuccgcgcuccccuauuccccagucuuaaccaggagggaugcggcaggagugcugcguggggcuaggcacgccaccagccaguccccaagccaacauccugagccccgcggcuugcucaccgagugacuucauguagucaucgaaauucuugcuguccacuagcuuccaggugcccaggaaagcguccaccauagugaugcugggcuaggcugagagaagcuacaagagagcaggcgugcaagggcuccgacggcggcucccugcccgggcugccgcuuuaaauagcccucgcaucacaugaggagacguggcccacgcccccggcucccgaaauaggaagccccaggcuagggcucacccaggaggggcuggugcgcccaucccccaacccaccgagguggguggggaccagccaguggcgcccugcuagccug
